United States Patent 7,745,391 (HUMAN THROMBOSPONDIN POLYPEPTIDE) - sequence listing, part 168

SEQ ID NO: 426911 - DNA, 1298 bp, Homo sapiens
  misc_feature (1)..(4): n is a, c, g, or t
nnnngtttgctctgagataccagtctcgctcctgcccagcccgggcggctgcccttgggtgctcccttccctgcccgacacccagaccgaccttgaccgcccacctggcaggagcaggacaggacggccggacgcggccatggccgagctcccggggccctttctctgcggggccctgctaggcttcctgtgcctgagtgggctggccgtggaggtgaaggtacccacagagccgctgagcacgcccctggggaagacagccgagctgacctgcacctacagcacgtcggtgggagacagcttcgccctggagtggagctttgtgcagcctgggaaacccatctctgagtcccatccaatcctgtacttcaccaatggccatctgtatccaactggttctaagtcaaagcgggtcagcctgcttcagaacccccccacagtgggggtggccacactgaaactgactgacgtccacccctcagatactggaacctacctctgccaagtcaacaacccaccagatttctacaccaatgggttggggctaatcaaccttactgtgctggttccccccagtaatcccttatgcagtcagagtggacaaacctctgtgggaggctctactgcactgagatgcagctcttccgagggggctcctaagccagtgtacaactgggtgcgtcttggaacttttcctacaccttctcctggcagcatggttcaagatgaggtgtctggccagctcattctcaccaacctctccctgacctcctcgggcacctaccgctgtgtggccaccaaccagatgggcagtgcatcctgtgagctgaccctctctgtgaccgaaccctcccaaggccgagtggccggagctctgattggggtgctcctgggcgtgctgttgctgtcagttgctgcgttctgcctggtcaggttccagaaagagagggggaagaagcccaaggagacatatgggggtagtgaccttcgggaggatgccatcgctcctgggatctctgagcacacttgtatgagggctgattctagcaaggggttcctggaaagaccctcgtctgccagcaccgtgacgaccaccaagtccaagctccctatggtcgtgtgacttctcccgatccctgagggcggtgagggggaatatcaataattaaagtctgtgggtaccataaaaactccttcttctttctgctggtatggcgaattcctctaggcggctcagagtattaacagtaagagaaggaatgggcttgaagtccgagaaaaggtaggcaggaagtttg

SEQ ID NO: 426912 - DNA, 1027 bp, Homo sapiens
  misc_feature (1)..(4): n is a, c, g, or t
nnnngtttgctctgagataccagtctcgctcctgcccagcccgggcggctgcccttgggtgctcccttccctgcccgacacccagaccgaccttgaccgcccacctggcaggagcaggacaggacggccggacgcggccatggccgagctcccggggccctttctctgcggggccctgctaggcttcctgtgcctgagtgatcctgtacttcaccaatggccatctgtatccaactggttctaagtcaaagcgggtcagcctgcttcagaacccccccacagtgggggtggccacactgaaactgactgacgtccacccctcagatactggaacctacctctgccaagtcaacaacccaccagatttctacaccaatgggttggggctaatcaaccttactgtgctggttccccccagtaatcccttatgcagtcagagtggacaaacctctgtgggaggctctactgcactgagatgcagctcttccgagggggctcctaagccagtgtacaactgggtgcgtcttggaacttttcctacaccttctcctggcagcatggttcaagatgaggtgtctggccagctcattctcaccaacctctccctgacctcctcgggcacctaccgctgtgtggccaccaaccagatgggcagtgcatcctgtgagctgaccctctctgtgaccgaaccctcccaaggccgagtggccggagctctgattggggtgctcctgggcgtgctgttgctgtcagttgctgcgttctgcctggtcaggttccagaaagagagggggaagaagcccaaggagacatatgggggtagtgaccttcgggaggatgccatcgctcctgggatctctgagcacacttgtatgagggctgattctagcaaggggttcctggaaagaccctcgtctgccagcaccgtgacgaccaccaagtccaagctccctatggtcgtgtgacttctcccgatccctgagggcggtgagggggaatatcaataattaaagtctgtgggtaccat

SEQ ID NO: 426913 - DNA, 1488 bp, Homo sapiens
  misc_feature (1)..(4): n is a, c, g, or t
nnnngtttgctctgagataccagtctcgctcctgcccagcccgggcggctgcccttgggtgctcccttccctgcccgacacccagaccgaccttgaccgcccacctggcaggagcaggacaggacggccggacgcggccatggccgagctcccggggccctttctctgcggggccctgctaggcttcctgtgcctgagtggtgaggaggggccgggcgggaccacggcgagggctggggggcataggcctggcttccccggctcctcggacccactctgtccccgccaggccagatgaggctgccgtgggcgccagggccctaaggcgcctgaggtgaggccggagagggggtgtccaaggcccggagggcgtaggagagagacccccaagccggcgagcgagttgggcctctccgcggcacaggcctgaaccaccccaccgcagggctagtgttttcctttctctgctaaacacacacaccctcttacctggcccggttccggctcttttacccacaaagacccggcccctcccggaaacctcaggttttgggaagggaggggttggattgaggggagagggttgtgctctggggagggagcccccagcttccaatatagatgcccgggggtgggcccgaccctccagatcactggaatttgggttcccacctccctctggtccccggccccagggctggccgtggaggtgaaggtacccacagagccgctgagcacgcccctggggaagacagccgagctgacctgcacctacagcacgtcggtgggagacagcttcgccctggagtggagctttgtgcagcctgggaaacccatctctgagtcccatccaatcctgtacttcaccaatggccatctgtatccaactggttctaagtcaaagcgggtcagcctgcttcagaacccccccacagtgggggtggccacactgaaactgactgacgtccacccctcagatactggaacctacctctgccaagtcaacaacccaccagatttctacaccaatgggttggggctaatcaaccttactgtgctggttccccccagtaatcccttatgcagtcagagtggacaaacctctgtgggaggctctactgcactgagatgcagctcttccgagggggctcctaagccagtgtacaactgggtgcgtcttggaacttttcctacaccttctcctggcagcatggttcaaggtaagggcccagggcatcaggaagagggtactggagacctgggcaaatctggtctctaaatcccacacacccgtattatccgttccatgactaggggtatgacacaaaccactatacctttccctgtctcttccttggcttcctgtattgttccctcctgcctgtctttctgcagtctgtggctgcatgatcctggaggtatttctcaagctgaatatactgctgatatcctggaagagagtagagggcagggagcaatctgatgatg

SEQ ID NO: 426914 - DNA, 760 bp, Homo sapiens
cttagacgccgccactgtctccacttctctattaccctccagggagaagtagccagagagggtgtcttcaagatgaccagcttttccttctacttgcagggtcaccaaagtgaaaattgagtgttcatttttttcttatttgcgatacctgtagcctgagaatgttacttctagcagttgtcttcattttgtttatttttattaatgtagaaaattatcaaacccatagaaaaattgagagtagagtgaatacccatatgcccctgtccttggttctccagctattaacaccttgtcatatttcttatccctccttccctctcttactctttcctttctctctctctttcttcttctgtctcttctcttttgtcagaccatgtgacacttcaccaacatataacacttcactcctagaccctttggggcatactaatgctccttacaaggaaggtgttcttcccacagctagagtacccttaccctttcataaaatgatcagcattaattccatgacatcccatcctcccaaaaaagtctaggtaactctgttttcaacacatgatttaattgtttcatgcattattcttagtctagaacagtcttgcccttcctctcttctttaagacattcagtactttgcaatgtacagatcagttgtttcacagagtggttcacattgtggattcctccagtgagttctttctgatgagatgtagcttgcacgtttctaacacgaccactacagattcctgaagac

SEQ ID NO: 426915 - DNA, 706 bp, Homo sapiens
cttagacgccgccactgtctccacttctctattaccctccagggagaagtagccagagagggtgtcttcaagatgaccagcttttccttctacttgcagggtcaccaaagtgaaaattgagtgttcatttttttcttatttgcgatacctgtagcctgagaatgttacttctagcagttgtcttcattttgtttatttttattaatgtagaaaattatcaaacccatagaaaaattgagagtagagtgaatacccatatgcccctgtccttggttctccagctattaacaccttgtcatatttcttatccctccttccctctcttactctttcctttctctctctctttcttcttctgtctcttctcttttgtcagaccatgtgacacttcaccaacatataacacttcactcctagaccctttggggcatactaatgctccttacaaggaaggtgttcttcccacagctagagtacccttaccctttcataatctgttttcaacacatgatttaattgtttcatgcattattcttagtctagaacagtcttgcccttcctctcttctttaagacattcagtactttgcaatgtacagatcagttgtttcacagagtggttcacattgtggattcctccagtgagttctttctgatgagatgtagcttgcacgtttctaacacgaccactacagattcctgaagac

SEQ ID NO: 426916 - DNA, 463 bp, Homo sapiens
atgatcagcattaattccatgacatcccatcctcccaaaaaagtctaggtaactctgttttcaacacatgatttaattgtttcatgcattattcttagtctagaacagtcttgcccttcctctcttctttaagacattcagtactttgcaatgtacagatcagttgtttcacagagtggttcacattgtggattcctccagtgagttctttctgatgagatgtagcttgcacgtttctaacacgaccactacagattcctgaagacggtgcagaagtagctgggactacaggtgcccgccaccacgcccggctaatttttttgtatttttagtagagacagggttttaccatgttagccaggatggccatccttgtttcccagcagccttcccccagtggttcagcactcacttctgtcagttatcatactggaggttataaaatggtaattttctaaatttg

SEQ ID NO: 426917 - DNA, 794 bp, Homo sapiens
cttagacgccgccactgtctccacttctctattaccctccagggagaagtagccagagagggtgtcttcaagatgaccagcttttccttctacttgcagggtcaccaaagtgaaaattgagtgttcatttttttcttatttgcgatacctgtagcctgagaatgttacttctagcagttgtcttcattttgtttatttttattaatgtagaaaattatcaaacccatagaaaaattgagagtagagtgaatacccatatgcccctgtccttggttctccagctattaacaccttgtcatatttcttatccctccttccctctcttactctttcctttctctctctctttcttcttctgtctcttctcttttgtcagaccatgtgacacttcaccaacatataacacttcactcctagaccctttggggcatactaatgctccttacaaggaaggtgttcttcccacagctagagtacccttaccctttcataaaatgatcagcattaattccatgacatcccatcctcccaaaaaagtctaggtaactctgttttcaacacatgatttaattgtttcatgcattattcttagtctagaacagtcttgcccttcctctcttctttaagacattcagtactttgcaatgtacagatcagttgtttcacagagtggttcacattgtggattcctccagtgagttctttctgatgagatgcgccaggcttcgtcccagtcacgaccatttacagattctggcagaccctcggtatactctagcgtctacactctagag

SEQ ID NO: 426918 - DNA, 2819 bp, Homo sapiens
gcgcggcgctgctgggttctccgaggcgacctggccgccggccgctcctccgcgcgctgttccgcacttgctgccctcgcccggcccggagcgccgctgccatgcggctggcgctgctctgggccctggggctcctgggcgcgggcagccctctgccttcctggccgctcccaaatataggtggcactgaggagcagcaggcagagtcagagaaggccccgagggagcccttggagccccaggtccttcaggacgatctcccaattagcctcaaaaaggtgcttcagaccagtctgcctgagcccctgaggatcaagttggagctggacggtgacagtcatatcctggagctgctacagaatagggagttggtcccaggccgcccaaccctggtgtggtaccagcccgatggcactcgggtggtcagtgagggacacactttggagaactgctgctaccagggaagagtgcggggatatgcaggctcctgggtgtccatctgcacctgctctgggctcagaggcttggtggtcctgaccccagagagaagctataccctggagcaggggcctggggaccttcagggtcctcccattatttcgcgaatccaagatctccacctgccaggccacacctgtgccctgagctggcgggaatctgtacacactcagacgccaccagagcaccccctgggacagcgccacattcgccggaggcgggatgtggtaacagagaccaagactgtggagttggtgattgtggctgatcactcggaggcccagaaataccgggacttccagcacctgctaaaccgcacactggaagtggccctcttgctggacacattcttccggcccctgaatgtacgagtggcactagtgggcctggaggcctggacccagcgtgacctggtggagatcagcccaaacccagctgtcaccctcgaaaacttcctccactggcgcagggcacatttgctgcctcgattgccccatgacagtgcccagctggtgactggtacttcattctctgggcctacggtgggcatggccattcagaactccatctgttctcctgacttctcaggaggtgtgaacatggaccactccaccagcatcctgggagtcgcctcctccatagcccatgagttgggccacagcctgggcctggaccatgatttgcctgggaatagctgcccctgtccaggtccagccccagccaagacctgcatcatggaggcctccacagacttcctaccaggcctgaacttcagcaactgcagccgacgggccctggagaaagccctcctggatggaatgggcagctgcctcttcgaacggctgcctagcctaccccctatggctgctttctgcggaaatatgtttgtggagccgggcgagcagtgtgactgtggcttcctggatgactgcgtcgatccctgctgtgattctttgacctgccagctgaggccaggtgcacagtgtgcatctgacggaccctgttgtcaaaattgccagctgcgcccgtctggctggcagtgtcgtcctaccagaggggattgtgacttgcctgaattctgcccaggagacagctcccagtgtccccctgatgtcagcctaggggatggcgagccctgcgctggcgggcaagctgtgtgcatgcacgggcgttgtgcctcctatgcccagcagtgccagtcactttggggacctggagcccagcccgctgcgccactttgcctccagacagctaatactcggggaaatgcttttgggagctgtgggcgcaaccccagtggcagttatgtgtcctgcacccctagagatgccatttgtgggcagctccagtgccagacaggtaggacccagcctctgctgggctccatccgggatctactctgggagacaatagatgtgaatgggactgagctgaactgcagctgggtgcacctggacctgggcagtgatgtggcccagcccctcctgactctgcctggcacagcctgtggccctggcctggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacagggcagcccaatctggtccctctgaacggccaggacctccgcagagggccctgctggcacgaggcactaagtctcaggggccagccaagcccccacccccaaggaagccactgcctgccgacccccagggccggtgcccatcgggtgacctgcccggcccaggggctggaatcccgcccctagtggtaccctccagaccagcgccaccgcctccgacagtgtcctcgctctacctctgacctctccggaggttccgctgcctccaagccggacttagggcttcaagaggcgggcgtgccctctggagtcccctaccatgactgaaggcgccagagactggcggtgtcttaagactccgggcaccgccacgcgctgtcaagcaacactctgcggacctgccggcgtagttgcagcgggggcttggggaggggctgggggttggacgggattgaggaaggtccgcacagcctgtctctgctcagttgcaataaacgtgacatcttgggagcgtt

SEQ ID NO: 426919 - DNA, 1528 bp, Homo sapiens
gcgcggcgctgctgggttctccgaggcgacctggccgccggccgctcctccgcgcgctgttccgcacttgctgccctcgcccggcccggagcgccgctgccatgcggctggcgctgctctgggccctggggctcctgggcgcgggcagccctctgccttcctggccgctcccaaatataggtggcactgaggagcagcaggcagagtcagagaaggccccgagggagcccttggagccccaggtccttcaggacgatctcccaattagcctcaaaaaggtgcttcagaccagtctgcctgagcccctgaggatcaagttggagctggacggtgacagtcatatcctggagctgctacagaatagggagttggtcccaggccgcccaaccctggtgtggtaccagcccgatggcactcgggtggtcagtgagggacacactttggagaactgctgctaccagggaagagtgcggggatatgcaggctcctgggtgtccatctgcacctgctctgggctcagaggcttggtggtcctgaccccagagagaagctataccctggagcaggggcctggggaccttcagggtcctcccattatttcgcgaatccaagatctccacctgccaggccacacctgtgccctgagctggcgggaatctgtacacactcagacgccaccagagcaccccctgggacagcgccacattcgccggaggcgggatgtggtaacagagaccaagactgtggagttggtgattgtggctgatcactcggaggcccagaaataccgggacttccagcacctgctaaaccgcacactggaagtggccctcttgctggacacattcttccggcccctgaatgtacgagtggcactagtgggcctggaggcctggacccagcgtgacctggtggagatcagcccaaacccagctgtcaccctcgaaaacttcctccactggcgcagggcacatttgctgcctcgattgccccatgacagtgcccagctggtgactggtacttcattctctgggcctacggtgggcatggccattcagaactccatctgttctcctgacttctcaggaggtgtgaacatggaccactccaccagcatcctgggagtcgcctcctccatagcccatgagttgggccacagcctgggcctggaccatgatttgctggaatcccgcccctagtggtaccctccagaccagcgccaccgcctccgacagtgtcctcgctctacctctgacctctccggaggttccgctgcctccaagccggacttagggcttcaagaggcgggcgtgccctctggagtcccctaccatgactgaaggcgccagagactggcggtgtcttaagactccgggcaccgccacgcgctgtcaagcaacactctgcggacctgccggcgtagttgcagcgggggcttggggaggggctgggggttggacgggattgaggaaggtccgcacagcctgtctctgctcagttgcaataaacgtgacatcttgggagcgtt

SEQ ID NO: 426920 - DNA, 510 bp, Homo sapiens
cgccacccgctggcggatatcctgcaccgcggctgcccgctcctgcgccgctggctgtgccggcgctgcgtggtgtgccaggcacccgagacgcccgagtcctacgtgtgccggacgctggactgcgaggccgtgtactgctggtcgtgctgggacgacatgcggcagcggtgcccggtctgcacgccccgcgaagagctctcttcctccgcctttagtgacagcaacgacgacactgcctacgcggggtgaagaggcgtcctgctcgctcttccgcaccgtccttcccggttaataaaatgccctgtacgcttcacgtgggtcggggactggggtgagccgcgcactgcctcgcctgcagtcgggaaagcctgcccgcccgacctctccgagccaggccgcgcacaggaggcagggaggccgcgaagctactagggaggggtccggacctggcgccgggtgaaggcgcgccgcccaagccggtcggaccgggcaccggctcccactccg

SEQ ID NO: 426921 - DNA, 2749 bp, Homo sapiens
gcgcggcgctgctgggttctccgaggcgacctggccgccggccgctcctccgcgcgctgttccgcacttgctgccctcgcccggcccggagcgccgctgccatgcggctggcgctgctctgggccctggggctcctgggcgcgggcagccctctgccttcctggccgctcccaaatataggtggcactgaggagcagcaggcagagtcagagaaggccccgagggagcccttggagccccaggtccttcaggacgatctcccaattagcctcaaaaaggtgcttcagaccagtctgcctgagcccctgaggatcaagttggagctggacggtgacagtcatatcctggagctgctacagaatagggagttggtcccaggccgcccaaccctggtgtggtaccagcccgatggcactcgggtggtcagtgagggacacactttggagaactgctgctaccagggaagagtgcggggatatgcaggctcctgggtgtccatctgcacctgctctgggctcagaggcttggtggtcctgaccccagagagaagctataccctggagcaggggcctggggaccttcagggtcctcccattatttcgcgaatccaagatctccacctgccaggccacacctgtgccctgagctggcgggaatctgtacacactcagacgccaccagagcaccccctgggacagcgccacattcgccggaggcgggatgtggtaacagagaccaagactgtggagttggtgattgtggctgatcactcggaggcccagaaataccgggacttccagcacctgctaaaccgcacactggaagtggccctcttgctggacacattcttccggcccctgaatgtacgagtggcactagtgggcctggaggcctggacccagcgtgacctggtggagatcagcccaaacccagctgtcaccctcgaaaacttcctccactggcgcagggcacatttgctgcctcgattgccccatgacagtgcccagctggtgactggtacttcattctctgggcctacggtgggcatggccattcagaactccatctgttctcctgacttctcaggaggtgtgaacatggaccactccaccagcatcctgggagtcgcctcctccatagcccatgagttgggccacagcctgggcctggaccatgatttgcctgggaatagctgcccctgtccaggtccagccccagccaagacctgcatcatggaggcctccacagacttcctaccaggcctgaacttcagcaactgcagccgacgggccctggagaaagccctcctggatggaatgggcagctgcctcttcgaacggctgcctagcctaccccctatggctgctttctgcggaaatatgtttgtggagccgggcgagcagtgtgactgtggcttcctggatgactgcgtcgatccctgctgtgattctttgacctgccagctgaggccaggtgcacagtgtgcatctgacggaccctgttgtcaaaattgccagctgcgcccgtctggctggcagtgtcgtcctaccagaggggattgtgacttgcctgaattctgcccaggagacagctcccagtgtccccctgatgtcagcctaggggatggcgagccctgcgctggcgggcaagctgtgtgcatgcacgggcgttgtgcctcctatgcccagcagtgccagtcactttggggacctggagcccagcccgctgcgccactttgcctccagacagctaatactcggggaaatgcttttgggagctgtgggcgcaaccccagtggcagttatgtgtcctgcacccctagagatgccatttgtgggcagctccagtgccagacaggtaggacccagcctctgctgggctccatccgggatctactctgggagacaatagatgtgaatgggactgagctgaactgcagctgggtgcacctggacctgggcagtgatgtggcccagcccctcctgactctgcctggcacagcctgtggccctggcctggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacagtctcaggggccagccaagcccccacccccaaggaagccactgcctgccgacccccagggccggtgcccatcgggtgacctgcccggcccaggggctggaatcccgcccctagtggtaccctccagaccagcgccaccgcctccgacagtgtcctcgctctacctctgacctctccggaggttccgctgcctccaagccggacttagggcttcaagaggcgggcgtgccctctggagtcccctaccatgactgaaggcgccagagactggcggtgtcttaagactccgggcaccgccacgcgctgtcaagcaacactctgcggacctgccggcgtagttgcagcgggggcttggggaggggctgggggttggacgggattgaggaaggtccgcacagcctgtctctgctcagttgcaataaacgtgacatcttgggagcgtt

SEQ ID NO: 426922 - DNA, 2962 bp, Homo sapiens
gcgcggcgctgctgggttctccgaggcgacctggccgccggccgctcctccgcgcgctgttccgcacttgctgccctcgcccggcccggagcgccgctgccatgcggctggcgctgctctgggccctggggctcctgggcgcgggcagccctctgccttcctggccgctcccaaatataggtggcactgaggagcagcaggcagagtcagagaaggccccgagggagcccttggagccccaggtccttcaggacgatctcccaattagcctcaaaaaggtgcttcagaccagtctgcctgagcccctgaggatcaagttggagctggacggtgacagtcatatcctggagctgctacagaatagggagttggtcccaggccgcccaaccctggtgtggtaccagcccgatggcactcgggtggtcagtgagggacacactttggagaactgctgctaccagggaagagtgcggggatatgcaggctcctgggtgtccatctgcacctgctctgggctcagaggcttggtggtcctgaccccagagagaagctataccctggagcaggggcctggggaccttcagggtcctcccattatttcgcgaatccaagatctccacctgccaggccacacctgtgccctgagctggcgggaatctgtacacactcagacgccaccagagcaccccctgggacagcgccacattcgccggaggcgggatgtggtaacagagaccaagactgtggagttggtgattgtggctgatcactcggaggcccagaaataccgggacttccagcacctgctaaaccgcacactggaagtggccctcttgctggacacattcttccggcccctgaatgtacgagtggcactagtgggcctggaggcctggacccagcgtgacctggtggagatcagcccaaacccagctgtcaccctcgaaaacttcctccactggcgcagggcacatttgctgcctcgattgccccatgacagtgcccagctggtgactggtacttcattctctgggcctacggtgggcatggccattcagaactccatctgttctcctgacttctcaggaggtgtgaacatggaccactccaccagcatcctgggagtcgcctcctccatagcccatgagttgggccacagcctgggcctggaccatgatttgcctgggaatagctgcccctgtccaggtccagccccagccaagacctgcatcatggaggcctccacagacttcctaccaggcctgaacttcagcaactgcagccgacgggccctggagaaagccctcctggatggaatgggcagctgcctcttcgaacggctgcctagcctaccccctatggctgctttctgcggaaatatgtttgtggagccgggcgagcagtgtgactgtggcttcctggatgactgcgtcgatccctgctgtgattctttgacctgccagctgaggccaggtgcacagtgtgcatctgacggaccctgttgtcaaaattgccagctgcgcccgtctggctggcagtgtcgtcctaccagaggggattgtgacttgcctgaattctgcccaggagacagctcccagtgtccccctgatgtcagcctaggggatggcgagccctgcgctggcgggcaagctgtgtgcatgcacgggcgttgtgcctcctatgcccagcagtgccagtcactttggggacctggagcccagcccgctgcgccactttgcctccagacagctaatactcggggaaatgcttttgggagctgtgggcgcaaccccagtggcagttatgtgtcctgcacccctagagatgccatttgtgggcagctccagtgccagacaggtaggacccagcctctgctgggctccatccgggatctactctgggagacaatagatgtgaatgggactgagctgaactgcagctgggtgcacctggacctgggcagtgatgtggcccagcccctcctgactctgcctggcacagcctgtggccctggcctggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacagggcagcccaatctggtccctctgaacggccaggacctccgcagagggccctgctggcacgaggcactaaggctagtgctctcagcttcccggcccccccttccaggccgtgccgcctgaccctgtgtccaagagactccaggctgagctggctgaccgacccaatccccctacccgccctctgcccgctgacccggtggtgagaagcccgaagtctcaggggccagccaagcccccacccccaaggaagccactgcctgccgacccccagggccggtgcccatcgggtgacctgcccggcccaggggctggaatcccgcccctagtggtaccctccagaccagcgccaccgcctccgacagtgtcctcgctctacctctgacctctccggaggttccgctgcctccaagccggacttagggcttcaagaggcgggcgtgccctctggagtcccctaccatgactgaaggcgccagagactggcggtgtcttaagactccgggcaccgccacgcgctgtcaagcaacactctgcggacctgccggcgtagttgcagcgggggcttggggaggggctgggggttggacgggattgaggaaggtccgcacagcctgtctctgctcagttgcaataaacgtgacatcttgggagcgtt

SEQ ID NO: 426923 - DNA, 2978 bp, Homo sapiens
cgccacccgctggcggatatcctgcaccgcggctgcccgctcctgcgccgctggctgtgccggcgctgcgtggtgtgccaggcacccgagacgcccgagtcctacgtgtgccggacgctggactgcgaggccgtgtactgctggtcgtgctgggacgacatgcggcagcggtgcccggtctgcacgccccgcgaagagctctcttcctccgcctttagtgacagcaacgacgacactgcctacgcggggtgaagaggcgtcctgctcgctcttccgcaccgtccttcccggttaataaaatgccctgtggcactgaggagcagcaggcagagtcagagaaggccccgagggagcccttggagccccaggtccttcaggacgatctcccaattagcctcaaaaaggtgcttcagaccagtctgcctgagcccctgaggatcaagttggagctggacggtgacagtcatatcctggagctgctacagaatagggagttggtcccaggccgcccaaccctggtgtggtaccagcccgatggcactcgggtggtcagtgagggacacactttggagaactgctgctaccagggaagagtgcggggatatgcaggctcctgggtgtccatctgcacctgctctgggctcagaggcttggtggtcctgaccccagagagaagctataccctggagcaggggcctggggaccttcagggtcctcccattatttcgcgaatccaagatctccacctgccaggccacacctgtgccctgagctggcgggaatctgtacacactcagacgccaccagagcaccccctgggacagcgccacattcgccggaggcgggatgtggtaacagagaccaagactgtggagttggtgattgtggctgatcactcggaggcccagaaataccgggacttccagcacctgctaaaccgcacactggaagtggccctcttgctggacacattcttccggcccctgaatgtacgagtggcactagtgggcctggaggcctggacccagcgtgacctggtggagatcagcccaaacccagctgtcaccctcgaaaacttcctccactggcgcagggcacatttgctgcctcgattgccccatgacagtgcccagctggtgactggtacttcattctctgggcctacggtgggcatggccattcagaactccatctgttctcctgacttctcaggaggtgtgaacatggaccactccaccagcatcctgggagtcgcctcctccatagcccatgagttgggccacagcctgggcctggaccatgatttgcctgggaatagctgcccctgtccaggtccagccccagccaagacctgcatcatggaggcctccacagacttcctaccaggcctgaacttcagcaactgcagccgacgggccctggagaaagccctcctggatggaatgggcagctgcctcttcgaacggctgcctagcctaccccctatggctgctttctgcggaaatatgtttgtggagccgggcgagcagtgtgactgtggcttcctggatgactgcgtcgatccctgctgtgattctttgacctgccagctgaggccaggtgcacagtgtgcatctgacggaccctgttgtcaaaattgccagctgcgcccgtctggctggcagtgtcgtcctaccagaggggattgtgacttgcctgaattctgcccaggagacagctcccagtgtccccctgatgtcagcctaggggatggcgagccctgcgctggcgggcaagctgtgtgcatgcacgggcgttgtgcctcctatgcccagcagtgccagtcactttggggacctggagcccagcccgctgcgccactttgcctccagacagctaatactcggggaaatgcttttgggagctgtgggcgcaaccccagtggcagttatgtgtcctgcacccctagagatgccatttgtgggcagctccagtgccagacaggtaggacccagcctctgctgggctccatccgggatctactctgggagacaatagatgtgaatgggactgagctgaactgcagctgggtgcacctggacctgggcagtgatgtggcccagcccctcctgactctgcctggcacagcctgtggccctggcctggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacagggcagcccaatctggtccctctgaacggccaggacctccgcagagggccctgctggcacgaggcactaagtctcaggggccagccaagcccccacccccaaggaagccactgcctgccgacccccagggccggtgcccatcgggtgacctgcccggcccaggggctggaatcccgcccctagtggtaccctccagaccagcgccaccgcctccgacagtgtcctcgctctacctctgacctctccggaggttccgctgcctccaagccggacttagggcttcaagaggcgggcgtgccctctggagtcccctaccatgactgaaggcgccagagactggcggtgtcttaagactccgggcaccgccacgcgctgtcaagcaacactctgcggacctgccggcgtagttgcagcgggggcttggggaggggctgggggttggacgggattgaggaaggtccgcacagcctgtctctgctcagttgcaataaacgtgacatcttgggagcgttaaaaacacaaacacaacaacacaaaaaaacaag

SEQ ID NO: 426924 - DNA, 2789 bp, Homo sapiens
gcgcggcgctgctgggttctccgaggcgacctggccgccggccgctcctccgcgcgctgttccgcacttgctgccctcgcccggcccggagcgccgctgccatgcggctggcgctgctctgggccctggggctcctgggcgcgggcagccctctgccttcctggccgctcccaaatataggtggcactgaggagcagcaggcagagtcagagaaggccccgagggagcccttggagccccaggtccttcaggacgatctcccaattagcctcaaaaaggtgcttcagaccagtctgcctgagcccctgaggatcaagttggagctggacggtgacagtcatatcctggagctgctacagaatagggagttggtcccaggccgcccaaccctggtgtggtaccagcccgatggcactcgggtggtcagtgagggacacactttggagaactgctgctaccagggaagagtgcggggatatgcaggctcctgggtgtccatctgcacctgctctgggctcagaggcttggtggtcctgaccccagagagaagctataccctggagcaggggcctggggaccttcagggtcctcccattatttcgcgaatccaagatctccacctgccaggccacacctgtgccctgagctggcgggaatctgtacacactcagacgccaccagagcaccccctgggacagcgccacattcgccgggcccagaaataccgggacttccagcacctgctaaaccgcacactggaagtggccctcttgctggacacattcttccggcccctgaatgtacgagtggcactagtgggcctggaggcctggacccagcgtgacctggtggagatcagcccaaacccagctgtcaccctcgaaaacttcctccactggcgcagggcacatttgctgcctcgattgccccatgacagtgcccagctggtgactggtacttcattctctgggcctacggtgggcatggccattcagaactccatctgttctcctgacttctcaggaggtgtgaacatggaccactccaccagcatcctgggagtcgcctcctccatagcccatgagttgggccacagcctgggcctggaccatgatttgcctgggaatagctgcccctgtccaggtccagccccagccaagacctgcatcatggaggcctccacagacttcctaccaggcctgaacttcagcaactgcagccgacgggccctggagaaagccctcctggatggaatgggcagctgcctcttcgaacggctgcctagcctaccccctatggctgctttctgcggaaatatgtttgtggagccgggcgagcagtgtgactgtggcttcctggatgactgcgtcgatccctgctgtgattctttgacctgccagctgaggccaggtgcacagtgtgcatctgacggaccctgttgtcaaaattgccagctgcgcccgtctggctggcagtgtcgtcctaccagaggggattgtgacttgcctgaattctgcccaggagacagctcccagtgtccccctgatgtcagcctaggggatggcgagccctgcgctggcgggcaagctgtgtgcatgcacgggcgttgtgcctcctatgcccagcagtgccagtcactttggggacctggagcccagcccgctgcgccactttgcctccagacagctaatactcggggaaatgcttttgggagctgtgggcgcaaccccagtggcagttatgtgtcctgcacccctagagatgccatttgtgggcagctccagtgccagacaggtaggacccagcctctgctgggctccatccgggatctactctgggagacaatagatgtgaatgggactgagctgaactgcagctgggtgcacctggacctgggcagtgatgtggcccagcccctcctgactctgcctggcacagcctgtggccctggcctggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacagggcagcccaatctggtccctctgaacggccaggacctccgcagagggccctgctggcacgaggcactaagtctcaggggccagccaagcccccacccccaaggaagccactgcctgccgacccccagggccggtgcccatcgggtgacctgcccggcccaggggctggaatcccgcccctagtggtaccctccagaccagcgccaccgcctccgacagtgtcctcgctctacctctgacctctccggaggttccgctgcctccaagccggacttagggcttcaagaggcgggcgtgccctctggagtcccctaccatgactgaaggcgccagagactggcggtgtcttaagactccgggcaccgccacgcgctgtcaagcaacactctgcggacctgccggcgtagttgcagcgggggcttggggaggggctgggggttggacgggattgaggaaggtccgcacagcctgtctctgctcagttgcaataaacgtgacatcttgggagcgttaaaaacacaaacacaacaacacaaaaaaacaag

SEQ ID NO: 426925 - DNA, 3066 bp, Homo sapiens
cgccacccgctggcggatatcctgcaccgcggctgcccgctcctgcgccgctggctgtgccggcgctgcgtggtgtgccaggcacccgagacgcccgagtcctacgtgtgccggacgctggactgcgaggccgtgtactgctggtcgtgctgggacgacatgcggcagcggtgcccggtctgcacgccccgcgaagagctctcttcctccgcctttagtgacagcaacgacgacactgcctacgcggggtgaagaggcgtcctgctcgctcttccgcaccgtccttcccggttaataaaatgccctgtggcactgaggagcagcaggcagagtcagagaaggccccgagggagcccttggagccccaggtccttcaggacgatctcccaattagcctcaaaaaggtgcttcagaccagtctgcctgagcccctgaggatcaagttggagctggacggtgacagtcatatcctggagctgctacagaatagggagttggtcccaggccgcccaaccctggtgtggtaccagcccgatggcactcgggtggtcagtgagggacacactttggagaactgctgctaccagggaagagtgcggggatatgcaggctcctgggtgtccatctgcacctgctctgggctcagaggcttggtggtcctgaccccagagagaagctataccctggagcaggggcctggggaccttcagggtcctcccattatttcgcgaatccaagatctccacctgccaggccacacctgtgccctgagctggcgggaatctgtacacactcagacgccaccagagcaccccctgggacagcgccacattcgccggagtaggagtggctgcctcttggtcagcccggcacagctgctggctgcgagcggcaggtttgcctgataattcttcttgtccatagtagaggcgggatgtggtaacagagaccaagactgtggagttggtgattgtggctgatcactcggaggcccagaaataccgggacttccagcacctgctaaaccgcacactggaagtggccctcttgctggacacattcttccggcccctgaatgtacgagtggcactagtgggcctggaggcctggacccagcgtgacctggtggagatcagcccaaacccagctgtcaccctcgaaaacttcctccactggcgcagggcacatttgctgcctcgattgccccatgacagtgcccagctggtgactggtacttcattctctgggcctacggtgggcatggccattcagaactccatctgttctcctgacttctcaggaggtgtgaacatggaccactccaccagcatcctgggagtcgcctcctccatagcccatgagttgggccacagcctgggcctggaccatgatttgcctgggaatagctgcccctgtccaggtccagccccagccaagacctgcatcatggaggcctccacagacttcctaccaggcctgaacttcagcaactgcagccgacgggccctggagaaagccctcctggatggaatgggcagctgcctcttcgaacggctgcctagcctaccccctatggctgctttctgcggaaatatgtttgtggagccgggcgagcagtgtgactgtggcttcctggatgactgcgtcgatccctgctgtgattctttgacctgccagctgaggccaggtgcacagtgtgcatctgacggaccctgttgtcaaaattgccagctgcgcccgtctggctggcagtgtcgtcctaccagaggggattgtgacttgcctgaattctgcccaggagacagctcccagtgtccccctgatgtcagcctaggggatggcgagccctgcgctggcgggcaagctgtgtgcatgcacgggcgttgtgcctcctatgcccagcagtgccagtcactttggggacctggagcccagcccgctgcgccactttgcctccagacagctaatactcggggaaatgcttttgggagctgtgggcgcaaccccagtggcagttatgtgtcctgcacccctagagatgccatttgtgggcagctccagtgccagacaggtaggacccagcctctgctgggctccatccgggatctactctgggagacaatagatgtgaatgggactgagctgaactgcagctgggtgcacctggacctgggcagtgatgtggcccagcccctcctgactctgcctggcacagcctgtggccctggcctggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacagggcagcccaatctggtccctctgaacggccaggacctccgcagagggccctgctggcacgaggcactaagtctcaggggccagccaagcccccacccccaaggaagccactgcctgccgacccccagggccggtgcccatcgggtgacctgcccggcccaggggctggaatcccgcccctagtggtaccctccagaccagcgccaccgcctccgacagtgtcctcgctctacctctgacctctccggaggttccgctgcctccaagccggacttagggcttcaagaggcgggcgtgccctctggagtcccctaccatgactgaaggcgccagagactggcggtgtcttaagactccgggcaccgccacgcgctgtcaagcaacactctgcggacctgccggcgtagttgcagcgggggcttggggaggggctgggggttggacgggattgaggaaggtccgcacagcctgtctctgctcagttgcaataaacgtgacatcttgggagcgttaaaaacacaaacacaacaacacaaaaaaacaag

SEQ ID NO: 426926 - DNA, 1078 bp, Homo sapiens
gcgcggcgctgctgggttctccgaggcgacctggccgccggccgctcctccgcgcgctgttccgcacttgctgccctcgcccggcccggagcgccgctgccatgcggctggcgctgctctgggccctggggctcctgggcgcgggcagccctctgccttcctggccgctcccaaatataggtggcactgaggagcagcaggcagagtcagagaaggccccgagggagcccttggagccccaggtccttcaggacgatctcccaattagcctcaaaaaggtgcttcagaccagtctgcctgagcccctgaggatcaagttggagctggacggtgacagtcatatcctggagctgctacagaatagggagttggtcccaggccgcccaaccctggtgtggtaccagcccgatggcactcgggtggtcagtgagggacacactttggagaactgctgctaccagggaagagtgcggggatatgcaggctcctgggtgtccatctgcacctgctctgggctcagaggcttggtggtcctgaccccagagagaagctataccctggagcaggggcctggggaccttcagggtcctcccattatttcgcgaatccaagatctccacctgccaggccacacctgtgccctgagctggcgggaatctgtacacactcagacgccaccagagcaccccctgggacagcgccacattcgccgggtgaggatgaatggcagggggggtgggctttggttgtcttgagggctgatccccagacacttagagctatgtgtgcacagtaacaacagctcctgcgaatggagcactttccacatgctgggcactttgtgaacattagctcgtgtactcctcccatacctaggaggtaggtgctatcaatagctctattttaaaatgacgaaaccttacaaaaagtatctgggcatggtggcgtgcacccgtagttccagccactcaggaggccgaagtggaagaatcgcttgagcccaggaggcagaggtttcagtgggccgagatcgagccactacacaccagcctgggtgaaagagtgagacctcgtctca

SEQ ID NO: 426927 - DNA, 2852 bp, Homo sapiens
gcgcggcgctgctgggttctccgaggcgacctggccgccggccgctcctccgcgcgctgttccgcacttgctgccctcgcccggcccggagcgccgctgccatgcggctggcgctgctctgggccctggggctcctgggcgcgggcagccctctgccttcctggccgctcccaaatataggtggcactgaggagcagcaggcagagtcagagaaggccccgagggagcccttggagccccaggtccttcaggacgatctcccaattagcctcaaaaaggtgcttcagaccagtctgcctgagcccctgaggatcaagttggagctggacggtgacagtcatatcctggagctgctacagaatagggagttggtcccaggccgcccaaccctggtgtggtaccagcccgatggcactcgggtggtcagtgagggacacactttggagaactgctgctaccagggaagagtgcggggatatgcaggctcctgggtgtccatctgcacctgctctgggctcagaggcttggtggtcctgaccccagagagaagctataccctggagcaggggcctggggaccttcagggtcctcccattatttcgcgaatccaagatctccacctgccaggccacacctgtgccctgagctggcgggaatctgtacacactcagacgccaccagagcaccccctgggacagcgccacattcgccggaggcgggatgtggtaacagagaccaagactgtggagttggtgattgtggctgatcactcggaggcccagaaataccgggacttccagcacctgctaaaccgcacactggaagtggccctcttgctggacacattcttccggcccctgaatgtacgagtggcactagtgggcctggaggcctggacccagcgtgacctggtggagatcagcccaaacccagctgtcaccctcgaaaacttcctccactggcgcagggcacatttgctgcctcgattgccccatgacagtgcccagctggtgactggtacttcattctctgggcctacggtgggcatggccattcagaactccatctgttctcctgacttctcaggaggtgtgaacatggaccactccaccagcatcctgggagtcgcctcctccatagcccatgagttgggccacagcctgggcctggaccatgatttgcctgggaatagctgcccctgtccaggtccagccccagccaagacctgcatcatggaggcctccacagacttcctaccaggcctgaacttcagcaactgcagccgacgggccctggagaaagccctcctggatggaatgggcagctgcctcttcgaacggctgcctagcctaccccctatggctgctttctgcggaaatatgtttgtggagccgggcgagcagtgtgactgtggcttcctggatgactgcgtcgatccctgctgtgattctttgacctgccagctgaggccaggtgcacagtgtgcatctgacggaccctgttgtcaaaattgccagctgcgcccgtctggctggcagtgtcgtcctaccagaggggattgtgacttgcctgaattctgcccaggagacagctcccagtgtccccctgatgtcagcctaggggatggcgagccctgcgctggcgggcaagctgtgtgcatgcacgggcgttgtgcctcctatgcccagcagtgccagtcactttggggacctggagcccagcccgctgcgccactttgcctccagacagctaatactcggggaaatgcttttgggagctgtgggcgcaaccccagtggcagttatgtgtcctgcacccctagagatgccatttgtgggcagctccagtgccagacaggtaggacccagcctctgctgggctccatccgggatctactctgggagacaatagatgtgaatgggactgagctgaactgcagctgggtgcacctggacctgggcagtgatgtggcccagcccctcctgactctgcctggcacagcctgtggccctggcctggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacagggcagcccaatctggtccctctgaacggccaggacctccgcagagggccctgctggcacgaggcactaagtctcaggggccagccaagcccccacccccaaggaagccactgcctgccgacccccagggccggtgcccatcgggtgacctgcccggcccaggggctggaatcccgcccctagtggtaccctccagaccagcgccaccgcctccgacagtgtcctcgctctacctctgacctctccggaggttccgctgcctccaagccggacttagggcttcaagaggcgggcgtgccctctggagtcccctaccatgactgaaggcgccagagactggcggtgtcttaagactccgggcaccgccacgcgctgtcaagcaacactctgcggacctgccggcgtagttgcagcgggggcttggggaggggctgggggttggacgggattgaggaaggtccgcacagcctgtctctgctcagttgcaataaacgtgacatcttgggagcgttaaaaacacaaacacaacaacacaaaaaaacaag

SEQ ID NO: 426928 - DNA, 1131 bp, Homo sapiens
gacactctgagcctcagaagcagcaaagtgtctcaggggccagccaagcccccacccccaaggaagccactgcctgccgacccccagggccggtgcccatcgggtgacctgcccggcccaggggctggaatcccgcccctagtggtaccctccagaccagcgccaccgcctccgacagtgtcctcgctctacctctgacctctccggaggttccgctgcctccaagccggacttagggcttcaagaggcgggcgtgccctctggagtcccctaccatgactgaaggcgccagagactggcggtgtcttaagactccgggcaccgccacgcgctgtcaagcaacactctgcggacctgccggcgtagttgcagcgggggcttggggaggggctgggggttggacgggattgaggaaggtccgcacagcctgtctctgctcagttgcaataaacgtgacatcttgggagcgttaaaaaaaaaaaaaaaaaaacaagaaaacaagaatatctccaaaaggggcacaggacaccttccaaacgcgaccaccaaagcgagagccccaggagatgaggccccccaaacaaccacggacaataagcaacgccacatccaggcaacacgcaaaccacaaacacaacgccacggcgacacacgacgacccccgaaacccaaagaaccaacgcacgtcgcgacacacccgaagccctacaacagacaagaagaaaataagcggcaaaacacacgcagacaaaaaaactcacgacaccacgaatacacacagcgagggaaaacagatgcacacattcaggcaacggcattgcgtgccaaaaacgcccgagagaaaagcggacaacagttggaagaaccacaaccgccccaggctagccgggaccaggtagacacgcctcccccgcagctgtcgtactccccacagggaaggctcctgaccccctcacactgcactaagacccagagctacgcgaagaccgcggcgcgcacagacaaacaaaacccgcggcacctcataacaccgggcaggagatagagaaaacaccagacaacagcacagcagcctcccgaataaacaaagacacacacaaaaacacaaagacaacaccactctgcagccat

SEQ ID NO: 426929 - DNA, 3104 bp, Homo sapiens
gcgcggcgctgctgggttctccgaggcgacctggccgccggccgctcctccgcgcgctgttccgcacttgctgccctcgcccggcccggagcgccgctgccatgcggctggcgctgctctgggccctggggctcctgggcgcgggcagccctctgccttcctggccgctcccaaatataggtggcactgaggagcagcaggcagagtcagagaaggccccgagggagcccttggagccccaggtccttcaggacgatctcccaattagcctcaaaaaggtgcttcagaccagtctgcctgagcccctgaggatcaagttggagctggacggtgacagtcatatcctggagctgctacagaatagggagttggtcccaggccgcccaaccctggtgtggtaccagcccgatggcactcgggtggtcagtgagggacacactttggagaactgctgctaccagggaagagtgcggggatatgcaggctcctgggtgtccatctgcacctgctctgggctcagaggcttggtggtcctgaccccagagagaagctataccctggagcaggggcctggggaccttcagggtcctcccattatttcgcgaatccaagatctccacctgccaggccacacctgtgccctgagctggcgggaatctgtacacactcagacgccaccagagcaccccctgggacagcgccacattcgccggaggcgggatgtggtaacagagaccaagactgtggagttggtgattgtggctgatcactcggaggcccagaaataccgggacttccagcacctgctaaaccgcacactggaagtggccctcttgctggacacattcttccggcccctgaatgtacgagtggcactagtgggcctggaggcctggacccagcgtgacctggtggagatcagcccaaacccagctgtcaccctcgaaaacttcctccactggcgcagggcacatttgctgcctcgattgccccatgacagtgcccagctggtgactggtacttcattctctgggcctacggtgggcatggccattcagaactccatctgttctcctgacttctcaggaggtgtgaacatggaccactccaccagcatcctgggagtcgcctcctccatagcccatgagttgggccacagcctgggcctggaccatgatttgcctgggaatagctgcccctgtccaggtccagccccagccaagacctgcatcatggaggcctccacagacttcctaccaggcctgaacttcagcaactgcagccgacgggccctggagaaagccctcctggatggaatgggcagctgcctcttcgaacggctgcctagcctaccccctatggctgctttctgcggaaatatgtttgtggagccgggcgagcagtgtgactgtggcttcctggatgactgcgtcgatccctgctgtgattctttgacctgccagctgaggccaggtgcacagtgtgcatctgacggaccctgttgtcaaaattgccagctgcgcccgtctggctggcagtgtcgtcctaccagaggggattgtgacttgcctgaattctgcccaggagacagctcccagtgtccccctgatgtcagcctaggggatggcgagccctgcgctggcgggcaagctgtgtgcatgcacgggcgttgtgcctcctatgcccagcagtgccagtcactttggggacctggagcccagcccgctgcgccactttgcctccagacagctaatactcggggaaatgcttttgggagctgtgggcgcaaccccagtggcagttatgtgtcctgcacccctagagatgccatttgtgggcagctccagtgccagacaggtaggacccagcctctgctgggctccatccgggatctactctgggagacaatagatgtgaatgggactgagctgaactgcagctgggtgcacctggacctgggcagtgatgtggcccagcccctcctgactctgcctggcacagcctgtggccctggcctggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacagggcagcccaatctggtccctctgaacggccaggacctccgcagagggccctgctggcacgaggcactaaggctagtgctctcagcttcccggcccccccttccaggccgtgccgcctgaccctgtgtccaagagactccaggctgagctggctgaccgacccaatccccctacccgccctctgcccgctgacccggtggtgagaagcccgaaggtaacggtggggggagagaagggcacggcctctccccccacctagggctgtggtgctggtagccatgacggtggtggccgtggcgagatgccccctcagtgcatgagggcacatatcccggtggtgcctttaatggtgacagtctcaggggccagccaagcccccacccccaaggaagccactgcctgccgacccccagggccggtgcccatcgggtgacctgcccggcccaggggctggaatcccgcccctagtggtaccctccagaccagcgccaccgcctccgacagtgtcctcgctctacctctgacctctccggaggttccgctgcctccaagccggacttagggcttcaagaggcgggcgtgccctctggagtcccctaccatgactgaaggcgccagagactggcggtgtcttaagactccgggcaccgccacgcgctgtcaagcaacactctgcggacctgccggcgtagttgcagcgggggcttggggaggggctgggggttggacgggattgaggaaggtccgcacagcctgtctctgctcagttgcaataaacgtgacatcttgggagcgtt

SEQ ID NO: 426930 - DNA, 2893 bp, Homo sapiens
gcgcggcgctgctgggttctccgaggcgacctggccgccggccgctcctccgcgcgctgttccgcacttgctgccctcgcccggcccggagcgccgctgccatgcggctggcgctgctctgggccctggggctcctgggcgcgggcagccctctgccttcctggccgctcccaaatataggtggcactgaggagcagcaggcagagtcagagaaggccccgagggagcccttggagccccaggtccttcaggacgatctcccaattagcctcaaaaaggtgcttcagaccagtctgcctgagcccctgaggatcaagttggagctggacggtgacagtcatatcctggagctgctacagaatagggagttggtcccaggccgcccaaccctggtgtggtaccagcccgatggcactcgggtggtcagtgagggacacactttggagaactgctgctaccagggaagagtgcggggatatgcaggctcctgggtgtccatctgcacctgctctgggctcagaggcttggtggtcctgaccccagagagaagctataccctggagcaggggcctggggaccttcagggtcctcccattatttcgcgaatccaagatctccacctgccaggccacacctgtgccctgagctggcgggaatctgtacacactcagacgccaccagagcaccccctgggacagcgccacattcgccggaggcgggatgtggtaacagagaccaagactgtggagttggtgattgtggctgatcactcggaggcccagaaataccgggacttccagcacctgctaaaccgcacactggaagtggccctcttgctggacacattcttccggcccctgaatgtacgagtggcactagtgggcctggaggcctggacccagcgtgacctggtggagatcagcccaaacccagctgtcaccctcgaaaacttcctccactggcgcagggcacatttgctgcctcgattgccccatgacagtgcccagctggtgactggtacttcattctctgggcctacggtgggcatggccattcagaactccatctgttctcctgacttctcaggaggtgtgaacatggaccactccaccagcatcctgggagtcgcctcctccatagcccatgagttgggccacagcctgggcctggaccatgatttgcctgggaatagctgcccctgtccaggtccagccccagccaagacctgcatcatggaggcctccacagacttcctaccaggcctgaacttcagcaactgcagccgacgggccctggagaaagccctcctggatggaatgggcagctgcctcttcgaacggctgcctagcctaccccctatggctgctttctgcggaaatatgtttgtggagccgggcgagcagtgtgactgtggcttcctggatgactgcgtcgatccctgctgtgattctttgacctgccagctgaggccaggtgcacagtgtgcatctgacggaccctgttgtcaaaattgccagctgcgcccgtctggctggcagtgtcgtcctaccagaggggattgtgacttgcctgaattctgcccaggagacagctcccagtgtccccctgatgtcagcctaggggatggcgagccctgcgctggcgggcaagctgtgtgcatgcacgggcgttgtgcctcctatgcccagcagtgccagtcactttggggacctggagcccagcccgctgcgccactttgcctccagacagctaatactcggggaaatgcttttgggagctgtgggcgcaaccccagtggcagttatgtgtcctgcacccctagagatgccatttgtgggcagctccagtgccagacaggtaggacccagcctctgctgggctccatccgggatctactctgggagacaatagatgtgaatgggactgagctgaactgcagctgggtgcacctggacctgggcagtgatgtggcccagcccctcctgactctgcctggcacagcctgtggccctggcctggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacagggcagcccaatctggtccctctgaacggccaggacctccgcagagggccctgctggcacgaggcactaagaggctgagctggctgaccgacccaatccccctacccgccctctgcccgctgacccggtggtgagaagcccgaagtctcaggggccagccaagcccccacccccaaggaagccactgcctgccgacccccagggccggtgcccatcgggtgacctgcccggcccaggggctggaatcccgcccctagtggtaccctccagaccagcgccaccgcctccgacagtgtcctcgctctacctctgacctctccggaggttccgctgcctccaagccggacttagggcttcaagaggcgggcgtgccctctggagtcccctaccatgactgaaggcgccagagactggcggtgtcttaagactccgggcaccgccacgcgctgtcaagcaacactctgcggacctgccggcgtagttgcagcgggggcttggggaggggctgggggttggacgggattgaggaaggtccgcacagcctgtctctgctcagttgcaataaacgtgacatcttgggagcgtt

SEQ ID NO: 426931 - DNA, 2931 bp, Homo sapiens
gcgcggcgctgctgggttctccgaggcgacctggccgccggccgctcctccgcgcgctgttccgcacttgctgccctcgcccggcccggagcgccgctgccatgcggctggcgctgctctgggccctggggctcctgggcgcgggcagccctctgccttcctggccgctcccaaatataggtggcactgaggagcagcaggcagagtcagagaaggccccgagggagcccttggagccccaggtccttcaggacgatctcccaattagcctcaaaaaggtgcttcagaccagtctgcctgagcccctgaggatcaagttggagctggacggtgacagtcatatcctggagctgctacagaatagggagttggtcccaggccgcccaaccctggtgtggtaccagcccgatggcactcgggtggtcagtgagggacacactttggagaactgctgctaccagggaagagtgcggggatatgcaggctcctgggtgtccatctgcacctgctctgggctcagaggcttggtggtcctgaccccagagagaagctataccctggagcaggggcctggggaccttcagggtcctcccattatttcgcgaatccaagatctccacctgccaggccacacctgtgccctgagctggcgggaatctgtacacactcagacgccaccagagcaccccctgggacagcgccacattcgccggaggcgggatgtggtaacagagaccaagactgtggagttggtgattgtggctgatcactcggaggcccagaaataccgggacttccagcacctgctaaaccgcacactggaagtggccctcttgctggacacagtgagtgctggacagggcaacccccaccccaggcccctgaccatggcaacccctcttctgagccccagctgtctttcagttcttccggcccctgaatgtacgagtggcactagtgggcctggaggcctggacccagcgtgacctggtggagatcagcccaaacccagctgtcaccctcgaaaacttcctccactggcgcagggcacatttgctgcctcgattgccccatgacagtgcccagctggtgactggtacttcattctctgggcctacggtgggcatggccattcagaactccatctgttctcctgacttctcaggaggtgtgaacatggaccactccaccagcatcctgggagtcgcctcctccatagcccatgagttgggccacagcctgggcctggaccatgatttgcctgggaatagctgcccctgtccaggtccagccccagccaagacctgcatcatggaggcctccacagacttcctaccaggcctgaacttcagcaactgcagccgacgggccctggagaaagccctcctggatggaatgggcagctgcctcttcgaacggctgcctagcctaccccctatggctgctttctgcggaaatatgtttgtggagccgggcgagcagtgtgactgtggcttcctggatgactgcgtcgatccctgctgtgattctttgacctgccagctgaggccaggtgcacagtgtgcatctgacggaccctgttgtcaaaattgccagctgcgcccgtctggctggcagtgtcgtcctaccagaggggattgtgacttgcctgaattctgcccaggagacagctcccagtgtccccctgatgtcagcctaggggatggcgagccctgcgctggcgggcaagctgtgtgcatgcacgggcgttgtgcctcctatgcccagcagtgccagtcactttggggacctggagcccagcccgctgcgccactttgcctccagacagctaatactcggggaaatgcttttgggagctgtgggcgcaaccccagtggcagttatgtgtcctgcacccctagagatgccatttgtgggcagctccagtgccagacaggtaggacccagcctctgctgggctccatccgggatctactctgggagacaatagatgtgaatgggactgagctgaactgcagctgggtgcacctggacctgggcagtgatgtggcccagcccctcctgactctgcctggcacagcctgtggccctggcctggtgtgtatagaccatcgatgccagcgtgtggatctcctgggggcacaggaatgtcgaagcaaatgccatggacatggggtctgtgacagcaacaggcactgctactgtgaggagggctgggcaccccctgactgcaccactcagctcaaagcaaccagctccctgaccacagggctgctcctcagcctcctggtcttattggtcctggtgatgcttggtgccagctactggtaccgtgcccgcctgcaccagcgactctgccagctcaagggacccacctgccagtacagggcagcccaatctggtccctctgaacggccaggacctccgcagagggccctgctggcacgaggcactaagtctcaggggccagccaagcccccacccccaaggaagccactgcctgccgacccccagggccggtgcccatcgggtgacctgcccggcccaggggctggaatcccgcccctagtggtaccctccagaccagcgccaccgcctccgacagtgtcctcgctctacctctgacctctccggaggttccgctgcctccaagccggacttagggcttcaagaggcgggcgtgccctctggagtcccctaccatgactgaaggcgccagagactggcggtgtcttaagactccgggcaccgccacgcgctgtcaagcaacactctgcggacctgccggcgtagttgcagcgggggcttggggaggggctgggggttggacgggattgaggaaggtccgcacagcctgtctctgctcagttgcaataaacgtgacatcttgggagcgttaaaaacacaaacacaacaacacaaaaaaacaag

SEQ ID NO: 426932 - DNA, 1171 bp, Homo sapiens
gcgcggcgctgctgggttctccgaggcgacctggccgccggccgctcctccgcgcgctgttccgcacttgctgccctcgcccggcccggagcgccgctgccatgcggctggcgctgctctgggccctggggctcctgggcgcgggcagccctctgccttcctggccgctcccaaatataggtggcactgaggagcagcaggcagagtcagagaaggccccgagggagcccttggagccccaggtccttcaggacgatctcccaattagcctcaaaaaggtgcttcagaccagtctgcctgagcccctgaggatcaagttggagctggacggtgacagtcatatcctggagctgctacagaatagggagttggtcccaggccgcccaaccctggtgtggtaccagcccgatggcactcgggtggtcagtgagggacacactttggagaactgctgctaccagggaagagtgcggggatatgcaggctcctgggtgtccatctgcacctgctctgggctcagaggcttggtggtcctgaccccagagagaagctataccctggagcaggggcctggggaccttcagggtcctcccattatttcgcgaatccaagatctccacctgccaggccacacctgtgccctgagctggcgggaatctgtacacactcagacgccaccagagcaccccctgggacagcgccacattcgccggaggcgggatgtggtaacagagaccaagactgtggagttggtgattgtggctgatcactcggaggcccagaaataccgggacttccagcacctgctaaaccgcacactggaagtggccctcttgctggacacagtgagtgctggacagggcaacccccaccccaggcccctgaccatggcaacccctcttctgagccccagctgtctttcagttcttccggcccctgaatgtacgagtggcactagtgggcctggaggcctggacccagcgtgacctggtggagatcagcccaaacccagctgtcaccctcgaaaacttcctccactggcgcagggcacatttgctgcctcgattgccccatgacagtgcccagctggtgactggtacttcattaatctgggcctacggagggaatggccattcaacgcgctccgaccgctaacatactgcaggctcat

SEQ ID NO: 426933 - DNA, 655 bp, Homo sapiens
gcgcggcgctgctgggttctccgaggcgacctggccgccggccgctcctccgcgcgctgttccgcacttgctgccctcgcccggcccggagcgccgctgccatgcggctggcgctgctctgggccctggggctcctgggcgcgggcagccctctgccttcctggccgctcccaaatataggtggcactgaggagcagcaggcagagtcagagaaggccccgagggagcccttggagccccaggtccttcaggacgatctcccaattagcctcaaaaaggtgcttcagaccagtctgcctgagcccctgaggatcaagttggagctggacggtgacagtcatatcctggagctgctacagaatagggagttggtcccaggccgcccaaccctggtgtggtaccagcccgatggcactcgggtggtcagtgagggacacactttggagaactgctgctaccagggaagagtgcggggatatgcaggctcctgggtgtccatctgcacctgctctgggctcagaggcttggtggtcctgaccccagagagaagctatacccggggagggggaggcagacagattactagaccccaggagtttgagaccagcctgggcaacacggtgagatcccgtctctgctaaaaatacaaaattag

SEQ ID NO: 426934 - DNA, 3082 bp, Homo sapiens
aactaaggctaggtacgaggctgggttgtgcgggccggccgacatggcggcagcggtggcggctgcgctggcgcggcttttggcggcctttctgctcctcgcggcccaggtggcctgtgagtacggcatggtgcacgtggtctcccaggccgggggccccgaaggcaaagactactgcatcctctacaacccgcagtgggcccatcttccgcacgacctcagcaaggcatctttcctgcagctgcgcaactggacggcctccctgctctgctccgcagccgacctccccgcccgtggcttcagcaaccagatcccgctggtggcgcgggggaactgcaccttctatgagaaagtgaggctggcccagggcagcggagcacgcgggctgctcatcgtcagcagggagaggctggtccccccggggggtaataagacgcagtatgatgagattggcattcccgtggccctgctcagctacaaagacatgctggacatcttcacgcgtttcggccgcacggtgagggcggcgctgtatgcgcctaaggagccggtgctggactacaacatggtcatcatcttcatcatggctgtgggcaccgtcgccatcggcggctactgggccgggagtcgggacgtgaagaaaaggtacatgaagcacaagcgcgacgatgggcccgagaagcaggaggacgaggcggtggacgtgacgccggtgatgacctgcgtgtttgtggtgatgtgctgctccatgctggtgctgctctactatttctacgacctcctcgtgtacgtggtcatcgggatcttctgcctggcctccgccaccggcctctacagctgcctggcgccctgtgtgcggcggctgcccttcggcaagtgcaggatccccaacaacagcctgccctacttccacaagcgcccgcaggcccgtatgctgctcctggcgctcttctgcgtggccgtcagcgtggtgtggggcgtcttccgcaacgaggaccagtaagtgctgcttcccccgggccccggcgggcagcggagtcctcgggcgcaccagggctcctggggccctgactccctgccctccctggaggccgccccagcctggagctgcttcagcaccgcgtgatgaagagccctggccccgggctgctctgacagggctgcgagggcgtttcacctggggtttgtccgggtgtcatgggaaccctgactggaatccgggaggagaggccggagcccctgtggccaggagccacgtcctccagcctggatgggactcctttgtggggcatcgctgcccagggccacagtctgtcccccgctgtccctttcctggcacccacgtgcacgccgcaggttcgaggcccagggtgtgggcaccagggcacccggtcctcttggtcatgactgctgcggcttctgagcagtggtggaggtggggcaggcactgctccccccacgctcacctcccacgtggcctggacttgtggctgcctcccgctggccgggcctcccccatgaggccgagtgcctggtgccgtgttgggaggacagagctggcccgtccccgcccggtccccaccgctgtcgctgataccatctggcacttcctcccagccttcctgaggcagccaagtacgcttggctttggtgtgtattggagccacggcacgtttaactggcagaaggaagatgtgaaaatattttgaatcctttgtacacaaagagaaaatgaatcttttcagttatttccaagccaggaaactcgctccgtcacatgaagttagagcaggcctcagtcagctgggcgcaggggctcacgcctgggatcccagcatttggtaggccaaggcaggacgatcactttgcccaggagttcaagaccagcctgggcaacaagcgagacgccctatttaagaaataatataaaatcagaaaaaataactggccgcagttctctgggtgcttgaagtacgtggcgcctggaattggctgtaccagcgtctcccatggaggcctctgctgttagcagccgccccgccctggagatgtttttatcccattttcaaatgaagcctttgatgtttgagacgctgaggaacgctggggaactcgtccagcaagtgacaggcagagcctgcattgggggcaggggccagcggggaggggactctggggcttcgtggggccaggagagagccgaagttgcggctggctgcaggggccgtggccttgtgcaggaggcagttctgtgctttgccccagggcaccaaccgcatggcagccccacccactgtggacccagaggttctttgaggaaacctggtgtggcacaagttttaatttaataaacagtttgggcacgggggctcatgcctgtaatcccagcactttgggaggtgaggcgggcagatcacttgaggtcaggagtttgagaccagcctggccaacatgacaaaaccccatctctactaaaaatacaaaaaaatttgcctggcattgtggtgtgtgcctgtaatcccagctacttgggaggctgaggcaggagaattgcttgaacctgggaggtggaggttgcagcgagtcaagatcgtgccaccaaactccagcctgggtgacagagtgagactccatctcaaaaacaaaataaaaacagtttggaggggtcagtgcccaagccctcctgcgcacgcaccctctgcctggcccctgcctacagcctgtgacccctgcctacagcgtgacgcccaccatccggggacagtgactgaggggacgcagccggccaggcccgtgtccaccatcctggccccaccatccggggacagcgactgaggggacgcagccggccaggcccgtgtccaccgtcctggccccaccatctggggacagcgaccgaggagacgcagccggccaggcctgtgtccactgtcctggctgccgagtggtgggctcctctacctgcttccgcagggtgggccctggggtggggcctgtgccgccagccctgctggagttgtaacagcaggggtcctcccacaggtctggggtcctcagagtcatcccctgggcaggtggaagg

SEQ ID NO: 426935 - DNA, 2552 bp, Homo sapiens
cggggcggttccttgcgcttcagtcccccccgggtcccctcctgctcccgggttttctgccccgttcccccgggtggctgtgggctcccgagccccgtgtcggccagccggccccagggccccacgaccccatggtgtctcccaagaaggtacatgaagcacaagcgcgacgatgggcccgagaagcaggaggacgaggcggtggacgtgacgccggtgatgacctgcgtgtttgtggtgatgtgctgctccatgctggtgctgctctactatttctacgacctcctcgtgtacgtggtcatcgggatcttctgcctggcctccgccaccggcctctacagctgcctggcgccctgtgtgcggcggctgcccttcggcaagtgcagcgcccgcaggcccgtatgctgctcctggcgctcttctgcgtggccgtcagcgtggtgtggggcgtcttccgcaacgaggaccagtaagtgctgcttcccccgggccccggcgggcagcggagtcctcgggcgcaccagggctcctggggccctgactccctgccctccctggaggccgccccagcctggagctgcttcagcaccgcgtgatgaagagccctggccccgggctgctctgacagggctgcgagggcgtttcacctggggtttgtccgggtgtcatgggaaccctgactggaatccgggaggagaggccggagcccctgtggccaggagccacgtcctccagcctggatgggactcctttgtggggcatcgctgcccagggccacagtctgtcccccgctgtccctttcctggcacccacgtgcacgccgcaggttcgaggcccagggtgtgggcaccagggcacccggtcctcttggtcatgactgctgcggcttctgagcagtggtggaggtggggcaggcactgctccccccacgctcacctcccacgtggcctggacttgtggctgcctcccgctggccgggcctcccccatgaggccgagtgcctggtgccgtgttgggaggacagagctggcccgtccccgcccggtccccaccgctgtcgctgataccatctggcacttcctcccagccttcctgaggcagccaagtacgcttggctttggtgtgtattggagccacggcacgtttaactggcagaaggaagatgtgaaaatattttgaatcctttgtacacaaagagaaaatgaatcttttcagttatttccaagccaggaaactcgctccgtcacatgaagttagagcaggcctcagtcagctgggcgcaggggctcacgcctgggatcccagcatttggtaggccaaggcaggacgatcactttgcccaggagttcaagaccagcctgggcaacaagcgagacgccctatttaagaaataatataaaatcagaaaaaataactggccgcagttctctgggtgcttgaagtacgtggcgcctggaattggctgtaccagcgtctcccatggaggcctctgctgttagcagccgccccgccctggagatgtttttatcccattttcaaatgaagcctttgatgtttgagacgctgaggaacgctggggaactcgtccagcaagtgacaggcagagcctgcattgggggcaggggccagcggggaggggactctggggcttcgtggggccaggagagagccgaagttgcggctggctgcaggggccgtggccttgtgcaggaggcagttctgtgctttgccccagggcaccaaccgcatggcagccccacccactgtggacccagaggttctttgaggaaacctggtgtggcacaagttttaatttaataaacagtttgggcacgggggctcatgcctgtaatcccagcactttgggaggtgaggcgggcagatcacttgaggtcaggagtttgagaccagcctggccaacatgacaaaaccccatctctactaaaaatacaaaaaaatttgcctggcattgtggtgtgtgcctgtaatcccagctacttgggaggctgaggcaggagaattgcttgaacctgggaggtggaggttgcagcgagtcaagatcgtgccaccaaactccagcctgggtgacagagtgagactccatctcaaaaacaaaataaaaacagtttggaggggtcagtgcccaagccctcctgcgcacgcaccctctgcctggcccctgcctacagcctgtgacccctgcctacagcgtgacgcccaccatccggggacagtgactgaggggacgcagccggccaggcccgtgtccaccatcctggccccaccatccggggacagcgactgaggggacgcagccggccaggcccgtgtccaccgtcctggccccaccatctggggacagcgaccgaggagacgcagccggccaggcctgtgtccactgtcctggctgccgagtggtgggctcctctacctgcttccgcagggtgggccctggggtggggcctgtgccgccagccctgctggagttgtaacagcaggggtcctcccacaggtctggggtcctcagagtcatcccctgggcaggtggaagg

SEQ ID NO: 426936 - DNA, 1413 bp, Homo sapiens
gtacgccttggaaataactgaaaagattcattttctgttcgtgtacaaaggattcaaaatattttcacatcttccttctgccagttaaacgtgccgtcgctccgtcacatgaagttagagcaggcctcagtcagctgggcgcaggggctcacgcctgggatcccagcatttggtaggccaaggcaggacgatcactttgcccaggagttcaagaccagcctgggcaacaagcgagacgccctatttaagaaataatataaaatcagaaaaaataactggccgcagttctctgggtgcttgaagtacgtggcgcctggaattggctgtaccagcgtctcccatggaggcctctgctgttagcagccgccccgccctggagatgtttttatcccattttcaaatgaagcctttgatgtttgagacgctgaggaacgctggggaactcgtccagcaagtgacaggcagagcctgcattgggggcaggggccagcggggaggggactctggggcttcgtggggccaggagagagccgaagttgcggctggctgcaggggccgtggccttgtgcaggaggcagttctgtgctttgccccagggcaccaaccgcatggcagccccacccactgtggacccagaggttctttgaggaaacctggtgtggcacaagttttaatttaataaacagtttgggcacgggggctcatgcctgtaatcccagcactttgggaggtgaggcgggcagatcacttgaggtcaggagtttgagaccagcctggccaacatgacaaaaccccatctctactaaaaatacaaaaaaatttgcctggcattgtggtgtgtgcctgtaatcccagctacttgggaggctgaggcaggagaattgcttgaacctgggaggtggaggttgcagcgagtcaagatcgtgccaccaaactccagcctgggtgacagagtgagactccatctcaaaaacaaaataaaaacagtttggaggggtcagtgcccaagccctcctgcgcacgcaccctctgcctggcccctgcctacagcctgtgacccctgcctacagcgtgacgcccaccatccggggacagtgactgaggggacgcagccggccaggcccgtgtccaccatcctggccccaccatccggggacagcgactgaggggacgcagccggccaggcccgtgtccaccgtcctggccccaccatctggggacagcgaccgaggagacgcagccggccaggcctgtgtccactgtcctggctgccgagtggtgggctcctctacctgcttccgcagggtgggccctggggtggggcctgtgccgccagccctgctggagttgtaacagcaggggtcctcccacaggtctggggtcctcagagtcatcccctgggcaggtggaagg

SEQ ID NO: 426937 - DNA, 733 bp, Homo sapiens
cggggcgttgctgggaaacatctgccgttggttgcggcgggcaccggccgacatggcggcagcggtggcggctgcgctggcgcggcttttggcggcctttctgctcctcgcggcccaggtggcctgtgagtacggcatggtgcacgtggtctcccaggccgggggccccgaaggcaaagactactgcatcctctacaacccgcagtgggcccatcttccgcacgacctcagcaaggcatactttccgtgcaagctcgcgcaatctgggactggccctcctctagctcgtgctaccgcaagcgcgacctaccccgcgccgtgcgcttcaagcaaccaagatccctgctgtgtggctgcggcgggaacttgcaccgttctactgagaacagtgatggcttggcccatggagcatgcggtgagacacgctgggcttgctcagtcgtacagcatgtggatgatgtgcttggtctccccctgggggtggtacatacagaccgcatgtagtgactgacgacttggacctatcactgttgcgccgctgctcaggctatcagaagacattagctggaccatcattcactgctgtttcgtgccggcacggttgaggtgctggcagctgatattgcgccataatggacgccgtgtgcctggagctaacaagcataggtccatcatacttcagtcagtggtctgtgcggcaccctgtcgccaatcggcaggctacttgggccgg

SEQ ID NO: 426938 - DNA, 3574 bp, Homo sapiens
cggggcgttgctgggaaacatctgccgttggttgcggcgggcaccggccgacatggcggcagcggtggcggctgcgctggcgcggcttttggcggcctttctgctcctcgcggcccaggtggcctgtgagtacggcatggtgcacgtggtctcccaggccgggggccccgaaggcaaagactactgcatcctctacaacccgcagtgggcccatcttccgcacgacctcagcaaggcatctttcctgcagctgcgcaactggacggcctccctgctctgctccgcagccgacctccccgcccgtggcttcagcaaccagatcccgctggtggcgcgggggaactgcaccttctatgagaaagtgaggctggcccagggcagcggagcacgcgggctgctcatcgtcagcagggagaggctggtccccccggggggtaataagacgcagtatgatgagattggcattcccgtggccctgctcagctacaaagacatgctggacatcttcacgcgtttcggccgcacggtgagggcggcgctgtatgcgcctaaggagccggtgctggactacaacatggtcatcatcttcatcatggctgtgggcaccgtcgccatcggcggctactgggccgggagtcgggacgtgaagaaaaggtacatgaagcacaagcgcgacgatgggcccgagaagcaggaggacgaggcggtggacgtgacgccggtgatgacctgcgtgtttgtggtgatgtgctgctccatgctggtgctgctctactatttctacgacctcctcgtgtacgtggtcatcgggatcttctgcctggcctccgccaccggcctctacagctgcctggcgccctgtgtgcggcggctgcccttcggcaagtgcaggatccccaacaacagcctgccctacttccacaagcgcccgcaggcccgtatgctgctcctggcgctcttctgcgtggccgtcagcgtggtgtggggcgtcttccgcaacgaggaccagtgggcctgggtcctccaggatgccctgggcatcgccttctgcctctacatgctgaagaccatccgtctgcccaccttcaaggcctgcacgctgctgctgctggtgctgttcctctacgacatcttcttcgtgttcatcacgcccttcctgaccaagagtgggagcagcatcatggtggaggtggccactgggccctcggactcagccacccgtgagaagctgcccatggtcctgaaggtgcccaggctgaactcctcacctctggccctgtgtgaccggcccttctccctcctgggtttcggagacattttggtgccagggctgctggtggcctactgccacaggtttgacatccaggtacagtcctccagggtatacttcgtggcctgcaccatcgcctatggcgttggcctccttgtgacattcgtggcactggccctgatgcagcgtggccagcccgctctcctctacctggtgccctgcacgctggtgacgagctgcgctgtggcgctctggcgccgggagctgggcgtgttctggacgggcagcggctttgcgaaagtcctacctccatctccgtgggccccagcaccagccgacggcccgcagcctcccaaagactctgccacgccactctccccgcagccgcccagcgaagaaccagccacatccccctggcctgctgagcagtccccaaaatcacgcacgtccgaggagatgggggctggagcccccatgcgggagcctgggagcccagctgaatccgagggccgggaccaggcccagccgtccccggtaacccagcctggcgcctcggcctaggggaggggtgagacgctcgctgccgtgcccgccacaccaagatgttggggctgcctggcgcccactggagacagacagacagacgcctgtcccccgggaccgaggcctgtgccgtccccacccgccccaacatggtgctcatccttgccgagacccctgcggtctgtgcccgcgcccagcccagctgccccggctgcacgcctgctgctcccagctcgcccggctgccacaagctctctgcgggtccatcctccccaccggggtccgtcctcgcaggccctgcccggcctctctgcagaccctcaagcgtcgtctgcatgagtgagcaggcgtgggtggactctggccgcggccacacttggtgctcaccagctgcttcggccttcaggtgacctccctccccacggcatcctgctctccgggtggaagagcagctttctgtctcccagaaggcatcgcttttccctcttgagcagatcggagcccctgggaggtttggaagctgcctccaagcctaggacacggaccggtggccggggcggcctctggcccctgacgctggctgagacaggcccgtggggcggggttttggggcgtgaacaaggctggcagtaagtggacaagctgctcccctggctaaggccctgccctgccctcagccagaggtgcctggccatgcctgcacactcctccccattttaataaatggtcgcaacttctagaagtcctgctggtgccacctggtggggtggacgtctctcagactgcccttctgacaagcaggggtgggcgccaggcaggctgggtcaggccctcaggggtccctggagccctgggagggagggactgggtcgtgggaggtcctggtagctcccggcacccaacctcgcttcccgtgtgggccccgtgttgcttttctgctgagaggggcttgggcctcggttctccctgtggcagcggcattggtgcctgggttcttaaccctctggacccagcagctaggagcttctggaacccacgaggacatctgccactggcatggtctactcactgatggggtcctcctgactccagggcagagacgtccgtgcgggaactgaccgaggcgtggccccaggccccggcatcctcccctcgctgcacgtggtcacttccgaagcagcgctccctgtggccgcagagacagagcccgcaccctggctgtctgtggtgcctgggccccagctcccgcccgccacccgccctgttgagtgcggcctccagactcgagtccagaatctgtttctgtcaagtcagtcgtccccagctgcacacggggactgctgagcgctgcgctctcacgggtctgttccggacagagggtggcaggggtgagccctgatcccttacaaaaaataccagcttcccagggagtaatggcgccttcactgaagccattttgtacatggggacggggtggggacgtctcttttttggtgttggacgtttgaccagtggggaggggttcagaggcggcggtcctgtccttggctccgtctgtccgtgtggccttgctgccattccgtctgatcattaaacacagcttttgattaaaaaaaaaggggggcgctaaaaacctgagggcagtacgtccacatttggaaaggcaagagaggaaaaaagggggcgggaaacgcgcggacggacgggctggaagaaccctggggggggaccaaaacggaaaagtgggacctcgcagggtaa

SEQ ID NO: 426939 - DNA, 3870 bp, Homo sapiens
cggggcgttgctgggaaacatctgccgttggttgcggcgggcaccggccgacatggcggcagcggtggcggctgcgctggcgcggcttttggcggcctttctgctcctcgcggcccaggtggcctgtgagtacggcatggtgcacgtggtctcccaggccgggggccccgaaggcaaagactactgcatcctctacaacccgcagtgggcccatcttccgcacgacctcagcaaggcatctttcctgcagctgcgcaactggacggcctccctgctctgctccgcagccgacctccccgcccgtggcttcagcaaccagatcccgctggtggcgcgggggaactgcaccttctatgagaaagtgaggctggcccagggcagcggagcacgcgggctgctcatcgtcagcagggagaggctggtccccccggggggtaataagacgcagtatgatgagattggcattcccgtggccctgctcagctacaaagacatgctggacatcttcacgcgtttcggccgcacggtgagggcggcgctgtatgcgcctaaggagccggtgctggactacaacatggtcatcatcttcatcatggctgtgggcaccgtcgccatcggcggctactgggccgggagtcgggacgtgaagaaaaggtacatgaagcacaagcgcgacgatgggcccgagaagcaggaggacgaggcggtggacgtgacgccggtgatgacctgcgtgtttgtggtgatgtgctgctccatgctggtgctgctctactatttctacgacctcctcgtgtacgtggtcatcgggatcttctgcctggcctccgccaccggcctctacagctgcctggcgccctgtgtgcggcggctgcccttcggcaagtgcaggatccccaacaacagcctgccctacttccacaagcgcccgcaggcccgtatgctgctcctggcgctcttctgcgtggccgtcagcgtggtgtggggcgtcttccgcaacgaggaccagtgggcctgggtcctccaggatgccctgggcatcgccttctgcctctacatgctgaagaccatccgtctgcccaccttcaaggcctgcacgctgctgctgctggtgctgttcctctacgacatcttcttcgtgttcatcacgcccttcctgaccaagagtgggagcagcatcatggtggaggtggccactgggccctcggactcagccacccgtgagaagctgcccatggtcctgaaggtgcccaggctgaactcctcacctctggccctgtgtgaccggcccttctccctcctgggtttcggagacattttggtgccagggctgctggtggcctactgccacaggtttgacatccaggtacagtcctccagggtatacttcgtggcctgcaccatcgcctatggcgttggcctccttgtgacattcgtggcactggccctgatgcagcgtggccagcccgctctcctctacctggtgccctgcacgctggtgacgagctgcgctgtggcgctctggcgccgggagctgggcgtgttctggacgggcagcggctttgcgaaagtcctacctccatctccgtgggccccagcaccagccgacggcccgcagcctcccaaagactctgccacgccactctccccgcagccgcccagcgaagaaccagccacatccccctggcctgctgagcagtccccaaaatcacgcacgtccgaggagatgggggctggagcccccatgcgggagcctgggagcccagctgaatccgagggccgggaccaggcccagccgtccccggtaacccagcctggcgcctcggcctaggggaggggtgagacgctcgctgccgtgcccgccacaccaagatgttggggctgcctggcgcccactggagacagacagacagacgcctgtcccccgggaccgaggcctgtgccgtccccacccgccccaacatggtgctcatccttgccgagacccctgcggtctgtgcccgcgcccagcccagctgccccggctgcacgcctgctgctcccagctcgcccggctgccacaagctctctgcgggtccatcctccccaccggggtccgtcctcgcaggccctgcccggcctctctgcagaccctcaagcgtcgtctgcatgagtgagcaggcgtgggtggactctggccgcggccacacttggtgctcaccagctgcttcggccttcaggtgacctccctccccacggcatcctgctctccgggtggaagagcagctttctgtctcccagaaggcatcgcttttccctcttgagcagatcggagcccctgggaggtttggaagctgcctccaagcctaggacacggaccggtggccggggcggcctctggcccctgacgctggctgagacaggcccgtggggcggggttttggggcgtgaacaaggctggcagtaagtggacaagctgctcccctggctaaggccctgccctgccctcagccagaggtgcctggccatgcctgcacactcctccccattttaataaatggtcgcaacttctagaagtcctgctggtgccacctggtggggtggacgtctctcagactgcccttctgacaagcaggggtgggcgccaggcaggctgggtcaggccctcaggggtccctggagccctgggagggagggactgggtcgtgggaggtcctggtagctcccggcacccaacctcgcttcccgtgtgggccccgtgttgcttttctgctgagaggggcttgggcctcggttctccctgtggcagcggcattggtgcctgggttcttaaccctctggacccagcagctaggagcttctggaacccacgaggacatctgccactggcatggtctactcactgatggggtcctcctgactccagggcagagacgtccgtgcgggaactgaccgaggcgtggccccaggccccggcatcctcccctcgctgcacgtggtcacttccgaagcagcgctccctgtggccgcagagacagagcccgcaccctggctgtctgtggtgcctgggccccagctcccgcccgccacccgccctgttgagtgcggcctccagactcgagtccagaatctgtttctgtcaagtcagtcgtccccagctgcacacggggactgctgagcgctgcgctctcacgggtctgttccggacagagggtggcaggggtgagccctgatcccttacaaaaaataccagcttcccagggagtaatggcgccttcactgaagccattttgtacatggggacggggtggggacgtctcttttttggtgttggacgtttgaccagtggggaggggttcagaggcggcggtcctgtccttggctccgtctgtccgtgtggccttgctgccattccgtctgatcattaaacacagcttttgatacatatggcccggcctctgcctccgcagtgcacggcttggggcatctgctctgtgcaggtcccggtgagcagaactgagagctggcaggccgcctggctgtcctgcagaggacggattggaattgccaccgcagggccggccagtgctgtgaggtgcccagcgtcactcccatgggctctgtgggccatgtggtccctgtcacgcttctcagctctgccactgttgctggaaagcatcacagaccatgtgtaaaatgggccaaaataccttttacaaaattaaaatagagatggggtcttgcagtgttgctgaggctgatctcgaactgctgagctcagacaatcctcctgtctcggcctcccaaagcgctgcaattacaggcacgagccaccacgcccatccctcaagtaattttctcgccagaccctgaaattggaattgtatagca

SEQ ID NO: 426940 - DNA, 3565 bp, Homo sapiens
aactaaggctaggtacgaggctgggttgtgcgggccggccgacatggcggcagcggtggcggctgcgctggcgcggcttttggcggcctttctgctcctcgcggcccaggtggcctgtgagtacggcatggtgcacgtggtctcccaggccgggggccccgaaggcaaagactactgcatcctctacaacccgcagtgggcccatcttccgcacgacctcagcaaggcatctttcctgcagctgcgcaactggacggcctccctgctctgctccgcagccgacctccccgcccgtggcttcagcaaccagatcccgctggtggcgcgggggaactgcaccttctatgagaaagtgaggctggcccagggcagcggagcacgcgggctgctcatcgtcagcagggagaggctggtccccccggggggtaataagacgcagtatgatgagattggcattcccgtggccctgctcagctacaaagacatgctggacatcttcacgcgtttcggccgcacggtgagggcggcgctgtatgcgcctaaggagccggtgctggactacaacatggtcatcatcttcatcatggctgtgggcaccgtcgccatcggcggctactgggccgggagtcgggacgtgaagaaaaggtacatgaagcacaagcgcgacgatgggcccgagaagcaggaggacgaggcggtggacgtgacgccggtgatgacctgcgtgtttgtggtgatgtgctgctccatgctggtgctgctctactatttctacgacctcctcgtgtacgtggtcatcgggatcttctgcctggcctccgccaccggcctctacagctgcctggcgccctgtgtgcggcggctgcccttcggcaagtgcaggatccccaacaacagcctgccctacttccacaagcgcccgcaggcccgtatgctgctcctggcgctcttctgcgtggccgtcagcgtggtgtggggcgtcttccgcaacgaggaccagtgggcctgggtcctccaggatgccctgggcatcgccttctgcctctacatgctgaagaccatccgtctgcccaccttcaaggcctgcacgctgctgctgctggtgctgttcctctacgacatcttcttcgtgttcatcacgcccttcctgaccaagagtgggagcagcatcatggtggaggtggccactgggccctcggactcagccacccgtgagaagctgcccatggtcctgaaggtgcccaggctgaactcctcacctctggccctgtgtgaccggcccttctccctcctgggtttcggagacattttggtgccagggctgctggtggcctactgccacaggtttgacatccaggtacagtcctccagggtatacttcgtggcctgcaccatcgcctatggcgttggcctccttgtgacattcgtggcactggccctgatgcagcgtggccagcccgctctcctctacctggtgccctgcacgctggtgacgagctgcgctgtggcgctctggcgccgggagctgggcgtgttctggacgggcagcggctttgcgaaagtcctacctccatctccgtgggccccagcaccagccgacggcccgcagcctcccaaagactctgccacgccactctccccgcagccgcccagcgaagaaccagccacatccccctggcctgctgagcagtccccaaaatcacgcacgtccgaggagatgggggctggagcccccatgcgggagcctgggagcccagctgaatccgagggccgggaccaggcccagccgtccccggtaacccagcctggcgcctcggcctaggggaggggtgagacgctcgctgccgtgcccgccacaccaagatgttggggctgcctggcgcccactggagacagacagacagacgcctgtcccccgggaccgaggcctgtgccgtccccacccgccccaacatggtgctcatccttgccgagacccctgcggtctgtgcccgcgcccagcccagctgccccggctgcacgcctgctgctcccagctcgcccggctgccacaagctctctgcgggtccatcctccccaccggggtccgtcctcgcaggccctgcccggcctctctgcagaccctcaagcgtcgtctgcatgagtgagcaggcgtgggtggactctggccgcggccacacttggtgctcaccagctgcttcggccttcaggtgacctccctccccacggcatcctgctctccgggtggaagagcagctttctgtctcccagaaggcatcgcttttccctcttgagcagatcggagcccctgggaggtttggaagctgcctccaagcctaggacacggaccggtggccggggcggcctctggcccctgacgctggctgagacaggcccgtggggcggggttttggggcgtgaacaaggctggcagtaagtggacaagctgctcccctggctaaggccctgccctgccctcagccagaggtgcctggccatgcctgcacactcctccccattttaataaatggtcgcaacttctagaagtcctgctggtgccacctggtggggtggacgtctctcagactgcccttctgacaagcaggggtgggcgccaggcaggctgggtcaggccctcaggggtccctggagccctgggagggagggactgggtcgtgggaggtcctggtagctcccggcacccaacctcgcttcccgtgtgggccccgtgttgcttttctgctgagaggggcttgggcctcggttctccctgtggcagcggcattggtgcctgggttcttaaccctctggacccagcagctaggagcttctggaacccacgaggacatctgccactggcatggtctactcactgatggggtcctcctgactccagggcagagacgtccgtgcgggaactgaccgaggcgtggccccaggccccggcatcctcccctcgctgcacgtggtcacttccgaagcagcgctccctgtggccgcagagacagagcccgcaccctggctgtctgtggtgcctgggccccagctcccgcccgccacccgccctgttgagtgcggcctccagactcgagtccagaatctgtttctgtcaagtcagtcgtccccagctgcacacggggactgctgagcgctgcgctctcacgggtctgttccggacagagggtggcaggggtgagccctgatcccttacaaaaaataccagcttcccagggagtaatggcgccttcactgaagccattttgtacatggggacggggtggggacgtctcttttttggtgttggacgtttgaccagtggggaggggttcagaggcggcggtcctgtccttggctccgtctgtccgtgtggccttgctgccattccgtctgatcattaaacacagcttttgattaaaaaaaaaggggggcgctaaaaacctgagggcagtacgtccacatttggaaaggcaagagaggaaaaaagggggcgggaaacgcgcggacggacgggctggaagaaccctggggggggaccaaaacggaaaagtgggacctcgcagggtaa

SEQ ID NO: 426941 - DNA, 3637 bp, Homo sapiens
cggggcgttgctgggaaacatctgccgttggttgcggcgggcaccggccgacatggcggcagcggtggcggctgcgctggcgcggcttttggcggcctttctgctcctcgcggcccaggtggcctgtgagtacggcatggtgcacgtggtctcccaggccgggggccccgaaggcaaagactactgcatcctctacaacccgcagtgggcccatcttccgcacgacctcagcaaggcatctttcctgcagctgcgcaactggacggcctccctgctctgctccgcagccgacctccccgcccgtggcttcagcaaccagatcccgctggtggcgcgggggaactgcaccttctatgagaaagtgaggctggcccagggcagcggagcacgcgggctgctcatcgtcagcagggagaggctggtccccccggggggtaataagacgcagtatgatgagattggcattcccgtggccctgctcagctacaaagacatgctggacatcttcacgcgtttcggccgcacggtgagggcggcgctgtatgcgcctaaggagccggtgctggactacaacatggtcatcatcttcatcatggctgtgggcaccgtcgccatcggcggctactgggccgggagtcgggacgtgaagaaaaggtacatgaagcacaagcgcgacgatgggcccgagaagcaggaggacgaggcggtggacgtgacgccggtgatgacctgcgtgtttgtggtgatgtgctgctccatgctggtgctgctctactatttctacgacctcctcgtgtacgtggtcatcgggatcttctgcctggcctccgccaccggcctctacagctgcctggcgccctgtgtgcggcggctgcccttcggcaagtgcaggatccccaacaacagcctgccctacttccacaagcgcccgcaggcccgtatgctgctcctggcgctcttctgcgtggccgtcagcgtggtgtggggcgtcttccgcaacgaggaccagtgggcctgggtcctccaggatgccctgggcatcgccttctgcctctacatgctgaagaccatccgtctgcccaccttcaaggcctgcacgctgctgctgctggtgctgttcctctacgacatcttcttcgtgttcatcacgcccttcctgaccaagagtgggagcagcatcatggtggaggtggccactgggccctcggactcagccacccgtgagaagctgcccatggtcctgaaggtgcccaggctgaactcctcacctctggccctgtgtgaccggcccttctccctcctgggtttcggagacattttggtgccagggctgctggtggcctactgccacaggtttgacatccaggtacagtcctccagggtatacttcgtggcctgcaccatcgcctatggcgttggcctccttgtgacattcgtggcactggccctgatgcagcgtggccagcccgctctcctctacctggtgccctgcacgctggtgacgagctgcgctgtggcgctctggcgccgggagctgggcgtgttctggacgggcagcggctttgcggtgaataccagtttgctctgactgtgagaaatactcgcctagtgagccctaactagagttaaaaaagtcctacctccatctccgtgggccccagcaccagccgacggcccgcagcctcccaaagactctgccacgccactctccccgcagccgcccagcgaagaaccagccacatccccctggcctgctgagcagtccccaaaatcacgcacgtccgaggagatgggggctggagcccccatgcgggagcctgggagcccagctgaatccgagggccgggaccaggcccagccgtccccggtaacccagcctggcgcctcggcctaggggaggggtgagacgctcgctgccgtgcccgccacaccaagatgttggggctgcctggcgcccactggagacagacagacagacgcctgtcccccgggaccgaggcctgtgccgtccccacccgccccaacatggtgctcatccttgccgagacccctgcggtctgtgcccgcgcccagcccagctgccccggctgcacgcctgctgctcccagctcgcccggctgccacaagctctctgcgggtccatcctccccaccggggtccgtcctcgcaggccctgcccggcctctctgcagaccctcaagcgtcgtctgcatgagtgagcaggcgtgggtggactctggccgcggccacacttggtgctcaccagctgcttcggccttcaggtgacctccctccccacggcatcctgctctccgggtggaagagcagctttctgtctcccagaaggcatcgcttttccctcttgagcagatcggagcccctgggaggtttggaagctgcctccaagcctaggacacggaccggtggccggggcggcctctggcccctgacgctggctgagacaggcccgtggggcggggttttggggcgtgaacaaggctggcagtaagtggacaagctgctcccctggctaaggccctgccctgccctcagccagaggtgcctggccatgcctgcacactcctccccattttaataaatggtcgcaacttctagaagtcctgctggtgccacctggtggggtggacgtctctcagactgcccttctgacaagcaggggtgggcgccaggcaggctgggtcaggccctcaggggtccctggagccctgggagggagggactgggtcgtgggaggtcctggtagctcccggcacccaacctcgcttcccgtgtgggccccgtgttgcttttctgctgagaggggcttgggcctcggttctccctgtggcagcggcattggtgcctgggttcttaaccctctggacccagcagctaggagcttctggaacccacgaggacatctgccactggcatggtctactcactgatggggtcctcctgactccagggcagagacgtccgtgcgggaactgaccgaggcgtggccccaggccccggcatcctcccctcgctgcacgtggtcacttccgaagcagcgctccctgtggccgcagagacagagcccgcaccctggctgtctgtggtgcctgggccccagctcccgcccgccacccgccctgttgagtgcggcctccagactcgagtccagaatctgtttctgtcaagtcagtcgtccccagctgcacacggggactgctgagcgctgcgctctcacgggtctgttccggacagagggtggcaggggtgagccctgatcccttacaaaaaataccagcttcccagggagtaatggcgccttcactgaagccattttgtacatggggacggggtggggacgtctcttttttggtgttggacgtttgaccagtggggaggggttcagaggcggcggtcctgtccttggctccgtctgtccgtgtggccttgctgccattccgtctgatcattaaacacagcttttgattaaaaaaaaaggggggcgctaaaaacctgagggcagtacgtccacatttggaaaggcaagagaggaaaaaagggggcgggaaacgcgcggacggacgggctggaagaaccctggggggggaccaaaacggaaaagtgggacctcgcagggtaa

SEQ ID NO: 426942 - DNA, 4073 bp, Homo sapiens
agctgctggctggggctgtggaactttggccgtggtcttgttgggtgcctgtcctagagcagcccccaggggtgacggagaccacaccctctgtggggatgggattggggtggcttctgaggagcaggtggcctggccctgagctggtcctttctgggtaccctggtgcccttgccctctagccggtggggccgtgctcgcctgtgtggtcctagccaggtggcctgaagcctggccccttttccatcttctgtgaaatggggctgtggttgagagctgggggcctggcagggctggtcacagcacagggacatgccgactgctgggctgggcagggtgcgtggccgcccctgaagtgtagttttggagtaagaaggaatggagttcaggaattccctcacagctctgcctgtggctctgggctgcccccgccagtgttgcaccctgagcctggcaatccacggaggcctggtgcaggggctcagggccgagggcagagcaggccgggcagagccgagagtgccatccctgtccgcacacgctgccgtcgtagttgagagaggccctcagtgggtgcggggctcaaggcggcttagtgggcaggcatgggctgtgacaagtatcactcaggacttgtatgtgcggttcgggagtcccacggccgagggagggattagtggcgcttttaggcctggggccctgttgtcaggtgaagaaggcttgatgcccttcggcctccctgttcttgggtcctcctggggggccggaggctgtcagctgcagagggggagccagcaggcgcccccagcctgacccgagcctcgagtgagggtcccaggagaggaggcgaatgggcacagagctgggggcccacccactgctgcgggtgatgcctgccgctccctcctctgggcccccaggtccccccggggggtaataagacgcagtatgatgagattggcattcccgtggccctgctcagctacaaagacatgctggacatcttcacgcgtttcggccgcacggtgagggcggcgctgtatgcgcctaaggagccggtgctggactacaacatggtcatcatcttcatcatggctgtgggcaccgtcgccatcggcggctactgggccgggagtcgggacgtgaagaaaaggtacatgaagcacaagcgcgacgatgggcccgagaagcaggaggacgaggcggtggacgtgacgccggtgatgacctgcgtgtttgtggtgatgtgctgctccatgctggtgctgctctactatttctacgacctcctcgtgtacgtggtcatcgggatcttctgcctggcctccgccaccggcctctacagctgcctggcgccctgtgtgcggcggctgcccttcggcaagtgcaggatccccaacaacagcctgccctacttccacaagcgcccgcaggcccgtatgctgctcctggcgctcttctgcgtggccgtcagcgtggtgtggggcgtcttccgcaacgaggaccagtgggcctgggtcctccaggatgccctgggcatcgccttctgcctctacatgctgaagaccatccgtctgcccaccttcaaggcctgcacgctgctgctgctggtgctgttcctctacgacatcttcttcgtgttcatcacgcccttcctgaccaagagtgggagcagcatcatggtggaggtggccactgggccctcggactcagccacccgtgagaagctgcccatggtcctgaaggtgcccaggctgaactcctcacctctggccctgtgtgaccggcccttctccctcctgggtttcggagacattttggtgccagggctgctggtggcctactgccacaggtttgacatccaggtacagtcctccagggtatacttcgtggcctgcaccatcgcctatggcgttggcctccttgtgacattcgtggcactggccctgatgcagcgtggccagcccgctctcctctacctggtgccctgcacgctggtgacgagctgcgctgtggcgctctggcgccgggagctgggcgtgttctggacgggcagcggctttgcgaaagtcctacctccatctccgtgggccccagcaccagccgacggcccgcagcctcccaaagactctgccacgccactctccccgcagccgcccagcgaagaaccagccacatccccctggcctgctgagcagtccccaaaatcacgcacgtccgaggagatgggggctggagcccccatgcgggagcctgggagcccagctgaatccgagggccgggaccaggcccagccgtccccggtaacccagcctggcgcctcggcctaggggaggggtgagacgctcgctgccgtgcccgccacaccaagatgttggggctgcctggcgcccactggagacagacagacagacgcctgtcccccgggaccgaggcctgtgccgtccccacccgccccaacatggtgctcatccttgccgagacccctgcggtctgtgcccgcgcccagcccagctgccccggctgcacgcctgctgctcccagctcgcccggctgccacaagctctctgcgggtccatcctccccaccggggtccgtcctcgcaggccctgcccggcctctctgcagaccctcaagcgtcgtctgcatgagtgagcaggcgtgggtggactctggccgcggccacacttggtgctcaccagctgcttcggccttcaggtgacctccctccccacggcatcctgctctccgggtggaagagcagctttctgtctcccagaaggcatcgcttttccctcttgagcagatcggagcccctgggaggtttggaagctgcctccaagcctaggacacggaccggtggccggggcggcctctggcccctgacgctggctgagacaggcccgtggggcggggttttggggcgtgaacaaggctggcagtaagtggacaagctgctcccctggctaaggccctgccctgccctcagccagaggtgcctggccatgcctgcacactcctccccattttaataaatggtcgcaacttctagaagtcctgctggtgccacctggtggggtggacgtctctcagactgcccttctgacaagcaggggtgggcgccaggcaggctgggtcaggccctcaggggtccctggagccctgggagggagggactgggtcgtgggaggtcctggtagctcccggcacccaacctcgcttcccgtgtgggccccgtgttgcttttctgctgagaggggcttgggcctcggttctccctgtggcagcggcattggtgcctgggttcttaaccctctggacccagcagctaggagcttctggaacccacgaggacatctgccactggcatggtctactcactgatggggtcctcctgactccagggcagagacgtccgtgcgggaactgaccgaggcgtggccccaggccccggcatcctcccctcgctgcacgtggtcacttccgaagcagcgctccctgtggccgcagagacagagcccgcaccctggctgtctgtggtgcctgggccccagctcccgcccgccacccgccctgttgagtgcggcctccagactcgagtccagaatctgtttctgtcaagtcagtcgtccccagctgcacacggggactgctgagcgctgcgctctcacgggtctgttccggacagagggtggcaggggtgagccctgatcccttacaaaaaataccagcttcccagggagtaatggcgccttcactgaagccattttgtacatggggacggggtggggacgtctcttttttggtgttggacgtttgaccagtggggaggggttcagaggcggcggtcctgtccttggctccgtctgtccgtgtggccttgctgccattccgtctgatcattaaacacagcttttgattaaaaaaaaaggggggcgctaaaaacctgagggcagtacgtccacatttggaaaggcaagagaggaaaaaagggggcgggaaacgcgcggacggacgggctggaagaaccctggggggggaccaaaacggaaaagtgggacctcgcagggtaa

SEQ ID NO: 426943 - DNA, 3512 bp, Homo sapiens
cggggcgttgctgggaaacatctgccgttggttgcggcgggcaccggccgacatggcggcagcggtggcggctgcgctggcgcggcttttggcggcctttctgctcctcgcggcccaggtggcctgtgagtacggcatggtgcacgtggtctcccaggccgggggccccgaaggcaaagactactgcatcctctacaacccgcagtgggcccatcttccgcacgacctcagcaaggcatctttcctgcagctgcgcaactggacggcctccctgctctgctccgcagccgacctccccgcccgtggcttcagcaaccagatcccgctggtggcgcgggggaactgcaccttctatgagaaagtgaggctggcccagggcagcggagcacgcgggctgctcatcgtcagcagggagaggctgctacaaagacatgctggacatcttcacgcgtttcggccgcacggtgagggcggcgctgtatgcgcctaaggagccggtgctggactacaacatggtcatcatcttcatcatggctgtgggcaccgtcgccatcggcggctactgggccgggagtcgggacgtgaagaaaaggtacatgaagcacaagcgcgacgatgggcccgagaagcaggaggacgaggcggtggacgtgacgccggtgatgacctgcgtgtttgtggtgatgtgctgctccatgctggtgctgctctactatttctacgacctcctcgtgtacgtggtcatcgggatcttctgcctggcctccgccaccggcctctacagctgcctggcgccctgtgtgcggcggctgcccttcggcaagtgcaggatccccaacaacagcctgccctacttccacaagcgcccgcaggcccgtatgctgctcctggcgctcttctgcgtggccgtcagcgtggtgtggggcgtcttccgcaacgaggaccagtgggcctgggtcctccaggatgccctgggcatcgccttctgcctctacatgctgaagaccatccgtctgcccaccttcaaggcctgcacgctgctgctgctggtgctgttcctctacgacatcttcttcgtgttcatcacgcccttcctgaccaagagtgggagcagcatcatggtggaggtggccactgggccctcggactcagccacccgtgagaagctgcccatggtcctgaaggtgcccaggctgaactcctcacctctggccctgtgtgaccggcccttctccctcctgggtttcggagacattttggtgccagggctgctggtggcctactgccacaggtttgacatccaggtacagtcctccagggtatacttcgtggcctgcaccatcgcctatggcgttggcctccttgtgacattcgtggcactggccctgatgcagcgtggccagcccgctctcctctacctggtgccctgcacgctggtgacgagctgcgctgtggcgctctggcgccgggagctgggcgtgttctggacgggcagcggctttgcgaaagtcctacctccatctccgtgggccccagcaccagccgacggcccgcagcctcccaaagactctgccacgccactctccccgcagccgcccagcgaagaaccagccacatccccctggcctgctgagcagtccccaaaatcacgcacgtccgaggagatgggggctggagcccccatgcgggagcctgggagcccagctgaatccgagggccgggaccaggcccagccgtccccggtaacccagcctggcgcctcggcctaggggaggggtgagacgctcgctgccgtgcccgccacaccaagatgttggggctgcctggcgcccactggagacagacagacagacgcctgtcccccgggaccgaggcctgtgccgtccccacccgccccaacatggtgctcatccttgccgagacccctgcggtctgtgcccgcgcccagcccagctgccccggctgcacgcctgctgctcccagctcgcccggctgccacaagctctctgcgggtccatcctccccaccggggtccgtcctcgcaggccctgcccggcctctctgcagaccctcaagcgtcgtctgcatgagtgagcaggcgtgggtggactctggccgcggccacacttggtgctcaccagctgcttcggccttcaggtgacctccctccccacggcatcctgctctccgggtggaagagcagctttctgtctcccagaaggcatcgcttttccctcttgagcagatcggagcccctgggaggtttggaagctgcctccaagcctaggacacggaccggtggccggggcggcctctggcccctgacgctggctgagacaggcccgtggggcggggttttggggcgtgaacaaggctggcagtaagtggacaagctgctcccctggctaaggccctgccctgccctcagccagaggtgcctggccatgcctgcacactcctccccattttaataaatggtcgcaacttctagaagtcctgctggtgccacctggtggggtggacgtctctcagactgcccttctgacaagcaggggtgggcgccaggcaggctgggtcaggccctcaggggtccctggagccctgggagggagggactgggtcgtgggaggtcctggtagctcccggcacccaacctcgcttcccgtgtgggccccgtgttgcttttctgctgagaggggcttgggcctcggttctccctgtggcagcggcattggtgcctgggttcttaaccctctggacccagcagctaggagcttctggaacccacgaggacatctgccactggcatggtctactcactgatggggtcctcctgactccagggcagagacgtccgtgcgggaactgaccgaggcgtggccccaggccccggcatcctcccctcgctgcacgtggtcacttccgaagcagcgctccctgtggccgcagagacagagcccgcaccctggctgtctgtggtgcctgggccccagctcccgcccgccacccgccctgttgagtgcggcctccagactcgagtccagaatctgtttctgtcaagtcagtcgtccccagctgcacacggggactgctgagcgctgcgctctcacgggtctgttccggacagagggtggcaggggtgagccctgatcccttacaaaaaataccagcttcccagggagtaatggcgccttcactgaagccattttgtacatggggacggggtggggacgtctcttttttggtgttggacgtttgaccagtggggaggggttcagaggcggcggtcctgtccttggctccgtctgtccgtgtggccttgctgccattccgtctgatcattaaacacagcttttgattaaaaaaaaaggggggcgctaaaaacctgagggcagtacgtccacatttggaaaggcaagagaggaaaaaagggggcgggaaacgcgcggacggacgggctggaagaaccctggggggggaccaaaacggaaaagtgggacctcgcagggtaa

SEQ ID NO: 426944 - DNA, 3487 bp, Homo sapiens
cggggcgttgctgggaaacatctgccgttggttgcggcgggcaccggccgacatggcggcagcggtggcggctgcgctggcgcggcttttggcggcctttctgctcctcgcggcccaggtggcctgtgagtacggcatggtgcacgtggtctcccaggccgggggccccgaaggcaaagactactgcatcctctacaacccgcagtgggcccatcttccgcacgacctcagcaaggcatctttcctgcagctgcgcaactggacggcctccctgctctgctccgcagccgacctccccgcccgtggcttcagcaaccagatcccgctggtggcgcgggggaactgcaccttctatgagaaagtgaggctggcccagggcagcggagcacgcgggctgctcatcgtcagcagggagaggctggtccccccggggggtaataagacgcagtatgatgagattggcattcccgtggccctgctcagctacaaagacatgctggacatcttcacgcgtttcggccgcacggtgagggcggcgctgtatgcgcctaaggagccggtgctggactacaacatggtcatcatcttcatcatggctgtgggcaccgtcgccatcggcggctactgggccgggagtcgggacgtgaagaaaaggtacatgaagcacaagcgcgacgatgggcccgagaagcaggaggacgaggcggtggacgtgacgccggtgatgacctgcgtgtttgtggtgatgtgctgctccatgctggtgctgctctactatttctacgacctcctcgtgtacgtggtcatcgggatcttctgcctggcctccgccaccggcctctacagctgcctggcgccctgtgtgcggcggctgcccttcggcaagtgcaggatccccaacaacagcctgccctacttccacaagcgcccgcaggcccgtatgctgctcctggcgctcttctgcgtggccgtcagcgtggtgtggggcgtcttccgcaacgaggaccagtgggcctgggtcctccaggatgccctgggcatcgccttctgcctctacatgctgaagaccatccgtctgcccaccttcaaggcctgcacgctgctgctgctggtgctgttcctctacgacatcttcttcgtgttcatcacgcccttcctgaccaagagtgggagcagcatcatggtggaggtggccactgggccctcggactcagccacccgtgagaagctgcccatggtcctgaaggtgcccaggctgaactcctcacctctggccctgtgtgaccggcccttctccctcctgggtttcggagacattttggtgccagggctgctggtggcctactgccacaggtttgacatccaggtacagtcctccagggtatacttcgtggcctgcaccatcgcctatggcgttggcctccttgtgacattcgtggcactggccctgatgcagcgtggccagcccgctctcctctacctggtgccctgcacgctggtgacgagctgcgctgtggcgctctggcgccgggagctgggcgtgttctggacgggcagcggctttgcgaaagtcctacctccatctccgtgggccccagcaccagccgacggcccgcagcctcccaaagactctgccacgccactctccccgcagccgcccagcgaagaaccagccacatccccctggcctgctgagcagtccccaaaatcacgcacgtccgaggagatgggggctggagcccccatgcgggagcctgggagcccagctgaatccgagggccgggaccaggcccagccgtccccggtaacccagcctggcgcctcggcctaggggaggggtgagacgctcgctgccgtgcccgccacaccaagatgttggggctgcctggcgcccactggagacagacagacagacgcctgtcccccgggaccgaggcctgtgccgtccccacccgccccaacatggtgctcatccttgccgagacccctgcggtctgtgcccgcgcccagcccagctgccccggctgcacgcctgctgctcccagctcgcccggctgccacaagctctctgcgggtccatcctccccaccggggtccgtcctcgcaggccctgcccggcctctctgcagaccctcaagcgtcgtctgcatgagtgagcaggcgtgggtggaagagcagctttctgtctcccagaaggcatcgcttttccctcttgagcagatcggagcccctgggaggtttggaagctgcctccaagcctaggacacggaccggtggccggggcggcctctggcccctgacgctggctgagacaggcccgtggggcggggttttggggcgtgaacaaggctggcagtaagtggacaagctgctcccctggctaaggccctgccctgccctcagccagaggtgcctggccatgcctgcacactcctccccattttaataaatggtcgcaacttctagaagtcctgctggtgccacctggtggggtggacgtctctcagactgcccttctgacaagcaggggtgggcgccaggcaggctgggtcaggccctcaggggtccctggagccctgggagggagggactgggtcgtgggaggtcctggtagctcccggcacccaacctcgcttcccgtgtgggccccgtgttgcttttctgctgagaggggcttgggcctcggttctccctgtggcagcggcattggtgcctgggttcttaaccctctggacccagcagctaggagcttctggaacccacgaggacatctgccactggcatggtctactcactgatggggtcctcctgactccagggcagagacgtccgtgcgggaactgaccgaggcgtggccccaggccccggcatcctcccctcgctgcacgtggtcacttccgaagcagcgctccctgtggccgcagagacagagcccgcaccctggctgtctgtggtgcctgggccccagctcccgcccgccacccgccctgttgagtgcggcctccagactcgagtccagaatctgtttctgtcaagtcagtcgtccccagctgcacacggggactgctgagcgctgcgctctcacgggtctgttccggacagagggtggcaggggtgagccctgatcccttacaaaaaataccagcttcccagggagtaatggcgccttcactgaagccattttgtacatggggacggggtggggacgtctcttttttggtgttggacgtttgaccagtggggaggggttcagaggcggcggtcctgtccttggctccgtctgtccgtgtggccttgctgccattccgtctgatcattaaacacagcttttgattaaaaaaaaaggggggcgctaaaaacctgagggcagtacgtccacatttggaaaggcaagagaggaaaaaagggggcgggaaacgcgcggacggacgggctggaagaaccctggggggggaccaaaacggaaaagtgggacctcgcagggtaa

SEQ ID NO: 426945 - DNA, 3069 bp, Homo sapiens
cggggcggttccttgcgcttcagtcccccccgggtcccctcctgctcccgggttttctgccccgttcccccgggtggctgtgggctcccgagccccgtgtcggccagccggccccagggccccacgaccccatggtgtctcccaagaaggtacatgaagcacaagcgcgacgatgggcccgagaagcaggaggacgaggcggtggacgtgacgccggtgatgacctgcgtgtttgtggtgatgtgctgctccatgctggtgctgctctactatttctacgacctcctcgtgtacgtggtcatcgggatcttctgcctggcctccgccaccggcctctacagctgcctggcgccctgtgtgcggcggctgcccttcggcaagtgcaggatccccaacaacagcctgccctacttccacaagcgcccgcaggcccgtatgctgctcctggcgctcttctgcgtggccgtcagcgtggtgtggggcgtcttccgcaacgaggaccagtgggcctgggtcctccaggatgccctgggcatcgccttctgcctctacatgctgaagaccatccgtctgcccaccttcaaggcctgcacgctgctgctgctggtgctgttcctctacgacatcttcttcgtgttcatcacgcccttcctgaccaagagtgggagcagcatcatggtggaggtggccactgggccctcggactcagccacccgtgagaagctgcccatggtcctgaaggtgcccaggctgaactcctcacctctggccctgtgtgaccggcccttctccctcctgggtttcggagacattttggtgccagggctgctggtggcctactgccacaggtttgacatccaggtacagtcctccagggtatacttcgtggcctgcaccatcgcctatggcgttggcctccttgtgacattcgtggcactggccctgatgcagcgtggccagcccgctctcctctacctggtgccctgcacgctggtgacgagctgcgctgtggcgctctggcgccgggagctgggcgtgttctggacgggcagcggctttgcgaaagtcctacctccatctccgtgggccccagcaccagccgacggcccgcagcctcccaaagactctgccacgccactctccccgcagccgcccagcgaagaaccagccacatccccctggcctgctgagcagtccccaaaatcacgcacgtccgaggagatgggggctggagcccccatgcgggagcctgggagcccagctgaatccgagggccgggaccaggcccagccgtccccggtaacccagcctggcgcctcggcctaggggaggggtgagacgctcgctgccgtgcccgccacaccaagatgttggggctgcctggcgcccactggagacagacagacagacgcctgtcccccgggaccgaggcctgtgccgtccccacccgccccaacatggtgctcatccttgccgagacccctgcggtctgtgcccgcgcccagcccagctgccccggctgcacgcctgctgctcccagctcgcccggctgccacaagctctctgcgggtccatcctccccaccggggtccgtcctcgcaggccctgcccggcctctctgcagaccctcaagcgtcgtctgcatgagtgagcaggcgtgggtggactctggccgcggccacacttggtgctcaccagctgcttcggccttcaggtgacctccctccccacggcatcctgctctccgggtggaagagcagctttctgtctcccagaaggcatcgcttttccctcttgagcagatcggagcccctgggaggtttggaagctgcctccaagcctaggacacggaccggtggccggggcggcctctggcccctgacgctggctgagacaggcccgtggggcggggttttggggcgtgaacaaggctggcagtaagtggacaagctgctcccctggctaaggccctgccctgccctcagccagaggtgcctggccatgcctgcacactcctccccattttaataaatggtcgcaacttctagaagtcctgctggtgccacctggtggggtggacgtctctcagactgcccttctgacaagcaggggtgggcgccaggcaggctgggtcaggccctcaggggtccctggagccctgggagggagggactgggtcgtgggaggtcctggtagctcccggcacccaacctcgcttcccgtgtgggccccgtgttgcttttctgctgagaggggcttgggcctcggttctccctgtggcagcggcattggtgcctgggttcttaaccctctggacccagcagctaggagcttctggaacccacgaggacatctgccactggcatggtctactcactgatggggtcctcctgactccagggcagagacgtccgtgcgggaactgaccgaggcgtggccccaggccccggcatcctcccctcgctgcacgtggtcacttccgaagcagcgctccctgtggccgcagagacagagcccgcaccctggctgtctgtggtgcctgggccccagctcccgcccgccacccgccctgttgagtgcggcctccagactcgagtccagaatctgtttctgtcaagtcagtcgtccccagctgcacacggggactgctgagcgctgcgctctcacgggtctgttccggacagagggtggcaggggtgagccctgatcccttacaaaaaataccagcttcccagggagtaatggcgccttcactgaagccattttgtacatggggacggggtggggacgtctcttttttggtgttggacgtttgaccagtggggaggggttcagaggcggcggtcctgtccttggctccgtctgtccgtgtggccttgctgccattccgtctgatcattaaacacagcttttgattaaaaaaaaaggggggcgctaaaaacctgagggcagtacgtccacatttggaaaggcaagagaggaaaaaagggggcgggaaacgcgcggacggacgggctggaagaaccctggggggggaccaaaacggaaaagtgggacctcgcagggtaa

SEQ ID NO: 426946 - DNA, 2443 bp, Homo sapiens
cgaagaggtcaagaaccttgcagaaaagttggccaggttcatagcggacgggggtcccgaggtggaaaccattgccctccagaacaaccgtgagaagctgcccatggtcctgaaggtgcccaggctgaactcctcacctctggccctgtgtgaccggcccttctccctcctgggtttcggagacattttggtgccagggctgctggtggcctactgccacaggtttgacatccaggtacagtcctccagggtatacttcgtggcctgcaccatcgcctatggcgttggcctccttgtgacattcgtggcactggccctgatgcagcgtggccagcccgctctcctctacctggtgccctgcacgctggtgacgagctgcgctgtggcgctctggcgccgggagctgggcgtgttctggacgggcagcggctttgcgaaagtcctacctccatctccgtgggccccagcaccagccgacggcccgcagcctcccaaagactctgccacgccactctccccgcagccgcccagcgaagaaccagccacatccccctggcctgctgagcagtccccaaaatcacgcacgtccgaggagatgggggctggagcccccatgcgggagcctgggagcccagctgaatccgagggccgggaccaggcccagccgtccccggtaacccagcctggcgcctcggcctaggggaggggtgagacgctcgctgccgtgcccgccacaccaagatgttggggctgcctggcgcccactggagacagacagacagacgcctgtcccccgggaccgaggcctgtgccgtccccacccgccccaacatggtgctcatccttgccgagacccctgcggtctgtgcccgcgcccagcccagctgccccggctgcacgcctgctgctcccagctcgcccggctgccacaagctctctgcgggtccatcctccccaccggggtccgtcctcgcaggccctgcccggcctctctgcagaccctcaagcgtcgtctgcatgagtgagcaggcgtgggtggactctggccgcggccacacttggtgctcaccagctgcttcggccttcaggtgacctccctccccacggcatcctgctctccgggtggaagagcagctttctgtctcccagaaggcatcgcttttccctcttgagcagatcggagcccctgggaggtttggaagctgcctccaagcctaggacacggaccggtggccggggcggcctctggcccctgacgctggctgagacaggcccgtggggcggggttttggggcgtgaacaaggctggcagtaagtggacaagctgctcccctggctaaggccctgccctgccctcagccagaggtgcctggccatgcctgcacactcctccccattttaataaatggtcgcaacttctagaagtcctgctggtgccacctggtggggtggacgtctctcagactgcccttctgacaagcaggggtgggcgccaggcaggctgggtcaggccctcaggggtccctggagccctgggagggagggactgggtcgtgggaggtcctggtagctcccggcacccaacctcgcttcccgtgtgggccccgtgttgcttttctgctgagaggggcttgggcctcggttctccctgtggcagcggcattggtgcctgggttcttaaccctctggacccagcagctaggagcttctggaacccacgaggacatctgccactggcatggtctactcactgatggggtcctcctgactccagggcagagacgtccgtgcgggaactgaccgaggcgtggccccaggccccggcatcctcccctcgctgcacgtggtcacttccgaagcagcgctccctgtggccgcagagacagagcccgcaccctggctgtctgtggtgcctgggccccagctcccgcccgccacccgccctgttgagtgcggcctccagactcgagtccagaatctgtttctgtcaagtcagtcgtccccagctgcacacggggactgctgagcgctgcgctctcacgggtctgttccggacagagggtggcaggggtgagccctgatcccttacaaaaaataccagcttcccagggagtaatggcgccttcactgaagccattttgtacatggggacggggtggggacgtctcttttttggtgttggacgtttgaccagtggggaggggttcagaggcggcggtcctgtccttggctccgtctgtccgtgtggccttgctgccattccgtctgatcattaaacacagcttttgattaaaaaaaaaggggggcgctaaaaacctgagggcagtacgtccacatttggaaaggcaagagaggaaaaaagggggcgggaaacgcgcggacggacgggctggaagaaccctggggggggaccaaaacggaaaagtgggacctcgcagggtaa

SEQ ID NO: 426947 - DNA, 2989 bp, Homo sapiens
cggggcgttgctgggaaacatctgccgttggttgcggcgggcaccggccgacatggcggcagcggtggcggctgcgctggcgcggcttttggcggcctttctgctcctcgcggcccaggtggcctgtgagtacggcatggtgcacgtggtctcccaggccgggggccccgaaggcaaagactactgcatcctctacaacccgcagtgggcccatcttccgcacgacctcagcaaggcatctttcctgcagctgcgcaactggacggcctccctgctctgctccgcagccgacctccccgcccgtggcttcagcaaccagatcccgctggtggcgcgggggaactgcaccttctatgagaaagtgaggctggcccagggcagcggagcacgcgggctgctcatcgtcagcagggagaggctggtccccccggggggtaataagacgcagtatgatgagattggcattcccgtggccctgctcagctacaaagacatgctggacatcttcacgcgtttcggccgcacggtgagggcggcgctgtatgcgcctaaggagccggtgctggactacaacatggtcatcatcttcatcatggctgtgggcaccgtcgccatcggcggctactgggccgggagtcgggacgtgaagaaaaggtacatgaagcacaagcgcgacgatgggcccgagaagcaggaggacgaggcggtggacgtgacgccggtgatgacctgcgtgtttgtggtgatgtgctgctccatgctggtgctgctctactatttctacgacctcctcgtgtacgtggtcatcgggatcttctgcctggcctccgccaccggcctctacagctgcctggcgccctgtgtgcggcggctgcccttcggcaagtgcaggatccccaacaacagcctgccctacttccacaagcgcccgcaggcccgtatgctgctcctggcgctcttctgcgtggccgtcagcgtggtgtggggcgtcttccgcaacgaggaccagtgggcctgggtcctccaggatgccctgggcatcgccttctgcctctacatgctgaagaccatccgtctgcccaccttcaaggcctgcacgctgctgctgctggtgctgttcctctacgacatcttcttcgtgttcatcacgcccttcctgaccaagagtgggagcagcatcatggtggaggtggccactgggccctcggactcagccacccgtgagaagctgcccatggtcctgaaggtgcccaggctgaactcctcacctctggccctgtgtgaccggcccttctccctcctgggtttcggagacattttggtgccagggctgctggtggcctactgccacaggtttgacatccaggtacagtcctccagggtatacttcgtggcctgcaccatcgcctatggcgttggcctccttgtgacattcgtggcactggccctgatgcagcgtggccagcccgctctcctctacctggtgccctgcacgctggtgacgagctgcgctgtggcgctctggcgccgggagctgggcgtgttctggacgggcagcggctttgcggtgaataccagtttgctctgactgtgagaaatactcgcctagtgagccctaactagagttaaaaaagtcctacctccatctccgtgggccccagcaccagccgacggcccgcagcctcccaaagactctgccacgccactctccccgcagccgcccagcgaagaaccagccacatccccctggcctgctgagcagtccccaaaatcacgcacgtccgaggagatgggggctggagcccccatgcgggagcctgggagcccagctgaatccgagggccgggaccaggcccagccgtccccggtaacccagccttggctaaggccctgccctgccctcagccagaggtgcctggccatgcctgcacactcctccccattttaataaatggtcgcaacttctagaagtcctgctggtgccacctggtggggtggacgtctctcagactgcccttctgacaagcaggggtgggcgccaggcaggctgggtcaggccctcaggggtccctggagccctgggagggagggactgggtcgtgggaggtcctggtagctcccggcacccaacctcgcttcccgtgtgggccccgtgttgcttttctgctgagaggggcttgggcctcggttctccctgtggcagcggcattggtgcctgggttcttaaccctctggacccagcagctaggagcttctggaacccacgaggacatctgccactggcatggtctactcactgatggggtcctcctgactccagggcagagacgtccgtgcgggaactgaccgaggcgtggccccaggccccggcatcctcccctcgctgcacgtggtcacttccgaagcagcgctccctgtggccgcagagacagagcccgcaccctggctgtctgtggtgcctgggccccagctcccgcccgccacccgccctgttgagtgcggcctccagactcgagtccagaatctgtttctgtcaagtcagtcgtccccagctgcacacggggactgctgagcgctgcgctctcacgggtctgttccggacagagggtggcaggggtgagccctgatcccttacaaaaaataccagcttcccagggagtaatggcgccttcactgaagccattttgtacatggggacggggtggggacgtctcttttttggtgttggacgtttgaccagtggggaggggttcagaggcggcggtcctgtccttggctccgtctgtccgtgtggccttgctgccattccgtctgatcattaaacacagcttttgattaaaaaaaaaggggggcgctaaaaacctgagggcagtacgtccacatttggaaaggcaagagaggaaaaaagggggcgggaaacgcgcggacggacgggctggaagaaccctggggggggaccaaaacggaaaagtgggacctcgcagggtaa

SEQ ID NO: 426948 - DNA, 2941 bp, Homo sapiens
cggggcgttgctgggaaacatctgccgttggttgcggcgggcaccggccgacatggcggcagcggtggcggctgcgctggcgcggcttttggcggcctttctgctcctcgcggcccaggtggcctgtgagtacggcatggtgcacgtggtctcccaggccgggggccccgaaggcaaagactactgcatcctctacaacccgcagtgggcccatcttccgcacgacctcagcaaggcatctttcctgcagctgcgcaactggacggcctccctgctctgctccgcagccgacctccccgcccgtggcttcagcaaccagatcccgctggtggcgcgggggaactgcaccttctatgagaaagtgaggctggcccagggcagcggagcacgcgggctgctcatcgtcagcagggagaggctggtccccccggggggtaataagacgcagtatgatgagattggcattcccgtggccctgctcagctacaaagacatgctggacatcttcacgcgtttcggccgcacggtgagggcggcgctgtatgcgcctaaggagccggtgctggactacaacatggtcatcatcttcatcatggctgtgggcaccgtcgccatcggcggctactgggccgggagtcgggacgtgaagaaaaggtacatgaagcacaagcgcgacgatgggcccgagaagcaggaggacgaggcggtggacgtgacgccggtgatgacctgcgtgtttgtggtgatgtgctgctccatgctggtgctgctctactatttctacgacctcctcgtgtacgtggtcatcgggatcttctgcctggcctccgccaccggcctctacagctgcctggcgccctgtgtgcggcggctgcccttcggcaagtgcaggatccccaacaacagcctgccctacttccacaagcgcccgcaggcccgtatgctgctcctggcgctcttctgcgtggccgtcagcgtggtgtggggcgtcttccgcaacgaggaccagtgggcctgggtcctccaggatgccctgggcatcgccttctgcctctacatgctgaagaccatccgtctgcccaccttcaaggcctgcacgctgctgctgctggtgctgttcctctacgacatcttcttcgtgttcatcacgcccttcctgaccaagagtgggagcagcatcatggtggaggtggccactgggccctcggactcagccacccgtgagaagctgcccatggtcctgaaggtgcccaggctgaactcctcacctctggccctgtgtgaccggcccttctccctcctgggtttcggagacattttggtgccagggctgctggtggcctactgccacaggtttgacatccaggtacagtcctccagggtatacttcgtggcctgcaccatcgcctatggcgttggcctccttgtgacattcgtggcactggccctgatgcagcgtggccagcccgctctcctctacctggtgccctgcacgctggtgacgagctgcgctgtggcgctctggcgccgggagctgggcgtgttctggacgggcagcggctttgcgaaagtcctacctccatctccgtgggccccagcaccagccgacggcccgcagcctcccaaagactctgccacgccactctccccgcagccgcccagcgaagaaccagccacatccccctggcctgctgagcagtccccaaaatcacgcacgtccgaggagatgggggctggagcccccatgcgggagcctgggagcccagctgaatccgagggccgggaccaggcccagccgtccccggtaacccagcctggcgcctcggcctaggggaggggtgagacgctcgctgccgtgcccgccacaccaagatgttggggctgcctggcgcccactggagacagacagacagacgcctgtcccccgggaccgaggcctgtgccgtccccacccgccccaacatggtgctcatccttgccgagacccctgcggtctgtgcccgcgcccagcccagctgccccggctgcacgcctgctgctcccagctcgcccggctgccacaagctctctgcgggtccatcctccccaccggggtccgtcctcgcaggccctgcccggcctctctgcagaccctcaagcgtcgtctgcatgagtgagcaggcgtgggtggactctggccgcggccacacttggtgctcaccagctgcttcggccttcaggtgacctccctccccacggcatcctgctctccgggtggaagagcagctttctgtctcccagaaggcatcgcttttccctcttgagcagatcggagcccctgggaggtttggaagctgcctccaagcctaggacacggaccggtggccggggcggcctctggcccctgacgctggctgagacaggcccgtggggcggggttttggggcgtgaacaaggctggcagtaagtggacaagctgctcccctggctaaggccctgccctgccctcagccagaggtgcctggccatgcctgcacactcctccccattttaataaatggtcgcaaccttcaaaaaaagaaaagaagcgacaagcaacaaacagcagagagactcacacacgacaacgcaaacagacacacagaagacaagacaaaaacgaacagggggccgggcgagccaaaaagaaaaccacgcaggcgggagcggcagacagacgcgagcagcacacccaagcacaactgcacagaaaaaagagacggcacaccaaaaagcagcgaagcagaaagagaaaaaaacagacagacaggaacgaaggcccacaaagacgaacaaaacaccgcaccaacggcgagcgagaacacacaagggccagcagaggagggaacaagcgaaagcagagagagcgcccaacaacacggggggaacggcgaccaacaccgcaggaccaacacacacagaa

SEQ ID NO: 426949 - DNA, 2191 bp, Homo sapiens
cggggcgttgctgggaaacatctgccgttggttgcggcgggcaccggccgacatggcggcagcggtggcggctgcgctggcgcggcttttggcggcctttctgctcctcgcggcccaggtggcctgtgagtacggcatggtgcacgtggtctcccaggccgggggccccgaaggcaaagactactgcatcctctacaacccgcagtgggcccatcttccgcacgacctcagcaaggcatctttcctgcagctgcgcaactggacggcctccctgctctgctccgcagccgacctccccgcccgtggcttcagcaaccagatcccgctggtggcgcgggggaactgcaccttctatgagaaagtgaggctggcccagggcagcggagcacgcgggctgctcatcgtcagcagggagaggctggtccccccggggggtaataagacgcagtatgatgagattggcattcccgtggccctgctcagctacaaagacatgctggacatcttcacgcgtttcggccgcacggtgagggcggcgctgtatgcgcctaaggagccggtgctggactacaacatggtcatcatcttcatcatggctgtgggcaccgtcgccatcggcggctactgggccgggagtcgggacgtgaagaaaaggtacatgaagcacaagcgcgacgatgggcccgagaagcaggaggacgaggcggtggacgtgacgccggtgatgacctgcgtgtttgtggtgatgtgctgctccatgctggtgctgctctactatttctacgacctcctcgtgtacgtggtcatcgggatcttctgcctggcctccgccaccggcctctacagctgcctggcgccctgtgtgcggcggctgcccttcggcaagtgcaggatccccaacaacagcctgccctacttccacaagcgcccgcaggcccgtatgctgctcctggcgctcttctgcgtggccgtcagcgtggtgtggggcgtcttccgcaacgaggaccagtgggcctgggtcctccaggatgccctgggcatcgccttctgcctctacatgctgaagaccatccgtctgcccaccttcaaggcctgcacgctgctgctgctggtgctgttcctctacgacatcttcttcgtgttcatcacgcccttcctgaccaagagtgggagcagcatcatggtggaggtggccactgggccctcggactcagccacccgtgagaagctgcccatggtcctgaaggtgcccaggctgaactcctcacctctggccctgtgtgaccggcccttctccctcctgggtttcggagacattttggtgccagggctgctggtggcctactgccacaggtttgacatccaggtacagtcctccagggtatacttcgtggcctgcaccatcgcctatggcgttggcctccttgtgacattcgtggcactggccctgatgcagcgtggccagcccgctctcctctacctggtgccctgcacgctggtgacgagctgcgctgtggcgctctggcgccgggagctgggcgtgttctggacgggcagcggctttgcgaaagtcctacctccatctccgtgggccccagcaccagccgacggcccgcagcctcccgcagagacagagcccgcaccctggctgtctgtggtgcctgggccccagctcccgcccgccacccgccctgttgagtgcggcctccagactcgagtccagaatctgtttctgtcaagtcagtcgtccccagctgcacacggggactgctgagcgctgcgctctcacgggtctgttccggacagagggtggcaggggtgagccctgatcccttacaaaaaataccagcttcccagggagtaatggcgccttcactgaagccattttgtacatggggacggggtggggacgtctcttttttggtgttggacgtttgaccagtggggaggggttcagaggcggcggtcctgtccttggctccgtctgtccgtgtggccttgctgccattccgtctgatcattaaacacagcttttgattaaaaaaaaaggggggcgctaaaaacctgagggcagtacgtccacatttggaaaggcaagagaggaaaaaagggggcgggaaacgcgcggacggacgggctggaagaaccctggggggggaccaaaacggaaaagtgggacctcgcagggtaa

SEQ ID NO: 426950 - DNA, 117 bp, Homo sapiens
tggcctactgccacaggtttgacatccaggtacagtcctccagggtatacttcgtggcctgcaccatcggtaagtgcctcggttgggcccgtgctggcctctctggctccagcccca

SEQ ID NO: 426951 - DNA, 2795 bp, Homo sapiens
tataaaagctgggccggcgcgggccgggccattcgcgacccggaggtgcgcgggcgcgggcgagcagggtctccgggtgggcggcggcgacgccccgcgcaggctggaggccgccgaggctcgccatgccgggagaactctaactcccccatggagtcggccgacttctacgaggcggagccgcggcccccgatgagcagccacctgcagagccccccgcacgcgcccagcagcgccgccttcggctttccccggggcgcgggccccgcgcagcctcccgccccacctgccgccccggagccgctgggcggcatctgcgagcacgagacgtccatcgacatcagcgcctacatcgacccggccgccttcaacgacgagttcctggccgacctgttccagcacagccggcagcaggagaaggccaaggcggccgtgggccccacgggcggcggcggcggcggcgactttgactacccgggcgcgcccgcgggccccggcggcgccgtcatgcccgggggagcgcacgggcccccgcccggctacggctgcgcggccgccggctacctggacggcaggctggagcccctgtacgagcgcgtcggggcgccggcgctgcggccgctggtgatcaagcaggagccccgcgaggaggatgaagccaagcagctggcgctggccggcctcttcccttaccagccgccgccgccgccgccgccctcgcacccgcacccgcacccgccgcccgcgcacctggccgccccgcacctgcagttccagatcgcgcactgcggccagaccaccatgcacctgcagcccggtcaccccacgccgccgcccacgcccgtgcccagcccgcaccccgcgcccgcgctcggtgccgccggcctgccgggccctggcagcgcgctcaaggggctgggcgccgcgcaccccgacctccgcgcgagtggcggcagcggcgcgggcaaggccaagaagtcggtggacaagaacagcaacgagtaccgggtgcggcgcgagcgcaacaacatcgcggtgcgcaagagccgcgacaaggccaagcagcgcaacgtggagacgcagcagaaggtgctggagctgaccagtgacaatgaccgcctgcgcaagcgggtggaacagctgagccgcgaactggacacgctgcggggcatcttccgccagctgccagagagctccttggtcaaggccatgggcaactgcgcgtgaggcgcgcggctgtgggaccgccctgggccagcctccggcggggacccagggagtggtttggggtcgccggatctcgaggcttgcccgagccgtgcgagccaggactaggagattccggtgcctcctgaaagcctggcctgctccgcgtgtcccctcccttcctctgcgccggacttggtgcgtctaagatgagggggccaggcggtggcttctccctgcgaggaggggagaattcttggggctgagctgggagcccggcaactctagtatttaggataaccttggccttggaaatgcaaactcaccgctccaatgcctactgagtagggggagcaaatcgtgccttgtcattttatttggaggtttcctgcctccttcccgaggctacagcagacccccatgagagaaggaggggagcaggcccgtggcaggaggagggctcagggagctgagatcccgacaagcccgccagccccagccgctcctccacgcctgtccttagaaaggggtggaaacatagggacttggggcttggaacctaaggttgttcccctagttctacatgaaggtggagggtctctagttccacgcctctcccacctccctccgcacacaccccaccccagcctgctataggctgggcttccccttggggcggaactcactgcgatgggggtcaccaggtgaccagtgggagcccccaccccgagtcacaccagaaagctaggtcgtgggtcagctctgaggatgtatacccctggtgggagagggagacctagagatctggctgtggggcgggcatggggggtgaagggccactgggaccctcagccttgtttgtactgtatgccttcagcattgcctaggaacacgaagcacgatcagtccatcccagagggaccggagttatgacaagctttccaaatattttgctttatcagccgatatcaacacttgtatctggcctctgtgccccagcagtgccttgtgcaatgtgaatgtgcgcgtctctgctaaaccaccattttatttggtttttgttttgttttggttttgctcggatacttgccaaaatgagactctccgtcggcagctgggggaagggtctgagactccctttccttttggttttgggattacttttgatcctgggggaccaatgaggtgaggggggttctcctttgccctcagctttccccagcccctccggcctgggctgcccacaaggcttgtcccccagaggccctggctcctggtcgggaagggaggtggcctcccgccaacgcatcactggggctgggagcagggaaggacggcttggttctcttcttttggggagaacgtagagtctcactctagatgttttatgtattatatctataatataaacatatcaaagtcaatgtcggtgtctttttaaaaccagaaagaagctacttccaaggttgtctgtgggccaggtcacatttgtaaataatacagcattttccctggcggcaatcctgactttcatgagctctccatccatcctgagcccctcttaccctaagggggtgacttacttcccc

SEQ ID NO: 426952 - DNA, 2708 bp, Homo sapiens
ctgcaggtggctgctcatcgggggccgcggctccgcctcgtagaagtcggccgactccatgggggagttagagttctcccggcatggcgagccctggcgcctccagcctgcgcggggcgtcgccgccgcccacccggagaccctgctcgcccgcgcccgcgcacctccgggtcgccgcccgcgcagcctcccgccccacctgccgccccggagccgctgggcggcatctgcgagcacgagacgtccatcgacatcagcgcctacatcgacccggccgccttcaacgacgagttcctggccgacctgttccagcacagccggcagcaggagaaggccaaggcggccgtgggccccacgggcggcggcggcggcggcgactttgactacccgggcgcgcccgcgggccccggcggcgccgtcatgcccgggggagcgcacgggcccccgcccggctacggctgcgcggccgccggctacctggacggcaggctggagcccctgtacgagcgcgtcggggcgccggcgctgcggccgctggtgatcaagcaggagccccgcgaggaggatgaagccaagcagctggcgctggccggcctcttcccttaccagccgccgccgccgccgccgccctcgcacccgcacccgcacccgccgcccgcgcacctggccgccccgcacctgcagttccagatcgcgcactgcggccagaccaccatgcacctgcagcccggtcaccccacgccgccgcccacgcccgtgcccagcccgcaccccgcgcccgcgctcggtgccgccggcctgccgggccctggcagcgcgctcaaggggctgggcgccgcgcaccccgacctccgcgcgagtggcggcagcggcgcgggcaaggccaagaagtcggtggacaagaacagcaacgagtaccgggtgcggcgcgagcgcaacaacatcgcggtgcgcaagagccgcgacaaggccaagcagcgcaacgtggagacgcagcagaaggtgctggagctgaccagtgacaatgaccgcctgcgcaagcgggtggaacagctgagccgcgaactggacacgctgcggggcatcttccgccagctgccagagagctccttggtcaaggccatgggcaactgcgcgtgaggcgcgcggctgtgggaccgccctgggccagcctccggcggggacccagggagtggtttggggtcgccggatctcgaggcttgcccgagccgtgcgagccaggactaggagattccggtgcctcctgaaagcctggcctgctccgcgtgtcccctcccttcctctgcgccggacttggtgcgtctaagatgagggggccaggcggtggcttctccctgcgaggaggggagaattcttggggctgagctgggagcccggcaactctagtatttaggataaccttggccttggaaatgcaaactcaccgctccaatgcctactgagtagggggagcaaatcgtgccttgtcattttatttggaggtttcctgcctccttcccgaggctacagcagacccccatgagagaaggaggggagcaggcccgtggcaggaggagggctcagggagctgagatcccgacaagcccgccagccccagccgctcctccacgcctgtccttagaaaggggtggaaacatagggacttggggcttggaacctaaggttgttcccctagttctacatgaaggtggagggtctctagttccacgcctctcccacctccctccgcacacaccccaccccagcctgctataggctgggcttccccttggggcggaactcactgcgatgggggtcaccaggtgaccagtgggagcccccaccccgagtcacaccagaaagctaggtcgtgggtcagctctgaggatgtatacccctggtgggagagggagacctagagatctggctgtggggcgggcatggggggtgaagggccactgggaccctcagccttgtttgtactgtatgccttcagcattgcctaggaacacgaagcacgatcagtccatcccagagggaccggagttatgacaagctttccaaatattttgctttatcagccgatatcaacacttgtatctggcctctgtgccccagcagtgccttgtgcaatgtgaatgtgcgcgtctctgctaaaccaccattttatttggtttttgttttgttttggttttgctcggatacttgccaaaatgagactctccgtcggcagctgggggaagggtctgagactccctttccttttggttttgggattacttttgatcctgggggaccaatgaggtgaggggggttctcctttgccctcagctttccccagcccctccggcctgggctgcccacaaggcttgtcccccagaggccctggctcctggtcgggaagggaggtggcctcccgccaacgcatcactggggctgggagcagggaaggacggcttggttctcttcttttggggagaacgtagagtctcactctagatgttttatgtattatatctataatataaacatatcaaagtcaatgtcggtgtctttttaaaaccagaaagaagctacttccaaggttgtctgtgggccaggtcacatttgtaaataatacagcattttccctggcggcaatcctgactttcatgagctctccatccatcctgagcccctcttaccctaagggggtgacttacttcccc

SEQ ID NO: 426953 - DNA, 2615 bp, Homo sapiens
tataaaagctgggccggcgcgggccgggccattcgcgacccggaggtgcgcgggcgcgggcgagcagggtctccgggtgggcggcggcgacgccccgcgcaggctggaggccgccgaggctcgccatgccgggagaactctaactcccccatggagtcggccgacttctacgaggcggagccgcggcccccgatgagcagccacctgcagagccccccgcacgcgcccagcagcgccgccttcggctttccccggggcgcgggccccgcgcagcctcccgccccacctgccgccccggagccgctgggcggcatctgcgagcacgagacgtccatcgacatcagcgcctacatcgacccggccgccttcaacgacgagttcctggccgacctgttccagcacagccggcagcaggagaaggccaaggcggccgtgggccccacgggcggcggcggcggcggcgactttgactacccgggcgcgcccgcgggccccggcggcgccgtcatgcccgggggagcgcacgggcccccgcccggctacggctgcgcggccgccggctacctggacggcaggctggagcccctgtacgagcgcgtcggggcgccggcgctgcggccgctggtgatcaagcaggagccccgcgaggaggatgaagccaagcagctggcgctggccggcctcttcccttaccagccgccgccgccgccgccgccctcgcacccgcacccgcacccgccgcccgcgcaccccgacctccgcgcgagtggcggcagcggcgcgggcaaggccaagaagtcggtggacaagaacagcaacgagtaccgggtgcggcgcgagcgcaacaacatcgcggtgcgcaagagccgcgacaaggccaagcagcgcaacgtggagacgcagcagaaggtgctggagctgaccagtgacaatgaccgcctgcgcaagcgggtggaacagctgagccgcgaactggacacgctgcggggcatcttccgccagctgccagagagctccttggtcaaggccatgggcaactgcgcgtgaggcgcgcggctgtgggaccgccctgggccagcctccggcggggacccagggagtggtttggggtcgccggatctcgaggcttgcccgagccgtgcgagccaggactaggagattccggtgcctcctgaaagcctggcctgctccgcgtgtcccctcccttcctctgcgccggacttggtgcgtctaagatgagggggccaggcggtggcttctccctgcgaggaggggagaattcttggggctgagctgggagcccggcaactctagtatttaggataaccttggccttggaaatgcaaactcaccgctccaatgcctactgagtagggggagcaaatcgtgccttgtcattttatttggaggtttcctgcctccttcccgaggctacagcagacccccatgagagaaggaggggagcaggcccgtggcaggaggagggctcagggagctgagatcccgacaagcccgccagccccagccgctcctccacgcctgtccttagaaaggggtggaaacatagggacttggggcttggaacctaaggttgttcccctagttctacatgaaggtggagggtctctagttccacgcctctcccacctccctccgcacacaccccaccccagcctgctataggctgggcttccccttggggcggaactcactgcgatgggggtcaccaggtgaccagtgggagcccccaccccgagtcacaccagaaagctaggtcgtgggtcagctctgaggatgtatacccctggtgggagagggagacctagagatctggctgtggggcgggcatggggggtgaagggccactgggaccctcagccttgtttgtactgtatgccttcagcattgcctaggaacacgaagcacgatcagtccatcccagagggaccggagttatgacaagctttccaaatattttgctttatcagccgatatcaacacttgtatctggcctctgtgccccagcagtgccttgtgcaatgtgaatgtgcgcgtctctgctaaaccaccattttatttggtttttgttttgttttggttttgctcggatacttgccaaaatgagactctccgtcggcagctgggggaagggtctgagactccctttccttttggttttgggattacttttgatcctgggggaccaatgaggtgaggggggttctcctttgccctcagctttccccagcccctccggcctgggctgcccacaaggcttgtcccccagaggccctggctcctggtcgggaagggaggtggcctcccgccaacgcatcactggggctgggagcagggaaggacggcttggttctcttcttttggggagaacgtagagtctcactctagatgttttatgtattatatctataatataaacatatcaaagtcaatgtcggtgtctttttaaaaccagaaagaagctacttccaaggttgtctgtgggccaggtcacatttgtaaataatacagcattttccctggcggcaatcctgactttcatgagctctccatccatcctgagcccctcttaccctaagggggtgacttacttcccc

SEQ ID NO: 426954 - DNA, 1781 bp, Homo sapiens
atgctgcagtgatctaaggatcccttgcatatggccgacaaggccaagcagcgcaacgtggagacgcagcagaaggtgctggagctgaccagtgacaatgaccgcctgcgcaagcgggtggaacagctgagccgcgaactggacacgctgcggggcatcttccgccagctgccagagagctccttggtcaaggccatgggcaactgcgcgtgaggcgcgcggctgtgggaccgccctgggccagcctccggcggggacccagggagtggtttggggtcgccggatctcgaggcttgcccgagccgtgcgagccaggactaggagattccggtgcctcctgaaagcctggcctgctccgcgtgtcccctcccttcctctgcgccggacttggtgcgtctaagatgagggggccaggcggtggcttctccctgcgaggaggggagaattcttggggctgagctgggagcccggcaactctagtatttaggataaccttggccttggaaatgcaaactcaccgctccaatgcctactgagtagggggagcaaatcgtgccttgtcattttatttggaggtttcctgcctccttcccgaggctacagcagacccccatgagagaaggaggggagcaggcccgtggcaggaggagggctcagggagctgagatcccgacaagcccgccagccccagccgctcctccacgcctgtccttagaaaggggtggaaacatagggacttggggcttggaacctaaggttgttcccctagttctacatgaaggtggagggtctctagttccacgcctctcccacctccctccgcacacaccccaccccagcctgctataggctgggcttccccttggggcggaactcactgcgatgggggtcaccaggtgaccagtgggagcccccaccccgagtcacaccagaaagctaggtcgtgggtcagctctgaggatgtatacccctggtgggagagggagacctagagatctggctgtggggcgggcatggggggtgaagggccactgggaccctcagccttgtttgtactgtatgccttcagcattgcctaggaacacgaagcacgatcagtccatcccagagggaccggagttatgacaagctttccaaatattttgctttatcagccgatatcaacacttgtatctggcctctgtgccccagcagtgccttgtgcaatgtgaatgtgcgcgtctctgctaaaccaccattttatttggtttttgttttgttttggttttgctcggatacttgccaaaatgagactctccgtcggcagctgggggaagggtctgagactccctttccttttggttttgggattacttttgatcctgggggaccaatgaggtgaggggggttctcctttgccctcagctttccccagcccctccggcctgggctgcccacaaggcttgtcccccagaggccctggctcctggtcgggaagggaggtggcctcccgccaacgcatcactggggctgggagcagggaaggacggcttggttctcttcttttggggagaacgtagagtctcactctagatgttttatgtattatatctataatataaacatatcaaagtcaatgtcggtgtctttttaaaaccagaaagaagctacttccaaggttgtctgtgggccaggtcacatttgtaaataatacagcattttccctggcggcaatcctgactttcatgagctctccatccatcctgagcccctcttaccctaagggggtgacttacttcccc

SEQ ID NO: 426955 - DNA, 1811 bp, Homo sapiens
tcgatctacaggatcccttcatatgctaatgttgcttggcctttccatatgcaattgcatatggccgacaaggccaagcagcgcaacgtggagacgcagcagaaggtgctggagctgaccagtgacaatgaccgcctgcgcaagcgggtggaacagctgagccgcgaactggacacgctgcggggcatcttccgccagctgccagagagctccttggtcaaggccatgggcaactgcgcgtgaggcgcgcggctgtgggaccgccctgggccagcctccggcggggacccagggagtggtttggggtcgccggatctcgaggcttgcccgagccgtgcgagccaggactaggagattccggtgcctcctgaaagcctggcctgctccgcgtgtcccctcccttcctctgcgccggacttggtgcgtctaagatgagggggccaggcggtggcttctccctgcgaggaggggagaattcttggggctgagctgggagcccggcaactctagtatttaggataaccttggccttggaaatgcaaactcaccgctccaatgcctactgagtagggggagcaaatcgtgccttgtcattttatttggaggtttcctgcctccttcccgaggctacagcagacccccatgagagaaggaggggagcaggcccgtggcaggaggagggctcagggagctgagatcccgacaagcccgccagccccagccgctcctccacgcctgtccttagaaaggggtggaaacatagggacttggggcttggaacctaaggttgttcccctagttctacatgaaggtggagggtctctagttccacgcctctcccacctccctccgcacacaccccaccccagcctgctataggctgggcttccccttggggcggaactcactgcgatgggggtcaccaggtgaccagtgggagcccccaccccgagtcacaccagaaagctaggtcgtgggtcagctctgaggatgtatacccctggtgggagagggagacctagagatctggctgtggggcgggcatggggggtgaagggccactgggaccctcagccttgtttgtactgtatgccttcagcattgcctaggaacacgaagcacgatcagtccatcccagagggaccggagttatgacaagctttccaaatattttgctttatcagccgatatcaacacttgtatctggcctctgtgccccagcagtgccttgtgcaatgtgaatgtgcgcgtctctgctaaaccaccattttatttggtttttgttttgttttggttttgctcggatacttgccaaaatgagactctccgtcggcagctgggggaagggtctgagactccctttccttttggttttgggattacttttgatcctgggggaccaatgaggtgaggggggttctcctttgccctcagctttccccagcccctccggcctgggctgcccacaaggcttgtcccccagaggccctggctcctggtcgggaagggaggtggcctcccgccaacgcatcactggggctgggagcagggaaggacggcttggttctcttcttttggggagaacgtagagtctcactctagatgttttatgtattatatctataatataaacatatcaaagtcaatgtcggtgtctttttaaaaccagaaagaagctacttccaaggttgtctgtgggccaggtcacatttgtaaataatacagcattttccctggcggcaatcctgactttcatgagctctccatccatcctgagcccctcttaccctaagggggtgacttacttcccc

SEQ ID NO: 426956 - DNA, 2629 bp, Homo sapiens
tataaaagctgggccggcgcgggccgggccattcgcgacccggaggtgcgcgggcgcgggcgagcagggtctccgggtgggcggcggcgacgccccgcgcaggctggaggccgccgaggctcgccatgccgggagaactctaactcccccatggagtcggccgacttctacgaggcggagccgcggcccccgatgagcagccacctgcagagccccccgcacgcgcccagcagcgccgccttcggctttccccggggcgcgggccccgcgcagcctcccgccccacctgccgccccggagccgctgggcggcatctgcgagcacgagacgtccatcgacatcagcgcctacatcgacccggccgccttcaacgacgagttcctggccgacctgttccagcacagccggcagcaggagaaggccaaggcggccgtgggccccacgggcggcggcggcggcggcgactttgactacccgggcgcgcccgcgggccccggcggcgccgtcatgcccgggggagcgcacgggcccccgcccggctacggctgcgcggccgccggctacctggacggcaggctggagcccctgtacgagcgcgtcggggcgccggcgctgcggccgctggtgatcaagcaggagccccgcgaggaggatgaagccaagcagctggcgctggccggcctcttcccttaccagccgccgccgccgccgccgccctcgcacccgcacccgcacccgccgcccgcgcacctggccgccccgcacctgcagttccagatcgcgcactgcggccagaccaccatgcacctgcagcccggtcaccccacgccgccgcccacgcccgtgcccagcccgcaccccgcgcccgcgctcggtgccgccggcctgccgggccctggcagcgcgctcaaggggctgggcgccgcgcaccccgacctccgcgcgagtggcggcagcggcgcgggcaaggccaagaagtcggtggacaagaacagcaacgagtaccgggtgcggcgcgagcgcaacaacatcgcggtgcgcaagagccgcgacaaggccaagcagcgcaacgtggagacgcagcagaaggtgctggagctgaccagtgacaatgaccgcctgcgcaagcgggtggaacagctgagccgcgaactggacacgctgcggggcatcttccgccagctgccagagagctccttggtcaaggccatgggcaactgcgcgtgaggcgcgcggctgtgggaccgccctgggccagcctccggcggggacccagggagtggtttggggtcgccggatctcgaggcttgcccgagccgtgcgagccaggactaggagattccggtgcctcctgaaagcctggcctgctccgcgtgtcccctcccttcctctgcgccggacttggtgcgtctaagatgagggggccaggcggtggcttctccctgcgaggaggggagaattcttggggctgagctgggagcccggcaactctagtatttaggataaccttggccttggaaatgcaaactcaccgctccaatgcctactgagtagggggagcaaatcgtgccttgtcattttatttggaggtttcctgcctccttcccgaggctacagcagacccccatgagagaaggaggggagcaggcccgtggcaggaggagggctcagggagctgagatcccgacaagcccgccagccccagccgctcctccacgcctgtccttagaaaggggtggaaacatagggacttggggcttggaacctaaggttgttcccctagttctacatgaaggtggagggtctctagttccacgcctctcccacctccctccgcacacaccccaccccagcctgctataggctgggcttccccttggggcggaactcagccttgtttgtactgtatgccttcagcattgcctaggaacacgaagcacgatcagtccatcccagagggaccggagttatgacaagctttccaaatattttgctttatcagccgatatcaacacttgtatctggcctctgtgccccagcagtgccttgtgcaatgtgaatgtgcgcgtctctgctaaaccaccattttatttggtttttgttttgttttggttttgctcggatacttgccaaaatgagactctccgtcggcagctgggggaagggtctgagactccctttccttttggttttgggattacttttgatcctgggggaccaatgaggtgaggggggttctcctttgccctcagctttccccagcccctccggcctgggctgcccacaaggcttgtcccccagaggccctggctcctggtcgggaagggaggtggcctcccgccaacgcatcactggggctgggagcagggaaggacggcttggttctcttcttttggggagaacgtagagtctcactctagatgttttatgtattatatctataatataaacatatcaaagtcaatgtcggtgtctttttaaaaccagaaagaagctacttccaaggttgtctgtgggccaggtcacatttgtaaataatacagcattttccctggcggcaatcctgactttcatgagctctccatccatcctgagcccctcttaccctaagggggtgacttacttcccc

SEQ ID NO: 426957 - DNA, 2748 bp, Homo sapiens
tataaaagctgggccggcgcgggccgggccattcgcgacccggaggtgcgcgggcgcgggcgagcagggtctccgggtgggcggcggcgacgccccgcgcaggctggaggccgccgaggctcgccatgccgggagaactctaactcccccatggagtcggccgacttctacgaggcggagccgcggcccccgatgagcagccacctgcagagccccccgcacgcgcccagcagcgccgccttcggctttccccggggcgcgggccccgcgcagcctcccgccccacctgccgccccggagccgctgggcggcatctgcgagcacgagacgtccatcgacatcagcgcctacatcgacccggccgccttcaacgacgagttcctggccgacctgttccagcacagccggcagcaggagaaggccaaggcggccgtgggccccacgggcggcggcggcggcggcgactttgactacccgggcgcgcccgcgggccccggcggcgccgtcatgcccgggggagcgcacgggcccccgcccggctacggctgcgcggccgccggctacctggacggcaggctggagcccctgtacgagcgcgtcggggcgccggcgctgcggccgctggtgatcaagcaggagccccgcgaggaggatgaagccaagcagctggcgctggccggcctcttcccttaccagccgccgccgccgccgccgccctcgcacccgcacccgcacccgccgcccgcgcacctggccgccccgcacctgcagttccagatcgcgcactgcggccagaccaccatgcacctgcagcccggtcaccccacgccgccgcccacgcccgtgcccagcccgcaccccgcgcccgcgctcggtgccgccggcctgccgggccctggcagcgcgctcaaggggctgggcgccgcgcaccccgacctccgcgcgagtggcggcagcggcgcgggcaaggccaagaagtcggtggacaagaacagcaacgagtaccgggtgcggcgcgagcgcaacaacatcgcggtgcgcaagagccgcgacaaggccaagcagcgcaacgtggagacgcagcagaaggtgctggagctgaccagtgacaatgaccgcctgcgcaagcgggtggaacagctgagccgcgaactggacacgctgcggggcatcttccgccagctgccagagagctccttggtcaaggccatgggcaactgcgcgtgaggcgcgcggctgtgggaccgccctgggccagcctccggcggggacccagggagtggtttggggtcgccggatctcgaggcttgcccgagccgtgcgagccaggactaggagattccggtgcctcctgaaagcctggcctgctccgcgtgtcccctcccttcctctgcgccggacttggtgcgtctaagatgagggggccaggcggtggcttctccctgcgaggaggggagaattcttggggctgagctgggagcccggcaactctagtatttaggataaccttggccttggaaatgcaaactcaccgctccaatgcctactgagtagggggagcaaatcgtgccttgtcattttatttggaggtttcctgcctccttcccgaggctacagcagacccccatgagagaaggaggggagcaggcccgtggcaggaggagggctcagggagctgagatcccgacaagcccgccagccccagccgctcctccacgcctgtccttagaaaggggtggaaacatagggacttggggcttggaacctaaggttgttcccctagttctacatgaaggtggagggtctctagttccacgcctctcccacctccctccgcacacaccccaccccagcctgctataggctgggcttccccttggggcggaactcactgcgatgggggtcaccaggtgaccagtgggagcccccaccccgagtcacaccagaaagctaggtcgtgggtcagctctgaggatgtatacccctggtgggagagggagacctagagatctggctgtggggcgggcatggggggtgaagggccactgggaccctcagccttgtttgtactgtatgccttcagcattgcctaggaacacgaagcacgatcagtccatcccagagggaccggagttatgacaagctttccaaatattttgctttatcagccgatatcaacacttgtatctggcctctgtgccccagcagtgccttgtgcaatgtgaatgtgcgcgtctctgctaaaccaccattttatttggtttttgttttgttttggttttgctcggatacttgccaaaatgattggttttgggattacttttgatcctgggggaccaatgaggtgaggggggttctcctttgccctcagctttccccagcccctccggcctgggctgcccacaaggcttgtcccccagaggccctggctcctggtcgggaagggaggtggcctcccgccaacgcatcactggggctgggagcagggaaggacggcttggttctcttcttttggggagaacgtagagtctcactctagatgttttatgtattatatctataatataaacatatcaaagtcaatgtcggtgtctttttaaaaccagaaagaagctacttccaaggttgtctgtgggccaggtcacatttgtaaataatacagcattttccctggcggcaatcctgactttcatgagctctccatccatcctgagcccctcttaccctaagggggtgacttacttcccc

SEQ ID NO: 426958 - DNA, 2687 bp, Homo sapiens
tataaaagctgggccggcgcgggccgggccattcgcgacccggaggtgcgcgggcgcgggcgagcagggtctccgggtgggcggcggcgacgccccgcgcaggctggaggccgccgaggctcgccatgccgggagaactctaactcccccatggagtcggccgacttctacgaggcggagccgcggcccccgatgagcagccacctgcagagccccccgcacgcgcccagcagcgccgccttcggctttccccggggcgcgggccccgcgcagcctcccgccccacctgccgccccggagccgctgggcggcatctgcgagcacgagacgtccatcgacatcagcgcctacatcgacccggccgccttcaacgacgagttcctggccgacctgttccagcacagccggcagcaggagaaggccaaggcggccgtgggccccacgggcggcggcggcggcggcgactttgactacccgggcgcgcccgcgggccccggcggcgccgtcatgcccgggggagcgcacgggcccccgcccggctacggctgcgcggccgccggctacctggacggcaggctggagcccctgtacgagcgcgtcggggcgccggcgctgcggccgctggtgatcaagcaggagccccgcgaggaggatgaagccaagcagctggcgctggccggcctcttcccttaccagccgccgccgccgccgccgccctcgcacccgcacccgcacccgccgcccgcgcacctggccgccccgcacctgcagttccagatcgcgcactgcggccagaccaccatgcacctgcagcccggtcaccccacgccgccgcccacgcccgtgcccagcccgcaccccgcgcccgcgctcggtgccgccggcctgccgggccctggcagcgcgctcaaggggctgggcgccgcgcaccccgacctccgcgcgagtggcggcagcggcgcgggcaaggccaagaagtcggtggacaagaacagcaacgagtaccgggtgcggcgcgagcgcaacaacatcgcggtgcgcaagagccgcgacaaggccaagcagcgcaacgtggagacgcagcagaaggtgctggagctgaccagtgacaatgaccgcctgcgcaagcgggtggaacagctgagccgcgaactggacacgctgcggggcatcttccgccagctgccagagagctccttggtcaaggccatgggcaactgcgcgtgaggcgcgcggctgtgggaccgccctgggccagcctccggcggggacccagggagtggtttggggtcgccggatctcgaggcttgcccgagccgtgcgagccaggactaggagattccggtgcctcctgaaagcctggcctgctccgcgtgtcccctcccttcctctgcgccggacttggtgcgtctaagatgagggggccaggcggtggcttctccctgcgaggaggggagaattcttggggctgagctgggagcccggcaactctagtatttaggataaccttggccttggaaatgcaaactcaccgctccaatgcctactgagtagggggagcaaatcgtgccttgtcattttatttggaggtttcctgcctccttcccgaggctacagcagacccccatgagagaaggaggggagcaggcccgtggcaggaggagggctcagggagctgagatcccgacaagcccgccagccccagccgctcctccacgcctgtccttagaaaggggtggaaacatagggacttggggcttggaacctaaggttgttcccctagttctacatgaaggtggagggtctctagttccacgcctctcccacctccctccgcacacaccccaccccagcctgctataggctgggcttccccttggggcggaactcactgcgatgggggtcaccaggtgaccagtgggagcccccaccccgagtcacaccagaaagctaggtcgtgggtcagctctgaggatgtatacccctggtgggagagggagacctagagatctggctgtggggcgggcatggggggtgaagggccactgggaccctcagccttgtttgtactgtatgccttcagcattgcctaggaacacgaagcacgatcagtccatcccagagggaccggagttatgacaagctttccaaatattttgctttatcagccgatatcaacacttgtatctggcctctgtgccccagcagtgccttgtgcaatgtgaatgtgcgcgtctctgctaaaccaccattttatttggtttttgttttgttttggttttgctcggatacttgccaaaatgacctcagctttccccagcccctccggcctgggctgcccacaaggcttgtcccccagaggccctggctcctggtcgggaagggaggtggcctcccgccaacgcatcactggggctgggagcagggaaggacggcttggttctcttcttttggggagaacgtagagtctcactctagatgttttatgtattatatctataatataaacatatcaaagtcaatgtcggtgtctttttaaaaccagaaagaagctacttccaaggttgtctgtgggccaggtcacatttgtaaataatacagcattttccctggcggcaatcctgactttcatgagctctccatccatcctgagcccctcttaccctaagggggtgacttacttcccc

SEQ ID NO: 426959 - DNA, 1774 bp, Homo sapiens
tatagaatccagcgtggtcccttcatattgcatgtcaagcagtgctagaagtggatgacatcaaaatggtgctggagctgaccagtgacaatgaccgcctgcgcaagcgggtggaacagctgagccgcgaactggacacgctgcggggcatcttccgccagctgccagagagctccttggtcaaggccatgggcaactgcgcgtgaggcgcgcggctgtgggaccgccctgggccagcctccggcggggacccagggagtggtttggggtcgccggatctcgaggcttgcccgagccgtgcgagccaggactaggagattccggtgcctcctgaaagcctggcctgctccgcgtgtcccctcccttcctctgcgccggacttggtgcgtctaagatgagggggccaggcggtggcttctccctgcgaggaggggagaattcttggggctgagctgggagcccggcaactctagtatttaggataaccttggccttggaaatgcaaactcaccgctccaatgcctactgagtagggggagcaaatcgtgccttgtcattttatttggaggtttcctgcctccttcccgaggctacagcagacccccatgagagaaggaggggagcaggcccgtggcaggaggagggctcagggagctgagatcccgacaagcccgccagccccagccgctcctccacgcctgtccttagaaaggggtggaaacatagggacttggggcttggaacctaaggttgttcccctagttctacatgaaggtggagggtctctagttccacgcctctcccacctccctccgcacacaccccaccccagcctgctataggctgggcttccccttggggcggaactcactgcgatgggggtcaccaggtgaccagtgggagcccccaccccgagtcacaccagaaagctaggtcgtgggtcagctctgaggatgtatacccctggtgggagagggagacctagagatctggctgtggggcgggcatggggggtgaagggccactgggaccctcagccttgtttgtactgtatgccttcagcattgcctaggaacacgaagcacgatcagtccatcccagagggaccggagttatgacaagctttccaaatattttgctttatcagccgatatcaacacttgtatctggcctctgtgccccagcagtgccttgtgcaatgtgaatgtgcgcgtctctgctaaaccaccattttatttggtttttgttttgttttggttttgctcggatacttgccaaaatgagactctccgtcggcagctgggggaagggtctgagactccctttccttttggttttgggattacttttgatcctgggggaccaatgaggtgaggggggttctcctttgccctcagctttccccagcccctccggcctgggctgcccacaaggcttgtcccccagaggccctggctcctggtcgggaagggaggtggcctcccgccaacgcatcactggggctgggagcagggaaggacggcttggttctcttcttttggggagaacgtagagtctcactctagatgttttatgtattatatctataatataaacatatcaaagtcaatgtcggtgtctttttaaaaccagaaagaagctacttccaaggttgtctgtgggccaggtcacatttgtaaataatacagcattttccctggcggcaatcctgactttcatgagctctccatccatcctgagcccctcttaccctaagggggtgacttacttcccc

SEQ ID NO: 426960 - DNA, 1568 bp, Homo sapiens
tataaaagctgggccggcgcgggccgggccattcgcgacccggaggtgcgcgggcgcgggcgagcagggtctccgggtgggcggcggcgacgccccgcgcaggctggaggccgccgaggctcgccatgccgggagaactctaactcccccatggagtcggccgacttctacgaggcggagccgcggcccccgatgagcagccacctgcagagccccccgcacgcgcccagcagcgccgccttcggctttccccggggcgcgggccccgcgcagcctcccgccccacctgccgccccggagccgctgggcggcatctgcgagcacgagacgtccatcgacatcagcgcctacatcgacccggccgccttcaacgacgagttcctggccgacctgttccagcacagccggcagcaggagaaggccaaggcggccgtgggccccacgggcggcggcggcggcggcgactttgactacccgggcgcgcccgcgggccccggcggcgccgtcatgcccgggggagcgcacgggcccccgcccggctacggctgcgcggccgccggctacctggacggcaggctggagcccctgtacgagcgcgtcggggcgccggcgctgcggccgctggtgatcaagcaggagccccgcgaggaggatgaagccaagcagctggcgctggccggcctcttcccttaccagccgccgccgccgccgccgccctcgcacccgcacccgcacccgccgcccgcgcacctggccgccccgcacctgcagttccagatcgcgcactgcggccagaccaccatgcacctgcagcccggtcaccccacgccgccgcccacgcccgtgcccagcccgcaccccgcgcccgcgctcggtgccgccggcctgccgggccctggcagcgcgctcaaggggctgggcgccgcgcaccccgacctccgcgcgagtggcggcagcggcgcgggcaaggccaagaagtcggtggacaagaacagcaacgagtaccgggtgcggcgcgagcgcaacaacatcgcggtgcgcaagagccgcgacaaggccaagcagcgcaacgtggagacgcagcagaaggtgctggagctgaccagtgacaatgaccgcctgcgcaagcgggtggaacagctgagccgcgaactggacacgctgcggggcatcttccgccagctgccagagagctccttggtcaaggccatgggcaactgcgcgtgaggcgcgcggctgtgggaccgccctgggccagcctccggcggggacccagggagtggtttggggtcgccggatctcgaggcttgcccgagccgtgcgagccaggactaggagattccggtgcctcctgaaagcctggcctgctccgcgtgtcccctcccttcctctgcgccggacttggtgcgtctaagatgagggggccaggcggtggcttctccctgcgaggaggggagaattcttggggctgagctgggagcccggcaactctagtatttaggataaccttgccatatgcaaggccaatgtaccctgcgtaggggcacaactccatagtagcgtgcctg

SEQ ID NO: 426961 - DNA, 888 bp, Homo sapiens
cctcctgcctcagcctcctgagtagatggggcaataggtatgtgccaccacacccagctaagtttttaaaaattttttgtagacacagggtcttgatatgttgcctgagctggtctggaactccgggcttcaagcaatcctcctgtctcagccttgtttgtactgtatgccttcagcattgcctaggaacacgaagcacgatcagtccatcccagagggaccggagttatgacaagctttccaaatattttgctttatcagccgatatcaacacttgtatctggcctctgtgccccagcagtgccttgtgcaatgtgaatgtgcgcgtctctgctaaaccaccattttatttggtttttgttttgttttggttttgctcggatacttgccaaaatgagactctccgtcggcagctgggggaagggtctgagactccctttccttttggttttgggattacttttgatcctgggggaccaatgaggtgaggggggttctcctttgccctcagctttccccagcccctccggcctgggctgcccacaaggcttgtcccccagaggccctggctcctggtcgggaagggaggtggcctcccgccaacgcatcactggggctgggagcagggaaggacggcttggttctcttcttttggggagaacgtagagtctcactctagatgttttatgtattatatctataatataaacatatcaaagtcaatgtcggtgtctttttaaaaccagaaagaagctacttccaaggttgtctgtgggccaggtcacatttgtaaataatacagcattttccctggcggcaatcctgactttcatgagctctccatccatcctgagcccctcttaccctaagggggtgacttacttcccc

SEQ ID NO: 426962 - DNA, 3924 bp, Homo sapiens
gggcgacggtggcagcgccatggagccgggggaggtgaaggaccggatcctggagaacatctcgctgtcggtgaagaagttgcagagctattttgctgcatgtgaggatgagatccctgccatccggaaccatgacaaggtcctacagcgtctgtgtgagcacctggaccacgccctgctgtacggactgcaagacctctcctctggctactgggtgctcgtggtgcattttactcggagagaggccatcaagcagatcgaggtgctgcagcacgtggccaccaacctggggcgcagccgtgcctggctgtacctggccctcaacgagaactccttggagagctacctgcggttgttccaggagaacctgggcctgctgcataagtactacgtcaagaatgccctggtctgcagccacgatcacctgacgctcttcctgaccttggtgtccgggctagagttcattcgtttcgagctggatctggatgccccttacctagacctggccccctacatgcccgactactacaaacctcagtacctgctggactttgaagaccgccttcccagctcggtccacggctcagacagtctgtccctcaactctttcaactccgtcacctccaccaacctggagtgggatgacagtgcgattgccccatctagtgaggattatgattttggagatgtgtttccagcagtgccgtctgtacccagcacagactgggaagatggagacctcacagacacggtcagtggtccccgctccacagcctccgacctgaccagcagcaaggcctccaccaggagccccacccagcgccagaaccccttcaacgaggagccggcagagactgtgtcctcctctgacaccacccccgtgcacaccacctctcaggagaaggaggaggcccaggccctggacccgccggatgcctgcacggagctcgaggtcatcagggtcaccaagaagaagaaaattggcaagaagaaaaagagcagatcagatgaggaggcaagtccactccaccccgcctgcagccagaagaaatgtgccaagcagggggacggtgacagccgcaacggcagcccaagccttgggcgggactcgccagacactatgcttgcctccccccaggaggagggagaggggccgagcagcaccacggagagcagcgagcgctccgagccgggcctgctgatccctgagatgaaggacacctccatggagcgcttggggcagcccctgagcaaggttatcgaccagctcaacgggcagctggaccccagcacctggtgctcccgtgctgagcccccagaccagtcctttcggaccggctctcccggggatgccccggagaggccgccgctttgcgactttagtgaggggctttcagccccaatggacttctaccgctttaccgtcgagagtccaagcactgttacatcaggtggcggccaccatgaccctgcagggcttggccaaccgctgcatgttcctagtagccctgaggctgctggccaagaagaagagggaggaggaggagagggacagacgcctcggcccctagaggataccacgagggaggctcaggagctggaggcccagctgtccctggtcagggaggggcctgtgtctgagccagagcctgggacccaggaggttctctgccagctcaagcgagaccagcccagcccgtgtctgagtagcgctgaggattctggggtggatgagggacaggggagcccttcggagatggtccattcctcggagttcagagtagacaacaatcacctgctcctgctcatgatccacgtgttccgagaaaacgaagagcagctgttcaaaatgatccggatgagcaccgggcacatggagggcaacctgcagctgctgtacgtgctgctcacagactgctatgtctacctgctccggaaaggggccacagagaagccatacctggtggaagaggccgtttcttacaatgaacttgactatgtgtcggttggccttgaccagcagacggtgaagctggtgtgcaccaaccgcaggaagcagtttctgctggacacggctgatgtggcgctggctgagttctttttggcttctttgaagtcagccatgatcaaaggctgtcgagaacctccctaccccagcatcctgacggatgccaccatggagaagctggcactggccaaatttgtggcccaagaatcgaagtgtgaggcatctgctgtcaccgtgcgcttctacggccttgtgcactgggaggaccccacagacgagtccctgggccccacgccctgccactgctcaccccccgagggcaccatcaccaaagaaggcatgctgcactacaaggcgggcacctcctacctgggcaaggaacactggaagacgtgcttcgtggtgctcagcaacgggatcctctaccagtacccggaccgcaccgacgtcatccctctgctctcggtgaacatggggggggagcagtgcggtggctgccggagagccaacaccacggatcggccccacgccttccaggtcattctctccgaccggccctgcctggagctaagtgccgagagcgaggccgagatggccgagtggatgcagcatctctgccaggctgtgtccaaaggggtcatcccccagggcgtagctcccagcccctgcataccctgctgcctggtcctcacggatgaccgcctctttacgtgccatgaggattgccagaccagcttcttccgctctttgggcacagccaagctgggcgacatcagcgccgtctccaccgagccgggcaaggagtactgcgtcttggagttctcccaggacagccagcagctcctcccgccctgggtcatctacctgagctgcacttctgaactggaccgattgctgtctgcactgaactctgggtggaaaaccatctatcaggtggacctcccccacacggcgatccaggaagcctccaacaagaagaaattcgaggatgccttgagcctcatccacagcgcctggcagcggagcgacagtctctgccgcggccgagcctcccgagacccctggtgctgaggcagagctggttggcgtccctggtgggcaggaaaggaaggcacgccagccggcaggcacactgtcacggctgttgtcatgctgtcgggagcctacagtccacccctgccctgggcggcagaaccaccgagtgtggcttaagacagggtccctccactccagggatccagatcaggtgcccggcacccctgggcatcctgcccgacaggtagcgaatggaggtcgctgggggcagagggtccgagccctgtgggctctgcggatgcacgccctcctcccgggcctccgcctcagtctgcagaatttctgccgagtggcaccgagaacaccatccatctaaggacgaacaaaagaaccaggagggcgggacccccctcttcctctcctgggttgggggctggggccctgagtgcccagccatccttgttcgtgtttgaacactctcctggccacgtggggaagcgggaacacggggtgtctgcgcatgtttcctcctcctagctccatcactgcgcacacagctgcctgcctcgccagatgcaggggggcgggcagccctccctggctgccaggaggctctgcatgcccacagtcctgccctgcctgtcccctcaacccggcagtgcctgtagcaccgaggagcaaagggggtggatggggggcttggagaagggcggagcccaccagcctggcatccatgttgacatcttctgactgtcccctgcttggctggagccaggcccttccctagagtttcgtcaagagcctcctggggaaggggtcaggtggtttgggttttgttttttaaaataaaatagacatgttatattgccaaaaaaaaaaaa

SEQ ID NO: 426963 - DNA, 3583 bp, Homo sapiens
aatcgagctcggtacctgtttcaggagaactgggctgctgcataagtactatcaagaatgccctggtctgcagccacgatcacctgacgctcttcctgaccttggtgtccgggctagagttcattcgtttcgagctggatctggatgccccttacctagacctggccccctacatgcccgactactacaaacctcagtacctgctggactttgaagaccgccttcccagctcggtccacggctcagacagtctgtccctcaactctttcaactccgtcacctccaccaacctggagtgggatgacagtgcgattgccccatctagtgaggattatgattttggagatgtgtttccagcagtgccgtctgtacccagcacagactgggaagatggagacctcacagacacggtcagtggtccccgctccacagcctccgacctgaccagcagcaaggcctccaccaggagccccacccagcgccagaaccccttcaacgaggagccggcagagactgtgtcctcctctgacaccacccccgtgcacaccacctctcaggagaaggaggaggcccaggccctggacccgccggatgcctgcacggagctcgaggtcatcagggtcaccaagaagaagaaaattggcaagaagaaaaagagcagatcagatgaggaggcaagtccactccaccccgcctgcagccagaagaaatgtgccaagcagggggacggtgacagccgcaacggcagcccaagccttgggcgggactcgccagacactatgcttgcctccccccaggaggagggagaggggccgagcagcaccacggagagcagcgagcgctccgagccgggcctgctgatccctgagatgaaggacacctccatggagcgcttggggcagcccctgagcaaggttatcgaccagctcaacgggcagctggaccccagcacctggtgctcccgtgctgagcccccagaccagtcctttcggaccggctctcccggggatgccccggagaggccgccgctttgcgactttagtgaggggctttcagccccaatggacttctaccgctttaccgtcgagagtccaagcactgttacatcaggtggcggccaccatgaccctgcagggcttggccaaccgctgcatgttcctagtagccctgaggctgctggccaagaagaagagggaggaggaggagagggacagacgcctcggcccctagaggataccacgagggaggctcaggagctggaggcccagctgtccctggtcagggaggggcctgtgtctgagccagagcctgggacccaggaggttctctgccagctcaagcgagaccagcccagcccgtgtctgagtagcgctgaggattctggggtggatgagggacaggggagcccttcggagatggtccattcctcggagttcagagtagacaacaatcacctgctcctgctcatgatccacgtgttccgagaaaacgaagagcagctgttcaaaatgatccggatgagcaccgggcacatggagggcaacctgcagctgctgtacgtgctgctcacagactgctatgtctacctgctccggaaaggggccacagagaagccatacctggtggaagaggccgtttcttacaatgaacttgactatgtgtcggttggccttgaccagcagacggtgaagctggtgtgcaccaaccgcaggaagcagtttctgctggacacggctgatgtggcgctggctgagttctttttggcttctttgaagtcagccatgatcaaaggctgtcgagaacctccctaccccagcatcctgacggatgccaccatggagaagctggcactggccaaatttgtggcccaagaatcgaagtgtgaggcatctgctgtcaccgtgcgcttctacggccttgtgcactgggaggaccccacagacgagtccctgggccccacgccctgccactgctcaccccccgagggcaccatcaccaaagaaggcatgctgcactacaaggcgggcacctcctacctgggcaaggaacactggaagacgtgcttcgtggtgctcagcaacgggatcctctaccagtacccggaccgcaccgacgtcatccctctgctctcggtgaacatggggggggagcagtgcggtggctgccggagagccaacaccacggatcggccccacgccttccaggtcattctctccgaccggccctgcctggagctaagtgccgagagcgaggccgagatggccgagtggatgcagcatctctgccaggctgtgtccaaaggggtcatcccccagggcgtagctcccagcccctgcataccctgctgcctggtcctcacggatgaccgcctctttacgtgccatgaggattgccagaccagcttcttccgctctttgggcacagccaagctgggcgacatcagcgccgtctccaccgagccgggcaaggagtactgcgtcttggagttctcccaggacagccagcagctcctcccgccctgggtcatctacctgagctgcacttctgaactggaccgattgctgtctgcactgaactctgggtggaaaaccatctatcaggtggacctcccccacacggcgatccaggaagcctccaacaagaagaaattcgaggatgccttgagcctcatccacagcgcctggcagcggagcgacagtctctgccgcggccgagcctcccgagacccctggtgctgaggcagagctggttggcgtccctggtgggcaggaaaggaaggcacgccagccggcaggcacactgtcacggctgttgtcatgctgtcgggagcctacagtccacccctgccctgggcggcagaaccaccgagtgtggcttaagacagggtccctccactccagggatccagatcaggtgcccggcacccctgggcatcctgcccgacaggtagcgaatggaggtcgctgggggcagagggtccgagccctgtgggctctgcggatgcacgccctcctcccgggcctccgcctcagtctgcagaatttctgccgagtggcaccgagaacaccatccatctaaggacgaacaaaagaaccaggagggcgggacccccctcttcctctcctgggttgggggctggggccctgagtgcccagccatccttgttcgtgtttgaacactctcctggccacgtggggaagcgggaacacggggtgtctgcgcatgtttcctcctcctagctccatcactgcgcacacagctgcctgcctcgccagatgcaggggggcgggcagccctccctggctgccaggaggctctgcatgcccacagtcctgccctgcctgtcccctcaacccggcagtgcctgtagcaccgaggagcaaagggggtggatggggggcttggagaagggcggagcccaccagcctggcatccatgttgacatcttctgactgtcccctgcttggctggagccaggcccttccctagagtttcgtcaagagcctcctggggaaggggtcaggtggtttgggttttgttttttaaaataaaatagacatgttatattgccaaaaaaaaaaaa

SEQ ID NO: 426964 - DNA, 3451 bp, Homo sapiens
gggcgacggtggcagcgccatggagccgggggaggtgaaggaccggatcctggagaacatctcgctgtcggtgaagaagttgcagagctattttgctgcatgtgaggatgagatccctgccatccggaaccatgacaaggtcctacagcgtctgtgtgagcacctggaccacgccctgctgtacggactgcaagacctctcctctggctactgggtgctcgtggtgcattttactcggagagaggccatcaagcagatcgaggtgctgcagcacgtggccaccaacctggggcgcagccgtgcctggctgtacctggccctcaacgagaactccttggagagctacctgcggttgttccaggagaacctgggcctgctgcataagtactacgtcaagaatgccctggtctgcagccacgatcacctgacgctcttcctgaccttggtgtccgggctagagttcattcgtttcgagctggatctggatgccccttacctagacctggccccctacatgcccgactactacaaacctcagtacctgctggactttgaagaccgcctgcagccagaagaaatgtgccaagcagggggacggtgacagccgcaacggcagcccaagccttgggcgggactcgccagacactatgcttgcctccccccaggaggagggagaggggccgagcagcaccacggagagcagcgagcgctccgagccgggcctgctgatccctgagatgaaggacacctccatggagcgcttggggcagcccctgagcaaggttatcgaccagctcaacgggcagctggaccccagcacctggtgctcccgtgctgagcccccagaccagtcctttcggaccggctctcccggggatgccccggagaggccgccgctttgcgactttagtgaggggctttcagccccaatggacttctaccgctttaccgtcgagagtccaagcactgttacatcaggtggcggccaccatgaccctgcagggcttggccaaccgctgcatgttcctagtagccctgaggctgctggccaagaagaagagggaggaggaggagagggacagacgcctcggcccctagaggataccacgagggaggctcaggagctggaggcccagctgtccctggtcagggaggggcctgtgtctgagccagagcctgggacccaggaggttctctgccagctcaagcgagaccagcccagcccgtgtctgagtagcgctgaggattctggggtggatgagggacaggggagcccttcggagatggtccattcctcggagttcagagtagacaacaatcacctgctcctgctcatgatccacgtgttccgagaaaacgaagagcagctgttcaaaatgatccggatgagcaccgggcacatggagggcaacctgcagctgctgtacgtgctgctcacagactgctatgtctacctgctccggaaaggggccacagagaagccatacctggtggaagaggccgtttcttacaatgaacttgactatgtgtcggttggccttgaccagcagacggtgaagctggtgtgcaccaaccgcaggaagcagtttctgctggacacggctgatgtggcgctggctgagttctttttggcttctttgaagtcagccatgatcaaaggctgtcgagaacctccctaccccagcatcctgacggatgccaccatggagaagctggcactggccaaatttgtggcccaagaatcgaagtgtgaggcatctgctgtcaccgtgcgcttctacggccttgtgcactgggaggaccccacagacgagtccctgggccccacgccctgccactgctcaccccccgagggcaccatcaccaaagaaggcatgctgcactacaaggcgggcacctcctacctgggcaaggaacactggaagacgtgcttcgtggtgctcagcaacgggatcctctaccagtacccggaccgcaccgacgtcatccctctgctctcggtgaacatggggggggagcagtgcggtggctgccggagagccaacaccacggatcggccccacgccttccaggtcattctctccgaccggccctgcctggagctaagtgccgagagcgaggccgagatggccgagtggatgcagcatctctgccaggctgtgtccaaaggggtcatcccccagggcgtagctcccagcccctgcataccctgctgcctggtcctcacggatgaccgcctctttacgtgccatgaggattgccagaccagcttcttccgctctttgggcacagccaagctgggcgacatcagcgccgtctccaccgagccgggcaaggagtactgcgtcttggagttctcccaggacagccagcagctcctcccgccctgggtcatctacctgagctgcacttctgaactggaccgattgctgtctgcactgaactctgggtggaaaaccatctatcaggtggacctcccccacacggcgatccaggaagcctccaacaagaagaaattcgaggatgccttgagcctcatccacagcgcctggcagcggagcgacagtctctgccgcggccgagcctcccgagacccctggtgctgaggcagagctggttggcgtccctggtgggcaggaaaggaaggcacgccagccggcaggcacactgtcacggctgttgtcatgctgtcgggagcctacagtccacccctgccctgggcggcagaaccaccgagtgtggcttaagacagggtccctccactccagggatccagatcaggtgcccggcacccctgggcatcctgcccgacaggtagcgaatggaggtcgctgggggcagagggtccgagccctgtgggctctgcggatgcacgccctcctcccgggcctccgcctcagtctgcagaatttctgccgagtggcaccgagaacaccatccatctaaggacgaacaaaagaaccaggagggcgggacccccctcttcctctcctgggttgggggctggggccctgagtgcccagccatccttgttcgtgtttgaacactctcctggccacgtggggaagcgggaacacggggtgtctgcgcatgtttcctcctcctagctccatcactgcgcacacagctgcctgcctcgccagatgcaggggggcgggcagccctccctggctgccaggaggctctgcatgcccacagtcctgccctgcctgtcccctcaacccggcagtgcctgtagcaccgaggagcaaagggggtggatggggggcttggagaagggcggagcccaccagcctggcatccatgttgacatcttctgactgtcccctgcttggctggagccaggcccttccctagagtttcgtcaagagcctcctggggaaggggtcaggtggtttgggttttgttttttaaaataaaatagacatgttatattgccaaaaaaaaaaaa

SEQ ID NO: 426965 - DNA, 3951 bp, Homo sapiens
  misc_feature (1863)..(1863): n is a, c, g, or t
  misc_feature (1865)..(1865): n is a, c, g, or t
  misc_feature (1869)..(1870): n is a, c, g, or t
gggcgacggtggcagcgccatggagccgggggaggtgaaggaccggatcctggagaacatctcgctgtcggtgaagaagttgcagagctattttgctgcatgtgaggatgagatccctgccatccggaaccatgacaaggtcctacagcgtctgtgtgagcacctggaccacgccctgctgtacggactgcaagacctctcctctggctactgggtgctcgtggtgcattttactcggagagaggccatcaagcagatcgaggtgctgcagcacgtggccaccaacctggggcgcagccgtgcctggctgtacctggccctcaacgagaactccttggagagctacctgcggttgttccaggagaacctgggcctgctgcataagtactacgtcaagaatgccctggtctgcagccacgatcacctgacgctcttcctgaccttggtgtccgggctagagttcattcgtttcgagctggatctggatgccccttacctagacctggccccctacatgcccgactactacaaacctcagtacctgctggactttgaagaccgccttcccagctcggtccacggctcagacagtctgtccctcaactctttcaactccgtcacctccaccaacctggagtgggatgacagtgcgattgccccatctagtgaggattatgattttggagatgtgtttccagcagtgccgtctgtacccagcacagactgggaagatggagacctcacagacacggtcagtggtccccgctccacagcctccgacctgaccagcagcaaggcctccaccaggagccccacccagcgccagaaccccttcaacgaggagccggcagagactgtgtcctcctctgacaccacccccgtgcacaccacctctcaggagaaggaggaggcccaggccctggacccgccggatgcctgcacggagctcgaggtcatcagggtcaccaagaagaagaaaattggcaagaagaaaaagagcagatcagatgaggaggcaagtccactccaccccgcctgcagccagaagaaatgtgccaagcagggggacggtgacagccgcaacggcagcccaagccttgggcgggactcgccagacactatgcttgcctccccccaggaggagggagaggggccgagcagcaccacggagagcagcgagcgctccgagccgggcctgctgatccctgagatgaaggacacctccatggagcgcttggggcagcccctgagcaaggttatcgaccagctcaacgggcagctggaccccagcacctggtgctcccgtgctgagcccccagaccagtcctttcggaccggctctcccggggatgccccggagaggccgccgctttgcgactttagtgaggggctttcagccccaatggacttctaccgctttaccgtcgagagtccaagcactgttacatcaggtggcggccaccatgaccctgcagggcttggccaaccgctgcatgttcctagtagccctgaggctgctggccaagaagaagagggaggaggaggagagggacagacgcctcggcccctagaggataccacgagggaggctcaggagctggaggcccagctgtccctggtcagggaggggcctgtgtctgagccagagcctgggacccaggaggttctctgccagctcaagcgagaccagcccagcccgtgtctgagtagcgctgaggattctggggtggatgagggacaggggagcccttcggagatggtccattcctcggagttcagagtagacaacaatcacctgctcctgctcatgatccacgtgttccgagaaaacgaagagcagctgttcaaatgatccggatgagnancggnncatggagggtaagcatgcagttgctgttcgtgctgctcatcagattgctatgtctacctgctccggataggggccacatgagaatccataacctgagtgagaagaggccggtatctctagcaactgagactgggactatgtagatacggcttggaacttgcacacatggatacggagaaagctggatgtgcaaccaaacagcaggaagcggtttcatgacatggacacggctgatgtggcgctgagctgaggttctttttggcttctttgaagtcagccatgatcaaaggctgtcgagaacctccctaccccagcatcctgacggatgccaccatggagaagctggcactggccaaatttgtggcccaagaatcgaagtgtgaggcatctgctgtcaccgtgcgcttctacggccttgtgcactgggaggaccccacagacgagtccctgggccccacgccctgccactgctcaccccccgagggcaccatcaccaaagaaggcatgctgcactacaaggcgggcacctcctacctgggcaaggaacactggaagacgtgcttcgtggtgctcagcaacgggatcctctaccagtacccggaccgcaccgacgtcatccctctgctctcggtgaacatggggggggagcagtgcggtggctgccggagagccaacaccacggatcggccccacgccttccaggtcattctctccgaccggccctgcctggagctaagtgccgagagcgaggccgagatggccgagtggatgcagcatctctgccaggctgtgtccaaaggggtcatcccccagggcgtagctcccagcccctgcataccctgctgcctggtcctcacggatgaccgcctctttacgtgccatgaggattgccagaccagcttcttccgctctttgggcacagccaagctgggcgacatcagcgccgtctccaccgagccgggcaaggagtactgcgtcttggagttctcccaggacagccagcagctcctcccgccctgggtcatctacctgagctgcacttctgaactggaccgattgctgtctgcactgaactctgggtggaaaaccatctatcaggtggacctcccccacacggcgatccaggaagcctccaacaagaagaaattcgaggatgccttgagcctcatccacagcgcctggcagcggagcgacagtctctgccgcggccgagcctcccgagacccctggtgctgaggcagagctggttggcgtccctggtgggcaggaaaggaaggcacgccagccggcaggcacactgtcacggctgttgtcatgctgtcgggagcctacagtccacccctgccctgggcggcagaaccaccgagtgtggcttaagacagggtccctccactccagggatccagatcaggtgcccggcacccctgggcatcctgcccgacaggtagcgaatggaggtcgctgggggcagagggtccgagccctgtgggctctgcggatgcacgccctcctcccgggcctccgcctcagtctgcagaatttctgccgagtggcaccgagaacaccatccatctaaggacgaacaaaagaaccaggagggcgggacccccctcttcctctcctgggttgggggctggggccctgagtgcccagccatccttgttcgtgtttgaacactctcctggccacgtggggaagcgggaacacggggtgtctgcgcatgtttcctcctcctagctccatcactgcgcacacagctgcctgcctcgccagatgcaggggggcgggcagccctccctggctgccaggaggctctgcatgcccacagtcctgccctgcctgtcccctcaacccggcagtgcctgtagcaccgaggagcaaagggggtggatggggggcttggagaagggcggagcccaccagcctggcatccatgttgacatcttctgactgtcccctgcttggctggagccaggcccttccctagagtttcgtcaagagcctcctggggaaggggtcaggtggtttgggttttgttttttaaaataaaatagacatgttatattgccaaaaaaaaaaaa

SEQ ID NO: 426966 - DNA, 3606 bp, Homo sapiens
gggcgacggtggcagcgccatggagccgggggaggtgaaggaccggatcctggagaacatctcgctgtcggtgaagaagttgcagagctattttgctgcatgtgaggatgagatccctgccatccggaaccatgacaaggtcctacagcgtctgtgtgagcacctggaccacgccctgctgtacggactgcaagacctctcctctggctactgggtgctcgtggtgcattttactcggagagaggccatcaagcagatcgaggtgctgcagcacgtggccaccaacctggggcgcagccgtgcctggctgtacctggccctcaacgagaactccttggagagctacctgcggttgttccaggagaacctgggcctgctgcataagtactacgtcaagaatgccctggtctgcagccacgatcacctgacgctcttcctgaccttggtgtccgggctagagttcattcgtttcgagctggatctggatgccccttacctagacctggccccctacatgcccgactactacaaacctcagtacctgctggactttgaagaccgccttcccagctcggtccacggctcagacagtctgtccctcaactctttcaactccgtcacctccaccaacctggagtgggatgacagtgcgattgccccatctagtgaggattatgattttggagatgtgtttccagcagtgccgtctgtacccagcacagactgggaagatggagacctcacagacacggtcagtggtccccgctccacagcctccgacctgaccagcagcaaggcctccaccaggagccccacccagcgccagaaccccttcaacgaggagccggcagagactgtgtcctcctctgacaccacccccgtgcacaccacctctcaggagaaggaggaggcccaggccctggacccgccggatgcctgcacggagctcgaggtcatcagggtcaccaagaagaagaaaattggcaagaagaaaaagagcagatcagatgaggaggcaagtccactccaccccgcctgcagccagaagaaatgtgccaagcagggggacggtgacagccgcaacggcagcccaagccttgggcgggactcgccagacactatgcttgcctccccccaggaggagggagaggggccgagcagcaccacggagagcagcgagcgctccgagccgggcctgctgatccctgagatgaaggacacctccatggagcgcttggggcagcccctgagcaaggttatcgaccagctcaacgggcagctggaccccagcacctggtgctcccgtgctgagcccccagaccagtcctttcggaccggctctcccggggatgccccggagaggccgccgctttgcgactttagtgaggggctttcagccccaatggacttctaccgctttaccgtcgagagtccaagcactgttacatcaggtggcggccaccatgaccctgcagggcttggccaaccgctgcatgttcctagtagccctgaggctgctggccaagaagaagagggaggaggaggagagggacagacgcctcggcccctagaggataccacgagggaggctcaggagctggaggcccagctgtccctggtcagggaggggcctgtgtctgagccagagcctgggacccaggaggttctctgccagctcaagcgagaccagcccagcccgtgtctgagtagcgctgaggattctggggtggatgagggacaggggagcccttcggagatggtccattcctcggagttcaggtaacaagactctgcagcttcagccatgatcaaaggctgtcgagaacctccctaccccagcatcctgacggatgccaccatggagaagctggcactggccaaatttgtggcccaagaatcgaagtgtgaggcatctgctgtcaccgtgcgcttctacggccttgtgcactgggaggaccccacagacgagtccctgggccccacgccctgccactgctcaccccccgagggcaccatcaccaaagaaggcatgctgcactacaaggcgggcacctcctacctgggcaaggaacactggaagacgtgcttcgtggtgctcagcaacgggatcctctaccagtacccggaccgcaccgacgtcatccctctgctctcggtgaacatggggggggagcagtgcggtggctgccggagagccaacaccacggatcggccccacgccttccaggtcattctctccgaccggccctgcctggagctaagtgccgagagcgaggccgagatggccgagtggatgcagcatctctgccaggctgtgtccaaaggggtcatcccccagggcgtagctcccagcccctgcataccctgctgcctggtcctcacggatgaccgcctctttacgtgccatgaggattgccagaccagcttcttccgctctttgggcacagccaagctgggcgacatcagcgccgtctccaccgagccgggcaaggagtactgcgtcttggagttctcccaggacagccagcagctcctcccgccctgggtcatctacctgagctgcacttctgaactggaccgattgctgtctgcactgaactctgggtggaaaaccatctatcaggtggacctcccccacacggcgatccaggaagcctccaacaagaagaaattcgaggatgccttgagcctcatccacagcgcctggcagcggagcgacagtctctgccgcggccgagcctcccgagacccctggtgctgaggcagagctggttggcgtccctggtgggcaggaaaggaaggcacgccagccggcaggcacactgtcacggctgttgtcatgctgtcgggagcctacagtccacccctgccctgggcggcagaaccaccgagtgtggcttaagacagggtccctccactccagggatccagatcaggtgcccggcacccctgggcatcctgcccgacaggtagcgaatggaggtcgctgggggcagagggtccgagccctgtgggctctgcggatgcacgccctcctcccgggcctccgcctcagtctgcagaatttctgccgagtggcaccgagaacaccatccatctaaggacgaacaaaagaaccaggagggcgggacccccctcttcctctcctgggttgggggctggggccctgagtgcccagccatccttgttcgtgtttgaacactctcctggccacgtggggaagcgggaacacggggtgtctgcgcatgtttcctcctcctagctccatcactgcgcacacagctgcctgcctcgccagatgcaggggggcgggcagccctccctggctgccaggaggctctgcatgcccacagtcctgccctgcctgtcccctcaacccggcagtgcctgtagcaccgaggagcaaagggggtggatggggggcttggagaagggcggagcccaccagcctggcatccatgttgacatcttctgactgtcccctgcttggctggagccaggcccttccctagagtttcgtcaagagcctcctggggaaggggtcaggtggtttgggttttgttttttaaaataaaatagacatgttatattgccaaaaaaaaaaaa

SEQ ID NO: 426967 - DNA, 3764 bp, Homo sapiens
gggcgacggtggcagcgccatggagccgggggaggtgaaggaccggatcctggagaacatctcgctgtcggtgaagaagttgcagagctattttgctgcatgtgaggatgagatccctgccatccggaaccatgacaaggtcctacagcgtctgtgtgagcacctggaccacgccctgctgtacggactgcaagacctctcctctggctactgggtgctcgtggtgcattttactcggagagaggccatcaagcagatcgaggtgctgcagcacgtggccaccaacctggggcgcagccgtgcctggctgtacctggccctcaacgagaactccttggagagctacctgcggttgttccaggagaacctgggcctgctgcataagtactacgtcaagaatgccctggtctgcagccacgatcacctgacgctcttcctgaccttggtgtccgggctagagttcattcgtttcgagctggatctggatgccccttacctagacctggccccctacatgcccgactactacaaacctcagtacctgctggactttgaagaccgccttcccagctcggtccacggctcagacagtctgtccctcaactctttcaactccgtcacctccaccaacctggagtgggatgacagtgcgattgccccatctagtgaggattatgattttggagatgtgtttccagcagtgccgtctgtacccagcacagactgggaagatggagacctcacagacacggtcagtggtccccgctccacagcctccgacctgaccagcagcaaggcctccaccaggagccccacccagcgccagaaccccttcaacgaggagccggcagagactgtgtcctcctctgacaccacccccgtgcacaccacctctcaggagaaggaggaggcccaggccctggacccgccggatgcctgcacggagctcgaggtcatcagggtcaccaagaagaagaaaattggcaagaagaaaaagagcagatcagatgaggaggcaagtccactccaccccgcctgcagccagaagaaatgtgccaagcagggggacggtgacagccgcaacggcagcccaagccttgggcgggactcgccagacactatgcttgcctccccccaggaggagggagaggggccgagcagcaccacggagagcagcgagcgctccgagccgggcctgctgatccctgagatgaaggacacctccatggagcgcttggggcagcccctgagcaaggttatcgaccagctcaacgggcagctggaccccagcacctggtgctcccgtgctgagcccccagaccagtcctttcggaccggctctcccggggatgccccggagaggccgccgctttgcgactttagtgaggggctttcagccccaatggacttctaccgctttaccgtcgagagtccaagcactgttacatcaggtggcggccaccatgaccctgcagggcttggccaaccgctgcatgttcctagtagccctgaggctgctggccaagaagaagagggaggaggaggagagggacagacgcctcggcccctagaggataccacgagggaggctcaggagctggaggcccagctgtccctggtcagggaggggcctgtgtctgagccagagcctgggacccaggaggttctctgccagctcaagcgagaccagcccagcccgtgtctgagtagcgctgaggattctggggtggatgagggacaggggagcccttcggagatggtccattcctcggagttcagagtagacaacaatcacctgctcctgctcatgatccacgtgttccgagaaaacgaagagcagctgttcaaaatgatccggatgagcaccgggcacatggagggcaacctgcagctgctgtacgtgctgctcacagactgctatgtctacctgctccggaaaggggccacagagaagccatacctggtggaagaggccgtttcttacaatgaacttgactatgtgtcggttggccttgaccagcagacggtgaagctggtgtgcaccaaccgcaggaagcagtttctgctggacacggctgatgtggcgctggctgagttctttttggcttctttgaagtcagccatgatcaaaggctgtcgagaacctccctaccccagcatcctgacggatgccaccatggagaagctggcactggccaaatttgtggcccaagaatcgaagtgtgaggcatctgctgtcaccgtgcgcttctacggccttgtgcactgggaggaccccacagacgagtccctgggccccacgccctgccactgctcaccccccgagggcaccatcaccaaagaaggcatgctgcactacaaggcgggcacctcctacctgggcaaggaacactggaagacgtgcttcgtggtgctcagcaacgggatcctctaccagtacccggaccgcaccgacgtcatccctctgctctcggtgaacatggggtcatcccccagggcgtagctcccagcccctgcataccctgctgcctggtcctcacggatgaccgcctctttacgtgccatgaggattgccagaccagcttcttccgctctttgggcacagccaagctgggcgacatcagcgccgtctccaccgagccgggcaaggagtactgcgtcttggagttctcccaggacagccagcagctcctcccgccctgggtcatctacctgagctgcacttctgaactggaccgattgctgtctgcactgaactctgggtggaaaaccatctatcaggtggacctcccccacacggcgatccaggaagcctccaacaagaagaaattcgaggatgccttgagcctcatccacagcgcctggcagcggagcgacagtctctgccgcggccgagcctcccgagacccctggtgctgaggcagagctggttggcgtccctggtgggcaggaaaggaaggcacgccagccggcaggcacactgtcacggctgttgtcatgctgtcgggagcctacagtccacccctgccctgggcggcagaaccaccgagtgtggcttaagacagggtccctccactccagggatccagatcaggtgcccggcacccctgggcatcctgcccgacaggtagcgaatggaggtcgctgggggcagagggtccgagccctgtgggctctgcggatgcacgccctcctcccgggcctccgcctcagtctgcagaatttctgccgagtggcaccgagaacaccatccatctaaggacgaacaaaagaaccaggagggcgggacccccctcttcctctcctgggttgggggctggggccctgagtgcccagccatccttgttcgtgtttgaacactctcctggccacgtggggaagcgggaacacggggtgtctgcgcatgtttcctcctcctagctccatcactgcgcacacagctgcctgcctcgccagatgcaggggggcgggcagccctccctggctgccaggaggctctgcatgcccacagtcctgccctgcctgtcccctcaacccggcagtgcctgtagcaccgaggagcaaagggggtggatggggggcttggagaagggcggagcccaccagcctggcatccatgttgacatcttctgactgtcccctgcttggctggagccaggcccttccctagagtttcgtcaagagcctcctggggaaggggtcaggtggtttgggttttgttttttaaaataaaatagacatgttatattgccaaaaaaaaaaaa

SEQ ID NO: 426968 - DNA, 3658 bp, Homo sapiens
gggcgacggtggcagcgccatggagccgggggaggtgaaggaccggatcctggagaacatctcgctgtcggtgaagaagttgcagagctattttgctgcatgtgaggatgagatccctgccatccggaaccatgacaaggtcctacagcgtctgtgtgagcacctggaccacgccctgctgtacggactgcaagacctctcctctggctactgggtgctcgtggtgcattttactcggagagaggccatcaagcagatcgaggtgctgcagcacgtggccaccaacctggggcgcagccgtgcctggctgtacctggccctcaacgagaactccttggagagctacctgcggttgttccaggagaacctgggcctgctgcataagtactacgtcaagaatgccctggtctgcagccacgatcacctgacgctcttcctgaccttggtgtccgggctagagttcattcgtttcgagctggatctggatgccccttacctagacctggccccctacatgcccgactactacaaacctcagtacctgctggactttgaagaccgccttcccagctcggtccacggctcagacagtctgtccctcaactctttcaactccgtcacctccaccaacctggagtgggatgacagtgcgattgccccatctagtgaggattatgattttggagatgtgtttccagcagtgccgtctgtacccagcacagactgggaagatggagacctcacagacacggtcagtggtccccgctccacagcctccgacctgaccagcagcaaggcctccaccaggagccccacccagcgccagaaccccttcaacgaggagccggcagagactgtgtcctcctctgacaccacccccgtgcacaccacctctcaggagaaggaggaggcccaggccctggacccgccggatgcctgcacggagctcgaggtcatcagggtcaccaagaagaagaaaattggcaagaagaaaaagagcagatcagatgaggaggcaagtccactccaccccgcctgcagccagaagaaatgtgccaagcagggggacggtgacagccgcaacggcagcccaagccttgggcgggactcgccagacactatgcttgcctccccccaggaggagggagaggggccgagcagcaccacggagagcagcgagcgctccgagccgggcctgctgatccctgagatgaaggacacctccatggagcgcttggggcagcccctgagcaaggttatcgaccagctcaacgggcagctggaccccagcacctggtgctcccgtgctgagcccccagaccagtcctttcggaccggctctcccggggatgccccggagaggccgccgctttgcgactttagtgaggggctttcagccccaatggacttctaccgctttaccgtcgagagtccaagcactgttacatcaggtggcggccaccatgaccctgcagggcttggccaaccgctgcatgttcctagtagccctgaggctgctggccaagaagaagagggaggaggaggagagggacagacgcctcggcccctagaggataccacgagggaggctcaggagctggaggcccagctgtccctggtcagggaggggcctgtgtctgagccagagcctgggacccaggaggttctctgccagctcaagcgagaccagcccagcccgtgtctgagtagcgctgaggattctggggtggatgagggacaggggagcccttcggagatggtccattcctcggagttcagagtagacaacaatcacctgctcctgctcatgatccacgtgttccgagaaaacgaagagcagctgttcaaaatgatccggatgagcaccgggcacatggagggcaacctgcagctgctgtacgtgctgctcacagactgctatgtctacctgctccggaaaggggccacagagaagccatacctggtggaagaggccgtttcttacaatgaacttgactatgtgtcggttggccttgaccagcagacggtgaagctggtgtgcaccaaccgcaggaagcagtttctgctggacacggctgatgtggcgctggctgagttctttttggcttctttgaagtcagccatgatcaaaggctgtcgagaacctccctaccccagcatcctgacggatgccaccatggagaagctggcactggccaaatttgtggcccaagaatcgaagtgtgaggcatctgctgtcaccgtgcgcttctacggccttgtgcactgggaggaccccacagacgagtccctgggccccacgccctgccactgctcaccccccgagggcaccatcaccaaagaaggcatgctgcactacaaggcgggcacctcctacctgggcaaggaacactggaagacgtgcttcgtggtgctcagcaacgggatcctctaccagtacccggaccgcaccgacgtcatccctctgctctcggtgaacatggggggggagcagtgcggtggctgccggagagccaacaccacggatcggccccacgccttccaggtcattctctccgaccggccctgcctggagctaagtgccgagagcgaggccgagatggccgagtggatgcagcatctctgccaggctgtgtccaaaggggtcatcccccagggcgtagctcccagcccctgcataccctgctgcctggtcctcacggatgaccgcctctttacgtgccatgaggattgccagaccagcttcttccgctctttgggcacagccaagctgggcgacatcagcgccgtctccaccgagccgggcaaggagtactgcgtcttggagttctcccaggacagccagcagctcctcccgccctgggtcatctacctgagctgcacttctgaactggaccgattgctgtctgcactgaactctgggtggaaaaccatctatcaggtggacctcccccacacggcgatccaggaagcctccaacaagaagaaattcgaggatgccttgagcctcatccacagcgcctggcagcggagcgacagtctctgccgcggccgagcctcccgagacccctggtgctgaggcagagctggttggcgtccctggtgggcaggaaaggaaggcacgccagccggcaggcacactgtcacggctgttgtcatgctgtcgggagcctacagtccacccctgccctgggcggcagaaccaccgagtgtggcttaagacagggtccctccactccagggatccagatcaggtgcccggcacccctgggcatcctgcccgacaggtagcgaatggaggtcgctgggggcagagggtccgagccctgtgggctctgcggatgcacgccctcctcccgggcctccgcctcagtctgcagaattgtgttcggttggtattggtatgggagtcattatacttccctgaaaaaatgaaattatcttttaaaaagtctattgttcttataatttccatgttacccatgtgagcatatgcaaatttcaggatctactgcatgctattctcaagtaatggactactagaaatgctagctctagctcatctagctagccaggcatggagatttggggaatttttttttttggggcgggagtggggaagggggggggggggcgtaccggcggggcaagccggggg

SEQ ID NO: 426969 - DNA, 3454 bp, Homo sapiens
  misc_feature (3365)..(3365): n is a, c, g, or t
gggcgacggtggcagcgccatggagccgggggaggtgaaggaccggatcctggagaacatctcgctgtcggtgaagaagttgcagagctattttgctgcatgtgaggatgagatccctgccatccggaaccatgacaaggtcctacagcgtctgtgtgagcacctggaccacgccctgctgtacggactgcaagacctctcctctggctactgggtgctcgtggtgcattttactcggagagaggccatcaagcagatcgaggtgctgcagcacgtggccaccaacctggggcgcagccgtgcctggctgtacctggccctcaacgagaactccttggagagctacctgcggttgttccaggagaacctgggcctgctgcataagtactacgtcaagaatgccctggtctgcagccacgatcacctgacgctcttcctgaccttggtgtccgggctagagttcattcgtttcgagctggatctggatgccccttacctagacctggccccctacatgcccgactactacaaacctcagtacctgctggactttgaagaccgccttcccagctcggtccacggctcagacagtctgtccctcaactctttcaactccgtcacctccaccaacctggagtgggatgacagtgcgattgccccatctagtgaggattatgattttggagatgtgtttccagcagtgccgtctgtacccagcacagactgggaagatggagacctcacagacacggtcagtggtccccgctccacagcctccgacctgaccagcagcaaggcctccaccaggagccccacccagcgccagaaccccttcaacgaggagccggcagagactgtgtcctcctctgacaccacccccgtgcacaccacctctcaggagaaggaggaggcccaggccctggacccgccggatgcctgcacggagctcgaggtcatcagggtcaccaagaagaagaaaattggcaagaagaaaaagagcagatcagatgaggaggcaagtccactccaccccgcctgcagccagaagaaatgtgccaagcagggggacggtgacagccgcaacggcagcccaagccttgggcgggactcgccagacactatgcttgcctccccccaggaggagggagaggggccgagcagcaccacggagagcagcgagcgctccgagccgggcctgctgatccctgagatgaaggacacctccatggagcgcttggggcagcccctgagcaaggttatcgaccagctcaacgggcagctggaccccagcacctggtgctcccgtgctgagcccccagaccagtcctttcggaccggctctcccggggatgccccggagaggccgccgctttgcgactttagtgaggggctttcagccccaatggacttctaccgctttaccgtcgagagtccaagcactgttacatcaggtggcggccaccatgaccctgcagggcttggccaaccgctgcatgttcctagtagccctgaggctgctggccaagaagaagagggaggaggaggagagggacagacgcctcggcccctagaggataccacgagggaggctcaggagctggaggcccagctgtccctggtcagggaggggcctgtgtctgagccagagcctgggacccaggaggttctctgccagctcaagcgagaccagcccagcccgtgtctgagtagcgctgaggattctggggtggatgagggacaggggagcccttcggagatggtccattcctcggagttcagagtagacaacaatcacctgctcctgctcatgatccacgtgttccgagaaaacgaagagcagctgttcaaaatgatccggatgagcaccgggcacatggagggcaacctgcagctgctgtacgtgctgctcacagactgctatgtctacctgctccggaaaggggccacagagaagccatacctggtggaagaggccgtttcttacaatgaacttgactatgtgtcggttggccttgaccagcagacggtgaagctggtgtgcaccaaccgcaggaagcagtttctgctggacacggctgatgtggcgctggctgagttctttttggcttctttgaagtcagccatgatcaaaggctgtcgagaacctccctaccccagcatcctgacggatgccaccatggagaagctggcactggccaaatttgtggcccaagaatcgaagtgtgaggcatctgctgtcaccgtgcgcttctacggccttgtgcactgggaggaccccacagacgagtccctgggccccacgccctgccactgctcaccccccgagggcaccatcaccaaagaaggcatgctgcactacaaggcgggcacctcctacctgggcaaggaacactggaagacgtgcttcgtggtgctcagcaacgggatcctctaccagtacccggaccgcaccgacgtcatccctctgctctcggtgaacatggggggggagcagtgcggtggctgccggagagccaacaccacggatcggccccacgccttccaggtcattctctccgaccggccctgcctggagctaagtgccgagagcgaggccgagatggccgagtggatgcagcatctctgccaggctgtgtccaaaggggtcatcccccagggcgtagctcccagcccctgcataccctgctgcctggtcctcacggatgaccgcctctttacgtgccatgaggattgccagaccagcttcttccgctctttgggcacagccaagctgggcgacatcagcgccgtctccaccgagccgggcaaggagtactgcgtcttggagttctcccaggacagccagcagctcctcccgccctgggtcatctacctgagctgcacttctgaactggaccgattgctgtctgcactgaactctgggtggaaaaccatctatcaggtggacctcccccacacggcgatccaggaagcctccaacaagaagaaattcgaggatgccttgagcctcatccacagcgcctggcagcggagcgacagtctctgccgcggccgagcctcccgagacccctggtgctgaggcagagctggttggcgtccctggtgggcaggaaaggaaggcacgccagccggcaggcacactgtcacggctgttgtcatgctgtcgggagcctacagtccacccctgccctggtgcaggcatccctcgagtatgcctgcaccaggccatctgcggggtcagtgggggctgctgtatgtcttggctgccgaacggggaaggtgacataggcatcatagccaaagaggcacgtagcgattaggcccagtacccctgcggcgggtttggagtggtttcctctcacacnacccacaacaatggaggtggtcaggtagaggaaaaacgctatgagggttcggaagaaatctctccagggccagttgaggagggtttcct

SEQ ID NO: 426970 - DNA, 3140 bp, Homo sapiens
gggcgacggtggcagcgccatggagccgggggaggtgaaggaccggatcctggagaacatctcgctgtcggtgaagaagttgcagagctattttgctgcatgtgaggatgagatccctgccatccggaaccatgacaaggtcctacagcgtctgtgtgagcacctggaccacgccctgctgtacggactgcaagacctctcctctggctactgggtgctcgtggtgcattttactcggagagaggccatcaagcagatcgaggtgctgcagcacgtggccaccaacctggggcgcagccgtgcctggctgtacctggccctcaacgagaactccttggagagctacctgcggttgttccaggagaacctgggcctgctgcataagtactacgtcaagaatgccctggtctgcagccacgatcacctgacgctcttcctgaccttggtgtccgggctagagttcattcgtttcgagctggatctggatgccccttacctagacctggccccctacatgcccgactactacaaacctcagtacctgctggactttgaagaccgccttcccagctcggtccacggctcagacagtctgtccctcaactctttcaactccgtcacctccaccaacctggagtgggatgacagtgcgattgccccatctagtgaggattatgattttggagatgtgtttccagcagtgccgtctgtacccagcacagactgggaagatggagacctcacagacacggtcagtggtccccgctccacagcctccgacctgaccagcagcaaggcctccaccaggagccccacccagcgccagaaccccttcaacgaggagccggcagagactgtgtcctcctctgacaccacccccgtgcacaccacctctcaggagaaggaggaggcccaggccctggacccgccggatgcctgcacggagctcgaggtcatcagggtcaccaagaagaagaaaattggcaagaagaaaaagagcagatcagatgaggaggcaagtccactccaccccgcctgcagccagaagaaatgtgccaagcagggggacggtgacagccgcaacggcagcccaagccttgggcgggactcgccagacactatgcttgcctccccccaggaggagggagaggggccgagcagcaccacggagagcagcgagcgctccgagccgggcctgctgatccctgagatgaaggacacctccatggagcgcttggggcagcccctgagcaaggttatcgaccagctcaacgggcagctggaccccagcacctggtgctcccgtgctgagcccccagaccagtcctttcggaccggctctcccggggatgccccggagaggccgccgctttgcgactttagtgaggggctttcagccccaatggacttctaccgctttaccgtcgagagtccaagcactgttacatcaggtggcggccaccatgaccctgcagggcttggccaaccgctgcatgttcctagtagccctgaggctgctggccaagaagaagagggaggaggaggagagggacagacgcctcggcccctagaggataccacgagggaggctcaggagctggaggcccagctgtccctggtcagggaggggcctgtgtctgagccagagcctgggacccaggaggttctctgccagctcaagcgagaccagcccagcccgtgtctgagtagcgctgaggattctggggtggatgagggacaggggagcccttcggagatggtccattcctcggagttcagagtagacaacaatcacctgctcctgctcatgatccacgtgttccgagaaaacgaagagcagctgttcaaaatgatccggatgagcaccgggcacatggagggcaacctgcagctgctgtacgtgctgctcacagactgctatgtctacctgctccggaaaggggccacagagaagccatacctggtggaagaggccgtttcttacaatgaacttgactatgtgtcggttggccttgaccagcagacggtgaagctggtgtgcaccaaccgcaggaagcagtttctgctggacacggctgatgtggcgctggctgagttctttttggcttctttgaagtcagccatgatcaaaggctgtcgagaacctccctaccccagcatcctgacggatgccaccatggagaagctggcactggccaaatttgtggcccaagaatcgaagtgtgaggcatctgctgtcaccgtgcgcttctacggccttgtgcactgggaggaccccacagacgagtccctgggccccacgccctgccactgctcaccccccgagggcaccatcaccaaagaaggcatgctgcactacaaggcgggcacctcctacctgggcaaggaacactggaagacgtgcttcgtggtgctcagcaacgggatcctctaccagtacccggaccgcaccgacgtcatccctctgctctcggtgaacatggggggggagcagtgcggtggctgccggagagccaacaccacggatcggccccacgccttccaggtcattctctccgaccggccctgcctggagctaagtgccgagagcgaggccgagatggccgagtggatgcagcatctctgccaggctgtgtccaaaggggtcatcccccagggcgtagctcccagcccctgcataccctgctgcctggtcctcacggatgaccgcctctttacgtgccatgaggattgccagaccagcttcttccgctctttgggcacagccaagctgggcgacatcagcgccgtctccaccgagccgggcaaggagtactgcgtcttggagttctcccaggacagccagcagctcctcccgccctgggtcatctacctgagctgcacttctgaactggaccgattgctgtctgcactgaactctgggtggaaaaccatctatcaggtggacctcccccacacggcgatccaggaagcctccaacaagaagaaattcgaggatgccttgagcctcatccacagcgcctggcagcggagcgacagtctctgccgcggccgagcctcccgagacccctggtgctgaggcagagctggttggcgtccctggtgggcacacattatggaggggtcctctagagcaccca

SEQ ID NO: 426971 - DNA, 1458 bp, Homo sapiens
aaaataaaaaattataacaaaccctgagaaccaaaatgaagcgaacagattttcgacggatcggccccacgccttccaggtcattctctccgaccggccctgcctggagctaagtgccgagagcgaggccgagatggccgagtggatgcagcatctctgccaggctgtgtccaaaggggtcatcccccagggcgtagctcccagcccctgcataccctgctgcctggtcctcacggatgaccgcctctttacgtgccatgaggattgccagaccagcttcttccgctctttgggcacagccaagctgggcgacatcagcgccgtctccaccgagccgggcaaggagtactgcgtcttggagttctcccaggacagccagcagctcctcccgccctgggtcatctacctgagctgcacttctgaactggaccgattgctgtctgcactgaactctgggtggaaaaccatctatcaggtggacctcccccacacggcgatccaggaagcctccaacaagaagaaattcgaggatgccttgagcctcatccacagcgcctggcagcggagcgacagtctctgccgcggccgagcctcccgagacccctggtgctgaggcagagctggttggcgtccctggtgggcaggaaaggaaggcacgccagccggcaggcacactgtcacggctgttgtcatgctgtcgggagcctacagtccacccctgccctgggcggcagaaccaccgagtgtggcttaagacagggtccctccactccagggatccagatcaggtgcccggcacccctgggcatcctgcccgacaggtagcgaatggaggtcgctgggggcagagggtccgagccctgtgggctctgcggatgcacgccctcctcccgggcctccgcctcagtctgcagaatttctgccgagtggcaccgagaacaccatccatctaaggacgaacaaaagaaccaggagggcgggacccccctcttcctctcctgggttgggggctggggccctgagtgcccagccatccttgttcgtgtttgaacactctcctggccacgtggggaagcgggaacacggggtgtctgcgcatgtttcctcctcctagctccatcactgcgcacacagctgcctgcctcgccagatgcaggggggcgggcagccctccctggctgccaggaggctctgcatgcccacagtcctgccctgcctgtcccctcaacccggcagtgcctgtagcaccgaggagcaaagggggtggatggggggcttggagaagggcggagcccaccagcctggcatccatgttgacatcttctgactgtcccctgcttggctggagccaggcccttccctagagtttcgtcaagagcctcctggggaaggggtcaggtggtttgggttttgttttttaaaataaaatagacatgttatattgccaaaaaaaaaaaa

SEQ ID NO: 426972 - DNA, 2814 bp, Homo sapiens
gggcgacggtggcagcgccatggagccgggggaggtgaaggaccggatcctggagaacatctcgctgtcggtgaagaagttgcagagctattttgctgcatgtgaggatgagatccctgccatccggaaccatgacaaggtcctacagcgtctgtgtgagcacctggaccacgccctgctgtacggactgcaagacctctcctctggctactgggtgctcgtggtgcattttactcggagagaggccatcaagcagatcgaggtgctgcagcacgtggccaccaacctggggcgcagccgtgcctggctgtacctggccctcaacgagaactccttggagagctacctgcggttgttccaggagaacctgggcctgctgcataagtactacgtcaagaatgccctggtctgcagccacgatcacctgacgctcttcctgaccttggtgtccgggctagagttcattcgtttcgagctggatctggatgccccttacctagacctggccccctacatgcccgactactacaaacctcagtacctgctggactttgaagaccgccttcccagctcggtccacggctcagacagtctgtccctcaactctttcaactccgtcacctccaccaacctggagtgggatgacagtgcgattgccccatctagtgaggattatgattttggagatgtgtttccagcagtgccgtctgtacccagcacagactgggaagatggagacctcacagacacggtcagtggtccccgctccacagcctccgacctgaccagcagcaaggcctccaccaggagccccacccagcgccagaaccccttcaacgaggagccggcagagactgtgtcctcctctgacaccacccccgtgcacaccacctctcaggagaaggaggaggcccaggccctggacccgccggatgcctgcacggagctcgaggtcatcagggtcaccaagaagaagaaaattggcaagaagaaaaagagcagatcagatgaggaggcaagtccactccaccccgcctgcagccagaagaaatgtgccaagcagggggacggtgacagccgcaacggcagcccaagccttgggcgggactcgccagacactatgcttgcctccccccaggaggagggagaggggccgagcagcaccacggagagcagcgagcgctccgagccgggcctgctgatccctgagatgaaggacacctccatggagcgcttggggcagcccctgagcaaggttatcgaccagctcaacgggcagctggaccccagcacctggtgctcccgtgctgagcccccagaccagtcctttcggaccggctctcccggggatgccccggagaggccgccgctttgcgactttagtgaggggctttcagccccaatggacttctaccgctttaccgtcgagagtccaagcactgttacatcaggtggcggccaccatgaccctgcagggcttggccaaccgctgcatgttcctagtagccctgaggctgctggccaagaagaagagggaggaggaggagagggacagacgcctcggcccctagaggataccacgagggaggctcaggagctggaggcccagctgtccctggtcagggaggggcctgtgtctgagccagagcctgggacccaggaggttctctgccagctcaagcgagaccagcccagcccgtgtctgagtagcgctgaggattctggggtggatgagggacaggggagcccttcggagatggtccattcctcggagttcagagtagacaacaatcacctgctcctgctcatgatccacgtgttccgagaaaacgaagagcagctgttcaaaatgatccggatgagcaccgggcacatggagggcaacctgcagctgctgtacgtgctgctcacagactgctatgtctacctgctccggaaaggggccacagagaagccatacctggtggaagaggccgtttcttacaatgaacttgactatgtgtcggttggccttgaccagcagacggtgaagctggtgtgcaccaaccgcaggaagcagtttctgctggacacggctgatgtggcgctggctgagttctttttggcttctttgaagtcagccatgatcaaaggctgtcgagaacctccctaccccagcatcctgacggatgccaccatggagaagctggcactggccaaatttgtggcccaagaatcgaagtgtgaggcatctgctgtcaccgtgcgcttctacggccttgtgcactgggaggaccccacagacgagtccctgggccccacgccctgccactgctcaccccccgagggcaccatcaccaaagaaggcatgctgcactacaaggcgggcacctcctacctgggcaaggaacactggaagacgtgcttcgtggtgctcagcaacgggatcctctaccagtacccggaccgcaccgacgtcatccctctgctctcggtgaacatggggggggagcagtgcggtggctgccggagagccaacaccacggatcggccccacgccttccaggtcattctctccgaccggccctgcctggagctaagtgccgagagcgaggccgagatggccgagtggatgcagcatctctgccaggctgtgtccaaaggggtcatcccccagggcgtagctcccagcccctgcataccctgctgcctggtcctcacggatgaccgcctctttacgtgccatgaggattgccagaccagcttcttccgctctttgggcacagccaagctgggcgacatcagcgccatggggatcctcctagagtcagactc

SEQ ID NO: 426973 - DNA, 1116 bp, Homo sapiens
ttcccagggagagatggggagggcctgacaggggctccgtggccaaggcagaggcaggcctggtgcccacaagccctgaagactcctgtggccctcagtggccctcatctgttctctgcacgccccaacacaggtggacctcccccacacggcgatccaggaagcctccaacaagaagaaattcgaggatgccttgagcctcatccacagcgcctggcagcggagcgacagtctctgccgcggccgagcctcccgagacccctggtgctgaggcagagctggttggcgtccctggtgggcaggaaaggaaggcacgccagccggcaggcacactgtcacggctgttgtcatgctgtcgggagcctacagtccacccctgccctgggcggcagaaccaccgagtgtggcttaagacagggtccctccactccagggatccagatcaggtgcccggcacccctgggcatcctgcccgacaggtagcgaatggaggtcgctgggggcagagggtccgagccctgtgggctctgcggatgcacgccctcctcccgggcctccgcctcagtctgcagaatttctgccgagtggcaccgagaacaccatccatctaaggacgaacaaaagaaccaggagggcgggacccccctcttcctctcctgggttgggggctggggccctgagtgcccagccatccttgttcgtgtttgaacactctcctggccacgtggggaagcgggaacacggggtgtctgcgcatgtttcctcctcctagctccatcactgcgcacacagctgcctgcctcgccagatgcaggggggcgggcagccctccctggctgccaggaggctctgcatgcccacagtcctgccctgcctgtcccctcaacccggcagtgcctgtagcaccgaggagcaaagggggtggatggggggcttggagaagggcggagcccaccagcctggcatccatgttgacatcttctgactgtcccctgcttggctggagccaggcccttccctagagtttcgtcaagagcctcctggggaaggggtcaggtggtttgggttttgttttttaaaataaaatagacatgttatattgccaaaaaaaaaaaa

SEQ ID NO: 426974 - DNA, 1991 bp, Homo sapiens
gggcgacggtggcagcgccatggagccgggggaggtgaaggaccggatcctggagaacatctcgctgtcggtgaagaagttgcagagctattttgctgcatgtgaggatgagatccctgccatccggaaccatgacaaggtcctacagcgtctgtgtgagcacctggaccacgccctgctgtacggactgcaagacctctcctctggctactgggtgctcgtggtgcattttactcggagagaggccatcaagcagatcgaggtgctgcagcacgtggccaccaacctggggcgcagccgtgcctggctgtacctggccctcaacgagaactccttggagagctacctgcggttgttccaggagaacctgggcctgctgcataagtactacgtcaagaatgccctggtctgcagccacgatcacctgacgctcttcctgaccttggtgtccgggctagagttcattcgtttcgagctggatctggatgccccttacctagacctggccccctacatgcccgactactacaaacctcagtacctgctggactttgaagaccgccttcccagctcggtccacggctcagacagtctgtccctcaactctttcaactccgtcacctccaccaacctggagtgggatgacagtgcgattgccccatctagtgaggattatgattttggagatgtgtttccagcagtgccgtctgtacccagcacagactgggaagatggagacctcacagacacggtcagtggtccccgctccacagcctccgacctgaccagcagcaaggcctccaccaggagccccacccagcgccagaaccccttcaacgaggagccggcagagactgtgtcctcctctgacaccacccccgtgcacaccacctctcaggagaaggaggaggcccaggccctggacccgccggatgcctgcacggagctcgaggtcatcagggtcaccaagaagaagaaaattggcaagaagaaaaagagcagatcagatgaggaggcaagtccactccaccccgcctgcagccagaagaaatgtgccaagcagggggacggtgacagccgcaacggcagcccaagccttgggcgggactcgccagacactatgcttgcctccccccaggaggagggagaggggccgagcagcaccacggagagcagcgagcgctccgagccgggcctgctgatccctgagatgaaggacacctccatggagcgcttggggcagcccctgagcaaggttatcgaccagctcaacgggcagctggaccccagcacctggtgctcccgtgctgagcccccagaccagtcctttcggaccggctctcccggggatgccccggagaggccgccgctttgcgactttagtgaggggctttcagccccaatggacttctaccgctttaccgtcgagagtccaagcactgttacatcaggtggcggccaccatgaccctgcagggcttggccaaccgctgcatgttcctagtagccctgaggctgctggccaagaagaagagggaggaggaggagagggacagacgcctcgccatccttgttcgtgtttgaacactctcctggccacgtggggaagcgggaacacggggtgtctgcgcatgtttcctcctcctagctccatcactgcgcacacagctgcctgcctcgccagatgcaggggggcgggcagccctccctggctgccaggaggctctgcatgcccacagtcctgccctgcctgtcccctcaacccggcagtgcctgtagcaccgaggagcaaagggggtggatggggggcttggagaagggcggagcccaccagcctggcatccatgttgacatcttctgactgtcccctgcttggctggagccaggcccttccctagagtttcgtcaagagcctcctggggaaggggtcaggtggtttgggttttgttttttaaaataaaatagacatgttatattgccaaaaaaaaaaaa

SEQ ID NO: 426975 - DNA, 2498 bp, Homo sapiens
gggcgacggtggcagcgccatggagccgggggaggtgaaggaccggatcctggagaacatctcgctgtcggtgaagaagttgcagagctattttgctgcatgtgaggatgagatccctgccatccggaaccatgacaaggtcctacagcgtctgtgtgagcacctggaccacgccctgctgtacggactgcaagacctctcctctggctactgggtgctcgtggtgcattttactcggagagaggccatcaagcagatcgaggtgctgcagcacgtggccaccaacctggggcgcagccgtgcctggctgtacctggccctcaacgagaactccttggagagctacctgcggttgttccaggagaacctgggcctgctgcataagtactacgtcaagaatgccctggtctgcagccacgatcacctgacgctcttcctgaccttggtgtccgggctagagttcattcgtttcgagctggatctggatgccccttacctagacctggccccctacatgcccgactactacaaacctcagtacctgctggactttgaagaccgccttcccagctcggtccacggctcagacagtctgtccctcaactctttcaactccgtcacctccaccaacctggagtgggatgacagtgcgattgccccatctagtgaggattatgattttggagatgtgtttccagcagtgccgtctgtacccagcacagactgggaagatggagacctcacagacacggtcagtggtccccgctccacagcctccgacctgaccagcagcaaggcctccaccaggagccccacccagcgccagaaccccttcaacgaggagccggcagagactgtgtcctcctctgacaccacccccgtgcacaccacctctcaggagaaggaggaggcccaggccctggacccgccggatgcctgcacggagctcgaggtcatcagggtcaccaagaagaagaaaattggcaagaagaaaaagagcagatcagatgaggaggcaagtccactccaccccgcctgcagccagaagaaatgtgccaagcagggggacggtgacagccgcaacggcagcccaagccttgggcgggactcgccagacactatgcttgcctccccccaggaggagggagaggggccgagcagcaccacggagagcagcgagcgctccgagccgggcctgctgatccctgagatgaaggacacctccatggagcgcttggggcagcccctgagcaaggttatcgaccagctcaacgggcagctggaccccagcacctggtgctcccgtgctgagcccccagaccagtcctttcggaccggctctcccggggatgccccggagaggccgccgctttgcgactttagtgaggggctttcagccccaatggacttctaccgctttaccgtcgagagtccaagcactgttacatcaggtggcggccaccatgaccctgcagggcttggccaaccgctgcatgttcctagtagccctgaggctgctggccaagaagaagagggaggaggaggagagggacagacgcctcggcccctagaggataccacgagggaggctcaggagctggaggcccagctgtccctggtcagggaggggcctgtgtctgagccagagcctgggacccaggaggttctctgccagctcaagcgagaccagcccagcccgtgtctgagtagcgctgaggattctggggtggatgagggacaggggagcccttcggagatggtccattcctcggagttcagagtagacaacaatcacctgctcctgctcatgatccacgtgttccgagaaaacgaagagcagctgttcaaaatgatccggatgagcaccgggcacatggagggcaacctgcagctgctgtacgtgctgctcacagactgctatgtctacctgctccggaaaggggccacagagaagccatacctggtggaagaggccgtttcttacaatgaacttgactatgtgtcggttggccttgaccagcagacggtgaagctggtgtgcaccaaccgcaggaagcagtttctgctggacacggctgatgtggcgctggctgagttctttttggcttctttgaagtcagccatgatcaaaggctgtcgagaacctccctaccccagcatcctgacggatgccaccatggagaagctggcactggccaaatttgtggcccaagaatcgaagtgtgaggcatctgctgtcaccgtgcgcttctacggccttgtgcactgggaggaccccacagacgagtccctgggccccacgccctgccactgctcaccccccgagggcaccatcaccaaagaaggcatgctgcactacaaggcgggcaccaccaataagtattggtggtgctgcctctgctgagccacaatccaagaacctggattctgggcactgtgtcccggagcccagctcctcaggccagcgcctgtatcctgaggttttctatggcagtgct

SEQ ID NO: 426976 - DNA, 1911 bp, Homo sapiens
  misc_feature (1863)..(1863): n is a, c, g, or t
  misc_feature (1865)..(1865): n is a, c, g, or t
  misc_feature (1869)..(1870): n is a, c, g, or t
gggcgacggtggcagcgccatggagccgggggaggtgaaggaccggatcctggagaacatctcgctgtcggtgaagaagttgcagagctattttgctgcatgtgaggatgagatccctgccatccggaaccatgacaaggtcctacagcgtctgtgtgagcacctggaccacgccctgctgtacggactgcaagacctctcctctggctactgggtgctcgtggtgcattttactcggagagaggccatcaagcagatcgaggtgctgcagcacgtggccaccaacctggggcgcagccgtgcctggctgtacctggccctcaacgagaactccttggagagctacctgcggttgttccaggagaacctgggcctgctgcataagtactacgtcaagaatgccctggtctgcagccacgatcacctgacgctcttcctgaccttggtgtccgggctagagttcattcgtttcgagctggatctggatgccccttacctagacctggccccctacatgcccgactactacaaacctcagtacctgctggactttgaagaccgccttcccagctcggtccacggctcagacagtctgtccctcaactctttcaactccgtcacctccaccaacctggagtgggatgacagtgcgattgccccatctagtgaggattatgattttggagatgtgtttccagcagtgccgtctgtacccagcacagactgggaagatggagacctcacagacacggtcagtggtccccgctccacagcctccgacctgaccagcagcaaggcctccaccaggagccccacccagcgccagaaccccttcaacgaggagccggcagagactgtgtcctcctctgacaccacccccgtgcacaccacctctcaggagaaggaggaggcccaggccctggacccgccggatgcctgcacggagctcgaggtcatcagggtcaccaagaagaagaaaattggcaagaagaaaaagagcagatcagatgaggaggcaagtccactccaccccgcctgcagccagaagaaatgtgccaagcagggggacggtgacagccgcaacggcagcccaagccttgggcgggactcgccagacactatgcttgcctccccccaggaggagggagaggggccgagcagcaccacggagagcagcgagcgctccgagccgggcctgctgatccctgagatgaaggacacctccatggagcgcttggggcagcccctgagcaaggttatcgaccagctcaacgggcagctggaccccagcacctggtgctcccgtgctgagcccccagaccagtcctttcggaccggctctcccggggatgccccggagaggccgccgctttgcgactttagtgaggggctttcagccccaatggacttctaccgctttaccgtcgagagtccaagcactgttacatcaggtggcggccaccatgaccctgcagggcttggccaaccgctgcatgttcctagtagccctgaggctgctggccaagaagaagagggaggaggaggagagggacagacgcctcggcccctagaggataccacgagggaggctcaggagctggaggcccagctgtccctggtcagggaggggcctgtgtctgagccagagcctgggacccaggaggttctctgccagctcaagcgagaccagcccagcccgtgtctgagtagcgctgaggattctggggtggatgagggacaggggagcccttcggagatggtccattcctcggagttcagagtagacaacaatcacctgctcctgctcatgatccacgtgttccgagaaaacgaagagcagctgttcaaatgatccggatgagnancggnncatggagggtaagtgctcccgtaagatcctctaagtcacct

SEQ ID NO: 426977 - DNA, 347 bp, Homo sapiens
gccctctaagagagggggctgtgtctaagaaaatggggcagggggagggaaaagaggcctgtggggataataggccttggggtttcctctctcaggggccacagagaagccatacctggtggaagaggccgtttcttacaatgaacttgactatgtgtcggtgagtccaggccccgcagttgtgcgcctgctgtaggtacagggcttctcaagccacttacccatagaactgcagggcgaggcacggccccttactcccctcccggggttgggcaccaacttaactctcagagaggcttctgtacacgatgctgggggtaagaaccaagcttgaggttgcctcttcc

SEQ ID NO: 426978 - DNA, 354 bp, Homo sapiens
caaattgttgtgagctccggaggccccaggggtggtggagatggtgttccttccaagttgctcctaaagtacaaaaccccatgtcctgttaggttgtggcttctactcgaaatggggccacccctgtcaggtttccctgggaggaactggccagcctgcctccctcctgggctaacgcatgctctgggggtcggggaccccggggggtgcctgacagggtgtctcctgcttccttgtcctcccagatggagacctcacagacacggtcagtggtccccgctccacagcctccgacctgaccagcagcaaggcctccaccaggagccccacccagcgccagaaccccttcaacga

SEQ ID NO: 426979 - DNA, 367 bp, Homo sapiens
gctgcctggtcctcacggatgaccgcctctttacgtgccatgaggattgccagaccagcttcttccgctctttgggcacagccaagctgggcgacatcagcgccgtctccaccgagccgggcaaggagtactgcgtcttggtgagctttgagtgggggcggggctgcaaggcctgcagaaggaaagctctggctgctcacccgggggcctggctctccctaggagttctcccaggacagccagcagctcctcccgccctgggtcatctacctgagctgcacttctgaactggaccgattgctgtctgcactgaactctgggtggaaaaccatctatcaggtacccagctgcccaggaaacccattag

SEQ ID NO: 426980 - DNA, 1902 bp, Homo sapiens
gggcgacggtggcagcgccatggagccgggggaggtgaaggaccggatcctggagaacatctcgctgtcggtgaagaagttgcagagctattttgctgcatgtgaggatgagatccctgccatccggaaccatgacaaggtcctacagcgtctgtgtgagcacctggaccacgccctgctgtacggactgcaagacctctcctctggctactgggtgctcgtggtgcattttactcggagagaggccatcaagcagatcgaggtgctgcagcacgtggccaccaacctggggcgcagccgtgcctggctgtacctggccctcaacgagaactccttggagagctacctgcggttgttccaggagaacctgggcctgctgcataagtactacgtcaagaatgccctggtctgcagccacgatcacctgacgctcttcctgaccttggtgtccgggctagagttcattcgtttcgagctggatctggatgccccttacctagacctggccccctacatgcccgactactacaaacctcagtacctgctggactttgaagaccgccttcccagctcggtccacggctcagacagtctgtccctcaactctttcaactccgtcacctccaccaacctggagtgggatgacagtgcgattgccccatctagtgaggattatgattttggagatgtgtttccagcagtgccgtctgtacccagcacagactgggaagatggagacctcacagacacggtcagtggtccccgctccacagcctccgacctgaccagcagcaaggcctccaccaggagccccacccagcgccagaaccccttcaacgaggagccggcagagactgtgtcctcctctgacaccacccccgtgcacaccacctctcaggagaaggaggaggcccaggccctggacccgccggatgcctgcacggagctcgaggtcatcagggtcaccaagaagaagaaaattggcaagaagaaaaagagcagatcagatgaggaggcaagtccactccaccccgcctgcagccagaagaaatgtgccaagcagggggacggtgacagccgcaacggcagcccaagccttgggcgggactcgccagacactatgcttgcctccccccaggaggagggagaggggccgagcagcaccacggagagcagcgagcgctccgagccgggcctgctgatccctgagatgaaggacacctccatggagcgcttggggcagcccctgagcaaggttatcgaccagctcaacgggcagctggaccccagcacctggtgctcccgtgctgagcccccagaccagtcctttcggaccggctctcccggggatgccccggagaggccgccgctttgcgactttagtgaggggctttcagccccaatggacttctaccgctttaccgtcgagagtccaagcactgttacatcaggtggcggccaccatgaccctgcagggcttggccaaccgctgcatgttcctagtagccctgaggctgctggccaagaagaagagggaggaggaggagagggacagacgcctcggcccctagaggataccacgagggaggctcaggagctggaggcccagctgtccctggtcagggaggggcctgtgtctgagccagagcctgggacccaggaggttctctgccagctcaagcgagaccagcccagcccgtgtctgagtagcgctgaggattctggggtggatgagggacaggggagcccttcggagatggtccattcctcggagttcagagtagacaacaatcacctgctcctgctcatgatccacgtgttccgagaaaacgaagagcagctgttcaaatccggtggccggggctggggcacctggtgcgcggtgccacggtatacggccga

SEQ ID NO: 426981 - DNA, 1055 bp, Homo sapiens
gggcgacggtggcagcgccatggagccgggggaggtgaaggaccggatcctggagaacatctcgctgtcggtgaagaagttgcagagctattttgctgcatgtgaggatgagatccctgccatccggaaccatgacaaggtcctacagcgtctgtgtgagcacctggaccacgccctgctgtacggactgcaagacctctcctctggctactgggtgctcgtggtgcattttactcggagagaggccatcaagcagatcgaggtgctgcagcacgtggccaccaacctggggcgcagccgtgcctggctgtacctggccctcaacgagaactccttggagagctacctgcggttgttccaggagaacctgggcctgctgcataagtactacgtcaagaatgccctggtctgcagccacgatcacctgacgctcttcctgaccttggtgtccgggctagagttcattcgtttcgagctggatctggatgccccttacctagacctggccccctacatgcccgactactacaaacctcagtacctgctggactttgaagaccgccttcccagctcggtccacggctcagacagtctgtccctcaactctttcaactccgtcacctccaccaacctggagtgggatgacagtgcgattgccccatctagtgaggatggagacctcacagacacggtcagtggtccccgctccacagcctccgacctgaccagcagcaaggcctccaccaggagccccacccagcgccagaaccccttcaacgaggagccggcagagactgtgtcctcctctgacaccacccccgtgcacaccacctctcaggagaaggaggaggcccaggccctggacccgccggatgcctgcacggagctcgaggtcatcagggtcaccaagaagaagaaagaggatgccctaaatgagaccagggaatcagagacaaagctgaaggagctcccaggagtgtgcaatgagaccatgatggccctctgggaagagtgtaagccctgcctgaaacagacctgcatgaagttctacgcac

SEQ ID NO: 426982 - DNA, 3753 bp, Homo sapiens
cattttccccgcacaactgctaaagctccagagacacgagcgtgtgtggcagcaagagccgccagttcgggaccaccgcagctggggtggcagcggcgcaggaggggtcgcggggagggagtggtgagcgcaggcggcaggggtctgggaaagacgaagtcgctatttgctgtctgagcgcgctcgcagctcctggaagtgttgccgcctctcggtttcgctctcgctcgctgcgctcctagaaggggcggccgcctccaggtgacacagacgggactctcgcttgcgctttccagatgcatcagagatacttttggactgaccagggccaagtggcgctcggcgggcactacatggcggagggtgaagggtacttcgccatgtctgaggacgagctggcctgcagcccctacatccccctaggcggcgacttcggcggcggcgaccttcggcggcggcgacttcggcggcggcgacttcggcggtggcggcagcttcggtgggcattgcttggactattgcgaaagccctacggcgcactgcaatgtgctgaactgggagcaagtgcagcggctggacggcatcctgagcgagaccattccgattcacgggcgcggcaacttccccacgctcgagctgcagccgagcctgatcgtgaaggtggtgcggcggcgcctggccgagaagcgcattggcgtccgcgacgtgcgcctcaacggctcggcagccagccatgtcctgcaccaggacagcggcctgggctacaaggacctggacctcatcttctgcgccgacctgcgcggggaaggggagtttcagactgtgaaggacgtcgtgctggactgcctgttggacttcttacccgagggggtgaacaaagagaagatcacaccactcacgctcaaggaagcttatgtgcagaaaatggttaaagtgtgcaatgactctgaccgatggagtcttatatccctgtcaaacaacagtggcaaaaatgtggaactgaaatttgtggattccctccggaggcagtttgaattcagtgtagattcttttcaaatcaaattagactctcttctgctcttttatgaatgttcagagaacccaatgactgagacatttcaccccacaataatcggggagagcgtctatggcgatttccaggaagcctttgatcacctttgtaacaagatcattgccaccaggaacccagaggaaatccgagggggaggcctgcttaagtactgcaacctcttggtgaggggctttaggcccgcctctgatgaaatcaagacccttcaaaggtatatgtgttccaggtttttcatcgacttctcagacattggagagcagcagagaaaactggagtcctatttgcagaaccactttgtgggattggaagaccgcaagtatgagtatctcatgacccttcatggagtggtaaatgagagcacagtgtgcctgatgggacatgaaagaagacagactttaaaccttatcaccatgctggctatccgggtgttagctgaccaaaatgtcattcctaatgtggctaatgtcacttgctattaccagccagccccctatgtagcagatgccaactttagcaattactacattgcacaggttcagccagtattcacgtgccagcaacagacctactccacttggctaccctgcaattaagaatcatttaaaaatgtcctgtggggaagccatttcagacaagacaggagagaaaaaaaaaaaaaagaaaaaaaaaagagtgatccagcccttattagggatgtgttttgtgcaatgatgatatgctcctggttttaagtttggcaaagcttatgtatcttttaatagatgtgggagcatgatctcgaaaggatccttttcccttctcttattctcctacccaattggattctatcctgcaaaaaaagagagacctgtcattagaagcaaccaggttctcctgatacaagagaagaaatgtgtgatgacaatatgggtttgctgtatctgctcccatagctttgccataggaaaaaaaaaaagtggaaagtttcttttaagatggaattcataaaagggaaaatacggaggaaaaaaggtctcactccaacttgtgaatcagtttaggagttcagatattaatagtaacaatacaggaaaaaggggaactccaacgttgggattactgtctgaggcttgtagcaagtgctttctgtggaatgatcttgttttgctaacaaacggcttgctccaaatgaacagtagtaggttggtgcagttctcgtaacaatcagcagaacttatgatgacacaatccattaattccagctgcgtgcatagatcacatttttaaaatgtaaaaatgcaagcaaaaacagctgtaacaaagaaagtgtgctcaaggaccaaagatttaacagataaaaatacccaattagaagagatatagtagactatatgaagagagattatatttgttacacaccaatatacatcaaagtgcctgttgccttctgaaaatttgaagtggcaaaattattttatggtttaatgattattttattttatcagggactgcctcaagaagaaaataacataagcttgtgaatggtggagaaaatgccctattttttcttgcaaatacttgtataaagttaacatttgttgatctgatattatcataggtacatgtgtatgtgtgtataaattatatgtgtgtgtgtatatatacattttatatatacattttatatgtatatatacacagtagattgactatgatctagaataatgtctcaaataggaaatgtttaaatactgtgtgtttttatgttttcaacaggataacatgagacgtgggcatattgcaatgatgaattaaatccacatctaaaaaaattaaatgaaggagggaaccaagtaatatatttcataggaagagcagaaattatactgttttagtgggatttttttttctttttttttttttctttggtgagccataaaattccacaaatgggagaatatttgtttggcagagcactcttttttatattgaactgccattttgacagttggaacccatttattaaaaaaaaaattgcattcctctatgatgtttaatctagtggatcatggatcagtaataggctacttaaatccctgactgctaaaaaggatttccggtgatctaaacactacttgctaatgtttaaatgaattttaatgaatgcattctgcatttctggaccactagaatttagtaatgtgaaatgaccctttttacagaatatttgcacaattgcttaaaatttatatatgagatatatattatatataacattttataaatcatgtcaatatgaaacatctttgatctggttgtcacactgcatttaaatatttagtactgtactttaaatcgctttccattaaatcaaatccaactttattttctttcttacaaaaataccagttatacctttgtgaaatgaactggcattactatttcagttcaataacagctaatcctaaaaccaccctttctcctagccagtagttcctctagatactggtctctgaaaatgcatttgttaaaaacaaaacaaaactaacacataagaaccttccctttgtgttgtgaaacaaccacataatctccacaaccttagtggatgactgcttgctatgataattcctcgaagacccaattaggaagattttcatcatcagttaaagagagaccacggg

SEQ ID NO: 426983 - DNA, 3261 bp, Homo sapiens
cattttccccgcacaactgctaaagctccagagacacgagcgtgtgtggcagcaagagccgccagttcgggaccaccgcagctggggtggcagcggcgcaggaggggtcgcggggagggagtggtgagcgcaggcggcaggggtctgggaaagacgaagtcgctatttgctgtctgagcgcgctcgcagctcctggaagtgttgccgcctctcggtttcgctctcgctcgctgcgctcctagaaggggcggccgcctccaggtgacacagacgggactctcgcttgcgctttccagatgcatcagagatacttttggactgaccagggccaagtggcgctcggcgggcactacatggcggagggtgaagggtacttcgccatgtctgaggacgagctggcctgcagcccctacatccccctaggcggcgacttcggcggcggcgaccttcggcggcggcgacttcggcggcggcgacttcggcggtggcggcagcttcggtgggcattgcttggactattgcgaaagccctacggcgcactgcaatgtgctgaactgggagcaagtgcagcggctggacggcatcctgagcgagaccattccgattcacgggcgcggcaacttccccacgctcgagctgcagccgagcctgatcgtgaaggtggtgcggcggcgcctggccgagaagcgcattggcgtccgcgacgtgcgcctcaacggctcggcagccagccatgtcctgcaccaggacagcggcctgggctacaaggacctggacctcatcttctgcgccgacctgcgcggggaaggggagtttcagactgtgaaggacgtcgtgctggactgcctgttggacttcttacccgagggggtgaacaaagagaagatcacaccactcacgctcaaggaagcttatgtgcagaaaatggttaaagtgtgcaatgactctgaccgatggagtcttatatccctgtcaaacaacagtggcaaaaatgtggaactgaaatttgtggattccctccggaggcagtttgaattcagtgtagattcttttcaaatcaaattagactctcttctgctcttttatgaatgttcagagaacccaatgactgagacatttcaccccacaataatcggggagagcgtctatggcgatttccaggaagcctttgatcacctttgtaacaagatcattgccaccaggaacccagaggaaatccgagggggaggcctgcttaagtactgcaacctcttggtgaggggctttaggcccgcctctgatgaaatcaagacccttcaaaggtatatgtgttccaggtttttcatcgacttctcagacattggagagcagcagagaaaactggagtcctatttgcagaaccactttgtgggattggaagaccgcaagtatgagtatctcatgacccttcatggagtggtaaatgagagcacagtgtgcctgatgggacatgaaagaagacagactttaaaccttatcaccatgctggctatccgggtgttagctgaccaaaatgtcattcctaatgtggctaatgtcacttgctattaccagccagccccctatgtagcagatgccaactttagcaattactacattgcacaggttcagccagtattcacgtgccagcaacagacctactccacttggctaccctgcaattaagaatcatttaaaaatgtcctgtggggaagccatttcagacaagacaggagagaaaaaaaaaaaaaagaaaaaaaaaagagtgatccagcccttattagggatgtgttttgtgcaatgatgatatgctcctggttttaagtttggcaaagcttatgtatcttttaatagatgtgggagcatgatctcgaaaggatccttttcccttctcttattctcctacccaattggattctatcctgcaaaaaaagagagacctgtcattagaagcaaccaggttctcctgatacaagagaagaaatgtgtgatgacaatatgggtttgctgtatctgctcccatagctttgccataggaaaaaaaaaaagtggaaagtttcttttaagatggaattcataaaagggaaaatacggaggaaaaaaggtctcactccaacttgtgaatcagtttaggagttcagatattaatagtaacaatacaggaaaaaggggaactccaacgttgggattactgtctgaggcttgtagcaagtgctttctgtggaatgatcttgttttgctaacaaacggcttgctccaaatgaacagtagtaggttggtgcagttctcgtaacaatcagcagaacttatgatgacacaatccattaattccagctgcgtgcatagatcacatttttaaaatgtaaaaatgcaagcaaaaacagctgtaacaaagaaagtgtgctcaaggaccaaagatttaacagataaaaatacccaattagaagagatatagtagactatatgaagagagattatatttgttacacaccaatatacatcaaagtgcctgttgccttctgaaaatttgaagtggcaaaattattttatggtttaatgattattttattttatcagggactgcctcaagaagaaaataacataagcttgtgaatggtggagaaaatgccctattttttcttgcaaatacttgtataaagttaacatttgttgatctgatattatcataggtacatgtgtatgtgtgtataaattatatgtgtgtgtgtatatatacattttatatatacattttatatgtatatatacacagtagattgactatgatctagaataatgtctcaaataggaaatgtttaaatactgtgtgtttttatgttttcaacaggataacatgagacgtgggcatattgcaatgatgaattaaatccacatctaaaaaaattaaatgaaggagggaaccaagtaatatatttcataggaagagcagaaattatactgttttagtgggatttttttttctttttttttttttctttggtgagccataaaattccacaaatgggagaatatttgtttggcagagcactcttttttatattgaactgccattttgacagttggaacccatttattaaaaaaaaaattgcattcctctatgatgtttaatctagtggatcatggatcagtaataggctacttaaatccctgactgctaaaaaggatttccggtgatctcttaaattagtaagggaaatgaccttttacagattgcatgtaatatttgagttttttactttactg

SEQ ID NO: 426984 - DNA, 3682 bp, Homo sapiens
cattttccccgcacaactgctaaagctccagagacacgagcgtgtgtggcagcaagagccgccagttcgggaccaccgcagctggggtggcagcggcgcaggaggggtcgcggggagggagtggtgagcgcaggcggcaggggtctgggaaagacgaagtcgctatttgctgtctgagcgcgctcgcagctcctggaagtgttgccgcctctcggtttcgctctcgctcgctgcgctcctagaaggggcggccgcctccaggactgaccagggccaagtggcgctcggcgggcactacatggcggagggtgaagggtacttcgccatgtctgaggacgagctggcctgcagcccctacatccccctaggcggcgacttcggcggcggcgacttcggcggcggcgacttcggcggtggcggcagcttcggtgggcattgcttggactattgcgaaagccctacggcgcactgcaatgtgctgaactgggagcaagtgcagcggctggacggcatcctgagcgagaccattccgattcacgggcgcggcaacttccccacgctcgagctgcagccgagcctgatcgtgaaggtggtgcggcggcgcctggccgagaagcgcattggcgtccgcgacgtgcgcctcaacggctcggcagccagccatgtcctgcaccaggacagcggcctgggctacaaggacctggacctcatcttctgcgccgacctgcgcggggaaggggagtttcagactgtgaaggacgtcgtgctggactgcctgttggacttcttacccgagggggtgaacaaagagaagatcacaccactcacgctcaaggaagcttatgtgcagaaaatggttaaagtgtgcaatgactctgaccgatggagtcttatatccctgtcaaacaacagtggcaaaaatgtggaactgaaatttgtggattccctccggaggcagtttgaattcagtgtagattcttttcaaatcaaattagactctcttctgctcttttatgaatgttcagagaacccaatgactgagacatttcaccccacaataatcggggagagcgtctatggcgatttccaggaagcctttgatcacctttgtaacaagatcattgccaccaggaacccagaggaaatccgagggggaggcctgcttaagtactgcaacctcttggtgaggggctttaggcccgcctctgatgaaatcaagacccttcaaaggtatatgtgttccaggtttttcatcgacttctcagacattggagagcagcagagaaaactggagtcctatttgcagaaccactttgtgggattggaagaccgcaagtatgagtatctcatgacccttcatggagtggtaaatgagagcacagtgtgcctgatgggacatgaaagaagacagactttaaaccttatcaccatgctggctatccgggtgttagctgaccaaaatgtcattcctaatgtggctaatgtcacttgctattaccagccagccccctatgtagcagatgccaactttagcaattactacattgcacaggttcagccagtattcacgtgccagcaacagacctactccacttggctaccctgcaattaagaatcatttaaaaatgtcctgtggggaagccatttcagacaagacaggagagaaaaaaaaaaaaaagaaaaaaaaaagagtgatccagcccttattagggatgtgttttgtgcaatgatgatatgctcctggttttaagtttggcaaagcttatgtatcttttaatagatgtgggagcatgatctcgaaaggatccttttcccttctcttattctcctacccaattggattctatcctgcaaaaaaagagagacctgtcattagaagcaaccaggttctcctgatacaagagaagaaatgtgtgatgacaatatgggtttgctgtatctgctcccatagctttgccataggaaaaaaaaaaagtggaaagtttcttttaagatggaattcataaaagggaaaatacggaggaaaaaaggtctcactccaacttgtgaatcagtttaggagttcagatattaatagtaacaatacaggaaaaaggggaactccaacgttgggattactgtctgaggcttgtagcaagtgctttctgtggaatgatcttgttttgctaacaaacggcttgctccaaatgaacagtagtaggttggtgcagttctcgtaacaatcagcagaacttatgatgacacaatccattaattccagctgcgtgcatagatcacatttttaaaatgtaaaaatgcaagcaaaaacagctgtaacaaagaaagtgtgctcaaggaccaaagatttaacagataaaaatacccaattagaagagatatagtagactatatgaagagagattatatttgttacacaccaatatacatcaaagtgcctgttgccttctgaaaatttgaagtggcaaaattattttatggtttaatgattattttattttatcagggactgcctcaagaagaaaataacataagcttgtgaatggtggagaaaatgccctattttttcttgcaaatacttgtataaagttaacatttgttgatctgatattatcataggtacatgtgtatgtgtgtataaattatatgtgtgtgtgtatatatacattttatatatacattttatatgtatatatacacagtagattgactatgatctagaataatgtctcaaataggaaatgtttaaatactgtgtgtttttatgttttcaacaggataacatgagacgtgggcatattgcaatgatgaattaaatccacatctaaaaaaattaaatgaaggagggaaccaagtaatatatttcataggaagagcagaaattatactgttttagtgggatttttttttctttttttttttttctttggtgagccataaaattccacaaatgggagaatatttgtttggcagagcactcttttttatattgaactgccattttgacagttggaacccatttattaaaaaaaaaattgcattcctctatgatgtttaatctagtggatcatggatcagtaataggctacttaaatccctgactgctaaaaaggatttccggtgatctaaacactacttgctaatgtttaaatgaattttaatgaatgcattctgcatttctggaccactagaatttagtaatgtgaaatgaccctttttacagaatatttgcacaattgcttaaaatttatatatgagatatatattatatataacattttataaatcatgtcaatatgaaacatctttgatctggttgtcacactgcatttaaatatttagtactgtactttaaatcgctttccattaaatcaaatccaactttattttctttcttacaaaaataccagttatacctttgtgaaatgaactggcattactatttcagttcaataacagctaatcctaaaaccaccctttctcctagccagtagttcctctagatactggtctctgaaaatgcatttgttaaaaacaaaacaaaactaacacataagaaccttccctttgtgttgtgaaacaaccacataatctccacaaccttagtggatgactgcttgctatgataattcctcgaagacccaattaggaagattttcatcatcagttaaagagagaccacggg

SEQ ID NO: 426985 - DNA, 3560 bp, Homo sapiens
cattttccccgcacaactgctaaagctccagagacacgagcgtgtgtggcagcaagagccgccagttcgggaccaccgcagctggggtggcagcggcgcaggaggggtcgcggggagggagtggactgaccagggccaagtggcgctcggcgggcactacatggcggagggtgaagggtacttcgccatgtctgaggacgagctggcctgcagcccctacatccccctaggcggcgacttcggcggcggcgaccttcggcggcggcgacttcggcggcggcgacttcggcggtggcggcagcttcggtgggcattgcttggactattgcgaaagccctacggcgcactgcaatgtgctgaactgggagcaagtgcagcggctggacggcatcctgagcgagaccattccgattcacgggcgcggcaacttccccacgctcgagctgcagccgagcctgatcgtgaaggtggtgcggcggcgcctggccgagaagcgcattggcgtccgcgacgtgcgcctcaacggctcggcagccagccatgtcctgcaccaggacagcggcctgggctacaaggacctggacctcatcttctgcgccgacctgcgcggggaaggggagtttcagactgtgaaggacgtcgtgctggactgcctgttggacttcttacccgagggggtgaacaaagagaagatcacaccactcacgctcaaggaagcttatgtgcagaaaatggttaaagtgtgcaatgactctgaccgatggagtcttatatccctgtcaaacaacagtggcaaaaatgtggaactgaaatttgtggattccctccggaggcagtttgaattcagtgtagattcttttcaaatcaaattagactctcttctgctcttttatgaatgttcagagaacccaatgactgagacatttcaccccacaataatcggggagagcgtctatggcgatttccaggaagcctttgatcacctttgtaacaagatcattgccaccaggaacccagaggaaatccgagggggaggcctgcttaagtactgcaacctcttggtgaggggctttaggcccgcctctgatgaaatcaagacccttcaaaggtatatgtgttccaggtttttcatcgacttctcagacattggagagcagcagagaaaactggagtcctatttgcagaaccactttgtgggattggaagaccgcaagtatgagtatctcatgacccttcatggagtggtaaatgagagcacagtgtgcctgatgggacatgaaagaagacagactttaaaccttatcaccatgctggctatccgggtgttagctgaccaaaatgtcattcctaatgtggctaatgtcacttgctattaccagccagccccctatgtagcagatgccaactttagcaattactacattgcacaggttcagccagtattcacgtgccagcaacagacctactccacttggctaccctgcaattaagaatcatttaaaaatgtcctgtggggaagccatttcagacaagacaggagagaaaaaaaaaaaaaagaaaaaaaaaagagtgatccagcccttattagggatgtgttttgtgcaatgatgatatgctcctggttttaagtttggcaaagcttatgtatcttttaatagatgtgggagcatgatctcgaaaggatccttttcccttctcttattctcctacccaattggattctatcctgcaaaaaaagagagacctgtcattagaagcaaccaggttctcctgatacaagagaagaaatgtgtgatgacaatatgggtttgctgtatctgctcccatagctttgccataggaaaaaaaaaaagtggaaagtttcttttaagatggaattcataaaagggaaaatacggaggaaaaaaggtctcactccaacttgtgaatcagtttaggagttcagatattaatagtaacaatacaggaaaaaggggaactccaacgttgggattactgtctgaggcttgtagcaagtgctttctgtggaatgatcttgttttgctaacaaacggcttgctccaaatgaacagtagtaggttggtgcagttctcgtaacaatcagcagaacttatgatgacacaatccattaattccagctgcgtgcatagatcacatttttaaaatgtaaaaatgcaagcaaaaacagctgtaacaaagaaagtgtgctcaaggaccaaagatttaacagataaaaatacccaattagaagagatatagtagactatatgaagagagattatatttgttacacaccaatatacatcaaagtgcctgttgccttctgaaaatttgaagtggcaaaattattttatggtttaatgattattttattttatcagggactgcctcaagaagaaaataacataagcttgtgaatggtggagaaaatgccctattttttcttgcaaatacttgtataaagttaacatttgttgatctgatattatcataggtacatgtgtatgtgtgtataaattatatgtgtgtgtgtatatatacattttatatatacattttatatgtatatatacacagtagattgactatgatctagaataatgtctcaaataggaaatgtttaaatactgtgtgtttttatgttttcaacaggataacatgagacgtgggcatattgcaatgatgaattaaatccacatctaaaaaaattaaatgaaggagggaaccaagtaatatatttcataggaagagcagaaattatactgttttagtgggatttttttttctttttttttttttctttggtgagccataaaattccacaaatgggagaatatttgtttggcagagcactcttttttatattgaactgccattttgacagttggaacccatttattaaaaaaaaaattgcattcctctatgatgtttaatctagtggatcatggatcagtaataggctacttaaatccctgactgctaaaaaggatttccggtgatctaaacactacttgctaatgtttaaatgaattttaatgaatgcattctgcatttctggaccactagaatttagtaatgtgaaatgaccctttttacagaatatttgcacaattgcttaaaatttatatatgagatatatattatatataacattttataaatcatgtcaatatgaaacatctttgatctggttgtcacactgcatttaaatatttagtactgtactttaaatcgctttccattaaatcaaatccaactttattttctttcttacaaaaataccagttatacctttgtgaaatgaactggcattactatttcagttcaataacagctaatcctaaaaccaccctttctcctagccagtagttcctctagatactggtctctgaaaatgcatttgttaaaaacaaaacaaaactaacacataagaaccttccctttgtgttgtgaaacaaccacataatctccacaaccttagtggatgactgcttgctatgataattcctcgaagacccaattaggaagattttcatcatcagttaaagagagaccacggg

SEQ ID NO: 426986 - DNA, 487 bp, Homo sapiens
ccatgtcctgcaccaggacagcggcctgggctacaaggacctggacctcatcttctgcgccgacctgcgcggggaaggggagtttcagactgtgaaggacgtcgtgctggactgcctgttggacttcttacccgagggggtgaacaaagagaagatcacaccactcacgctcaaggtaacaccacccgagatgcacttgggtcctgacccagtctgggccgggtgtgacggggagcgggcagaggggcatcggttaaatgccatgaatctgtggccatcacgagtttgggcgcgcgttatttctttgatttttgattttttaaaccagtaaactgacgtgcgtggacggtgttgagtgtttcagtttacttgatgctttggcgctacaactcttctcccaggtcctcctctgccctctcttctcttctttctccttatgttttaactcttggctttccctgttggagtcttgtccagagtagattct

SEQ ID NO: 426987 - DNA, 1471 bp, Homo sapiens
tgccgggagctgggaagcccggcgcgcgtcgtttgctggggctgtttgtgcgttgctgctgtgctaccgcgttgcgttttctaggcatttacttacacgctttgtggtttacgctctcataaccttgtggttttatagtccttaaattattgtagcgcacgttacttaaatccagaagcagatgtgtaccccagcaagagataaaatgacgctcagagtcagtagatccagaccgtgcctgagatcctgaatcctgtttcctacccactattcagccattgggtcacaagcgatgaaaagagcaccttgaagatttgtggtctgcattatgtctggagccagaagtaagcttgctcttttcctctgcggctgttacgtggttgccctgggagcccacaccggggaggagagcgtggctgaccatcacgaggctgaatattatgtggctgccgtgtatgagcatccatccatcctgagtctgaaccctctggctctcatcagccgccaagaggccttggagctcatgaaccagaaccttgacatctatgaacagcaagtgatgactgcagcccaaaaggatgtacagattatagtgtttccagaagatggcattcatggattcaactttacaagaacatccatttatccatttttggacttcatgccgtctccccaggtggtcaggtggaacccatgcctggagcctcaccgcttcaatgacacagaggtgattcctgcctttttcctcagtaggctgagggtacacagaggtgatctaagtcagggaccagaagctgtgacatgttaactaagattgataggagaccttaacatccccaaaatccaacccaaactcccaaagatccatgtgccacatgttcattccattaaagaatgtctgacgttacaaggcagttattcatctatggatctttccatttattaattacacaataaatacaggaatgtatacttaaaccaaaccaaaagtaaaaaaagaaaagttcatcttcaccacagcctgcacctcatcccatgcccttgcttagagaaactgccatcaacaatttgatgtgcattcagttgtattcttttctatgcatttcatagttattgacatcctcttttttttttttttttttgagatggagtcttactctgccacccaggctggagcgcagtggcgcgatctcagctcactgcaagctctgccttccgggttcatgccattctcctgcctcagcctcccgagtagctgggactacaggcacccaccaccacgcccggctaattttttttgtgtgtgtatttttagtagagatggggtttcaccatgttagccaggatggtctcgatctcctgaccttgtgatctgtctacctcggcctgccaaagtgctgggattacaggcatgagccactgtgcctggccttgacatcctctttttaagcatactatatgcttattcatt

SEQ ID NO: 426988 - DNA, 1295 bp, Homo sapiens
gcctatgcaaagcagacagatttccccacgcagacgctgtgtgtcacagggggaatgggcagctgtcactttttacatccagtcatattgtatgaaattgcaagcaaattcaaaaagatgccatcgtgggagtgtgatttgtggtctgcattatgtctggagccagaagtaagcttgctcttttcctctgcggctgttacgtggttgccctgggagcccacaccggggaggagagcgtggctgaccatcacgaggctgaatattatgtggctgccgtgtatgagcatccatccatcctgagtctgaaccctctggctctcatcagccgccaagaggccttggagctcatgaaccagaaccttgacatctatgaacagcaagtgatgactgcagcccaaaaggatgtacagattatagtgtttccagaagatggcattcatggattcaactttacaagaacatccatttatccatttttggacttcatgccgtctccccaggtggtcaggtggaacccatgcctggagcctcaccgcttcaatgacacagaggtgattcctgcctttttcctcagtaggctgagggtacacagaggtgatctaagtcagggaccagaagctgtgacatgttaactaagattgataggagaccttaacatccccaaaatccaacccaaactcccaaagatccatgtgccacatgttcattccattaaagaatgtctgacgttacaaggcagttattcatctatggatctttccatttattaattacacaataaatacaggaatgtatacttaaaccaaaccaaaagtaaaaaaagaaaagttcatcttcaccacagcctgcacctcatcccatgcccttgcttagagaaactgccatcaacaatttgatgtgcattcagttgtattcttttctatgcatttcatagttattgacatcctcttttttttttttttttttgagatggagtcttactctgccacccaggctggagcgcagtggcgcgatctcagctcactgcaagctctgccttccgggttcatgccattctcctgcctcagcctcccgagtagctgggactacaggcacccaccaccacgcccggctaattttttttgtgtgtgtatttttagtagagatggggtttcaccatgttagccaggatggtctcgatctcctgaccttgtgatctgtctacctcggcctgccaaagtgctgggattacaggcatgagccactgtgcctggccttgacatcctctttttaagcatactatatgcttattcatt

SEQ ID NO: 426989 - DNA, 2099 bp, Homo sapiens
agaatgccagagggaggcgggactagcaggagattgctgcctatgcaaagcaggtaagaagccgaactctgaggcctctcgccattgtctccgagtcggccagctggagcgttttcggggctgtaaagggagaatggcgcatgcgcatattcagggcggaaggcgcgctaagagcagatttgtggtctgcattatgtctggagccagaagtaagcttgctcttttcctctgcggctgttacgtggttgccctgggagcccacaccggggaggagagcgtggctgaccatcacgaggctgaatattatgtggctgccgtgtatgagcatccatccatcctgagtctgaaccctctggctctcatcagccgccaagaggccttggagctcatgaaccagaaccttgacatctatgaacagcaagtgatgactgcagcccaaaaggatgtacagattatagtgtttccagaagatggcattcatggattcaactttacaagaacatccatttatccatttttggacttcatgccgtctccccaggtggtcaggtggaacccatgcctggagcctcaccgcttcaatgacacagaggtgctccagcgcctgagttgtatggccatcaggggagatatgttcttggtggccaatcttgggacaaaggagccttgtcatagcagtgacccaaggtgcccaaaagatgggagataccagttcaacacaaatgtcgtgttcagcaataatggaacccttgttgaccgctaccgtaaacacaacctctactttgaggcagcattcgatgttcctcttaaagtggatctcatcacctttgataccccctttgctggcaggtttggcatcttcacatgctttgatatattgttctttgaccctgccatcagagtcctcagagactacaaggtgaagcatgttgtgtacccaactgcctggatgaaccagctcccactcttggcagcaattgagattcagaaagcttttgctgttgcctttggcatcaacgttctggcagctaatgtccaccacccagttctggggatgacaggaagtggcatacacacccctctggagtccttttggtaccatgacatggaaaatcccaaaagtcaccttataattgcccaggtggccaaaaatccagtgggtctcattggtgcagagaatgcaacaggtgaaacggacccatcccatagtaagtttttaaaaattttgtcaggcgatccgtactgtgagaaggatgctcaggaagtccactgtgatgaggccaccaagtggaacgtgaatgctcctcccacatttcactctgagatgatgtatgacaatttcaccctggtccctgtctggggaaaggaaggctatctccacgtctgttccaatggcctctgctgttatttactttacgagaggcccaccttatccaaagagctgtatgccctgggggtctttgatgggcttcacacagtacatggcacttactacatccaagtgtgtgccctggtcaggtgtgggggtcttggcttcgacacctgtggacaggaaatcacagaggccacggggatatttgagtttcacctgtggggcaacttcagtacttcctatatctttcctttgtttctgacctcagggatgaccctagaagtccctgaccagcttggctgggagaatgaccactatttcctgaggaaaagtaggctgtcctctgggctggtgacggcggctctctatgggcgcttgtatgagagggactaggaaaagtgtgtggtctgtggggcggactctggccatcatgttgacagccttgcacttccacaggctacaagccctgggaccatctttctgccttaagggcaggagcccacttctgtggcaccagattccaccctgggaactgtggaaaaagtaggagaggcagattccctcagtgtcttcctcttaaacctcaatcatcgagacattagggggtattttctgttcacatttatctttttcaagccacatcttcctctaacaaatctctcagtatgcgattggtctcaagctaaaacaaaaataaatgtcagtttatattttacacatccacaaa

SEQ ID NO: 426990 - DNA, 2234 bp, Homo sapiens
tgccgggagctgggaagcccggcgcgcgtcgtttgctggggctgtttgtgcgttgctgctgtgctaccgcgttgcgttttctaggcatttacttacacgctttgtggtttacgctctcataaccttgtggttttatagtccttaaattattgtagcgcacgttacttaaatccagaagcagatgtgtaccccagcaagagataaaatgacgctcagagtcagtagatccagaccgtgcctgagatcctgaatcctgtttcctacccactattcagccattgggtcacaagcgatgaaaagagcaccttgaagatttgtggtctgcattatgtctggagccagaagtaagcttgctcttttcctctgcggctgttacgtggttgccctgggagcccacaccggggaggagagcgtggctgaccatcacgaggctgaatattatgtggctgccgtgtatgagcatccatccatcctgagtctgaaccctctggctctcatcagccgccaagaggccttggagctcatgaaccagaaccttgacatctatgaacagcaagtgatgactgcagcccaaaaggatgtacagattatagtgtttccagaagatggcattcatggattcaactttacaagaacatccatttatccatttttggacttcatgccgtctccccaggtggtcaggtggaacccatgcctggagcctcaccgcttcaatgacacagaggtgctccagcgcctgagttgtatggccatcaggggagatatgttcttggtggccaatcttgggacaaaggagccttgtcatagcagtgacccaaggtgcccaaaagatgggagataccagttcaacacaaatgtcgtgttcagcaataatggaacccttgttgaccgctaccgtaaacacaacctctactttgaggcagcattcgatgttcctcttaaagtggatctcatcacctttgataccccctttgctggcaggtttggcatcttcacatgctttgatatattgttctttgaccctgccatcagagtcctcagagactacaaggtgaagcatgttgtgtacccaactgcctggatgaaccagctcccactcttggcagcaattgagattcagaaagcttttgctgttgcctttggcatcaacgttctggcagctaatgtccaccacccagttctggggatgacaggaagtggcatacacacccctctggagtccttttggtaccatgacatggaaaatcccaaaagtcaccttataattgcccaggtggccaaaaatccagtgggtctcattggtgcagagaatgcaacaggtgaaacggacccatcccatagtaagtttttaaaaattttgtcaggcgatccgtactgtgagaaggatgctcaggaagtccactgtgatgaggccaccaagtggaacgtgaatgctcctcccacatttcactctgagatgatgtatgacaatttcaccctggtccctgtctggggaaaggaaggctatctccacgtctgttccaatggcctctgctgttatttactttacgagaggcccaccttatccaaagagctgtatgccctgggggtctttgatgggcttcacacagtacatggcacttactacatccaagtgtgtgccctggtcaggtgtgggggtcttggcttcgacacctgtggacaggaaatcacagaggccacggggatatttgagtttcacctgtggggcaacttcagtacttcctatatctttcctttgtttctgacctcagggatgaccctagaagtccctgaccagcttggctgggagaatgaccactatttcctgaggaaaagtaggctgtcctctgggctggtgacggcggctctctatgggcgcttgtatgagagggactaggaaaagtgtgtggtctgtggggcggactctggccatcatgttgacagccttgcacttccacaggctacaagccctgggaccatctttctgccttaagggcaggagcccacttctgtggcaccagattccaccctgggaactgtggaaaaagtaggagaggcagattccctcagtgtcttcctcttaaacctcaatcatcgagacattagggggtattttctgttcacatttatctttttcaagccacatcttcctctaacaaatctctcagtatgcgattggtctcaagctaaaacaaaaataaatgtcagtttatattttacacatccacaaa

SEQ ID NO: 426991 - DNA, 1975 bp, Homo sapiens
agaatgccagagggaggcgggactagcaggagattgctgcctatgcaaagcagatttgtggtctgcattatgtctggagccagaagtaagcttgctcttttcctctgcggctgttacgtggttgccctgggagcccacaccggggaggagagcgtggctgaccatcacgaggctgaatattatgtggctgccgtgtatgagcatccatccatcctgagtctgaaccctctggctctcatcagccgccaagaggccttggagctcatgaaccagaaccttgacatctatgaacagcaagtgatgactgcagcccaaaaggatgtacagattatagtgtttccagaagatggcattcatggattcaactttacaagaacatccatttatccatttttggacttcatgccgtctccccaggtggtcaggtggaacccatgcctggagcctcaccgcttcaatgacacagaggtgctccagcgcctgagttgtatggccatcaggggagatatgttcttggtggccaatcttgggacaaaggagccttgtcatagcagtgacccaaggtgcccaaaagatgggagataccagttcaacacaaatgtcgtgttcagcaataatggaacccttgttgaccgctaccgtaaacacaacctctactttgaggcagcattcgatgttcctcttaaagtggatctcatcacctttgataccccctttgctggcaggtttggcatcttcacatgctttgatatattgttctttgaccctgccatcagagtcctcagagactacaaggtgaagcatgttgtgtacccaactgcctggatgaaccagctcccactcttggcagcaattgagattcagaaagcttttgctgttgcctttggcatcaacgttctggcagctaatgtccaccacccagttctggggatgacaggaagtggcatacacacccctctggagtccttttggtaccatgacatggaaaatcccaaaagtcaccttataattgcccaggtggccaaaaatccagtgggtctcattggtgcagagaatgcaacaggtgaaacggacccatcccatagtaagtttttaaaaattttgtcaggcgatccgtactgtgagaaggatgctcaggaagtccactgtgatgaggccaccaagtggaacgtgaatgctcctcccacatttcactctgagatgatgtatgacaatttcaccctggtccctgtctggggaaaggaaggctatctccacgtctgttccaatggcctctgctgttatttactttacgagaggcccaccttatccaaagagctgtatgccctgggggtctttgatgggcttcacacagtacatggcacttactacatccaagtgtgtgccctggtcaggtgtgggggtcttggcttcgacacctgtggacaggaaatcacagaggccacggggatatttgagtttcacctgtggggcaacttcagtacttcctatatctttcctttgtttctgacctcagggatgaccctagaagtccctgaccagcttggctgggagaatgaccactatttcctgaggaaaagtaggctgtcctctgggctggtgacggcggctctctatgggcgcttgtatgagagggactaggaaaagtgtgtggtctgtggggcggactctggccatcatgttgacagccttgcacttccacaggctacaagccctgggaccatctttctgccttaagggcaggagcccacttctgtggcaccagattccaccctgggaactgtggaaaaagtaggagaggcagattccctcagtgtcttcctcttaaacctcaatcatcgagacattagggggtattttctgttcacatttatctttttcaagccacatcttcctctaacaaatctctcagtatgcgattggtctcaagctaaaacaaaaataaatgtcagtttatattttacacatccacaaa

SEQ ID NO: 426992 - DNA, 1728 bp, Homo sapiens
agaatgccagagggaggcgggactagcaggagattgctgcctatgcaaagcaggtaagaagccgaactctgaggcctctcgccattgtctccgagtcggccagctggagcgttttcggggctgtaaagggagaatggcgcatgcgcatattcagggcggaaggcgcgctaagagcagatttgtggtctgcattatgtctggagccagaagtaagcttgctcttttcctctgcggctgttacgtggttgccctgggagcccacaccggggaggagagcgtggctgaccatcacgaggctgaatattatgtggctgccgtgtatgagcatccatccatcctgagtctgaaccctctggctctcatcagccgccaagaggccttggagctcatgaaccagaaccttgacatctatgaacagcaagtgatgactgcagcccaaaaggatgtacagattatagtgtttccagaagatggcattcatggattcaactttacaagaacatccatttatccatttttggacttcatgccgtctccccaggtggtcaggtggaacccatgcctggagcctcaccgcttcaatgacacagaggtgctccagcgcctgagttgtatggccatcaggggagatatgttcttggtggccaatcttgggacaaaggagccttgtcatagcagtgacccaaggtgcccaaaagatgggagataccagttcaacacaaatgtcgtgttcagcaataatggaacccttgttgaccgctaccgtaaacacaacctctactttgaggcagcattcgatgttcctcttaaagtggatctcatcacctttgataccccctttgctggcaggtttggcatcttcacatgctttgatatattgttctttgaccctgccatcagagtcctcagagactacaaggtgaagcatgttgtgtacccaactgcctggatgaaccagctcccactcttggcagcaattgagattcagaaagcttttgctgttgcctttggcatcaacgttctggcagctaatgtccaccacccagttctggggatgacaggaagtggcatacacacccctctggagtccttttggtaccatgacatggaaaatcccaaaagtcaccttataattgcccaggtggccaaaaatccagtgggtctcattggtgcagagaatgcaacaggtgaaacggacggggatatttgagtttcacctgtggggcaacttcagtacttcctatatctttcctttgtttctgacctcagggatgaccctagaagtccctgaccagcttggctgggagaatgaccactatttcctgaggaaaagtaggctgtcctctgggctggtgacggcggctctctatgggcgcttgtatgagagggactaggaaaagtgtgtggtctgtggggcggactctggccatcatgttgacagccttgcacttccacaggctacaagccctgggaccatctttctgccttaagggcaggagcccacttctgtggcaccagattccaccctgggaactgtggaaaaagtaggagaggcagattccctcagtgtcttcctcttaaacctcaatcatcgagacattagggggtattttctgttcacatttatctttttcaagccacatcttcctctaacaaatctctcagtatgcgattggtctcaagctaaaacaaaaataaatgtcagtttatattttacacatccacaaa

SEQ ID NO: 426993 - DNA, 1336 bp, Homo sapiens
agaatgccagagggaggcgggactagcaggagattgctgcctatgcaaagcaggtaagaagccgaactctgaggcctctcgccattgtctccgagtcggccagctggagcgttttcggggctgtaaagggagaatggcgcatgcgcatattcagggcggaaggcgcgctaagagcagatttgtggtctgcattatgtctggagccagaagtaagcttgctcttttcctctgcggctgttacgtggttgccctgggagcccacaccggggaggagagcgtggctgaccatcacgaggctgaatattatgtggctgccgtgtatgagcatccatccatcctgagtctgaaccctctggctctcatcagccgccaagaggccttggagctcatgaaccagaaccttgacatctatgaacagcaagtgatgactgcagcccaaaaggatgtacagattatagtgtttccagaagatggcattcatggattcaactttacaagaacatccatttatccatttttggacttcatgccgtctccccaggtggtcaggtggaacccatgcctggagcctcaccgcttcaatgacacagaggtgattcctgcctttttcctcagtaggctgagggtacacagaggtgatctaagtcagggaccagaagctgtgacatgttaactaagattgataggagaccttaacatccccaaaatccaacccaaactcccaaagatccatgtgccacatgttcattccattaaagaatgtctgacgttacaaggcagttattcatctatggatctttccatttattaattacacaataaatacaggaatgtatacttaaaccaaaccaaaagtaaaaaaagaaaagttcatcttcaccacagcctgcacctcatcccatgcccttgcttagagaaactgccatcaacaatttgatgtgcattcagttgtattcttttctatgcatttcatagttattgacatcctcttttttttttttttttttgagatggagtcttactctgccacccaggctggagcgcagtggcgcgatctcagctcactgcaagctctgccttccgggttcatgccattctcctgcctcagcctcccgagtagctgggactacaggcacccaccaccacgcccggctaattttttttgtgtgtgtatttttagtagagatggggtttcaccatgttagccaggatggtctcgatctcctgaccttgtgatctgtctacctcggcctgccaaagtgctgggattacaggcatgagccactgtgcctggccttgacatcctctttttaagcatactatatgcttattcatt

SEQ ID NO: 426994 - DNA, 543 bp, Homo sapiens
agaatgccagagggaggcgggactagcaggagattgctgcctatgcaaagcaggtaagaagccgaactctgaggcctctcgccattgtctccgagtcggccagctggagcgttttcggggctgtaaagggagaatggcgcatgcgcatattcagggcggaaggcgcgctaagagcagatttgtggtctgcattatgtctggagccagaagtaagcttgctcttttcctctgcggactctggccatcatgttgacagccttgcacttccacaggctacaagccctgggaccatctttctgccttaagggcaggagcccacttctgtggcaccagattccaccctgggaactgtggaaaaagtaggagaggcagattccctcagtgtcttcctcttaaacctcaatcatcgagacattagggggtattttctgttcacatttatctttttcaagccacatcttcctctaacaaatctctcagtatgcgattggtctcaagctaaaacaaaaataaatgtcagtttatattttacacatccacaaa

SEQ ID NO: 426995 - DNA, 393 bp, Homo sapiens
agtaggagaggcagattccctcagtgtcttcctcttaaacctcaatcatcgagacattagggggtattttctgttcacatttatctttttcaagccacatcttcctctaacaaatctctcagtatgcgattggtctcaagctaaaacaaaaataaatgtcagtttatattttacacatccacaaagcagtggcttggggtttttttttttttttttatcttgttgatcaagtgacacccaggacatgtaaatatttcataagccttaaacatttcctgaggtaagaaacaagctctcaaagcaaaagctcaattagaaatggcccttgtggggaaccttcccattctggtcgaccagaactctagccagatgaaatggcaatgctagcgccac

SEQ ID NO: 426996 - DNA, 2013 bp, Homo sapiens
  misc_feature (3)..(3): n is a, c, g, or t
ggnagagggccgtgcccgcggagagagcgcggcgcgggaggccggcggccggccggctgcatggcgcgctgcgagaggctgcgcggagcggccctgcgcgacgtgctgggccgggcgcagggggtcctgttcgactgtgacggggtgctgtggaacggcgagcgcgccgtgccgggcgccccggagctgctggagcggctggcgcgggccggcaaggcggctctgtttgtgagcaacaacagccggcgcgcgcggcccgagctggccctgcgcttcgcgcgcctcggcttcggggggctgcgcgccgagcagctcttcagctccgcgctgtgcgccgcgcgcctgctgcgccagcgcctgcccgggcctccggacgcgccgggcgccgtgttcgtgctgggcggcgaggggctgcgcgccgagctgcgcgccgcggggctgcgcctggccggggacccgagcgcgggggacggcgcggccccgcgcgtgcgcgccgtgcttgtgggctacgacgagcacttctccttcgccaagctgagggaggcgtgcgcgcacctgcgcgaccccgagtgcctactcgtggccaccgaccgtgacccatggcacccgctgagcgacggcagccggacccctggcaccgggagcctggccgctgcagtggagacagcctcgggacgccaggccctggtggtgggcaagcccagcccctacatgttcgagtgcatcacggagaacttcagcatcgaccccgcacgcacgcttatggtgggtgaccgcctggagaccgacatcctctttggccaccgctgcggcatgaccactgtgctcacgctcacaggagtctcccgcctagaagaggcccaggcctacctagcggccggccagcacgacctcgtgccccattactatgtggagagcatcgcagacttgacagaggggttggaggactgagcccactgcacctgcagccacaggcccacccctccccactccctgatcccgtaggtggaggcgatgggtcacgagccatgttaagcacaaccggctccttggtccagttctgcaccggggtggggctgggacccggggaaggtttgagggcccttgcaaccccctcccagcagtggctgggcactctttgctgccccagaagctggtcccctatggattcatcttggcctgacccagccaggtggccttatttcttccctgtcacctcccctccttgaaatctgggccctggtgcctgctgaagattccctctatccctgagtacttagtcttctcccccttccctggggcttctagagctctctctgcccctcaggtcctggcccttgggtccttgtcaaccagaggtctagggaaccacaacccttattgtcctgggtggaccaatccaaaggctaagtgatagtgactcatcaatgttgggtcctgtggggtaccagtttaggttcctaagtaatagtgaccctttcacgtcctggagcccgagtggaccaatcggaagcctaagtgacgatgaccctcgcatgtcctaggtccctgggtggacccatcaggaccccaagtgatagtgacccagtggtcttttagatcctcagtagaacagtccagaagcctgagagacagtggccccttgataatctgggtctcacgggaccagctaggggtccaggtttcagtcagtaaataagagtggtccacgtcctaaagacacctctcctttacaaagacttgtgatgctctggggcttctgtggccaagccccaccctttcctggtcatggtacccgtacagcgttgatggccacagctcgaaggggggctttcgtgtccccctgtgcggtcagtgttttcagtaccacctctctcccgtgcccacttggctatttacttatttatttattgtgtgccagtgatggtgggtgggggctgggccttccccgccacctccacccctgttgtgacctgtccttccgtacttaataaagtgcgcgtgggagtgttc

SEQ ID NO: 426997 - DNA, 1952 bp, Homo sapiens
  misc_feature (3)..(3): n is a, c, g, or t
ggnagagggccgtgcccgcggagagagcgcggcgcgggaggccggcggccggccggctgcatggcgcgctgcgagaggctgcgcggagcggccctgcgcgacgtgctgggccgggcgcagggggtcctgttcgactgtgacggggtgctgtggaacggcgagcgcgccgtgccgggcgccccggagctgctggagcggctggcgcgggccggcaaggcggctctgtttgtgagcaacaacagccggcgcgcgcggcccgagctggccctgcgcttcgcgcgcctcggcttcggggggctgcgcgccgagcagctcttcagctccgcgctgtgcgccgcgcgcctgctgcgccagcgcctgcccgggcctccggacgcgccgggcgccgtgttcgtgctgggcggcgaggggctgcgcgccgagctgcgcgccgcggggctgcgcctggccggggacccgagcgcgggggacggcgcggccccgcgcgtgcgcgccgtgcttgtgggctacgacgagcacttctccttcgccaagctgagggaggcgtgcgcgcacctgcgcgaccccgagtgcctactcgtggccaccgaccgtgacccatggcacccgctgagcgacggcagccggacccctggcaccgggagcctggccgctgcagtggagacagcctcgggacgccaggccctggtggtgggcaagcccagcccctacatgttcgagtgcatcacggagaacttcagcatcgaccccgcacgcacgcttatggtgggtgaccgcctggagaccgacatcctctttggccaccgctgcggcatgaccactgtgctcacgctcacaggagtctcccgcctagaagaggcccaggcctacctagcggccggccagcacgacctcgtgccccattactatgtggagagcatcgcagacttgacagaggggttggaggactgagcccactgcacctgcagccacaggcccacccctccccactccctgatcccgtaggtggaggcgatgggtcacgagccatgttaagcacaaccggctccttggtccagttctgcaccggggtggggctgggacccggggaaggtttgagggcccttgcaaccccctcccagcagtggctgggcactctttgctgccccagaagctggtcccctatggattcatcttggcctgacccagccaggtggccttatttcttccctgtcacctcccctccttgaaatctgggccctggtgcctgctgaagattccctctatccctgagtacttagtcttctcccccttccctggggcttctagagctctctctgcccctcaggtcctggcccttgggtccttgtcaaccagaggtctagggaaccacaacccttattgtcctgggtggaccaatccaaaggctaagtgatagtgactcatcaatgttgggtcctgtggggtaccagtttaggttcctaagtaatagtgaccctttcacgtcctggagcccgagtggaccaatcggaagcctaagtgacgatgaccctcgcatgtcctaggtccctgggtggacccatcaggaccccaagtgatagtgacccagtggtcttttagatcctcagtagaacagtccaggtttcagtcagtaaataagagtggtccacgtcctaaagacacctctcctttacaaagacttgtgatgctctggggcttctgtggccaagccccaccctttcctggtcatggtacccgtacagcgttgatggccacagctcgaaggggggctttcgtgtccccctgtgcggtcagtgttttcagtaccacctctctcccgtgcccacttggctatttacttatttatttattgtgtgccagtgatggtgggtgggggctgggccttccccgccacctccacccctgttgtgacctgtccttccgtacttaataaagtgcgcgtgggagtgttc

SEQ ID NO: 426998 - DNA, 2377 bp, Homo sapiens
  misc_feature (3)..(3): n is a, c, g, or t
ggnagagggccgtgcccgcggagagagcgcggcgcgggaggccggcggccggccggctgcatggcgcgctgcgagaggctgcgcggagcggccctgcgcgacgtgctgggccgggcgcagggggtcctgttcgactgtgacggggtgctgtggaacggcgagcgcgccgtgccgggcgccccggagctgctggagcggctggcgcgggccggcaaggcggctctgtttgtgagcaacaacagccggcgcgcgcggcccgagctggccctgcgcttcgcgcgcctcggcttcggggggctgcgcgccgagcagctcttcagctccgcgctgtgcgccgcgcgcctgctgcgccagcgcctgcccgggcctccggacgcgccgggcgccgtgttcgtgctgggcggcgaggggctgcgcgccgagctgcgcgccgcggggctgcgcctggccggggacccgagcgcgggggacggcgcggccccgcgcgtgcgcgccgtgcttgtgggctacgacgagcacttctccttcgccaagctgagggaggcgtgcgcgcacctgcgcgaccccgagtgcctactcgtggccaccgaccgtgacccatggcacccgctgagcgacggcagccggacccctggcaccgggagcctggccgctgcagtggagacagcctcgggacgccaggccctggtggtgggcaagcccagcccctacatgttcgagtgcatcacggagaacttcagcatcgaccccgcacgcacgcttatggtgggtgaccgcctggagaccgacatcctctttggccaccgctgcggcatgaccactgtgctcacgctcacaggagtctcccgcctagaagaggcccaggcctacctagcggccggccagcacgacctcgtgccccattactatgtggagagcatcgcagacttgacagaggggttggaggactgagcccactgcacctgcagccacaggcccacccctccccactccctgatcccgtaggtggaggcgatgggtcacgagccatgttaagcacaaccggctccttggtccagttctgcaccggggtggggctgggacccggggaaggtttgagggcccttgcaaccccctcccagcagtggctgggcactctttgctgccccagaagctggtcccctatggattcatcttggcctgacccagccaggtggccttatttcttccctgtcacctcccctccttgaaatctgggccctggtgcctgctgaagattccctctatccctgagtacttagtcttctcccccttccctggggcttctagagctctctctgcccctcaggtcctggcccttgggtccttgtcaaccagaggtctagggaaccacaacccttattgtcctgggtggaccaatccaaaggctaagtgatagtgactcatcaatgttgggtcctgtggggtaccagtttaggttcctaagtaatagtgaccctttcacgtcctggagcccgagtggaccaatcggaagcctaagtgacgatgaccctcgcatgtcctaggtccctgggtggacccatcaggaccccaagtgatagtgacccagtggtcttttagatcctcagtagaacagtccagaagcctgagagacagtggccccttgataatctgggtctcacgggaccagctaggggtccaggtttcagtcagtaaataagagtggtccacgtcctaaagacacctctcctttacaaagacttgtgatgctctggggcttctgtggccaagccccaccctttcctggtcatggtacccgtacagcgttgatggccacagctcgaaggggggctttcgtgtccccctgtgcggtcagtgttttcagtaccacctctctcccgtgcccacttggctatttacttatttatttattgtgtgccagtgatggtgggtgggggctgggccttccccgccacctccacccctgttgtgacctgtccttccgtacttaataaagtgcgcgtgggagtgttcaaaaaaaaaaacaacacccgaaccccaaagcgcacacccccacacacccccaaccgcacagcaccaccacacaaaagggaggccggcgacacaaacaagcacaagccaggaggcgccaccacgaacaacgcagacacaacacaccggagcgacgcagagaacacaacagggcgcccccaacaaacacgacggccaagccacctacgcaaaagaggagagacaccggagaccggaggtagacagacacacgccggggcgcagggaacaaaaacacagcagcacacggccgactctttccgtgcagacgcacgaaccgccaaagctccgggaaggcacgacgaccaaaagaggcggacaaacggac

SEQ ID NO: 426999 - DNA, 2877 bp, Homo sapiens
cgcgccgtgcgttcgccctgcgatcccgctcactcttggcgccttcgcggaaggtgcgtccgagccatggccgctgccaacccgtgggacccggcgtccgcgcctaacggcgctgggctagtgctaggccacttcatagcttcggggatggtcaatcagaaaaacctggaaattgaactcctgaaactagaaaaagatacagcagatgttgttcatcctttctttttggagatgaagtcttgctatgttgcccaggctggtctcgaactcatggcctcaattctcccgtttcagtctcccaaaacactgcgattacagctcagaagtgtcatactctgcaaagcatgaataatcatttggaagcagtgctgaaagagaagagatcccttaggcaaagactgttgaaacccatgtgccaggaaaacttacctattgaagctgtttatcacagatatatggtacatttgctggagttggctgtgactttcattgagagattagaaacccaccttgaaacaattagaaatattcctcatttagctgcaaatctaaagaaaatgaaccaggctttagcaaagatggatatattggtgactgagacagaagaactggcagagaatatactcaagtggcgtaaacaacaaaacgaagtttcgtcttgtatccccaaaatattagctgaagaaagttatctttataaacatgatattataatgcctcctttaccttttacttctaaagttcatgtccaaactattaatgccaagtagtcatcaactttatttttgcttaattatgtgtagtcatatgaagtctatttctagttgactgtaacatgggtattaatagtctttgctgctggtaatactgaaagaacctgctttatattggagtatcaagatctcaggttcattaagaccaaactgacttttcctttgtttttcatatatttttattctacctttcagtaaaactagagaagctaaaaaatagccatgacaatttattaatataagtgaattaaccatttctcaggtgggaaattctctttttttaaaaatgtgtgtttatcgtctggtgtggtggctcacacctgtaatcctaacacttggggaggctgaggcgggcagatcacttaaacccaggagttcaagaccagcctgggtaacatggtgaaatcccatatctacaaaataaacaaaaaattagccgaccatggtggtgcatgcctgtagtcccagctattcgggaggctgaggtaagaggatcacctaagcctgtgaggtcatggttgcaatgagtcatgatcacgccactgcgctacagcctgggcgacacagtaagaccctgtctcaaaaaaaagaagtgtgtttctggccaggcacggtggctcacgcctgtaatcccagcactttgggaggcctaggtgggcagatcatgaggtcaggagttcgagaccagcctggccaacatggcgaaacacctgtctctactaaaaatacaaaaattaggccgggcgcagtggctcacacctgtaatcccaacactttgggaggccgacccagatgggtggatcacctgaggtcaggagtttgagaccagccttgacaacatggtgaaaccccatctctggtagaaatataaaaaattaaccgggcatggtggtggacgcctgtaatcccagctacttgggaggctgaggcagaataatcgcttgaacccaggaggcagaggttgcagtaagccaagatcgtgcctctgcactccaacctgggtgatggagcaagactccatctccaaaaaaataaaaaatacaaaaattagccaggcatggtagcatgtgcctgtaatcccagctactcaggaggctgaggcaggagaatcacttgaacccaggaggcagaggttgcagtgagcccagatcgtgccaccgcactctagcctgggcaacagagcaagactctgtcttaaaaaaaaaaaaaaaaggtgtttctgaattagaagggtcttcttgaatctgaaaatgtctatgatgattattcctgtgggaatgtcactaagtatgcagaaaagagtaacacagccagcctgacttatcctttgaaaggcctgattataaggtttgtcctcagctgttgcatctgggaacttagatatcagaaggtatcttagtctgttctgctgtcataacagaattacacaaactaagtattttataatgaacagaagtttatttggttgacaggtgtggaggctaggcagtccaagaacatggtgccagcatctagtgagggtcttgccatggcagaaggcaccacatggcaagtgagcatgagaaagatatatgggtctaaacttagccttttatcatgagcccactcccaagatagcagcactaattcattaatgagggcaaagccctccttacctaattactttttaaaggtctcataacacttttacaatgtcaattaaatttccaacacttgaactttgggggacatatttaaaccttaacaggagggctccactcactgaaaagagtcgttcatggtagctaacctgtggtttgtgctgaaaacctgctttcttcctgggagtctagaattttggtacatggtaggtagaaggtacctacgtgaccagcccccagtaaaaaccctgggcactgtatctctaacaagtttccctggtaaacaacatttctcacatgttgtcacaattcagttgctggtggaatgaaacaacagatatgtgtgactccactgttagaggactctggaagcttatacctggtttcccccagactttgcctctgtaccttttctctttgctgttttgcttcatatgcttttgctgtaataaatcatagctgtg

SEQ ID NO: 427000 - DNA, 897 bp, Homo sapiens
aaagaaaagaaaatggaatggggtttttttatctagggagaaaatgattaacattgaggtttctctaacattaagttggattccagataggattactgttgtctctttccatttttttatttggatgacaagttgcttaaagtgaaagagaaggacctttttttaatcactaatatttctatgaatgcaggaaggttgttattggctctctaggttgattataattcttatctcaaattaaaagtcctgattaaaggagaagaaaaggcactgtaaaccaatttaccttttaaaaaatggttgacttttttctttctctttcagatatatggtacatttgctggagttggctgtgactttcattgagagattagaaacccaccttgaaacaattagaaatattcctcatttagctgcaaatctaaagaaaatggtgagtattaatatagcaatcttcagttattttttactagaaacttagaggtgtgctctcccagtttagctttttaatagctaatattacgagctagttaatttttaaatcaagaagtattttcttggcctggcatggtagttcacacctgtaatccctgcactttgggaggccacaacgggtggatcacttgaggtcaggagttggagaccagcctggccaacatggtgaaactccatctctactgaaaatacaaaaattagctgggcatggtggtgcgtgcctgtaattccagctacccgggaggctgaggcaggagaactgcttgaacctgggaggcagaagttgcagtgagctgagatcgtgccagtgcactccatcctgggcgacagcaagactccatctcccattaaaaaaaaaaaaaaaaaagaagaagaagtgtttatttatttagaccttggatt

SEQ ID NO: 427001 - DNA, 1117 bp, Homo sapiens
cgcgccgtgcgttcgccctgcgatcccgctcactcttggcgccttcgcggaaggtgcgtccgagccatggccgctgccaacccgtgggacccggcgtccgcgcctaacggcgctgggctagtgctaggccacttcatagcttcggggatggtcaatcaggagatgttaaacatgtctaagaaaacagtttcttgttttgtgaacttcaccagactacagcagatcacaaatattcaagctgaaatctaccagaaaaacctggaaattgaactcctgaaactagaaaaagatacagcagatgttgttcatcctttctttttggagatgaagtcttgctatgttgcccaggctggtctcgaactcatggcctcaattctcccgtttcagtctcccaaaacactgcgattacagctcagaagtgtcatactctgcaaagcatgaataatcatttggaagcagtgctgaaagagaagagatcccttaggcaaagactgttgaaacccatgtgccaggaaaacttacctattgaagctgtttatcacagatatatggtacatttgctggagttggctgtgactttcattgagagattagaaacccaccttgaaacaattagaaatattcctcatttagctgcaaatctaaagaaaatggtgagtattaatatagcaatcttcagttattttttactagaaacttagaggtgtgctctcccagtttagctttttaatagctaatattacgagctagttaatttttaaatcaagaagtattttcttggcctggcatggtagttcacacctgtaatccctgcactttgggaggccacaacgggtggatcacttgaggtcaggagttggagaccagcctggccaacatggtgaaactccatctctactgaaaatacaaaaattagctgggcatggtggtgcgtgcctgtaattccagctacccgggaggctgaggcaggagaactgcttgaacctgggaggcagaagttgcagtgagctgagatcgtgccagtgcactccatcctgggcgacagcaagactccatctcccattaaaaaaaaaaaaaaaaaagaagaagaagtgtttatttatttagaccttggatt

SEQ ID NO: 427002 - DNA, 3959 bp, Homo sapiens
cgcgccgtgcgttcgccctgcgatcccgctcactcttggcgccttcgcggaaggtgcgtccgagccatggccgctgccaacccgtgggacccggcgtccgcgcctaacggcgctgggctagtgctaggccacttcatagcttcggggatggtcaatcaggagatgttaaacatgtctaagaaaacagtttcttgttttgtgaacttcaccagactacagcagatcacaaatattcaagctgaaatctaccagaaaaacctggaaattgaactcctgaaactagaaaaagatacagcagatgttgttcatcctttctttttggctcagaagtgtcatactctgcaaagcatgaataatcatttggaagcagtgctgaaagagaagagatcccttaggcaaagactgttgaaacccatgtgccaggaaaacttacctattgaagctgtttatcacagatatatggtacatttgctggagttggctgtgactttcattgagagattagaaacccaccttgaaacaattagaaatattcctcatttagctgcaaatctaaagaaaatgaaccaggctttagcaaagatggatatattggtgactgagacagaagaactggcagagaatatactcaagtggcgtaaacaacaaaacgaagtttcgtcttgtatccccaaaatattagctgaagaaagttatctttataaacatgatattataatgcctcctttaccttttacttctaaagttcatgtccaaactattaatgccaagtagtcatcaactttatttttgcttaattatgtgtagtcatatgaagtctatttctagttgactgtaacatgggtattaatagtctttgctgctggtaatactgaaagaacctgctttatattggagtatcaagatctcaggttcattaagaccaaactgacttttcctttgtttttcatatatttttattctacctttcagtaaaactagagaagctaaaaaatagccatgacaatttattaatataagtgaattaaccatttctcaggtgggaaattctctttttttaaaaatgtgtgtttatcgtctggtgtggtggctcacacctgtaatcctaacacttggggaggctgaggcgggcagatcacttaaacccaggagttcaagaccagcctgggtaacatggtgaaatcccatatctacaaaataaacaaaaaattagccgaccatggtggtgcatgcctgtagtcccagctattcgggaggctgaggtaagaggatcacctaagcctgtgaggtcatggttgcaatgagtcatgatcacgccactgcgctacagcctgggcgacacagtaagaccctgtctcaaaaaaaagaagtgtgtttctggccaggcacggtggctcacgcctgtaatcccagcactttgggaggcctaggtgggcagatcatgaggtcaggagttcgagaccagcctggccaacatggcgaaacacctgtctctactaaaaatacaaaaattaggccgggcgcagtggctcacacctgtaatcccaacactttgggaggccgacccagatgggtggatcacctgaggtcaggagtttgagaccagccttgacaacatggtgaaaccccatctctggtagaaatataaaaaattaaccgggcatggtggtggacgcctgtaatcccagctacttgggaggctgaggcagaataatcgcttgaacccaggaggcagaggttgcagtaagccaagatcgtgcctctgcactccaacctgggtgatggagcaagactccatctccaaaaaaataaaaaatacaaaaattagccaggcatggtagcatgtgcctgtaatcccagctactcaggaggctgaggcaggagaatcacttgaacccaggaggcagaggttgcagtgagcccagatcgtgccaccgcactctagcctgggcaacagagcaagactctgtcttaaaaaaaaaaaaaaaaggtgtttctgaattagaagggtcttcttgaatctgaaaatgtctatgatgattattcctgtgggaatgtcactaagtatgcagaaaagagtaacacagccagcctgacttatcctttgaaaggcctgattataaggtttgtcctcagctgttgcatctgggaacttagatatcagaaggtatcttagtctgttctgctgtcataacagaattacacaaactaagtattttataatgaacagaagtttatttggttgacaggtgtggaggctaggcagtccaagaacatggtgccagcatctagtgagggtcttgccatggcagaaggcaccacatggcaagtgagcatgagaaagatatatgggtctaaacttagccttttatcatgagcccactcccaagatagcagcactaattcattaatgagggcaaagccctccttacctaattactttttaaaggtctcataacacttttacaatgtcaattaaatttccaacacttgaactttgggggacatatttaaaccttaacaggagggctccactcactgaaaagagtcgttcatggtagctaacctgtggtttgtgctgaaaacctgctttcttcctgggagtctagaattttggtacatggtaggtagaaggtacctacgtgaccagcccccagtaaaaaccctgggcactgtatctctaacaagtttccctggtaaacaacatttctcacatgttgtcacaattcagttgctggtggaatgaaacaacagatatgtgtgactccactgttagaggactctggaagcttatacctggtttcccccagactttgcctctgtaccttttctctttgctgttttgcttcatatgcttttgctgtaataaatcatagctgtgtgatgatatgctgagtcttgtgaattctcctagcaaatcatggaacctggaggtagtcttggagaccctggcatacaaagcagttcctaagtgtttactggtagctgtaggaataggcaaagaagaaacagcaaagaaaaaggcacactgtggtataactttggaggtttaccttgcaaaatgctcagatattttacctatcagaggttattgtgcatataatagagagtgatatactaacaactgcctcaggatatactctttttaatcagtattgtaactaaccttggcttattttacttttagacttggggttctattttgctttaaaacatgtacatcagttttgttttttgttttgttcttttctttcctttttttttttttttttttaaagacaggatctcactctgtcacccaggttgctgagagtgtggtgtggcccaatcttgacctcactgcagccttgacctctcaggctcgggtgatcctcccgcctcagcctcccaagtagctgggactataggcacgcgccaccacgcctggctaattttgtattttctgtagagacagagttttgccatgttgttgaggctggtcttgaactcctgggttcaaacgaccctcccgcctcagcctccgaaagtgctgggagtacaggtgttagccactgcgcctggcctcattgtactccttaacacaagaagacttcaacaatgataagtagttgtttataaggaagcaggatcattaccaaaataaatcctgctaaaacaacaggaatcatgttttaaagcctagtttgctaatttttgctagtaggataagagtgatcgtaatatctcgaacattacatagacacttaaaacctttagttgtatttcatcaaaaatctgttcataccccacgttggtttcaaaacatactatgctttttcttcgtgttatttcctatattcatttttgtgtgtatgtgtatgtcacaaatattgatatgcctggttgtttatttttgttttctattatgcctttttcaaaatataaaaataaacttgtaatttctaactaaaaaaaaaaag

SEQ ID NO: 427003 - DNA, 2304 bp, Homo sapiens
cgcgccgtgcgttcgccctgcgatcccgctcactcttggcgccttcgcggaaggtgcgtccgagccatggccgctgccaacccgtgggacccggcgtccgcgcctaacggcgctgggctagtgctaggccacttcatagcttcggggatggtcaatcaggagatgttaaacatgtctaagaaaacagtttcttgttttgtgaacttcaccagactacagcagatcacaaatattcaagctgaaatctaccagaaaaacctggaaattgaactcctgaaactagaaaaagatacagcagatgttgttcatcctttctttttggctcagaagtgtcatactctgcaaagcatgaataatcatttggaagcagtgctgaaagagaagagatcccttaggcaaagactgttgaaacccatgtgccaggaaaacttacctattgaagctgtttatcacagatatatggtacatttgctggagttggctgtgactttcattgagagattagaaacccaccttgaaacaattagaaatattcctcatttagctgcaaatctaaagaaaatgaaccaggctttagcaaagatggatatattggtgactgagacagaagaactggcagagaatatactcaagtggcgtaaacaacaaaacgaagtttcgtcttgtatccccaaaatattagctgaagaaagttatctttataaacatgatattataatgcctcctttaccttttacttctaaagttcatgtccaaactattaatgccaagtagtcatcaactttatttttgcttaattatgtgtagtcatatgaagtctatttctagttgactgtaacatgggtattaatagtctttgctgctggtaatactgaaagaacctgctttatattggagtatcaagatctcaggttcattaagaccaaactgacttttcctttgtttttcatatatttttattctacctttcagtaaaactagagaagctaaaaaatagccatgacaatttattaatataagtgaattaaccatttctcaggtgggaaattctctttttttaaaaatgtgtgtttatcgtctggtgtggtggctcacacctgtaatcctaacacttggggaggctgaggcgggcagatcacttaaacccaggagttcaagaccagcctgggtaacatggtgaaatcccatatctacaaaataaacaaaaaattagccgaccatggtggtgcatgcctgtagtcccagctattcgggaggctgaggtaagaggatcacctaagcctgtgaggtcatggttgcaatgagtcatgatcacgccactgcgctacagcctgggcgacacagtaagaccctgtctcaaaaaaaagaagtgtgtttctggccaggcacggtggctcacgcctgtaatcccagcactttgggaggcctaggtgggcagatcatgaggtcaggagttcgagaccagcctggccaacatggcgaaacacctgtctctactaaaaatacaaaaattaggccgggcgcagtggctcacacctgtaatcccaacactttgggaggccgacccagatgggtggatcacctgaggtcaggagtttgagaccagccttgacaacatggtgaaaccccatctctggtagaaatataaaaaattaaccgggcatggtggtggacgcctgtaatcccagctacttgggaggctgaggcagaataatcgcttgaacccaggaggcagaggttgcagtaagccaagatcgtgcctctgcactccaacctgggtgatggagcaagactccatctccaaaaaaataaaaaatacaaaaattagccaggcatggtagcatgtgcctgtaatcccagagcctccgaaagtgctgggagtacaggtgttagccactgcgcctggcctcattgtactccttaacacaagaagacttcaacaatgataagtagttgtttataaggaagcaggatcattaccaaaataaatcctgctaaaacaacaggaatcatgttttaaagcctagtttgctaatttttgctagtaggataagagtgatcgtaatatctcgaacattacatagacacttaaaacctttagttgtatttcatcaaaaatctgttcataccccacgttggtttcaaaacatactatgctttttcttcgtgttatttcctatattcatttttgtgtgtatgtgtatgtcacaaatattgatatgcctggttgtttatttttgttttctattatgcctttttcaaaatataaaaataaacttgtaatttctaactaaaaaaaaaaag

SEQ ID NO: 427004 - DNA, 2881 bp, Homo sapiens
cgcgccgtgcgttcgccctgcgatcccgctcactcttggcgccttcgcggaaggtgcgtccgagccatggccgctgccaacccgtgggacccggcgtccgcgcctaacggcgctgggctagtgctaggccacttcatagcttcggggatggtcaatcaggagatgttaaacatgtctaagaaaacagtttcttgttttgtgaacttcaccagactacagcagatcacaaatattcaagctgaaatctaccagaaaaacctggaaattgaactcctgaaactagaaaaagatacagcagatgttgttcatcctttctttttggctcagaagtgtcatactctgcaaagcatgaataatcatttggaagcagtgctgaaagagaagagatcccttaggcaaagactgttgaaacccatgtgccaggaaaacttacctattgaagctgtttatcacagatatatggtacatttgctggagttggctgtgactttcattgagagattagaaacccaccttgaaacaattagaaatattcctcatttagctgcaaatctaaagaaaatgaaccaggctttagcaaagatggatatattggtgactgagacagaagaactggcagagaatatactcaagtggcgtaaacaacaaaacgaagtttcgtcttgtatccccaaaatattagctgaagaaagttatctttataaacatgatattataatgcctcctttaccttttacttctaaagttcatgtccaaactattaatgccaagtagtcatcaactttatttttgcttaattatgtgtagtcatatgaagtctatttctagttgactgtaacatgggtattaatagtctttgctgctggtaatactgaaagaacctgctttatattggagtatcaagatctcaggttcattaagaccaaactgacttttcctttgtttttcatatatttttattctacctttcagtaaaactagagaagctaaaaaatagccatgacaatttattaatataagtgaattaaccatttctcaggtgggaaattctctttttttaaaaatgtgtgtttatcgtctggtgtggtggctcacacctgtaatcctaacacttggggaggctgaggcgggcagatcacttaaacccaggagttcaagaccagcctgggtaacatggtgaaatcccatatctacaaaataaacaaaaaattagccgaccatggtggtgcatgcctgtagtcccagctattcgggaggctgaggtaagaggatcacctaagcctgtgaggtcatggttgcaatgagtcatgatcacgccactgcgctacagcctgggcgacacagtaagaccctgtctcaaaaaaaagaagtgtgtttctggccaggcacggtggctcacgcctgtaatcccagcactttgggaggcctaggtgggcagatcatgaggtcaggagttcgagaccagcctggccaacatggcgaaacacctgtctctactaaaaatacaaaaattaggccgggcgcagtggctcacacctgtaatcccaacactttgggaggccgacccagatgggtggatcacctgaggtcaggagtttgagaccagccttgacaacatggtgaaaccccatctctggtagaaatataaaaaattaaccgggcatggtggtggacgcctgtaatcccagctacttgggaggctgaggcagaataatcgcttgaacccaggaggcagaggttgcagtaagccaagatcgtgcctctgcactccaacctgggtgatggagcaagactccatctccaaaaaaataaaaaatacaaaaattagccaggcatggtagcatgtgcctgtaatcccagctactcaggaggctgaggcaggagaatcacttgaacccaggaggcagaggttgcagtgagcccagatcgtgccaccgcactctagcctgggcaacagagcaagactctgtcttaaaaaaaaaaaaaaaaggtgtttctgaattagaagggtcttcttgaatctgaaaatgtctatgatgattattcctgtgggaatgtcactaagtatgcagaaaagagtaacacagccagcctgacttatcctttgaaaggcctgattataaggtttgtcctcagctgttgcatctgggaacttagatatcagaaggtatcttagtctgttctgctgtcataacagaattacacaaactaagtattttataatgaacagaagtttatttggttgacaggtgtggaggctaggcagtccaagaacatggtgccagcatctagtgagggtcttgccatggcagaaggcaccacatggcaagtgagcatgagaaagatatatgggtctaaacttagccttttatcatgagcccactcccaagatagcagcactaattcattaatgagggcaaagccctccttacctaattactttttaaaggtctcataacacttttacaatgtcaattaaatttccaacacttgaactttgggggacatatttaaaccttaacaggagggctccactcactgaaaagagtcgttcatggtagctaacctgtggtttgtgctgaaaacctgctttcttcctgggagtctagaattttggtacatggtaggtagaaggtacctacgtgaccagcccccagtaaaaaccctgggcactgtatctctaacaagtttccctggtaaacaacatttctcacatgttgtcacaattcagttgctggtggaatgaaacaacagatatgtgtgactccactgttagaggactctggaagcttatacctggtttcccccagactttgcctctgtaccttttctctttgctgttttgcttcatatgcttttgctgtaataaatcatagctgtg

SEQ ID NO: 427005 - DNA, 3978 bp, Homo sapiens
cgcgccgtgcgttcgccctgcgatcccgctcactcttggcgccttcgcggaaggtgcgtccgagccatggccgctgccaacccgtgggacccggcgtccgcgcctaacggcgctgggctagtgctaggccacttcatagcttcggggatggtcaatcaggagatgttaaacatgtctaagaaaacagtttcttgttttgtgaacttcaccagactacagcagatcacaaatattcaagctgaaatctaccagagatgaagtcttgctatgttgcccaggctggtctcgaactcatggcctcaattctcccgtttcagtctcccaaaacactgcgattacagctcagaagtgtcatactctgcaaagcatgaataatcatttggaagcagtgctgaaagagaagagatcccttaggcaaagactgttgaaacccatgtgccaggaaaacttacctattgaagctgtttatcacagatatatggtacatttgctggagttggctgtgactttcattgagagattagaaacccaccttgaaacaattagaaatattcctcatttagctgcaaatctaaagaaaatgaaccaggctttagcaaagatggatatattggtgactgagacagaagaactggcagagaatatactcaagtggcgtaaacaacaaaacgaagtttcgtcttgtatccccaaaatattagctgaagaaagttatctttataaacatgatattataatgcctcctttaccttttacttctaaagttcatgtccaaactattaatgccaagtagtcatcaactttatttttgcttaattatgtgtagtcatatgaagtctatttctagttgactgtaacatgggtattaatagtctttgctgctggtaatactgaaagaacctgctttatattggagtatcaagatctcaggttcattaagaccaaactgacttttcctttgtttttcatatatttttattctacctttcagtaaaactagagaagctaaaaaatagccatgacaatttattaatataagtgaattaaccatttctcaggtgggaaattctctttttttaaaaatgtgtgtttatcgtctggtgtggtggctcacacctgtaatcctaacacttggggaggctgaggcgggcagatcacttaaacccaggagttcaagaccagcctgggtaacatggtgaaatcccatatctacaaaataaacaaaaaattagccgaccatggtggtgcatgcctgtagtcccagctattcgggaggctgaggtaagaggatcacctaagcctgtgaggtcatggttgcaatgagtcatgatcacgccactgcgctacagcctgggcgacacagtaagaccctgtctcaaaaaaaagaagtgtgtttctggccaggcacggtggctcacgcctgtaatcccagcactttgggaggcctaggtgggcagatcatgaggtcaggagttcgagaccagcctggccaacatggcgaaacacctgtctctactaaaaatacaaaaattaggccgggcgcagtggctcacacctgtaatcccaacactttgggaggccgacccagatgggtggatcacctgaggtcaggagtttgagaccagccttgacaacatggtgaaaccccatctctggtagaaatataaaaaattaaccgggcatggtggtggacgcctgtaatcccagctacttgggaggctgaggcagaataatcgcttgaacccaggaggcagaggttgcagtaagccaagatcgtgcctctgcactccaacctgggtgatggagcaagactccatctccaaaaaaataaaaaatacaaaaattagccaggcatggtagcatgtgcctgtaatcccagctactcaggaggctgaggcaggagaatcacttgaacccaggaggcagaggttgcagtgagcccagatcgtgccaccgcactctagcctgggcaacagagcaagactctgtcttaaaaaaaaaaaaaaaaggtgtttctgaattagaagggtcttcttgaatctgaaaatgtctatgatgattattcctgtgggaatgtcactaagtatgcagaaaagagtaacacagccagcctgacttatcctttgaaaggcctgattataaggtttgtcctcagctgttgcatctgggaacttagatatcagaaggtatcttagtctgttctgctgtcataacagaattacacaaactaagtattttataatgaacagaagtttatttggttgacaggtgtggaggctaggcagtccaagaacatggtgccagcatctagtgagggtcttgccatggcagaaggcaccacatggcaagtgagcatgagaaagatatatgggtctaaacttagccttttatcatgagcccactcccaagatagcagcactaattcattaatgagggcaaagccctccttacctaattactttttaaaggtctcataacacttttacaatgtcaattaaatttccaacacttgaactttgggggacatatttaaaccttaacaggagggctccactcactgaaaagagtcgttcatggtagctaacctgtggtttgtgctgaaaacctgctttcttcctgggagtctagaattttggtacatggtaggtagaaggtacctacgtgaccagcccccagtaaaaaccctgggcactgtatctctaacaagtttccctggtaaacaacatttctcacatgttgtcacaattcagttgctggtggaatgaaacaacagatatgtgtgactccactgttagaggactctggaagcttatacctggtttcccccagactttgcctctgtaccttttctctttgctgttttgcttcatatgcttttgctgtaataaatcatagctgtgtgatgatatgctgagtcttgtgaattctcctagcaaatcatggaacctggaggtagtcttggagaccctggcatacaaagcagttcctaagtgtttactggtagctgtaggaataggcaaagaagaaacagcaaagaaaaaggcacactgtggtataactttggaggtttaccttgcaaaatgctcagatattttacctatcagaggttattgtgcatataatagagagtgatatactaacaactgcctcaggatatactctttttaatcagtattgtaactaaccttggcttattttacttttagacttggggttctattttgctttaaaacatgtacatcagttttgttttttgttttgttcttttctttcctttttttttttttttttttaaagacaggatctcactctgtcacccaggttgctgagagtgtggtgtggcccaatcttgacctcactgcagccttgacctctcaggctcgggtgatcctcccgcctcagcctcccaagtagctgggactataggcacgcgccaccacgcctggctaattttgtattttctgtagagacagagttttgccatgttgttgaggctggtcttgaactcctgggttcaaacgaccctcccgcctcagcctccgaaagtgctgggagtacaggtgttagccactgcgcctggcctcattgtactccttaacacaagaagacttcaacaatgataagtagttgtttataaggaagcaggatcattaccaaaataaatcctgctaaaacaacaggaatcatgttttaaagcctagtttgctaatttttgctagtaggataagagtgatcgtaatatctcgaacattacatagacacttaaaacctttagttgtatttcatcaaaaatctgttcataccccacgttggtttcaaaacatactatgctttttcttcgtgttatttcctatattcatttttgtgtgtatgtgtatgtcacaaatattgatatgcctggttgtttatttttgttttctattatgcctttttcaaaatataaaaataaacttgtaatttctaactaaaaaaaaaaag

SEQ ID NO: 427006 - DNA, 1534 bp, Homo sapiens
cgcgccgtgcgttcgccctgcgatcccgctcactcttggcgccttcgcggaaggtgcgtccgagccatggccgctgccaacccgtgggacccggcgtccgcgcctaacggcgctgggctagtgctaggccacttcatagcttcggggatggtcaatcaggagatgttaaacatgtctaagaaaacagtttcttgttttgtgaacttcaccagactacagcagatcacaaatattcaagctgaaatctaccagaaaaacctggaaattgaactcctgaaactagaaaaagatacagcagatgttgttcatcctttctttttggctcagaagtgtcatactctgcaaagcatgaataatcatttggaagcagtgctgaaagagaagagatcccttaggcaaagactgttgaaacccatgtgccaggaaaacttacctattgaagctgtttatcacagatatatggtacatttgctggagttggctgtgactttcattgagagattagaaacccaccttgaaacaattagaaatattcctcatttagctgcaaatctaaagaaaatgaaccaggctttagcaaagatggatatattggtgactgagacagaagaactggcagagaatatactcaagtggcgtaaacaacaaaacgaagtttcgtcttgtatccccaaaatattagctgaagaaagttatctttataaacatgatattataatgcctcctttaccttttacttctaaagttcatgtccaaactattaatgccaagtagtcatcaactttatttttgcttaattatgtgtagtcatatgaagtctatttctagttgactgtaacatgggtattaatagtctttgctgctggtaatactgaaagaacctgctttatattggagtatcaagatctcaggttcattaagaccaaactgacttttcctttgtttttcatatatttttattctacctttcagtaaaactagagaagctaaaaaatagccatgacaatttattaatataagtgaattaaccatttctcaggtgggaaattctctttttttaaaaatgtgtgtttatcgtctggtgtggtggagcctccgaaagtgctgggagtacaggtgttagccactgcgcctggcctcattgtactccttaacacaagaagacttcaacaatgataagtagttgtttataaggaagcaggatcattaccaaaataaatcctgctaaaacaacaggaatcatgttttaaagcctagtttgctaatttttgctagtaggataagagtgatcgtaatatctcgaacattacatagacacttaaaacctttagttgtatttcatcaaaaatctgttcataccccacgttggtttcaaaacatactatgctttttcttcgtgttatttcctatattcatttttgtgtgtatgtgtatgtcacaaatattgatatgcctggttgtttatttttgttttctattatgcctttttcaaaatataaaaataaacttgtaatttctaactaaaaaaaaaaag

SEQ ID NO: 427007 - DNA, 3828 bp, Homo sapiens
aaagaaaagaaaatggaatggggtttttttatctagggagaaaatgattaacattgaggtttctctaacattaagttggattccagataggattactgttgtctctttccatttttttatttggatgacaagttgcttaaagtgaaagagaaggacctttttttaatcactaatatttctatgaatgcaggaaggttgttattggctctctaggttgattataattcttatctcaaattaaaagtcctgattaaaggagaagaaaaggcactgtaaaccaatttaccttttaaaaaatggttgacttttttctttctctttcagatatatggtacatttgctggagttggctgtgactttcattgagagattagaaacccaccttgaaacaattagaaatattcctcatttagctgcaaatctaaagaaaatgaaccaggctttagcaaagatggatatattggtgactgagacagaagaactggcagagaatatactcaagtggcgtaaacaacaaaacgaagtttcgtcttgtatccccaaaatattagctgaagaaagttatctttataaacatgatattataatgcctcctttaccttttacttctaaagttcatgtccaaactattaatgccaagtagtcatcaactttatttttgcttaattatgtgtagtcatatgaagtctatttctagttgactgtaacatgggtattaatagtctttgctgctggtaatactgaaagaacctgctttatattggagtatcaagatctcaggttcattaagaccaaactgacttttcctttgtttttcatatatttttattctacctttcagtaaaactagagaagctaaaaaatagccatgacaatttattaatataagtgaattaaccatttctcaggtgggaaattctctttttttaaaaatgtgtgtttatcgtctggtgtggtggctcacacctgtaatcctaacacttggggaggctgaggcgggcagatcacttaaacccaggagttcaagaccagcctgggtaacatggtgaaatcccatatctacaaaataaacaaaaaattagccgaccatggtggtgcatgcctgtagtcccagctattcgggaggctgaggtaagaggatcacctaagcctgtgaggtcatggttgcaatgagtcatgatcacgccactgcgctacagcctgggcgacacagtaagaccctgtctcaaaaaaaagaagtgtgtttctggccaggcacggtggctcacgcctgtaatcccagcactttgggaggcctaggtgggcagatcatgaggtcaggagttcgagaccagcctggccaacatggcgaaacacctgtctctactaaaaatacaaaaattaggccgggcgcagtggctcacacctgtaatcccaacactttgggaggccgacccagatgggtggatcacctgaggtcaggagtttgagaccagccttgacaacatggtgaaaccccatctctggtagaaatataaaaaattaaccgggcatggtggtggacgcctgtaatcccagctacttgggaggctgaggcagaataatcgcttgaacccaggaggcagaggttgcagtaagccaagatcgtgcctctgcactccaacctgggtgatggagcaagactccatctccaaaaaaataaaaaatacaaaaattagccaggcatggtagcatgtgcctgtaatcccagctactcaggaggctgaggcaggagaatcacttgaacccaggaggcagaggttgcagtgagcccagatcgtgccaccgcactctagcctgggcaacagagcaagactctgtcttaaaaaaaaaaaaaaaaggtgtttctgaattagaagggtcttcttgaatctgaaaatgtctatgatgattattcctgtgggaatgtcactaagtatgcagaaaagagtaacacagccagcctgacttatcctttgaaaggcctgattataaggtttgtcctcagctgttgcatctgggaacttagatatcagaaggtatcttagtctgttctgctgtcataacagaattacacaaactaagtattttataatgaacagaagtttatttggttgacaggtgtggaggctaggcagtccaagaacatggtgccagcatctagtgagggtcttgccatggcagaaggcaccacatggcaagtgagcatgagaaagatatatgggtctaaacttagccttttatcatgagcccactcccaagatagcagcactaattcattaatgagggcaaagccctccttacctaattactttttaaaggtctcataacacttttacaatgtcaattaaatttccaacacttgaactttgggggacatatttaaaccttaacaggagggctccactcactgaaaagagtcgttcatggtagctaacctgtggtttgtgctgaaaacctgctttcttcctgggagtctagaattttggtacatggtaggtagaaggtacctacgtgaccagcccccagtaaaaaccctgggcactgtatctctaacaagtttccctggtaaacaacatttctcacatgttgtcacaattcagttgctggtggaatgaaacaacagatatgtgtgactccactgttagaggactctggaagcttatacctggtttcccccagactttgcctctgtaccttttctctttgctgttttgcttcatatgcttttgctgtaataaatcatagctgtgtgatgatatgctgagtcttgtgaattctcctagcaaatcatggaacctggaggtagtcttggagaccctggcatacaaagcagttcctaagtgtttactggtagctgtaggaataggcaaagaagaaacagcaaagaaaaaggcacactgtggtataactttggaggtttaccttgcaaaatgctcagatattttacctatcagaggttattgtgcatataatagagagtgatatactaacaactgcctcaggatatactctttttaatcagtattgtaactaaccttggcttattttacttttagacttggggttctattttgctttaaaacatgtacatcagttttgttttttgttttgttcttttctttcctttttttttttttttttttaaagacaggatctcactctgtcacccaggttgctgagagtgtggtgtggcccaatcttgacctcactgcagccttgacctctcaggctcgggtgatcctcccgcctcagcctcccaagtagctgggactataggcacgcgccaccacgcctggctaattttgtattttctgtagagacagagttttgccatgttgttgaggctggtcttgaactcctgggttcaaacgaccctcccgcctcagcctccgaaagtgctgggagtacaggtgttagccactgcgcctggcctcattgtactccttaacacaagaagacttcaacaatgataagtagttgtttataaggaagcaggatcattaccaaaataaatcctgctaaaacaacaggaatcatgttttaaagcctagtttgctaatttttgctagtaggataagagtgatcgtaatatctcgaacattacatagacacttaaaacctttagttgtatttcatcaaaaatctgttcataccccacgttggtttcaaaacatactatgctttttcttcgtgttatttcctatattcatttttgtgtgtatgtgtatgtcacaaatattgatatgcctggttgtttatttttgttttctattatgcctttttcaaaatataaaaataaacttgtaatttctaactaaaaaaaaaaag

SEQ ID NO: 427008 - DNA, 3756 bp, Homo sapiens
tgcacatgtagtaaatggtcaatcatttttgaactgtagttagactgagtttgagatattgaaggtacatccagatagagattaccagtagtcttaaatgtgggcctgaattttaggaaggaagttaggtttagcaatataaattgagggtcatctgcattgagtgattattgaagacaaaagagttgaactcacaaagagtaggtttgtactgtaagaagtgggaaagcacagttttaaggagcttttgaagtaaggggctggaaaaagatcatgtgttaacctttggtatcagttactgatgatataatgaattaataagagacataatttctcctgtttcccttttcaaatgttacagaaccaggctttagcaaagatggatatattggtgactgagacagaagaactggcagagaatatactcaagtggcgtaaacaacaaaacgaagtttcgtcttgtatccccaaaatattagctgaagaaagttatctttataaacatgatattataatgcctcctttaccttttacttctaaagttcatgtccaaactattaatgccaagtagtcatcaactttatttttgcttaattatgtgtagtcatatgaagtctatttctagttgactgtaacatgggtattaatagtctttgctgctggtaatactgaaagaacctgctttatattggagtatcaagatctcaggttcattaagaccaaactgacttttcctttgtttttcatatatttttattctacctttcagtaaaactagagaagctaaaaaatagccatgacaatttattaatataagtgaattaaccatttctcaggtgggaaattctctttttttaaaaatgtgtgtttatcgtctggtgtggtggctcacacctgtaatcctaacacttggggaggctgaggcgggcagatcacttaaacccaggagttcaagaccagcctgggtaacatggtgaaatcccatatctacaaaataaacaaaaaattagccgaccatggtggtgcatgcctgtagtcccagctattcgggaggctgaggtaagaggatcacctaagcctgtgaggtcatggttgcaatgagtcatgatcacgccactgcgctacagcctgggcgacacagtaagaccctgtctcaaaaaaaagaagtgtgtttctggccaggcacggtggctcacgcctgtaatcccagcactttgggaggcctaggtgggcagatcatgaggtcaggagttcgagaccagcctggccaacatggcgaaacacctgtctctactaaaaatacaaaaattaggccgggcgcagtggctcacacctgtaatcccaacactttgggaggccgacccagatgggtggatcacctgaggtcaggagtttgagaccagccttgacaacatggtgaaaccccatctctggtagaaatataaaaaattaaccgggcatggtggtggacgcctgtaatcccagctacttgggaggctgaggcagaataatcgcttgaacccaggaggcagaggttgcagtaagccaagatcgtgcctctgcactccaacctgggtgatggagcaagactccatctccaaaaaaataaaaaatacaaaaattagccaggcatggtagcatgtgcctgtaatcccagctactcaggaggctgaggcaggagaatcacttgaacccaggaggcagaggttgcagtgagcccagatcgtgccaccgcactctagcctgggcaacagagcaagactctgtcttaaaaaaaaaaaaaaaaggtgtttctgaattagaagggtcttcttgaatctgaaaatgtctatgatgattattcctgtgggaatgtcactaagtatgcagaaaagagtaacacagccagcctgacttatcctttgaaaggcctgattataaggtttgtcctcagctgttgcatctgggaacttagatatcagaaggtatcttagtctgttctgctgtcataacagaattacacaaactaagtattttataatgaacagaagtttatttggttgacaggtgtggaggctaggcagtccaagaacatggtgccagcatctagtgagggtcttgccatggcagaaggcaccacatggcaagtgagcatgagaaagatatatgggtctaaacttagccttttatcatgagcccactcccaagatagcagcactaattcattaatgagggcaaagccctccttacctaattactttttaaaggtctcataacacttttacaatgtcaattaaatttccaacacttgaactttgggggacatatttaaaccttaacaggagggctccactcactgaaaagagtcgttcatggtagctaacctgtggtttgtgctgaaaacctgctttcttcctgggagtctagaattttggtacatggtaggtagaaggtacctacgtgaccagcccccagtaaaaaccctgggcactgtatctctaacaagtttccctggtaaacaacatttctcacatgttgtcacaattcagttgctggtggaatgaaacaacagatatgtgtgactccactgttagaggactctggaagcttatacctggtttcccccagactttgcctctgtaccttttctctttgctgttttgcttcatatgcttttgctgtaataaatcatagctgtgtgatgatatgctgagtcttgtgaattctcctagcaaatcatggaacctggaggtagtcttggagaccctggcatacaaagcagttcctaagtgtttactggtagctgtaggaataggcaaagaagaaacagcaaagaaaaaggcacactgtggtataactttggaggtttaccttgcaaaatgctcagatattttacctatcagaggttattgtgcatataatagagagtgatatactaacaactgcctcaggatatactctttttaatcagtattgtaactaaccttggcttattttacttttagacttggggttctattttgctttaaaacatgtacatcagttttgttttttgttttgttcttttctttcctttttttttttttttttttaaagacaggatctcactctgtcacccaggttgctgagagtgtggtgtggcccaatcttgacctcactgcagccttgacctctcaggctcgggtgatcctcccgcctcagcctcccaagtagctgggactataggcacgcgccaccacgcctggctaattttgtattttctgtagagacagagttttgccatgttgttgaggctggtcttgaactcctgggttcaaacgaccctcccgcctcagcctccgaaagtgctgggagtacaggtgttagccactgcgcctggcctcattgtactccttaacacaagaagacttcaacaatgataagtagttgtttataaggaagcaggatcattaccaaaataaatcctgctaaaacaacaggaatcatgttttaaagcctagtttgctaatttttgctagtaggataagagtgatcgtaatatctcgaacattacatagacacttaaaacctttagttgtatttcatcaaaaatctgttcataccccacgttggtttcaaaacatactatgctttttcttcgtgttatttcctatattcatttttgtgtgtatgtgtatgtcacaaatattgatatgcctggttgtttatttttgttttctattatgcctttttcaaaatataaaaataaacttgtaatttctaactaaaaaaaaaaag

SEQ ID NO: 427009 - DNA, 1355 bp, Homo sapiens
cgcgccgtgcgttcgccctgcgatcccgctcactcttggcgccttcgcggaaggtgcgtccgagccatggccgctgccaacccgtgggacccggcgtccgcgcctaacggcgctgggctagtgctaggccacttcatagcttcggggatggtcaatcaggagatgttaaacatgtctaagaaaacagtttcttgttttgtgaacttcaccagactacagcagatcacaaatattcaagctgaaatctaccagaaaaacctggaaattgaactcctgaaactagaaaaagatacagcagatgttgttcatcctttctttttggctcagaagtgtcatactctgcaaagcatgaataatcatttggaagcagtgctgaaagagaagagatcccttaggcaaagactgttgaaacccatgtgccaggaaaacttacctattgaagctgtttatcacagatatatggtacatttgctggagttggctgtgactttcattgagagattagaaacccaccttgaaacaattagaaatattcctcatttagctgcaaatctaaagaaaatgaaccaggctttagcaaagatggatatattggtgactgagacagaagaactggcagagaatatactcaagtggcgtaaacaacaaaacgaagtttcgtcttgtatccccaaaatattagctgaagaaagttatctttataaacatgatattataatgcctcctttaccttttacttctaaagttcatgtccaaactattaatgccaagtagtcatcaactttatttttgcttaattatgtgtagtcatatgaagtctatttctagttgactgtaacatgggtattaatagtctttgctgctggtaatactgaaagaacctgctttatattggagtatcaagatctcagagcctccgaaagtgctgggagtacaggtgttagccactgcgcctggcctcattgtactccttaacacaagaagacttcaacaatgataagtagttgtttataaggaagcaggatcattaccaaaataaatcctgctaaaacaacaggaatcatgttttaaagcctagtttgctaatttttgctagtaggataagagtgatcgtaatatctcgaacattacatagacacttaaaacctttagttgtatttcatcaaaaatctgttcataccccacgttggtttcaaaacatactatgctttttcttcgtgttatttcctatattcatttttgtgtgtatgtgtatgtcacaaatattgatatgcctggttgtttatttttgttttctattatgcctttttcaaaatataaaaataaacttgtaatttctaactaaaaaaaaaaag

SEQ ID NO: 427010 - DNA, 796 bp, Homo sapiens
atttgagcgataagtatataaaatccggttataaccccggcctttattcaaatattatattcgacccctcctcttttgaggagagctccccccatgattttcccccctcttgttcaacaaaaaatcgggtggtctactagaaaccacctttattgatccatcccttgcccctttctcttattactttcttttgtttccgccccccccctatcccccggtttttttttttttttttttttttttttttttttttttttttttttttttttttttttttttttttttttttcaagttttgccatgttgttgaggctggtcttgaactcctgggttcaaacgaccctcccgcctcagcctccgaaagtgctgggagtacaggtgttagccactgcgcctggcctcattgtactccttaacacaagaagacttcaacaatgataagtagttgtttataaggaagcaggatcattaccaaaataaatcctgctaaaacaacaggaatcatgttttaaagcctagtttgctaatttttgctagtaggataagagtgatcgtaatatctcgaacattacatagacacttaaaacctttagttgtatttcatcaaaaatctgttcataccccacgttggtttcaaaacatactatgctttttcttcgtgttatttcctatattcatttttgtgtgtatgtgtatgtcacaaatattgatatgcctggttgtttatttttgttttctattatgcctttttcaaaatataaaaataaacttgtaatttctaactaaaaaaaaaaag

SEQ ID NO: 427011 - DNA, 740 bp, Homo sapiens
cgcgccgtgcgttcgccctgcgatcccgctcactcttggcgccttcgcggaaggtgcgtccgagccatggccgctgccaacccgtgggacccggcgtccgcgcctaacggcgctgggctagtgctaggccacttcatagcttcggggatggtcaatcaggagatgttaaacatgtctaagaaaacagtttcttgttttgtgaacttcaccagactacagcagatcacaaatattcaagctgaaatctaccagaaaaacctggaaattgaactcctgaaactagaaaaagatacagcagatgttgttcatcctttctttttggctcagaagtgtcatactctgcaaagcatgaataatcatttggaagcagtgctgaaagagaagagatcccttaggcaaagactgttgaaacccatgtgccaggaaaacttacctattgaagctgtttatcacaggttagactgaaaagtagaaattaacagttacacctgttttctgagtttactttttgttttgcagttactttgtagcagaattcataaaacaattagtgattgtatttgttaacattattaatggtgatatattaaatcagaaagaaaatctttgcttttaaaccattatacctatggcaaaaaggaagaacttggccatcgtgttttgggaattataaattatgagtttaatgaaagaaattagatccataacatgtaacaataaaaactgtttgtatgtgaagt

SEQ ID NO: 427012 - DNA, 577 bp, Homo sapiens
cgcgccgtgcgttcgccctgcgatcccgctcactcttggcgccttcgcggaaggtgcgtccgagccatggccgctgccaacccgtgggacccggcgtccgcgcctaacggcgctgggctagtgctaggccacttcatagcttcggggatggtcaatcaggagatgttaaacatgtctaagaaaacagtttcttgttttgtgaacttcaccagactacagcagatcacaaatattcaagctgaaatctaccagaaaaacctggaaattgaactcctgaaactagaaaaagatacagcagatgttgttcatcctttctttttgggtggctcagacagtgtcatactgctgtatgcggggatctcgaacacgcagagaggacactgctcagctggctgctgatctgccggagggaatggctaagcccgtggatcttgcgggaggtgagactcggggttgagtcgaggtgaggcggggaaaaagattcagaactttcactgctcaggctgtccatgtcactgaggtcgaaggttactgccttcttggtgggggatcctctctgcgttaggggtaccgagct

SEQ ID NO: 427013 - DNA, 490 bp, Homo sapiens
aggaaggatagtttaggtcaacctgctacatcaatagattgggtaaggggaactctcatgggataaaataactaacattgttgagcacttgcgctaagcattttattagatgctctacatttatcatcttcatcaatcctcacatcagccctaggagatactattactgacatctttaataatgacttgatatttaatacattgatattcagttcaaaaattctaaccacaagtttctttcttctccatacctctctaggaacttggtctgcagaccatccagaggaataaaaaggttggccttagtagtcaaaaacaaagctgatagccagacacgttctgatttctgcccttgttccagctttgacgtattatctgttgccttatttctcattgcctcttctacttgtaaaatgcttttcactttctgtctaggttaaagctaaactgaatctatggctttaaataaattaagatcctaaactctcta

SEQ ID NO: 427014 - DNA, 4592 bp, Homo sapiens
ttatttgcacccgccccccgcccgcgtcggtctggggcttttgacttctccccgaacacatttcccctcccgtcgctgggtccctgcgatcgcccccagctggtggggctcgcggagctcaggggagcggggtcctctgcgccgctgcagcgcgagttaataaacagttaagtttggaagactctgcagacacgttgagggggagttaccaagcccaggcagcaaaaacatcctggcacattcctggggagtcctcagctgccagcatctgattagaaccatatctctcgccgggagtggccgcgcggctccgaagctcccggccggcggctatttaagcgaggcccgccgcatccgctgcgctgtagcctggaggctccgggcgcggggaagtcatgctcgcttcacggaggcaatagctagccggtgtctgtgggaggttatgtttatttgagacttctccatcgggatcgcctggtgtcaccaagtgtccactggtactgaggtttgctgcctgccttcttgccatgtctaacgaagtagaaacaagtgcaaccaatggtcagcccgaccaacaggccgcaccaaaagcaccctcaaagaaggaaaaaaagaaaggccctgaaaagacagatgaatatctcttagcaaggttcaaaggcgatggtgtaaaatataaggccaagctgattggcattgatgatgtgccagatgcaagaggggataaaatgagccaagactctatgatgaaactaaagggaatggcggcagctggtcggtctcagggacaacacaaacaaaggatctgggtcaacatttccctttctgggataaaaataattgatgagaaaactggggtaatagagcatgaacatccagtaaataagatttctttcattgcccgtgatgtgacagacaaccgggcatttggttacgtgtgtggaggagaaggccagcatcagttttttgccataaaaaccgggcaacaggctgaaccattagttgttgatcttaaagacctttttcaagttatctataatgtaaagaaaaaggaagaagaaaagaaaaagatagaggaagccagcaaagcagttgagaatgggagtgaggccctaatgattctagatgaccaaactaacaaactgaaatcgggtgttgaccagatggatttgtttggggacatgtctacacctcctgacctaaatagtccaacagaaagcaaagatatcctgttagtggatctaaactctgaaatcgacaccaatcagaattctttaagagaaaatccattcttaacaaacggcatcacctcctgttctcttcctcgaccaacgcctcaggcatccttcttgcctgaaaatgccttttctgccaatctcaacttctttcccacccctaatcctgatcctttccgtgacgatcctttcacacagccagaccaatcgacaccttcttcgtttgattctctcaaatctccagatcagaagaaagagaattcgagtagctcgtctactccgctgagtaatgggcccctgaatggtgatgttgactactttggtcagcaatttgaccagatctctaaccggactggcaaacaggaagctcaggcaggcccatggcccttttcaagttcgcaaacccagccagcagtgagaactcaaaatggggtatctgaaagagaacagaacggcttctctgtcaaatcctccccgaacccttttgtgggaagccctcccaaaggactgtccatacagaatggcgtaaagcaggacttggaaagctctgtccagtcctcaccacatgactccatagccattatcccacctccacaaagtaccaaaccaggaagaggcagaaggactgctaagtcttcagccaatgacttgcttgcatcagacatctttgctcctcccgtctcagaaccttcaggccaggcgtcacccacaggacaacctacagccctgcagcccaaccctctggatctcttcaaaacaagtgctcctgccccagtggggcccctggtgggtctaggtggtgtaactgtcacactccctcaggcaggaccatggaacacagcatctttggtcttcaatcagtccccttcaatggctccgggagccatgatgggtggtcaaccttcaggttttagtcagcccgtcatttttggtacaagtccagctgtttcaggttggaaccagccttcaccctttgcagcctcaactccccctccagtgcctgttgtctggggcccttctgcatctgtggcacccaatgcttggtcaacaacaagccctttggggaatccttttcagagcaatatttttccagctcctgctgtgtccactcagcccccatccatgcactcctctctcctggtcactcctcctcagccacctcccagagctggccctcccaaggacatctccagtgatgccttcactgccttagacccacttggggataaagagatcaaggatgtgaaagaaatgtttaaggatttccaactgcggcagccacctgctgtgcccgcgcggaagggagagcagacttcttctgggactttgagtgcctttgccagttatttcaacagcaaggttggcattcctcaggagaatgcagaccatgatgactttgatgctaatcaactattgaacaagatcaatgaaccaccaaagccagctcccagacaagtttccctgccagttaccaaatctactgacaatgcatttgagaaccctttctttaaagattcttttggttcatcacaagcctctgtggcttcttctcaacctgtatcttctgagatgtatagggatccatttggaaatccttttgcctaaattctgaacttggtctgcagaccatccagaggaataaaaaggttggccttagtagtcaaaaacaaagctgatagccagacacgttctgatttctgcccttgttccagctttgacgtattatctgttgccttatttctcattgcctcttctacttgtaaaatgcttttcactttctgtctaggttaaagctaaactgaatctatggctttaaataaattaagatcctaaactctctagcttaagtgtaaatgaagtacagtagtttccctactgaaccctgcctcttgtgtccctggaaccttctagaacacctgccttctaccctctggttgggagatgcagccaccacatcccttcatatcatactgttttgaataaattttcaaatccttattgttcagagttgtttgggggttctgtttcagagcataaaacctaaaggttatagtagaacaaggcaccttcttaaaagaaatcttgcttcagaccatcagttacagagaatttctaaagtaaaattgaagcaactacaacttctccttagacactttggaatctaaccacttaaggacctttttaaagagatagcttctcttctttctgaagatcaatttctcccaaggccaagattgtccttttctcccatttcttgctagctattgcaaatgagggaagaacattattcatctctcctccccttttttttctgattcttttttcagtcagttttgctcctgggttcaagtagtattaccaccctttcacaagcaacagactctcacagggcaaaaaaaaaaaaaaatctaatgattcacagacagatctggagcctctcttcattctcagtaattgctagtcccaagaactagaattgcaaatgggcacaacctatatccttcctgtggaagaggaggccactctcttgagctgaagttccagaagagcagttaatgttcaagagaaattgaactcaactcagcaacaaaggactctattttgaagagcaacatatcacaaagctaaatgtgattgtgccaaacacattaggtgcttatttggggtcatgctaggcctttatcaagtaactggaaaacttttcttgcagccacaatctcaatgtcgttagtaggaagataagaggggagaaaaagctgtagaacaaatgtttggggttaccattgaaaatctaatgtctgcaatatttttctcctcacaacttggaaacgttcccagttcattttcagtcctgttgtgagcacagttctgaagggtttattattgtcaaaataagttttgttttgttttgtttatgttgggtttttaatgttgtctcttgacccttaatgctcaggttcttgtgggagttaatcagccacatccaacgttaccttgagggggaagaagagggtgatgctcagaagctaaacaagacaggggccacatgaccctctattgattagccccaagtagaaagtcctgtggttttatgtttaatggtaatagttgatcatatatggcataattttctatcagcttcctactcagtcactataaacacagacttgaaatagtactttaaatgtccaaatacctaaatgtgctaaactggaggtaactatttctaggtagttgaatttttgaaagtcatgatcagccacacaactgttttgtacatacttattttctcatgcacttttctgtatgcaaataaagctataaatttactcatttcaataaactggagtggcagaa

SEQ ID NO: 427015 - DNA, 4644 bp, Homo sapiens
  misc_feature (4601)..(4601): n is a, c, g, or t
  misc_feature (4604)..(4604): n is a, c, g, or t
  misc_feature (4608)..(4609): n is a, c, g, or t
ttatttgcacccgccccccgcccgcgtcggtctggggcttttgacttctccccgaacacatttcccctcccgtcgctgggtccctgcgatcgcccccagctggtggggctcgcggagctcaggggagcggggtcctctgcgccgctgcagcgcgagttaataaacagttaagtttggaagactctgcagacacgttgagggggagttaccaagcccaggcagcaaaaacatcctggcacattcctggggagtcctcagctgccagcatctgattagaaccatatctctcgccgggagtggccgcgcggctccgaagctcccggccggcggctatttaagcgaggcccgccgcatccgctgcgctgtagcctggaggctccgggcgcggggaagtcatgctcgcttcacggaggcaatagctagccggtgtctgtgggaggttatgtttatttgagacttctccatcgggatcgcctggtgtcaccaagtgtccactggtactgaggtttgctgcctgccttcttgccatgtctaacgaagtagaaacaagtgcaaccaatggtcagcccgaccaacaggccgcaccaaaagcaccctcaaagaaggaaaaaaagaaaggccctgaaaagacagatgaatatctcttagcaaggttcaaaggcgatggtgtaaaatataaggccaagctgattggcattgatgatgtgccagatgcaagaggggataaaatgagccaagactctatgatgaaactaaagggaatggcggcagctggtcggtctcagggacaacacaaacaaaggatctgggtcaacatttccctttctgggataaaaataattgatgagaaaactggggtaatagagcatgaacatccagtaaataagatttctttcattgcccgtgatgtgacagacaaccgggcatttggttacgtgtgtggaggagaaggccagcatcagttttttgccataaaaaccgggcaacaggctgaaccattagttgttgatcttaaagacctttttcaagttatctataatgtaaagaaaaaggaagaagaaaagaaaaagatagaggaagccagcaaagcagttgagaatgggagtgaggccctaatgattctagatgaccaaactaacaaactgaaatcgggtgttgaccagatggatttgtttggggacatgtctacacctcctgacctaaatagtccaacagaaagcaaagatatcctgttagtggatctaaactctgaaatcgacaccaatcagaattctttaagagaaaatccattcttaacaaacggcatcacctcctgttctcttcctcgaccaacgcctcaggcatccttcttgcctgaaaatgccttttctgccaatctcaacttctttcccacccctaatcctgatcctttccgtgacgatcctttcacacagccagaccaatcgacaccttcttcgtttgattctctcaaatctccagatcagaagaaagagaattcgagtagctcgtctactccgctgagtaatgggcccctgaatggtgatgttgactactttggtcagcaatttgaccagatctctaaccggactggcaaacaggaagctcaggcaggcccatggcccttttcaagttcgcaaacccagccagcagtgagaactcaaaatggggtatctgaaagagaacagaacggcttctctgtcaaatcctccccgaacccttttgtgggaagccctcccaaaggactgtccatacagaatggcgtaaagcaggacttggaaagctctgtccagtcctcaccacatgactccatagccattatcccacctccacaaagtaccaaaccaggaagaggcagaaggactgctaagtcttcagccaatgacttgcttgcatcagacatctttgctcctcccgtctcagaaccttcaggccaggcgtcacccacaggacaacctacagccctgcagcccaaccctctggatctcttcaaaacaagtgctcctgccccagtggggcccctggtgggtctaggtggtgtaactgtcacactccctcaggcaggaccatggaacacagcatctttggtcttcaatcagtccccttcaatggctccgggagccatgatgggtggtcaaccttcaggttttagtcagcccgtcatttttggtacaagtccagctgtttcaggttggaaccagccttcaccctttgcagcctcaactccccctccagtgcctgttgtctggggcccttctgcatctgtggcacccaatgcttggtcaacaacaagccctttggggaatccttttcagagcaatatttttccagctcctgctgtgtccactcagcccccatccatgcactcctctctcctggtcactcctcctcagccacctcccagagctggccctcccaaggacatctccagtgatgccttcactgccttagacccacttggggataaagagatcaaggatgtgaaagaaatgtttaaggatttccaactgcggcagccacctgctgtgcccgcgcggaagggagagcagacttcttctgggactttgagtgcctttgccagttatttcaacagcaaggttggcattcctcaggagaatgcagaccatgatgactttgatgctaatcaactattgaacaagatcaatgaaccaccaaagccagctcccagacaagtttccctgccagttaccaaatctactgacaatgcatttgagaaccctttctttaaagattcttttggttcatcacaagcctctgtggcttcttctcaacctgtatcttctgagatgtatagggatccatttggaaatccttttgcctaaattctgaacttggtctgcagaccatccagaggaataaaaaggttggccttagtagtcaaaaacaaagctgatagccagacacgttctgatttctgcccttgttccagctttgacgtattatctgttgccttatttctcattgcctcttctacttgtaaaatgcttttcactttctgtctaggttaaagctaaactgaatctatggctttaaataaattaagatcctaaactctctagcttaagtgtaaatgaagtacagtagtttccctactgaaccctgcctcttgtgtccctggaaccttctagaacacctgccttctaccctctggttgggagatgcagccaccacatcccttcatatcatactgttttgaataaattttcaaatccttattgttcagagttgtttgggggttctgtttcagagcataaaacctaaaggttatagtagaacaaggcaccttcttaaaagaaatcttgcttcagaccatcagttacagagaatttctaaagtaaaattgaagcaactacaacttctccttagacactttggaatctaaccacttaaggacctttttaaagagatagcttctcttctttctgaagatcaatttctcccaaggccaagattgtccttttctcccatttcttgctagctattgcaaatgagggaagaacattattcatctctcctccccttttttttctgattcttttttcagtcagttttgctcctgggttcaagtagtattaccaccctttcacaagcaacagactctcacagggcaaaaaaaaaaaaaaatctaatgattcacagacagatctggagcctctcttcattctcagtaattgctagtcccaagaactagaattgcaaatgggcacaacctatatccttcctgtggaagaggaggccactctcttgagctgaagttccagaagagcagttaatgttcaagagaaattgaactcaactcagcaacaaaggactctattttgaagagcaacatatcacaaagctaaatgtgattgtgccaaacacattaggtgcttatttggggtcatgctaggcctttatcaagtaactggaaaacttttcttgcagccacaatctcaatgtcgttagtaggaagataagaggggagaaaaagctgtagaacaaatgtttggggttaccattgaaaatctaatgtctgcaatatttttctcctcacaacttggaaacgttcccagttcattttcagtcctgttgtgagcacagttctgaagggtttattattgtcaaaataagttttgttttgttttgtttatgttgggtttttaatgttgtctcttgacccttaatgctcaggttcttgtgggagttaatcagccacatccaacgttaccttgagggggaagaagagggtgatgctcagaagctaaacaagacaggggccacatgaccctctattgattagccccaagtagaaagtcctgtggttttatgtttaatggtaatagttgatcatatatggcataattttctatcagcttcctactcagtcactataaacacagacttgaaatagtactttaaatgtccaaatacctaaatgtgctaaactggaggtaactatttctaggtagttgaatttttgaaagtcatgatcagccacacaactgttttgtacatacttattttctcatgcacttttctgtatgcaaataaagctataaatttactcatttcaataaactggagtggcagaaaaaaaaacncanaacnnacaaaaacaaaaaaccacaaaaaccagaacaaagg

SEQ ID NO: 427016 - DNA, 4326 bp, Homo sapiens
ttatttgcacccgccccccgcccgcgtcggtctggggcttttgacttctccccgaacacatttcccctcccgtcgctgggtccctgcgatcgcccccagctggtggggctcgcggagctcaggggagcggggtcctctgcgccgctgcagcgcgagttaataaacagttaagtttggaagactctgcagacacgttgagggggagttaccaagcccaggcagcaaaaacatcctggcacattcctggggagtcctcagctgccagcatctgattagaaccatatctctcgccgggagtggccgcgcggctccgaagctcccggccggcggctatttaagcgaggcccgccgcatccgctgcgctgtagcctggaggctccgggcgcggggaagtcatgctcgcttcacggaggcaatagctagccggtgtctgtgggaggttatgtttatttgagacttctccatcgggatcgcctggtgtcaccaagtgtccactggtactgaggtttgctgcctgccttcttgccatgtctaacgaagtagaaacaagtgcaaccaatggtcagcccgaccaacaggccgcaccaaaagcaccctcaaagaaggaaaaaaagaaaggccctgaaaagacagatgaatatctcttagcaaggttcaaaggcgatggtgtaaaatataaggccaagctgattggcattgatgatgtgccagatgcaagaggggataaaatgagccaagactctatgatgaaactaaagggaatggcggcagctggtcggtctcagggacaacacaaacaaaggatctgggtcaacatttccctttctgggataaaaataattgatgagaaaactggggtaatagagcatgaacatccagtaaataagatttctttcattgcccgtgatgtgacagacaaccgggcatttggttacgtgtgtggaggagaaggccagcatcagttttttgccataaaaaccgggcaacaggctgaaccattagttgttgatcttaaagacctttttcaagttatctataatgtaaagaaaaaggaagaagaaaagaaaaagatagaggaagccagcaaagcagttgagaatgggagtgaggccctaatgattctagatgaccaaactaacaaactgaaatcgggtgttgaccagatggatttgtttggggacatgtctacacctcctgacctaaatagtccaacagaaagcaaagatatcctgttagtggatctaaactctgaaatcgacaccaatcagaattctttaagagaaaatccattcttaacaaacggcatcacctcctgttctcttcctcgaccaacgcctcaggcatccttcttgcctgaaaatgccttttctgccaatctcaacttctttcccacccctaatcctgatcctttccgtgacgatcctttcacacagccagaccaatcgacaccttcttcgtttgattctctcaaatctccagatcagaagaaagagaattcgagtagctcgtctactccgctgagtaatgggcccctgaatggtgatgttgactactttggtcagcaatttgaccagatctctaaccggactggcaaacaggaagctcaggcaggcccatggcccttttcaagttcgcaaacccagccagcagtgagaactcaaaatggggtatctgaaagagaacagaacggcttctctgtcaaatcctccccgaacccttttgtgggaagccctcccaaaggactgtccatacagaatggcgtaaagcaggacttggaaagctctgtccagtcctcaccacatgactccatagccattatcccacctccacaaagtaccaaaccaggaagaggcagaaggactgctaagtcttcagccaatgacttgcttgcatcagacatctttgctcctcccgtctcagaaccttcaggccaggcgtcacccacaggacaacctacagccctgcagcccaaccctctggatctcttcaaaacaagtgctcctgccccagtggggcccctggtgggtctaggtggtgtaactgtcacactccctcaggcaggaccatggaacacagcatctttggtcttcaatcagtccccttcaatggctccgggagccatgatgggtggtcaaccttcaggttttagtcagcccgtcatttttggtacaagtccagctgtttcaggttggaaccagccttcaccctttgcagcctcaactccccctccagtgcctgttgtctggggcccttctgcatctgtggcacccaatgcttggtcaacaacaagccctttggggaatccttttcagagcaatatttttccagctcctgctgtgtccactcagcccccatccatgcactcctctctcctggtcactcctcctcagccacctcccagagctggccctcccaaggacatctccagtgatgccttcactgccttagacccacttggggataaagagatcaaggatgtgaaagaaatgtttaaggatttccaactgcggcagccacctgctgtgcccgcgcggaagggagagcagacttcttctgggactttgagtgcctttgccagttatttcaacagcaaggttggcattcctcaggagaatgcagaccatgatgactttgatgctaatcaactattgaacaagatcaatgaaccaccaaagccagctcccagacaagtttccctgccagttaccaaatctactgacaatgcatttgagaaccctttctttaaagattcttttggttcatcacaagcctctgtggcttcttctcaacctgtatcttctgagatgtatagggatccatttggaaatccttttgcctaaattctgaacttggtctgcagaccatccagaggaataaaaaggttggccttagtagtcaaaaacaaagctgatagccagacacgttctgatttctgcccttgttccagctttgacgtattatctgttgccttatttctcattgcctcttctacttgtaaaatgcttttcactttctgtctaggttaaagctaaactgaatctatggctttaaataaattaagatcctaaactctctagcttaagtgtaaatgaagtacagtagtttccctactgaaccctgcctcttgtgtccctggaaccttctagaacacctgccttctaccctctggttgggagatgcagccaccacatcccttcatatcatactgttttgaataaattttcaaatccttattgttcagagttgtttgggggttctgtttcagagcataaaacctaaaggttatagtagaacaaggcaccttcttaaaagaaatcttgcttcagaccatcagttacagagaatttctaaagtaaaattgaagcaactacaacttctccttagacactttggaatctaaccacttaaggacctttttaaagagatagcttctcttctttctgaagatcaatttctcccaaggccaagattgtccttttctcccatttcttgctagctattgcaaatgagggaagaacattattcatctctcctccccttttttttctgattcttttttcagtcagttttgctcctgggttcaagtagtattaccaccctttcacaagcaacagactctcacagggcaaaaaaaaaaaaaaatctaatgattcacagacagatctggagcctctcttcattctcagtaattgctagtcccaagaactagaattgcaaatgggcacaacctatatccttcctgtggaagaggaggccactctcttgagctgaagttccagaagagcagttaatgttcaagagaaattgaactcaactcagcaacaaaggactctattttgaagagcaacatatcacaaagctaaatgtgattgtgccaaacacattaggtgcttatttggggtcatgctaggcctttatcaagtaactggaaaacttttcttgcagccacaatctcaatgtcgttagtaggaagataagagggtgatgctcagaagctaaacaagacaggggccacatgaccctctattgattagccccaagtagaaagtcctgtggttttatgtttaatggtaatagttgatcatatatggcataattttctatcagcttcctactcagtcactataaacacagacttgaaatagtactttaaatgtccaaatacctaaatgtgctaaactggaggtaactatttctaggtagttgaatttttgaaagtcatgatcagccacacaactgttttgtacatacttattttctcatgcacttttctgtatgcaaataaagctataaatttactcatttcaataaactggagtggcagaa

SEQ ID NO: 427017 - DNA, 4529 bp, Homo sapiens
ttatttgcacccgccccccgcccgcgtcggtctggggcttttgacttctccccgaacacatttcccctcccgtcgctgggtccctgcgatcgcccccagctggtggggctcgcggagctcaggggagcggggtcctctgcgccgctgcagcgcgagttaataaacagttaagtttggaagactctgcagacacgttgagggggagttaccaagcccaggcagcaaaaacatcctggcacattcctggggagtcctcagctgccagcatctgattagaaccatatctctcgccgggagtggccgcgcggctccgaagctcccggccggcggctatttaagcgaggcccgccgcatccgctgcgctgtagcctggaggctccgggcgcggggaagtcatgctcgcttcacggaggcaatagctagccggtgtctgtgggaggttatgtttatttgagacttctccatcgggatcgcctggtgtcaccaagtgtccactggtactgaggtttgctgcctgccttcttgccatgtctaacgaagtagaaacaagtgcaaccaatggtcagcccgaccaacaggccgcaccaaaagcaccctcaaagaaggaaaaaaagaaaggccctgaaaagacagatgaatatctcttagcaaggttcaaaggcgatggtgtaaaatataaggccaagctgattggcattgatgatgtgccagatgcaagaggggataaaatgagccaagactctatgatgaaactaaagggaatggcggcagctggtcggtctcagggacaacacaaacaaaggatctgggtcaacatttccctttctgggataaaaataattgatgagaaaactggggtaatagagcatgaacatccagtaaataagatttctttcattgcccgtgatgtgacagacaaccgggcatttggttacgtgtgtggaggagaaggccagcatcagttttttgccataaaaaccgggcaacaggctgaaccattagttgttgatcttaaagacctttttcaagttatctataatgtaaagaaaaaggaagaagaaaagaaaaagatagaggaagccagcaaagcagttgagaatgggagtgaggccctaatgattctagatgaccaaactaacaaactgaaatcggaaagcaaagatatcctgttagtggatctaaactctgaaatcgacaccaatcagaattctttaagagaaaatccattcttaacaaacggcatcacctcctgttctcttcctcgaccaacgcctcaggcatccttcttgcctgaaaatgccttttctgccaatctcaacttctttcccacccctaatcctgatcctttccgtgacgatcctttcacacagccagaccaatcgacaccttcttcgtttgattctctcaaatctccagatcagaagaaagagaattcgagtagctcgtctactccgctgagtaatgggcccctgaatggtgatgttgactactttggtcagcaatttgaccagatctctaaccggactggcaaacaggaagctcaggcaggcccatggcccttttcaagttcgcaaacccagccagcagtgagaactcaaaatggggtatctgaaagagaacagaacggcttctctgtcaaatcctccccgaacccttttgtgggaagccctcccaaaggactgtccatacagaatggcgtaaagcaggacttggaaagctctgtccagtcctcaccacatgactccatagccattatcccacctccacaaagtaccaaaccaggaagaggcagaaggactgctaagtcttcagccaatgacttgcttgcatcagacatctttgctcctcccgtctcagaaccttcaggccaggcgtcacccacaggacaacctacagccctgcagcccaaccctctggatctcttcaaaacaagtgctcctgccccagtggggcccctggtgggtctaggtggtgtaactgtcacactccctcaggcaggaccatggaacacagcatctttggtcttcaatcagtccccttcaatggctccgggagccatgatgggtggtcaaccttcaggttttagtcagcccgtcatttttggtacaagtccagctgtttcaggttggaaccagccttcaccctttgcagcctcaactccccctccagtgcctgttgtctggggcccttctgcatctgtggcacccaatgcttggtcaacaacaagccctttggggaatccttttcagagcaatatttttccagctcctgctgtgtccactcagcccccatccatgcactcctctctcctggtcactcctcctcagccacctcccagagctggccctcccaaggacatctccagtgatgccttcactgccttagacccacttggggataaagagatcaaggatgtgaaagaaatgtttaaggatttccaactgcggcagccacctgctgtgcccgcgcggaagggagagcagacttcttctgggactttgagtgcctttgccagttatttcaacagcaaggttggcattcctcaggagaatgcagaccatgatgactttgatgctaatcaactattgaacaagatcaatgaaccaccaaagccagctcccagacaagtttccctgccagttaccaaatctactgacaatgcatttgagaaccctttctttaaagattcttttggttcatcacaagcctctgtggcttcttctcaacctgtatcttctgagatgtatagggatccatttggaaatccttttgcctaaattctgaacttggtctgcagaccatccagaggaataaaaaggttggccttagtagtcaaaaacaaagctgatagccagacacgttctgatttctgcccttgttccagctttgacgtattatctgttgccttatttctcattgcctcttctacttgtaaaatgcttttcactttctgtctaggttaaagctaaactgaatctatggctttaaataaattaagatcctaaactctctagcttaagtgtaaatgaagtacagtagtttccctactgaaccctgcctcttgtgtccctggaaccttctagaacacctgccttctaccctctggttgggagatgcagccaccacatcccttcatatcatactgttttgaataaattttcaaatccttattgttcagagttgtttgggggttctgtttcagagcataaaacctaaaggttatagtagaacaaggcaccttcttaaaagaaatcttgcttcagaccatcagttacagagaatttctaaagtaaaattgaagcaactacaacttctccttagacactttggaatctaaccacttaaggacctttttaaagagatagcttctcttctttctgaagatcaatttctcccaaggccaagattgtccttttctcccatttcttgctagctattgcaaatgagggaagaacattattcatctctcctccccttttttttctgattcttttttcagtcagttttgctcctgggttcaagtagtattaccaccctttcacaagcaacagactctcacagggcaaaaaaaaaaaaaaatctaatgattcacagacagatctggagcctctcttcattctcagtaattgctagtcccaagaactagaattgcaaatgggcacaacctatatccttcctgtggaagaggaggccactctcttgagctgaagttccagaagagcagttaatgttcaagagaaattgaactcaactcagcaacaaaggactctattttgaagagcaacatatcacaaagctaaatgtgattgtgccaaacacattaggtgcttatttggggtcatgctaggcctttatcaagtaactggaaaacttttcttgcagccacaatctcaatgtcgttagtaggaagataagaggggagaaaaagctgtagaacaaatgtttggggttaccattgaaaatctaatgtctgcaatatttttctcctcacaacttggaaacgttcccagttcattttcagtcctgttgtgagcacagttctgaagggtttattattgtcaaaataagttttgttttgttttgtttatgttgggtttttaatgttgtctcttgacccttaatgctcaggttcttgtgggagttaatcagccacatccaacgttaccttgagggggaagaagagggtgatgctcagaagctaaacaagacaggggccacatgaccctctattgattagccccaagtagaaagtcctgtggttttatgtttaatggtaatagttgatcatatatggcataattttctatcagcttcctactcagtcactataaacacagacttgaaatagtactttaaatgtccaaatacctaaatgtgctaaactggaggtaactatttctaggtagttgaatttttgaaagtcatgatcagccacacaactgttttgtacatacttattttctcatgcacttttctgtatgcaaataaagctataaatttactcatttcaataaactggagtggcagaa

SEQ ID NO: 427018 - DNA, 5101 bp, Homo sapiens
ttatttgcacccgccccccgcccgcgtcggtctggggcttttgacttctccccgaacacatttcccctcccgtcgctgggtccctgcgatcgcccccagctggtggggctcgcggagctcaggggagcggggtcctctgcgccgctgcagcgcgagttaataaacagttaagtttggaagactctgcagacacgttgagggggagttaccaagcccaggcagcaaaaacatcctggcacattcctggggagtcctcagctgccagcatctgattagaaccatatctctcgccgggagtggccgcgcggctccgaagctcccggccggcggctatttaagcgaggcccgccgcatccgctgcgctgtagcctggaggctccgggcgcggggaagtcatgctcgcttcacggaggcaatagctagccggtgtctgtgggaggttatgtttatttgagacttctccatcgggatcgcctggtgtcaccaagtgtccactggtactgaggtttgctgcctgccttcttgccatgtctaacgaagtagaaacaagtgcaaccaatggtcagcccgaccaacaggccgcaccaaaagcaccctcaaagaaggaaaaaaagaaaggccctgaaaagacagatgaatatctcttagcaaggttcaaaggcgatggtgtaaaatataaggccaagctgattggcattgatgatgtgccagatgcaagaggggataaaatgagccaagactctatgatgaaactaaagggaatggcggcagctggtcggtctcagggacaacacaaacaaaggatctgggtcaacatttccctttctgggataaaaataattgatgagaaaactggggtaatagagcatgaacatccagtaaataagatttctttcattgcccgtgatgtgacagacaaccgggcatttggttacgtgtgtggaggagaaggccagcatcagttttttgccataaaaaccgggcaacaggtgagctctaagtcttgacatagacctggggacttgtcctctgtggacattggagtgtctgtcactcaactaaaagatttactggaaataattggatgtaagagggctaaataataattccgagaatgactatttttattggcctatggaatcttttaaaaatgtcattgatagctatgcactgctgtgtgccacaggattgtgagaatggaccttcttataaagtgaatactgacttcacaacagtggtgaattattctcaggaaccttaaaggacttcaaatatgatcatgatacctcttgttttgtctaaatacttattaaccctgctgtcttttatatacctaagggtgaggattgggttggtggtgatcccctataagccagcagagggtagtaaggcgttttaagattaaaaaaaatcccagtatgaattataattgatagcagacaaaggaaataaaatactaaaattaaaatactgataacagtgctttcccttactgcaggctgaaccattagttgttgatcttaaagacctttttcaagttatctataatgtaaagaaaaaggaagaagaaaagaaaaagatagaggaagccagcaaagcagttgagaatgggagtgaggccctaatgattctagatgaccaaactaacaaactgaaatcgggtgttgaccagatggatttgtttggggacatgtctacacctcctgacctaaatagtccaacagaaagcaaagatatcctgttagtggatctaaactctgaaatcgacaccaatcagaattctttaagagaaaatccattcttaacaaacggcatcacctcctgttctcttcctcgaccaacgcctcaggcatccttcttgcctgaaaatgccttttctgccaatctcaacttctttcccacccctaatcctgatcctttccgtgacgatcctttcacacagccagaccaatcgacaccttcttcgtttgattctctcaaatctccagatcagaagaaagagaattcgagtagctcgtctactccgctgagtaatgggcccctgaatggtgatgttgactactttggtcagcaatttgaccagatctctaaccggactggcaaacaggaagctcaggcaggcccatggcccttttcaagttcgcaaacccagccagcagtgagaactcaaaatggggtatctgaaagagaacagaacggcttctctgtcaaatcctccccgaacccttttgtgggaagccctcccaaaggactgtccatacagaatggcgtaaagcaggacttggaaagctctgtccagtcctcaccacatgactccatagccattatcccacctccacaaagtaccaaaccaggaagaggcagaaggactgctaagtcttcagccaatgacttgcttgcatcagacatctttgctcctcccgtctcagaaccttcaggccaggcgtcacccacaggacaacctacagccctgcagcccaaccctctggatctcttcaaaacaagtgctcctgccccagtggggcccctggtgggtctaggtggtgtaactgtcacactccctcaggcaggaccatggaacacagcatctttggtcttcaatcagtccccttcaatggctccgggagccatgatgggtggtcaaccttcaggttttagtcagcccgtcatttttggtacaagtccagctgtttcaggttggaaccagccttcaccctttgcagcctcaactccccctccagtgcctgttgtctggggcccttctgcatctgtggcacccaatgcttggtcaacaacaagccctttggggaatccttttcagagcaatatttttccagctcctgctgtgtccactcagcccccatccatgcactcctctctcctggtcactcctcctcagccacctcccagagctggccctcccaaggacatctccagtgatgccttcactgccttagacccacttggggataaagagatcaaggatgtgaaagaaatgtttaaggatttccaactgcggcagccacctgctgtgcccgcgcggaagggagagcagacttcttctgggactttgagtgcctttgccagttatttcaacagcaaggttggcattcctcaggagaatgcagaccatgatgactttgatgctaatcaactattgaacaagatcaatgaaccaccaaagccagctcccagacaagtttccctgccagttaccaaatctactgacaatgcatttgagaaccctttctttaaagattcttttggttcatcacaagcctctgtggcttcttctcaacctgtatcttctgagatgtatagggatccatttggaaatccttttgcctaaattctgaacttggtctgcagaccatccagaggaataaaaaggttggccttagtagtcaaaaacaaagctgatagccagacacgttctgatttctgcccttgttccagctttgacgtattatctgttgccttatttctcattgcctcttctacttgtaaaatgcttttcactttctgtctaggttaaagctaaactgaatctatggctttaaataaattaagatcctaaactctctagcttaagtgtaaatgaagtacagtagtttccctactgaaccctgcctcttgtgtccctggaaccttctagaacacctgccttctaccctctggttgggagatgcagccaccacatcccttcatatcatactgttttgaataaattttcaaatccttattgttcagagttgtttgggggttctgtttcagagcataaaacctaaaggttatagtagaacaaggcaccttcttaaaagaaatcttgcttcagaccatcagttacagagaatttctaaagtaaaattgaagcaactacaacttctccttagacactttggaatctaaccacttaaggacctttttaaagagatagcttctcttctttctgaagatcaatttctcccaaggccaagattgtccttttctcccatttcttgctagctattgcaaatgagggaagaacattattcatctctcctccccttttttttctgattcttttttcagtcagttttgctcctgggttcaagtagtattaccaccctttcacaagcaacagactctcacagggcaaaaaaaaaaaaaaatctaatgattcacagacagatctggagcctctcttcattctcagtaattgctagtcccaagaactagaattgcaaatgggcacaacctatatccttcctgtggaagaggaggccactctcttgagctgaagttccagaagagcagttaatgttcaagagaaattgaactcaactcagcaacaaaggactctattttgaagagcaacatatcacaaagctaaatgtgattgtgccaaacacattaggtgcttatttggggtcatgctaggcctttatcaagtaactggaaaacttttcttgcagccacaatctcaatgtcgttagtaggaagataagaggggagaaaaagctgtagaacaaatgtttggggttaccattgaaaatctaatgtctgcaatatttttctcctcacaacttggaaacgttcccagttcattttcagtcctgttgtgagcacagttctgaagggtttattattgtcaaaataagttttgttttgttttgtttatgttgggtttttaatgttgtctcttgacccttaatgctcaggttcttgtgggagttaatcagccacatccaacgttaccttgagggggaagaagagggtgatgctcagaagctaaacaagacaggggccacatgaccctctattgattagccccaagtagaaagtcctgtggttttatgtttaatggtaatagttgatcatatatggcataattttctatcagcttcctactcagtcactataaacacagacttgaaatagtactttaaatgtccaaatacctaaatgtgctaaactggaggtaactatttctaggtagttgaatttttgaaagtcatgatcagccacacaactgttttgtacatacttattttctcatgcacttttctgtatgcaaataaagctataaatttactcatttcaataaactggagtggcagaa

SEQ ID NO: 427019 - DNA, 3509 bp, Homo sapiens
tggctggatgaggccggggtaatcggccgaggtatgatctagatgaccaaactaacaaactgaaatcgggtgttgaccagatggatttgtttggggacatgtctacacctcctgacctaaatagtccaacagaaagcaaagatatcctgttagtggatctaaactctgaaatcgacaccaatcagaattctttaagagaaaatccattcttaacaaacggcatcacctcctgttctcttcctcgaccaacgcctcaggcatccttcttgcctgaaaatgccttttctgccaatctcaacttctttcccacccctaatcctgatcctttccgtgacgatcctttcacacagccagaccaatcgacaccttcttcgtttgattctctcaaatctccagatcagaagaaagagaattcgagtagctcgtctactccgctgagtaatgggcccctgaatggtgatgttgactactttggtcagcaatttgaccagatctctaaccggactggcaaacaggaagctcaggcaggcccatggcccttttcaagttcgcaaacccagccagcagtgagaactcaaaatggggtatctgaaagagaacagaacggcttctctgtcaaatcctccccgaacccttttgtgggaagccctcccaaaggactgtccatacagaatggcgtaaagcaggacttggaaagctctgtccagtcctcaccacatgactccatagccattatcccacctccacaaagtaccaaaccaggaagaggcagaaggactgctaagtcttcagccaatgacttgcttgcatcagacatctttgctcctcccgtctcagaaccttcaggccaggcgtcacccacaggacaacctacagccctgcagcccaaccctctggatctcttcaaaacaagtgctcctgccccagtggggcccctggtgggtctaggtggtgtaactgtcacactccctcaggcaggaccatggaacacagcatctttggtcttcaatcagtccccttcaatggctccgggagccatgatgggtggtcaaccttcaggttttagtcagcccgtcatttttggtacaagtccagctgtttcaggttggaaccagccttcaccctttgcagcctcaactccccctccagtgcctgttgtctggggcccttctgcatctgtggcacccaatgcttggtcaacaacaagccctttggggaatccttttcagagcaatatttttccagctcctgctgtgtccactcagcccccatccatgcactcctctctcctggtcactcctcctcagccacctcccagagctggccctcccaaggacatctccagtgatgccttcactgccttagacccacttggggataaagagatcaaggatgtgaaagaaatgtttaaggatttccaactgcggcagccacctgctgtgcccgcgcggaagggagagcagacttcttctgggactttgagtgcctttgccagttatttcaacagcaaggttggcattcctcaggagaatgcagaccatgatgactttgatgctaatcaactattgaacaagatcaatgaaccaccaaagccagctcccagacaagtttccctgccagttaccaaatctactgacaatgcatttgagaaccctttctttaaagattcttttggttcatcacaagcctctgtggcttcttctcaacctgtatcttctgagatgtatagggatccatttggaaatccttttgcctaaattctgaacttggtctgcagaccatccagaggaataaaaaggttggccttagtagtcaaaaacaaagctgatagccagacacgttctgatttctgcccttgttccagctttgacgtattatctgttgccttatttctcattgcctcttctacttgtaaaatgcttttcactttctgtctaggttaaagctaaactgaatctatggctttaaataaattaagatcctaaactctctagcttaagtgtaaatgaagtacagtagtttccctactgaaccctgcctcttgtgtccctggaaccttctagaacacctgccttctaccctctggttgggagatgcagccaccacatcccttcatatcatactgttttgaataaattttcaaatccttattgttcagagttgtttgggggttctgtttcagagcataaaacctaaaggttatagtagaacaaggcaccttcttaaaagaaatcttgcttcagaccatcagttacagagaatttctaaagtaaaattgaagcaactacaacttctccttagacactttggaatctaaccacttaaggacctttttaaagagatagcttctcttctttctgaagatcaatttctcccaaggccaagattgtccttttctcccatttcttgctagctattgcaaatgagggaagaacattattcatctctcctccccttttttttctgattcttttttcagtcagttttgctcctgggttcaagtagtattaccaccctttcacaagcaacagactctcacagggcaaaaaaaaaaaaaaatctaatgattcacagacagatctggagcctctcttcattctcagtaattgctagtcccaagaactagaattgcaaatgggcacaacctatatccttcctgtggaagaggaggccactctcttgagctgaagttccagaagagcagttaatgttcaagagaaattgaactcaactcagcaacaaaggactctattttgaagagcaacatatcacaaagctaaatgtgattgtgccaaacacattaggtgcttatttggggtcatgctaggcctttatcaagtaactggaaaacttttcttgcagccacaatctcaatgtcgttagtaggaagataagaggggagaaaaagctgtagaacaaatgtttggggttaccattgaaaatctaatgtctgcaatatttttctcctcacaacttggaaacgttcccagttcattttcagtcctgttgtgagcacagttctgaagggtttattattgtcaaaataagttttgttttgttttgtttatgttgggtttttaatgttgtctcttgacccttaatgctcaggttcttgtgggagttaatcagccacatccaacgttaccttgagggggaagaagagggtgatgctcagaagctaaacaagacaggggccacatgaccctctattgattagccccaagtagaaagtcctgtggttttatgtttaatggtaatagttgatcatatatggcataattttctatcagcttcctactcagtcactataaacacagacttgaaatagtactttaaatgtccaaatacctaaatgtgctaaactggaggtaactatttctaggtagttgaatttttgaaagtcatgatcagccacacaactgttttgtacatacttattttctcatgcacttttctgtatgcaaataaagctataaatttactcatttcaataaactggagtggcagaa

SEQ ID NO: 427020 - DNA, 3536 bp, Homo sapiens
  misc_feature (40)..(40): n is a, c, g, or t
  misc_feature (144)..(144): n is a, c, g, or t
gggatgaggaacgtcactcctcttcgtaaatcccaacccnatatcatggtttcccatttcactcgggataaaatacaaccactttaacctgccctacataccctacttgatctggcccctggctagccactctacactcctganctaaatagtccacagaaagcaaagatatcctgttagtggatctaaactctgaaatcgacaccaatcagaattctttaagagaaaatccattcttaacaaacggcatcacctcctgttctcttcctcgaccaacgcctcaggcatccttcttgcctgaaaatgccttttctgccaatctcaacttctttcccacccctaatcctgatcctttccgtgacgatcctttcacacagccagaccaatcgacaccttcttcgtttgattctctcaaatctccagatcagaagaaagagaattcgagtagctcgtctactccgctgagtaatgggcccctgaatggtgatgttgactactttggtcagcaatttgaccagatctctaaccggactggcaaacaggaagctcaggcaggcccatggcccttttcaagttcgcaaacccagccagcagtgagaactcaaaatggggtatctgaaagagaacagaacggcttctctgtcaaatcctccccgaacccttttgtgggaagccctcccaaaggactgtccatacagaatggcgtaaagcaggacttggaaagctctgtccagtcctcaccacatgactccatagccattatcccacctccacaaagtaccaaaccaggaagaggcagaaggactgctaagtcttcagccaatgacttgcttgcatcagacatctttgctcctcccgtctcagaaccttcaggccaggcgtcacccacaggacaacctacagccctgcagcccaaccctctggatctcttcaaaacaagtgctcctgccccagtggggcccctggtgggtctaggtggtgtaactgtcacactccctcaggcaggaccatggaacacagcatctttggtcttcaatcagtccccttcaatggctccgggagccatgatgggtggtcaaccttcaggttttagtcagcccgtcatttttggtacaagtccagctgtttcaggttggaaccagccttcaccctttgcagcctcaactccccctccagtgcctgttgtctggggcccttctgcatctgtggcacccaatgcttggtcaacaacaagccctttggggaatccttttcagagcaatatttttccagctcctgctgtgtccactcagcccccatccatgcactcctctctcctggtcactcctcctcagccacctcccagagctggccctcccaaggacatctccagtgatgccttcactgccttagacccacttggggataaagagatcaaggatgtgaaagaaatgtttaaggatttccaactgcggcagccacctgctgtgcccgcgcggaagggagagcagacttcttctgggactttgagtgcctttgccagttatttcaacagcaaggttggcattcctcaggagaatgcagaccatgatgactttgatgctaatcaactattgaacaagatcaatgaaccaccaaagccagctcccagacaagtttccctgccagttaccaaatctactgacaatgcatttgagaaccctttctttaaagattcttttggttcatcacaagcctctgtggcttcttctcaacctgtatcttctgagatgtatagggatccatttggaaatccttttgcctaaattctgaacttggtctgcagaccatccagaggaataaaaaggttggccttagtagtcaaaaacaaagctgatagccagacacgttctgatttctgcccttgttccagctttgacgtattatctgttgccttatttctcattgcctcttctacttgtaaaatgcttttcactttctgtctaggttaaagctaaactgaatctatggctttaaataaattaagatcctaaactctctagcttaagtgtaaatgaagtacagtagtttccctactgaaccctgcctcttgtgtccctggaaccttctagaacacctgccttctaccctctggttgggagatgcagccaccacatcccttcatatcatactgttttgaataaattttcaaatccttattgttcagagttgtttgggggttctgtttcagagcataaaacctaaaggttatagtagaacaaggcaccttcttaaaagaaatcttgcttcagaccatcagttacagagaatttctaaagtaaaattgaagcaactacaacttctccttagacactttggaatctaaccacttaaggacctttttaaagagatagcttctcttctttctgaagatcaatttctcccaaggccaagattgtccttttctcccatttcttgctagctattgcaaatgagggaagaacattattcatctctcctccccttttttttctgattcttttttcagtcagttttgctcctgggttcaagtagtattaccaccctttcacaagcaacagactctcacagggcaaaaaaaaaaaaaaatctaatgattcacagacagatctggagcctctcttcattctcagtaattgctagtcccaagaactagaattgcaaatgggcacaacctatatccttcctgtggaagaggaggccactctcttgagctgaagttccagaagagcagttaatgttcaagagaaattgaactcaactcagcaacaaaggactctattttgaagagcaacatatcacaaagctaaatgtgattgtgccaaacacattaggtgcttatttggggtcatgctaggcctttatcaagtaactggaaaacttttcttgcagccacaatctcaatgtcgttagtaggaagataagaggggagaaaaagctgtagaacaaatgtttggggttaccattgaaaatctaatgtctgcaatatttttctcctcacaacttggaaacgttcccagttcattttcagtcctgttgtgagcacagttctgaagggtttattattgtcaaaataagttttgttttgttttgtttatgttgggtttttaatgttgtctcttgacccttaatgctcaggttcttgtgggagttaatcagccacatccaacgttaccttgagggggaagaagagggtgatgctcagaagctaaacaagacaggggccacatgaccctctattgattagccccaagtagaaagtcctgtggttttatgtttaatggtaatagttgatcatatatggcataattttctatcagcttcctactcagtcactataaacacagacttgaaatagtactttaaatgtccaaatacctaaatgtgctaaactggaggtaactatttctaggtagttgaatttttgaaagtcatgatcagccacacaactgttttgtacatacttattttctcatgcacttttctgtatgcaaataaagctataaatttactcatttcaataaactggagtggcagaa

SEQ ID NO: 427021 - DNA, 4231 bp, Homo sapiens
ttatttgcacccgccccccgcccgcgtcggtctggggcttttgacttctccccgaacacatttcccctcccgtcgctgggtccctgcgatcgcccccagctggtggggctcgcggagctcaggggagcggggtcctctgcgccgctgcagcgcgagttaataaacagttaagtttggaagactctgcagacacgttgagggggagttaccaagcccaggcagcaaaaacatcctggcacattcctggggagtcctcagctgccagcatctgattagaaccatatctctcgccgggagtggccgcgcggctccgaagctcccggccggcggctatttaagcgaggcccgccgcatccgctgcgctgtagcctggaggctccgggcgcggggaagtcatgctcgcttcacggaggcaatagctagccggtgtctgtgggaggttatgtttatttgagacttctccatcgggatcgcctggtgtcaccaagtgtccactggtactgaggtttgctgcctgccttcttgccatgtctaacgaagtagaaacaagtgcaaccaatggtcagcccgaccaacaggccgcaccaaaagcaccctcaaagaaggaaaaaaagaaaggccctgaaaagacagatgaatatctcttagcaaggttcaaaggcgatggtgtaaaatataaggccaagctgattggcattgatgatgtgccagatgcaagaggggataaaatgagccaagactctatgatgaaactaaagggaatggcggcagctggtcggtctcagggacaacacaaacaaaggatctgggtcaacatttccctttctgggataaaaataattgatgagaaaactggggtaatagagcatgaacatccagtaaataagatttctttcattgcccgtgatgtgacagacaaccgggcatttggttacgtgtgtggaggagaaggccagcatcagttttttgccataaaaaccgggcaacaggctgaaccattagttgttgatcttaaagacctttttcaagttatctataatgtaaagaaaaaggaagaagaaaagaaaaagatagaggaagccagcaaagcagttgagaatgggagtgaggccctaatgattctagatgaccaaactaacaaactgaaatcgggtgttgaccagatggatttgtttggggacatgtctacacctcctgacctaaatagtccaacagaaagcaaagatatcctgttagtggatctaaactctgaaatcgacaccaatcagaattctttaagagaaaatccattcttaacaaacggcatcacctcctgttctcttcctcgaccaacgcctcaggcatccttcttgcctgaaaatgccttttctgccaatctcaacttctttcccacccctaatcctgatcctttccgtgacgatcctttcacacagccagaccaatcgacaccttcttcgtttgattctctcaaatctccagatcagaagaaagagaattcgagtagctcgtctactccgctgagtaatgggcccctgaatggtgatgttgactactttggtcagcaatttgaccagatctctaaccggactggcaaacaggaagctcaggcaggcccatggcccttttcaagttcgcaaacccagccagcagtgagaactcaaaatggggtatctgaaagagaacagaacggcttctctgtcaaatcctccccgaacccttttgtgggaagccctcccaaaggactgtccatacagaatggcgtaaagcaggacttggaaagctctgtccagtcctcaccacatgactccatagccattatcccacctccacaaagtaccaaaccaggaagaggcagaaggactgctaaggtgaattgtcttctccacatatccattagcagagtgcatgttcggtaccaaagggtggtgtgatgcaagctctctttcctgctgctctcgtagtttcctgtgttgctgtgaaatagaaggtgggataaggcactttggttctccaggagtactttcctcagccacctcccagagctggccctcccaaggacatctccagtgatgccttcactgccttagacccacttggggataaagagatcaaggatgtgaaagaaatgtttaaggatttccaactgcggcagccacctgctgtgcccgcgcggaagggagagcagacttcttctgggactttgagtgcctttgccagttatttcaacagcaaggttggcattcctcaggagaatgcagaccatgatgactttgatgctaatcaactattgaacaagatcaatgaaccaccaaagccagctcccagacaagtttccctgccagttaccaaatctactgacaatgcatttgagaaccctttctttaaagattcttttggttcatcacaagcctctgtggcttcttctcaacctgtatcttctgagatgtatagggatccatttggaaatccttttgcctaaattctgaacttggtctgcagaccatccagaggaataaaaaggttggccttagtagtcaaaaacaaagctgatagccagacacgttctgatttctgcccttgttccagctttgacgtattatctgttgccttatttctcattgcctcttctacttgtaaaatgcttttcactttctgtctaggttaaagctaaactgaatctatggctttaaataaattaagatcctaaactctctagcttaagtgtaaatgaagtacagtagtttccctactgaaccctgcctcttgtgtccctggaaccttctagaacacctgccttctaccctctggttgggagatgcagccaccacatcccttcatatcatactgttttgaataaattttcaaatccttattgttcagagttgtttgggggttctgtttcagagcataaaacctaaaggttatagtagaacaaggcaccttcttaaaagaaatcttgcttcagaccatcagttacagagaatttctaaagtaaaattgaagcaactacaacttctccttagacactttggaatctaaccacttaaggacctttttaaagagatagcttctcttctttctgaagatcaatttctcccaaggccaagattgtccttttctcccatttcttgctagctattgcaaatgagggaagaacattattcatctctcctccccttttttttctgattcttttttcagtcagttttgctcctgggttcaagtagtattaccaccctttcacaagcaacagactctcacagggcaaaaaaaaaaaaaaatctaatgattcacagacagatctggagcctctcttcattctcagtaattgctagtcccaagaactagaattgcaaatgggcacaacctatatccttcctgtggaagaggaggccactctcttgagctgaagttccagaagagcagttaatgttcaagagaaattgaactcaactcagcaacaaaggactctattttgaagagcaacatatcacaaagctaaatgtgattgtgccaaacacattaggtgcttatttggggtcatgctaggcctttatcaagtaactggaaaacttttcttgcagccacaatctcaatgtcgttagtaggaagataagaggggagaaaaagctgtagaacaaatgtttggggttaccattgaaaatctaatgtctgcaatatttttctcctcacaacttggaaacgttcccagttcattttcagtcctgttgtgagcacagttctgaagggtttattattgtcaaaataagttttgttttgttttgtttatgttgggtttttaatgttgtctcttgacccttaatgctcaggttcttgtgggagttaatcagccacatccaacgttaccttgagggggaagaagagggtgatgctcagaagctaaacaagacaggggccacatgaccctctattgattagccccaagtagaaagtcctgtggttttatgtttaatggtaatagttgatcatatatggcataattttctatcagcttcctactcagtcactataaacacagacttgaaatagtactttaaatgtccaaatacctaaatgtgctaaactggaggtaactatttctaggtagttgaatttttgaaagtcatgatcagccacacaactgttttgtacatacttattttctcatgcacttttctgtatgcaaataaagctataaatttactcatttcaataaactggagtggcagaa

SEQ ID NO: 427022 - DNA, 3354 bp, Homo sapiens
  misc_feature (20)..(20): n is a, c, g, or t
tgaatgagctggtacctctngatgcaagtgtccatggtggtggtataaaattctcgagcttatctcctcttttaaatactgagtaaatacataagctttttctaagcttatgtatttactattaccactatgatctcagctttatttaagagcaatttaaaatgcagttcccataggtgtctttttttacctctcctaagaatatacaggcttgcctggattaagaccctatgatctctatgtagactgacttaaaatccaatggaatgaacaaaaatatttaggatgcttattggtagttgccccttttacacacttgctcccccaacttcaagcatttagcgatgagaccagaccaatgtgagtgtgtaaaggaatatagtagatttcactttgcaagtcctaggtagtgtcagacactaagactcagtagtccgtccgttgtaggaatctgtgtctttttttggaggactctttttctgtagtagtagttgttgttgttcatctgtcaagaaaaaagttttcctttttgtggctctcaaattggggtatagggtaggagacaaaatgaggctgtatttcactgttagtgagtaactaaggcttctccctccctccctgtcctgtcagtcttcagccaatgacttgcttgcatcagacatctttgctcctcccgtctcagaaccttcaggccaggcgtcacccacaggacaacctacagccctgcagcccaaccctctggatctcttcaaaacaagtgctcctgccccagtggggcccctggtgggtctaggtggtgtaactgtcacactccctcaggcaggaccatggaacacagcatctttggtcttcaatcagtccccttcaatggctccgggagccatgatgggtggtcaaccttcaggttttagtcagcccgtcatttttggtacaagtccagctgtttcaggttggaaccagccttcaccctttgcagcctcaactccccctccagtgcctgttgtctggggcccttctgcatctgtggcacccaatgcttggtcaacaacaagccctttggggaatccttttcagagcaatatttttccagctcctgctgtgtccactcagcccccatccatgcactcctctctcctggtcactcctcctcagccacctcccagagctggccctcccaaggacatctccagtgatgccttcactgccttagacccacttggggataaagagatcaaggatgtgaaagaaatgtttaaggatttccaactgcggcagccacctgctgtgcccgcgcggaagggagagcagacttcttctgggactttgagtgcctttgccagttatttcaacagcaaggttggcattcctcaggagaatgcagaccatgatgactttgatgctaatcaactattgaacaagatcaatgaaccaccaaagccagctcccagacaagtttccctgccagttaccaaatctactgacaatgcatttgagaaccctttctttaaagattcttttggttcatcacaagcctctgtggcttcttctcaacctgtatcttctgagatgtatagggatccatttggaaatccttttgcctaaattctgaacttggtctgcagaccatccagaggaataaaaaggttggccttagtagtcaaaaacaaagctgatagccagacacgttctgatttctgcccttgttccagctttgacgtattatctgttgccttatttctcattgcctcttctacttgtaaaatgcttttcactttctgtctaggttaaagctaaactgaatctatggctttaaataaattaagatcctaaactctctagcttaagtgtaaatgaagtacagtagtttccctactgaaccctgcctcttgtgtccctggaaccttctagaacacctgccttctaccctctggttgggagatgcagccaccacatcccttcatatcatactgttttgaataaattttcaaatccttattgttcagagttgtttgggggttctgtttcagagcataaaacctaaaggttatagtagaacaaggcaccttcttaaaagaaatcttgcttcagaccatcagttacagagaatttctaaagtaaaattgaagcaactacaacttctccttagacactttggaatctaaccacttaaggacctttttaaagagatagcttctcttctttctgaagatcaatttctcccaaggccaagattgtccttttctcccatttcttgctagctattgcaaatgagggaagaacattattcatctctcctccccttttttttctgattcttttttcagtcagttttgctcctgggttcaagtagtattaccaccctttcacaagcaacagactctcacagggcaaaaaaaaaaaaaaatctaatgattcacagacagatctggagcctctcttcattctcagtaattgctagtcccaagaactagaattgcaaatgggcacaacctatatccttcctgtggaagaggaggccactctcttgagctgaagttccagaagagcagttaatgttcaagagaaattgaactcaactcagcaacaaaggactctattttgaagagcaacatatcacaaagctaaatgtgattgtgccaaacacattaggtgcttatttggggtcatgctaggcctttatcaagtaactggaaaacttttcttgcagccacaatctcaatgtcgttagtaggaagataagaggggagaaaaagctgtagaacaaatgtttggggttaccattgaaaatctaatgtctgcaatatttttctcctcacaacttggaaacgttcccagttcattttcagtcctgttgtgagcacagttctgaagggtttattattgtcaaaataagttttgttttgttttgtttatgttgggtttttaatgttgtctcttgacccttaatgctcaggttcttgtgggagttaatcagccacatccaacgttaccttgagggggaagaagagggtgatgctcagaagctaaacaagacaggggccacatgaccctctattgattagccccaagtagaaagtcctgtggttttatgtttaatggtaatagttgatcatatatggcataattttctatcagcttcctactcagtcactataaacacagacttgaaatagtactttaaatgtccaaatacctaaatgtgctaaactggaggtaactatttctaggtagttgaatttttgaaagtcatgatcagccacacaactgttttgtacatacttattttctcatgcacttttctgtatgcaaataaagctataaatttactcatttcaataaactggagtggcagaa

SEQ ID NO: 427023 - DNA, 3498 bp, Homo sapiens
cgcgaggtcatcaacgtttatccattttgaatgcttctatgcttcgtatatcgctctgtctatatttttgatcttcgttgaatttggaaaagccctgcggagagttcttgtgattccctttgtacttccctgacactaacacatgccctgcacacccatcatgttgcatcagtgtccatggtggtggtataaaattctcgagcttatctcctcttttaaatactgagtaaatacataagctttttctaagcttatgtatttactattaccactatgatctcagctttatttaagagcaatttaaaatgcagttcccataggtgtctttttttacctctcctaagaatatacaggcttgcctggattaagaccctatgatctctatgtagactgacttaaaatccaatggaatgaacaaaaatatttaggatgcttattggtagttgccccttttacacacttgctcccccaacttcaagcatttagcgatgagaccagaccaatgtgagtgtgtaaaggaatatagtagatttcactttgcaagtcctaggtagtgtcagacactaagactcagtagtccgtccgttgtaggaatctgtgtctttttttggaggactctttttctgtagtagtagttgttgttgttcatctgtcaagaaaaaagttttcctttttgtggctctcaaattggggtatagggtaggagacaaaatgaggctgtatttcactgttagtgagtaactaaggcttctccctccctccctgtcctgtcagtcttcagccaatgacttgcttgcatcagacatctttgctcctcccgtctcagaaccttcaggccaggcgtcacccacaggacaacctacagccctgcagcccaaccctctggatctcttcaaaacaagtgctcctgccccagtggggcccctggtgggtctaggtggtgtaactgtcacactccctcaggcaggaccatggaacacagcatctttggtcttcaatcagtccccttcaatggctccgggagccatgatgggtggtcaaccttcaggttttagtcagcccgtcatttttggtacaagtccagctgtttcaggttggaaccagccttcaccctttgcagcctcaactccccctccagtgcctgttgtctggggcccttctgcatctgtggcacccaatgcttggtcaacaacaagccctttggggaatccttttcagagcaatatttttccagctcctgctgtgtccactcagcccccatccatgcactcctctctcctggtcactcctcctcagccacctcccagagctggccctcccaaggacatctccagtgatgccttcactgccttagacccacttggggataaagagatcaaggatgtgaaagaaatgtttaaggatttccaactgcggcagccacctgctgtgcccgcgcggaagggagagcagacttcttctgggactttgagtgcctttgccagttatttcaacagcaaggttggcattcctcaggagaatgcagaccatgatgactttgatgctaatcaactattgaacaagatcaatgaaccaccaaagccagctcccagacaagtttccctgccagttaccaaatctactgacaatgcatttgagaaccctttctttaaagattcttttggttcatcacaagcctctgtggcttcttctcaacctgtatcttctgagatgtatagggatccatttggaaatccttttgcctaaattctgaacttggtctgcagaccatccagaggaataaaaaggttggccttagtagtcaaaaacaaagctgatagccagacacgttctgatttctgcccttgttccagctttgacgtattatctgttgccttatttctcattgcctcttctacttgtaaaatgcttttcactttctgtctaggttaaagctaaactgaatctatggctttaaataaattaagatcctaaactctctagcttaagtgtaaatgaagtacagtagtttccctactgaaccctgcctcttgtgtccctggaaccttctagaacacctgccttctaccctctggttgggagatgcagccaccacatcccttcatatcatactgttttgaataaattttcaaatccttattgttcagagttgtttgggggttctgtttcagagcataaaacctaaaggttatagtagaacaaggcaccttcttaaaagaaatcttgcttcagaccatcagttacagagaatttctaaagtaaaattgaagcaactacaacttctccttagacactttggaatctaaccacttaaggacctttttaaagagatagcttctcttctttctgaagatcaatttctcccaaggccaagattgtccttttctcccatttcttgctagctattgcaaatgagggaagaacattattcatctctcctccccttttttttctgattcttttttcagtcagttttgctcctgggttcaagtagtattaccaccctttcacaagcaacagactctcacagggcaaaaaaaaaaaaaaatctaatgattcacagacagatctggagcctctcttcattctcagtaattgctagtcccaagaactagaattgcaaatgggcacaacctatatccttcctgtggaagaggaggccactctcttgagctgaagttccagaagagcagttaatgttcaagagaaattgaactcaactcagcaacaaaggactctattttgaagagcaacatatcacaaagctaaatgtgattgtgccaaacacattaggtgcttatttggggtcatgctaggcctttatcaagtaactggaaaacttttcttgcagccacaatctcaatgtcgttagtaggaagataagaggggagaaaaagctgtagaacaaatgtttggggttaccattgaaaatctaatgtctgcaatatttttctcctcacaacttggaaacgttcccagttcattttcagtcctgttgtgagcacagttctgaagggtttattattgtcaaaataagttttgttttgttttgtttatgttgggtttttaatgttgtctcttgacccttaatgctcaggttcttgtgggagttaatcagccacatccaacgttaccttgagggggaagaagagggtgatgctcagaagctaaacaagacaggggccacatgaccctctattgattagccccaagtagaaagtcctgtggttttatgtttaatggtaatagttgatcatatatggcataattttctatcagcttcctactcagtcactataaacacagacttgaaatagtactttaaatgtccaaatacctaaatgtgctaaactggaggtaactatttctaggtagttgaatttttgaaagtcatgatcagccacacaactgttttgtacatacttattttctcatgcacttttctgtatgcaaataaagctataaatttactcatttcaataaactggagtggcagaa

SEQ ID NO: 427024 - DNA, 4538 bp, Homo sapiens
ttatttgcacccgccccccgcccgcgtcggtctggggcttttgacttctccccgaacacatttcccctcccgtcgctgggtccctgcgatcgcccccagctggtggggctcgcggagctcaggggagcggggtcctctgcgccgctgcagcgcgagttaataaacagttaagtttggaagactctgcagacacgttgagggggagttaccaagcccaggcagcaaaaacatcctggcacattcctggggagtcctcagctgccagcatctgattagaaccatatctctcgccgggagtggccgcgcggctccgaagctcccggccggcggctatttaagcgaggcccgccgcatccgctgcgctgtagcctggaggctccgggcgcggggaagtcatgctcgcttcacggaggcaatagctagccggtgtctgtgggaggttatgtttatttgagacttctccatcgggatcgcctggtgtcaccaagtgtccactggtactgaggtttgctgcctgccttcttgccatgtctaacgaagtagaaacaagtgcaaccaatggtcagcccgaccaacaggccgcaccaaaagcaccctcaaagaaggaaaaaaagaaaggccctgaaaagacagatgaatatctcttagcaaggttcaaaggcgatggtgtaaaatataaggccaagctgattggcattgatgatgtgccagatgcaagaggggataaaatgagccaagactctatgatgaaactaaagggaatggcggcagctggtcggtctcagggacaacacaaacaaaggatctgggtcaacatttccctttctgggataaaaataattgatgagaaaactggggtaatagagcatgaacatccagtaaataagatttctttcattgcccgtgatgtgacagacaaccgggcatttggttacgtgtgtggaggagaaggccagcatcagttttttgccataaaaaccgggcaacaggctgaaccattagttgttgatcttaaagacctttttcaagttatctataatgtaaagaaaaaggaagaagaaaagaaaaagatagaggaagccagcaaagcagttgagaatgggagtgaggccctaatgattctagatgaccaaactaacaaactgaaatcgggtgttgaccagatggatttgtttggggacatgtctacacctcctgacctaaatagtccaacagaaagcaaagatatcctgttagtggatctaaactctgaaatcgacaccaatcagaattctttaagagaaaatccattcttaacaaacggcatcacctcctgttctcttcctcgaccaacgcctcaggcatccttcttgcctgaaaatgccttttctgccaatctcaacttctttcccacccctaatcctgatcctttccgtgacgatcctttcacacagccagaccaatcgacaccttcttcgtttgattctctcaaatctccagatcagaagaaagagaattcgagtagctcgtctactccgctgagtaatgggcccctgaatggtgatgttgactactttggtcagcaatttgaccagatctctaaccggactggcaaacaggaagctcaggcaggcccatggcccttttcaagttcgcaaacccagccagcagtgagaactcaaaatggggtatctgaaagagaacagaacggcttctctgtcaaatcctccccgaacccttttgtgggaagccctcccaaaggactgtccatacagaatggcgtaaagcaggacttggaaagctctgtccagtcctcaccacatgactccatagccattatcccacctccacaaagtaccaaaccaggaagaggcagaaggactgctaagtcttcagccaatgacttgcttgcatcagacatctttgctcctcccgtctcagaaccttcaggccaggcgtcacccacaggacaacctacagccctgcagcccaaccctctggatctcttcaaaacaagtgctcctgccccagtggggcccctggtgggtctaggtggtgtaactgtcacactccctcaggcaggaccatggaacacagcatctttggtcttcaatcagtccccttcaatggctccgggagccatgatgggtggtcaaccttcaggttttagtcagcccgtcatttttggtacaagtccagctgtttcaggttggaaccagccttcaccctttgcagcctcaactccccctccagtgcctgttgtctggggcccttctgcatctgtggcacccaatgcttggtcaacaacaagccctttggggaatccttttcagagcaatatttttccagctcctgctgtgtccactcagcccccatccatgcactcctctctcctggtcactcctcctcagccacctcccagagctggccctcccaaggacatctccagtgatgccttcactgccttagacccacttggggataaagagatcaaggatgtgaaagaaatgtttaaggatttccaactgcggcagccacctgctgtgcccgcgcggaagggagagcagacttcttctgggactttgagtgcctttgccagttatttcaacagcaaggttggcattcctcaggagaatgcagaccatgatgactttgatgctaatcaactattgaacaagatcaatgaaccaccaaagccagctcccagacaagtttccctgccagttaccaaatctactgacaatgcatttgagaaccctttctttaaagattcttttggttcatcacaagcctctgtggcttcttctcaacctgtatcttctgagatgtatagggatccatttggaaatccttttgcctaaattctgaacttggtctgcagaccatccagaggaataaaaaggttggccttagtagtcaaaaacaaagctgatagccagacacgttctgatttctgcccttgttccagctttgacgtattatctgttgccttatttctcattgcctcttctacttgtaaaatgcttttcactttctgtctaggttaaagctaaactgaatctatggctttaaataaattaagatcctaaactctctagcttaagtgtaaatgaagtacagtagtttccctactgaaccctgcctcttgtgtccctggaaccttctagaacacctgccttctaccctctggttgggagatgcagccaccacatcccttcatatcatactgttttgaataaattttcaaagttatagtagaacaaggcaccttcttaaaagaaatcttgcttcagaccatcagttacagagaatttctaaagtaaaattgaagcaactacaacttctccttagacactttggaatctaaccacttaaggacctttttaaagagatagcttctcttctttctgaagatcaatttctcccaaggccaagattgtccttttctcccatttcttgctagctattgcaaatgagggaagaacattattcatctctcctccccttttttttctgattcttttttcagtcagttttgctcctgggttcaagtagtattaccaccctttcacaagcaacagactctcacagggcaaaaaaaaaaaaaaatctaatgattcacagacagatctggagcctctcttcattctcagtaattgctagtcccaagaactagaattgcaaatgggcacaacctatatccttcctgtggaagaggaggccactctcttgagctgaagttccagaagagcagttaatgttcaagagaaattgaactcaactcagcaacaaaggactctattttgaagagcaacatatcacaaagctaaatgtgattgtgccaaacacattaggtgcttatttggggtcatgctaggcctttatcaagtaactggaaaacttttcttgcagccacaatctcaatgtcgttagtaggaagataagaggggagaaaaagctgtagaacaaatgtttggggttaccattgaaaatctaatgtctgcaatatttttctcctcacaacttggaaacgttcccagttcattttcagtcctgttgtgagcacagttctgaagggtttattattgtcaaaataagttttgttttgttttgtttatgttgggtttttaatgttgtctcttgacccttaatgctcaggttcttgtgggagttaatcagccacatccaacgttaccttgagggggaagaagagggtgatgctcagaagctaaacaagacaggggccacatgaccctctattgattagccccaagtagaaagtcctgtggttttatgtttaatggtaatagttgatcatatatggcataattttctatcagcttcctactcagtcactataaacacagacttgaaatagtactttaaatgtccaaatacctaaatgtgctaaactggaggtaactatttctaggtagttgaatttttgaaagtcatgatcagccacacaactgttttgtacatacttattttctcatgcacttttctgtatgcaaataaagctataaatttactcatttcaataaactggagtggcagaa

SEQ ID NO: 427025 - DNA, 2285 bp, Homo sapiens
tttctgaggactgacccaatgctgccctctagtgataaatcttaaaagggctgccatgagctattgaaatgtgatgactggtgactcttggagggctgtgtaataaggcgtcatccatgtcccatcagcttaaaatgaggggattctgaatctcttccacttcagataaatatgcatggctttctcttccgagaaggataataattattggggtacctagtatttggtgttgatttttgttccactgatgtaaatttcaaaagtatagaactaaacttcaaaaataagctgactcggggactggcctatatttggggaaagcttgtctactgattgcctggattttttaccttctagaaccaccaaagccagctcccagacaagtttccctgccagttaccaaatctactgacaatgcatttgagaaccctttctttaaagattcttttggttcatcacaagcctctgtggcttcttctcaacctgtatcttctgagatgtatagggatccatttggaaatccttttgcctaaattctgaacttggtctgcagaccatccagaggaataaaaaggttggccttagtagtcaaaaacaaagctgatagccagacacgttctgatttctgcccttgttccagctttgacgtattatctgttgccttatttctcattgcctcttctacttgtaaaatgcttttcactttctgtctaggttaaagctaaactgaatctatggctttaaataaattaagatcctaaactctctagcttaagtgtaaatgaagtacagtagtttccctactgaaccctgcctcttgtgtccctggaaccttctagaacacctgccttctaccctctggttgggagatgcagccaccacatcccttcatatcatactgttttgaataaattttcaaatccttattgttcagagttgtttgggggttctgtttcagagcataaaacctaaaggttatagtagaacaaggcaccttcttaaaagaaatcttgcttcagaccatcagttacagagaatttctaaagtaaaattgaagcaactacaacttctccttagacactttggaatctaaccacttaaggacctttttaaagagatagcttctcttctttctgaagatcaatttctcccaaggccaagattgtccttttctcccatttcttgctagctattgcaaatgagggaagaacattattcatctctcctccccttttttttctgattcttttttcagtcagttttgctcctgggttcaagtagtattaccaccctttcacaagcaacagactctcacagggcaaaaaaaaaaaaaaatctaatgattcacagacagatctggagcctctcttcattctcagtaattgctagtcccaagaactagaattgcaaatgggcacaacctatatccttcctgtggaagaggaggccactctcttgagctgaagttccagaagagcagttaatgttcaagagaaattgaactcaactcagcaacaaaggactctattttgaagagcaacatatcacaaagctaaatgtgattgtgccaaacacattaggtgcttatttggggtcatgctaggcctttatcaagtaactggaaaacttttcttgcagccacaatctcaatgtcgttagtaggaagataagaggggagaaaaagctgtagaacaaatgtttggggttaccattgaaaatctaatgtctgcaatatttttctcctcacaacttggaaacgttcccagttcattttcagtcctgttgtgagcacagttctgaagggtttattattgtcaaaataagttttgttttgttttgtttatgttgggtttttaatgttgtctcttgacccttaatgctcaggttcttgtgggagttaatcagccacatccaacgttaccttgagggggaagaagagggtgatgctcagaagctaaacaagacaggggccacatgaccctctattgattagccccaagtagaaagtcctgtggttttatgtttaatggtaatagttgatcatatatggcataattttctatcagcttcctactcagtcactataaacacagacttgaaatagtactttaaatgtccaaatacctaaatgtgctaaactggaggtaactatttctaggtagttgaatttttgaaagtcatgatcagccacacaactgttttgtacatacttattttctcatgcacttttctgtatgcaaataaagctataaatttactcatttcaataaactggagtggcagaa

SEQ ID NO: 427026 - DNA, 1930 bp, Homo sapiens
gtgctcgcttcggcagcacatatactaaaattggaacgatacagagaagattagcatggcccctgcgcaaggatgacacgcaaattcgtgaagcgttccatatttttcctctgtggcttcttctcaacctgtatcttctgagatgtatagggatccatttggaaatccttttgcctaaattctgaacttggtctgcagaccatccagaggaataaaaaggttggccttagtagtcaaaaacaaagctgatagccagacacgttctgatttctgcccttgttccagctttgacgtattatctgttgccttatttctcattgcctcttctacttgtaaaatgcttttcactttctgtctaggttaaagctaaactgaatctatggctttaaataaattaagatcctaaactctctagcttaagtgtaaatgaagtacagtagtttccctactgaaccctgcctcttgtgtccctggaaccttctagaacacctgccttctaccctctggttgggagatgcagccaccacatcccttcatatcatactgttttgaataaattttcaaatccttattgttcagagttgtttgggggttctgtttcagagcataaaacctaaaggttatagtagaacaaggcaccttcttaaaagaaatcttgcttcagaccatcagttacagagaatttctaaagtaaaattgaagcaactacaacttctccttagacactttggaatctaaccacttaaggacctttttaaagagatagcttctcttctttctgaagatcaatttctcccaaggccaagattgtccttttctcccatttcttgctagctattgcaaatgagggaagaacattattcatctctcctccccttttttttctgattcttttttcagtcagttttgctcctgggttcaagtagtattaccaccctttcacaagcaacagactctcacagggcaaaaaaaaaaaaaaatctaatgattcacagacagatctggagcctctcttcattctcagtaattgctagtcccaagaactagaattgcaaatgggcacaacctatatccttcctgtggaagaggaggccactctcttgagctgaagttccagaagagcagttaatgttcaagagaaattgaactcaactcagcaacaaaggactctattttgaagagcaacatatcacaaagctaaatgtgattgtgccaaacacattaggtgcttatttggggtcatgctaggcctttatcaagtaactggaaaacttttcttgcagccacaatctcaatgtcgttagtaggaagataagaggggagaaaaagctgtagaacaaatgtttggggttaccattgaaaatctaatgtctgcaatatttttctcctcacaacttggaaacgttcccagttcattttcagtcctgttgtgagcacagttctgaagggtttattattgtcaaaataagttttgttttgttttgtttatgttgggtttttaatgttgtctcttgacccttaatgctcaggttcttgtgggagttaatcagccacatccaacgttaccttgagggggaagaagagggtgatgctcagaagctaaacaagacaggggccacatgaccctctattgattagccccaagtagaaagtcctgtggttttatgtttaatggtaatagttgatcatatatggcataattttctatcagcttcctactcagtcactataaacacagacttgaaatagtactttaaatgtccaaatacctaaatgtgctaaactggaggtaactatttctaggtagttgaatttttgaaagtcatgatcagccacacaactgttttgtacatacttattttctcatgcacttttctgtatgcaaataaagctataaatttactcatttcaataaactggagtggcagaa

SEQ ID NO: 427027 - DNA, 1940 bp, Homo sapiens
gtttgattggctgattggcctatgacctaagcgatttttaaaagaattttggaagtcttcattgcgatttttttcttatgactgtaactgtatttattgactagatgattttatcttcttaggtggcttcttctcaacctgtatcttctgagatgtatagggatccatttggaaatccttttgcctaaattctgaacttggtctgcagaccatccagaggaataaaaaggttggccttagtagtcaaaaacaaagctgatagccagacacgttctgatttctgcccttgttccagctttgacgtattatctgttgccttatttctcattgcctcttctacttgtaaaatgcttttcactttctgtctaggttaaagctaaactgaatctatggctttaaataaattaagatcctaaactctctagcttaagtgtaaatgaagtacagtagtttccctactgaaccctgcctcttgtgtccctggaaccttctagaacacctgccttctaccctctggttgggagatgcagccaccacatcccttcatatcatactgttttgaataaattttcaaatccttattgttcagagttgtttgggggttctgtttcagagcataaaacctaaaggttatagtagaacaaggcaccttcttaaaagaaatcttgcttcagaccatcagttacagagaatttctaaagtaaaattgaagcaactacaacttctccttagacactttggaatctaaccacttaaggacctttttaaagagatagcttctcttctttctgaagatcaatttctcccaaggccaagattgtccttttctcccatttcttgctagctattgcaaatgagggaagaacattattcatctctcctccccttttttttctgattcttttttcagtcagttttgctcctgggttcaagtagtattaccaccctttcacaagcaacagactctcacagggcaaaaaaaaaaaaaaatctaatgattcacagacagatctggagcctctcttcattctcagtaattgctagtcccaagaactagaattgcaaatgggcacaacctatatccttcctgtggaagaggaggccactctcttgagctgaagttccagaagagcagttaatgttcaagagaaattgaactcaactcagcaacaaaggactctattttgaagagcaacatatcacaaagctaaatgtgattgtgccaaacacattaggtgcttatttggggtcatgctaggcctttatcaagtaactggaaaacttttcttgcagccacaatctcaatgtcgttagtaggaagataagaggggagaaaaagctgtagaacaaatgtttggggttaccattgaaaatctaatgtctgcaatatttttctcctcacaacttggaaacgttcccagttcattttcagtcctgttgtgagcacagttctgaagggtttattattgtcaaaataagttttgttttgttttgtttatgttgggtttttaatgttgtctcttgacccttaatgctcaggttcttgtgggagttaatcagccacatccaacgttaccttgagggggaagaagagggtgatgctcagaagctaaacaagacaggggccacatgaccctctattgattagccccaagtagaaagtcctgtggttttatgtttaatggtaatagttgatcatatatggcataattttctatcagcttcctactcagtcactataaacacagacttgaaatagtactttaaatgtccaaatacctaaatgtgctaaactggaggtaactatttctaggtagttgaatttttgaaagtcatgatcagccacacaactgttttgtacatacttattttctcatgcacttttctgtatgcaaataaagctataaatttactcatttcaataaactggagtggcagaa

SEQ ID NO: 427028 - DNA, 3076 bp, Homo sapiens
ttatttgcacccgccccccgcccgcgtcggtctggggcttttgacttctccccgaacacatttcccctcccgtcgctgggtccctgcgatcgcccccagctggtggggctcgcggagctcaggggagcggggtcctctgcgccgctgcagcgcgagttaataaacagttaagtttggaagactctgcagacacgttgagggggagttaccaagcccaggcagcaaaaacatcctggcacattcctggggagtcctcagctgccagcatctgattagaaccatatctctcgccgggagtggccgcgcggctccgaagctcccggccggcggctatttaagcgaggcccgccgcatccgctgcgctgtagcctggaggctccgggcgcggggaagtcatgctcgcttcacggaggcaatagctagccggtgtctgtgggaggttatgtttatttgagacttctccatcgggatcgcctggtgtcaccaagtgtccactggtactgaggtttgctgcctgccttcttgccatgtctaacgaagtagaaacaagtgcaaccaatggtcagcccgaccaacaggccgcaccaaaagcaccctcaaagaaggaaaaaaagaaaggccctgaaaagacagatgaatatctcttagcaaggttcaaaggcgatggtgtaaaatataaggccaagctgattggcattgatgatgtgccagatgcaagaggggataaaatgagccaagactctatgatgaaactaaagggaatggcggcagctggtcggtctcagggacaacacaaacaaaggatctgggtcaacatttccctttctgggataaaaataattgatgagaaaactggggtaatagagcatgaacatccagtaaataagatttctttcattgcccgtgatgtgacagacaaccgggcatttggttacgtgtgtggaggagaaggccagcatcagttttttgccataaaaaccgggcaacaggctgaaccattagttgttgatcttaaagacctttttcaagttatctataatgtaaagaaaaaggaagaagaaaagaaaaagatagaggaagccagcaaagcagttgagaatgggagtgaggccctaatgattctagatgaccaaactaacaaactgaaatcgggtgttgaccagatggatttgtttggggacatgtctacacctcctgacctaaatagtccaacagaaagcaaagatatcctgttagtggatctaaactctgaaatcgacaccaatcagaattctttaagagaaaatccattcttaacaaacggcatcacctcctgttctcttcctcgaccaacgcctcaggcatccttcttgcctgaaaatgccttttctgccaatctcaacttctttcccacccctaatcctgatcctttccgtgacgatcctttcacacagccagaccaatcgacaccttcttcgtttgattctctcaaatctccagatcagaagaaagagaattcgagtagctcgtctactccgctgagtaatgggcccctgaatggtgatgttgactactttggtcagcaatttgaccagatctctaaccggactggcaaacaggaagctcaggcaggcccatggcccttttcaagttcgcaaacccagccagcagtgagaactcaaaatggggtatctgaaagagaacagaacggcttctctgtcaaatcctccccgaacccttttgtgggaagccctcccaaaggactgtccatacagaatggcgtaaagcaggacttggaaagctctgtccagtcctcaccacatgactccatagccattatcccacctccacaaagtaccaaaccaggaagaggcagaaggactgctaagtcttcagccaatgacttgcttgcatcagacatctttgctcctcccgtctcagaaccttcaggccaggcgtcacccacaggacaacctacagccctgcagcccaaccctctggatctcttcaaaacaagtgctcctgccccagtggggcccctggtgggtctaggtggtgtaactgtcacactccctcaggcaggaccatggaacacagcatctttggtcttcaatcagtccccttcaatggctccgggagccatgatgggtggtcaaccttcaggttttagtcagcccgtcatttttggtacaagtccagctgtttcaggttggaaccagccttcaccctttgcagcctcaactccccctccagtgcctgttgtctggggcccttctgcatctgtggcacccaatgcttggtcaacaacaagccctttggggaatccttttcagagcaatatttttccagctcctgctgtgtccactcagcccccatccatgcactcctctctcctggtcactcctcctcagccacctcccagagctggccctcccaaggacatctccagtgatgccttcactgccttagacccacttggggataaagagatcaaggatgtgaaagaaatgtttaaggatttccaactgcggcagccacctgctgtgcccgcgcggaagggagagcagacttcttctgggactttgagtgcctttgccagttatttcaacagcaaggttggcattcctcaggagaatgcagaccatgatgactttgatgctaatcaactattgaacaagatcaatgaaccaccaaagccagctcccagacaagtttccctgccagttaccaaatctactgacaatgcatttgagaaccctttctttaaagattcttttggttcatcacaagcctctgtggcttcttctcaacctgtatcttctgagatgtatagggatccatttggaaatccttttgcctaaattctgaacttggtctgcagaccatccagaggaataaaaaggttggccttagtagtcaaaaacaaagctgatagccagacacgttctgatttctgcccttgttccagctttgacgtattatctgttgccttatttctcattgcctcttctacttgtaaaatgcttttcactttctgtctaggttaaagctaaactgaatctatggctttaaataaattaagatcctaaactctcta

SEQ ID NO: 427029 - DNA, 2006 bp, Homo sapiens
aggaaggatagtttaggtcaacctgctacatcaatagattgggtaaggggaactctcatgggataaaataactaacattgttgagcacttgcgctaagcattttattagatgctctacatttatcatcttcatcaatcctcacatcagccctaggagatactattactgacatctttaataatgacttgatatttaatacattgatattcagttcaaaaattctaaccacaagtttctttcttctccatacctctctaggaacttggtctgcagaccatccagaggaataaaaaggttggccttagtagtcaaaaacaaagctgatagccagacacgttctgatttctgcccttgttccagctttgacgtattatctgttgccttatttctcattgcctcttctacttgtaaaatgcttttcactttctgtctaggttaaagctaaactgaatctatggctttaaataaattaagatcctaaactctctagcttaagtgtaaatgaagtacagtagtttccctactgaaccctgcctcttgtgtccctggaaccttctagaacacctgccttctaccctctggttgggagatgcagccaccacatcccttcatatcatactgttttgaataaattttcaaatccttattgttcagagttgtttgggggttctgtttcagagcataaaacctaaaggttatagtagaacaaggcaccttcttaaaagaaatcttgcttcagaccatcagttacagagaatttctaaagtaaaattgaagcaactacaacttctccttagacactttggaatctaaccacttaaggacctttttaaagagatagcttctcttctttctgaagatcaatttctcccaaggccaagattgtccttttctcccatttcttgctagctattgcaaatgagggaagaacattattcatctctcctccccttttttttctgattcttttttcagtcagttttgctcctgggttcaagtagtattaccaccctttcacaagcaacagactctcacagggcaaaaaaaaaaaaaaatctaatgattcacagacagatctggagcctctcttcattctcagtaattgctagtcccaagaactagaattgcaaatgggcacaacctatatccttcctgtggaagaggaggccactctcttgagctgaagttccagaagagcagttaatgttcaagagaaattgaactcaactcagcaacaaaggactctattttgaagagcaacatatcacaaagctaaatgtgattgtgccaaacacattaggtgcttatttggggtcatgctaggcctttatcaagtaactggaaaacttttcttgcagccacaatctcaatgtcgttagtaggaagataagaggggagaaaaagctgtagaacaaatgtttggggttaccattgaaaatctaatgtctgcaatatttttctcctcacaacttggaaacgttcccagttcattttcagtcctgttgtgagcacagttctgaagggtttattattgtcaaaataagttttgttttgttttgtttatgttgggtttttaatgttgtctcttgacccttaatgctcaggttcttgtgggagttaatcagccacatccaacgttaccttgagggggaagaagagggtgatgctcagaagctaaacaagacaggggccacatgaccctctattgattagccccaagtagaaagtcctgtggttttatgtttaatggtaatagttgatcatatatggcataattttctatcagcttcctactcagtcactataaacacagacttgaaatagtactttaaatgtccaaatacctaaatgtgctaaactggaggtaactatttctaggtagttgaatttttgaaagtcatgatcagccacacaactgttttgtacatacttattttctcatgcacttttctgtatgcaaataaagctataaatttactcatttcaataaactggagtggcagaa

SEQ ID NO: 427030 - DNA, 1720 bp, Homo sapiens
acttgtaaaatgcttgtcactttcagtttagctttaacctagacagaaagtgaaaagcattttacaagtagaagaggcaatgagaaataaggcaacagataatacgtcaaagctggaacaagggcagaaatcagaacgtttctgtctaggttaaagctaaactgaatctatggctttaaataaattaagatcctaaactctctagcttaagtgtaaatgaagtacagtagtttccctactgaaccctgcctcttgtgtccctggaaccttctagaacacctgccttctaccctctggttgggagatgcagccaccacatcccttcatatcatactgttttgaataaattttcaaatccttattgttcagagttgtttgggggttctgtttcagagcataaaacctaaaggttatagtagaacaaggcaccttcttaaaagaaatcttgcttcagaccatcagttacagagaatttctaaagtaaaattgaagcaactacaacttctccttagacactttggaatctaaccacttaaggacctttttaaagagatagcttctcttctttctgaagatcaatttctcccaaggccaagattgtccttttctcccatttcttgctagctattgcaaatgagggaagaacattattcatctctcctccccttttttttctgattcttttttcagtcagttttgctcctgggttcaagtagtattaccaccctttcacaagcaacagactctcacagggcaaaaaaaaaaaaaaatctaatgattcacagacagatctggagcctctcttcattctcagtaattgctagtcccaagaactagaattgcaaatgggcacaacctatatccttcctgtggaagaggaggccactctcttgagctgaagttccagaagagcagttaatgttcaagagaaattgaactcaactcagcaacaaaggactctattttgaagagcaacatatcacaaagctaaatgtgattgtgccaaacacattaggtgcttatttggggtcatgctaggcctttatcaagtaactggaaaacttttcttgcagccacaatctcaatgtcgttagtaggaagataagaggggagaaaaagctgtagaacaaatgtttggggttaccattgaaaatctaatgtctgcaatatttttctcctcacaacttggaaacgttcccagttcattttcagtcctgttgtgagcacagttctgaagggtttattattgtcaaaataagttttgttttgttttgtttatgttgggtttttaatgttgtctcttgacccttaatgctcaggttcttgtgggagttaatcagccacatccaacgttaccttgagggggaagaagagggtgatgctcagaagctaaacaagacaggggccacatgaccctctattgattagccccaagtagaaagtcctgtggttttatgtttaatggtaatagttgatcatatatggcataattttctatcagcttcctactcagtcactataaacacagacttgaaatagtactttaaatgtccaaatacctaaatgtgctaaactggaggtaactatttctaggtagttgaatttttgaaagtcatgatcagccacacaactgttttgtacatacttattttctcatgcacttttctgtatgcaaataaagctataaatttactcatttcaataaactggagtggcagaa

SEQ ID NO: 427031 - DNA, 3114 bp, Homo sapiens
ttatttgcacccgccccccgcccgcgtcggtctggggcttttgacttctccccgaacacatttcccctcccgtcgctgggtccctgcgatcgcccccagctggtggggctcgcggagctcaggggagcggggtcctctgcgccgctgcagcgcgagttaataaacagttaagtttggaagactctgcagacacgttgagggggagttaccaagcccaggcagcaaaaacatcctggcacattcctggggagtcctcagctgccagcatctgattagaaccatatctctcgccgggagtggccgcgcggctccgaagctcccggccggcggctatttaagcgaggcccgccgcatccgctgcgctgtagcctggaggctccgggcgcggggaagtcatgctcgcttcacggaggcaatagctagccggtgtctgtgggaggttatgtttatttgagacttctccatcgggatcgcctggtgtcaccaagtgtccactggtactgaggtttgctgcctgccttcttgccatgtctaacgaagtagaaacaagtgcaaccaatggtcagcccgaccaacaggccgcaccaaaagcaccctcaaagaaggaaaaaaagaaaggccctgaaaagacagatgaatatctcttagcaaggttcaaaggcgatggtgtaaaatataaggccaagctgattggcattgatgatgtgccagatgcaagaggggataaaatgagccaagactctatgatgaaactaaagggaatggcggcagctggtcggtctcagggacaacacaaacaaaggatctgggtcaacatttccctttctgggataaaaataattgatgagaaaactggggtaatagagcatgaacatccagtaaataagatttctttcattgcccgtgatgtgacagacaaccgggcatttggttacgtgtgtggaggagaaggccagcatcagttttttgccataaaaaccgggcaacaggctgaaccattagttgttgatcttaaagacctttttcaagttatctataatgtaaagaaaaaggaagaagaaaagaaaaagatagaggaagccagcaaagcagttgagaatgggagtgaggccctaatgattctagatgaccaaactaacaaactgaaatcgggtgttgaccagatggatttgtttggggacatgtctacacctcctgacctaaatagtccaacagaaagcaaagatatcctgttagtggatctaaactctgaaatcgacaccaatcagaattctttaagagaaaatccattcttaacaaacggcatcacctcctgttctcttcctcgaccaacgcctcaggcatccttcttgcctgaaaatgccttttctgccaatctcaacttctttcccacccctaatcctgatcctttccgtgacgatcctttcacacagccagaccaatcgacaccttcttcgtttgattctctcaaatctccagatcagaagaaagagaattcgagtagctcgtctactccgctgagtaatgggcccctgaatggtgatgttgactactttggtcagcaatttgaccagatctctaaccggactggcaaacaggaagctcaggcaggcccatggcccttttcaagttcgcaaacccagccagcagtgagaactcaaaatggggtatctgaaagagaacagaacggcttctctgtcaaatcctccccgaacccttttgtgggaagccctcccaaaggactgtccatacagaatggcgtaaagcaggacttggaaagctctgtccagtcctcaccacatgactccatagccattatcccacctccacaaagtaccaaaccaggaagaggcagaaggactgctaagtcttcagccaatgacttgcttgcatcagacatctttgctcctcccgtctcagaaccttcaggccaggcgtcacccacaggacaacctacagccctgcagcccaaccctctggatctcttcaaaacaagtgctcctgccccagtggggcccctggtgggtctaggtggtgtaactgtcacactccctcaggcaggaccatggaacacagcatctttggtcttcaatcagtccccttcaatggctccgggagccatgatgggtggtcaaccttcaggttttagtcagcccgtcatttttggtacaagtccagctgtttcaggttggaaccagccttcaccctttgcagcctcaactccccctccagtgcctgttgtctggggcccttctgcatctgtggcacccaatgcttggtcaacaacaagccctttggggaatccttttcagagcaatatttttccagctcctgctgtgtccactcagcccccatccatgcactcctctctcctggtcactcctcctcagccacctcccagagctggccctcccaaggacatctccagtgatgccttcactgccttagacccacttggggataaagagatcaaggatgtgaaagaaatgtttaaggatttccaactgcggcagccacctgctgtgcccgcgcggaagggagagcagacttcttctgggactttgagtgcctttgccagttatttcaacagcaaggttggcattcctcaggagaatgcagaccatgatgactttgatgctaatcaactattgaacaagatcaatgaaccaccaaagccagctcccagacaagtttccctgccagttaccaaatctactgacaatgcatttgagaaccctttctttaaagattcttttggttcatcacaagcctctgtggcttcttctcaacctgtatcttctgagatgtatagggatccatttggaaatccttttgcctaaattctgtaagtagaagatcctaataagcctgtctcaggggtttttgtgagaaagggtgacatggaataaagagtgaaattttaattttagaattgggaagagggtaaatatctataatttaggagtaatcgacaggaaaatctctactgagatcattcaataatgactaggctgggcacttaagaatagaattcctaaacacatcaaaaaatagtaatatacccttggggatgtggatttttatcttattccatgttcttggtttttcagttct

SEQ ID NO: 427032 - DNA, 2979 bp, Homo sapiens
  misc_feature (1)..(1): n is a, c, g, or t
  misc_feature (1874)..(1874): n is a, c, g, or t
ngagatggtgccactgcactccagcctgggcgacagaacgagactctgtctcaaacaaacaaacttaaaactgtactcaggactatgtttaatattatatataaatatggtctatctgaaaatttggcttctatatgtattgtctattcttcccaatagggcaatggatacatttttatggttaggcacttctaatctgcactccctggcttttattttttttctctctatgagattcatattaattctaggaaatatacaggacaaccaagtttaaatccagtaactctactcaaaccttatattgatatgaaaaggggaggggaacggagggcagaaataatatacaagacttattcttgccttatgcctgtgaaccataggcatacttgtttgtgtatttaactccctttcactatgaatatgaagatcactgaatatgtatctttctttttagatagaggaagccagcaaagcagttgaggtaaaattgcatctttacttcttgttaatcatgtgtgtgacatgcgtaagcccctgttttctacctgcccaaccactctcgccacctcgcttattactatgtgtttatgacttctctgatcatgaaagatgtttagttaaaagatgataccaaaaccattgctgcttagcagactaatagagtggacaaatacattttatagacaaagctcaactaaatccttaaatatttgctatcttttcagaatgggagtgaggccctaatgattctagatgaccaaactaacaaactgaaatcgggtgttgaccagatggatttgtttggggacatgtctacacctcctgacctaaatagtccaacagtaagtgtttgtttttaaatttgcaatgtaataaaatgacatctataactcaaattggcaataaccagaaatcttaagcatctcattgaaacttggaaggtgactgttgatttttgcaaatgaagtgtcaatggtttttagaataaatgtgaatcttaagtcaccatgggaacctatccacactaattcagttatattaatattgcttacagattaaacctgaacaataagtcagcaatgtagtccttcttggtatcacttaggattagaaggaggaggtgaataatagtccttgaataagcctacttgaagaaagtatgactgttagatggttaatcataaagcctcctggcctcttcatttcttttgcattctgtctgttgcaatttagcagcataaatttggtgtgaagtaagatttaaaacaaacaagtggctcagttatattccaccaaagcttgtccttgttagaaagctgcccattctcataggattttataccatatccagtctgctcaatattgaatgatctgtaacaaccctgtaagaacagaacagtattttcctttataaattaaaaaaaaatggtggttcagggaaaaaaaaagaagaaaaaaaaataaaaaggaaagaggtccagattcaagacttaggcccaagtcttcagaccttccaaaacatacctctaatgaaaatgtccatgacattttgaatgacttcttgcaacttcttttatttatgtaacagtttcctgagcacctgctatttgcaaggcatagcagtaagatgcacaacatcaatgacatcatggaatttactctccggcagggagaccaacattaaaactaatcacatcgttagtaattgatgttactacagggtatttatctagttcagattcaggtaatgcttctgcaggagtgagtttctagatttgaacataaaagatgagaaggcaataaacagacaaaaagagaattagtctagaataatggggggaaatgtctagaaaggactctcttgtatcagnaaattatcatggaagcctatgtgaccaaggttacaggagttgaagcaatggatcaaagattggataaaattctcccttcagacttctgcagagaatttgaggcctgtgaatccttactgcataaaactttcaggtcaaatgagatggagaggagcagggacttcatgcattcttctctgaccctaaccatatgagtatcacaatgcatggtagcattctaaaatgcctttaagagagaagcctgtttaatattcattttagcagtgagccctaactcacttgcctatagaacctttcattcttcataatttttgttatagttctgaggataaactttttaaagtactagactagattatcctgacaggtccatcctaactctgaggtccttttgatttgtagtcaactttgtgctctcctccattagtgatgttttctcaaataaatcagtatctgaacacttacttcccaagtataaatgacattcaaacaagtaatattcaaagagagcaaagcactcaagatatgaagtggaattccactggaataggcaaggaagtactgcctatataatctacttctgtagacttctagaatgttctaaaaaaggaaatggaaaacaacatggataatcttcagtctcatttttattagactttatgaagtctaagaattttttatttataggaattcaagttttagttaaactaacaataaagtaataaataccatcaaaatatatactctctgataaccaaaagaaggctaacagatctaattatgtgctggttaggctttgacatgttcttatctattgactctatagtcataggtcaaaaatagatttatctctacttggtaaagccagcatgtttaaaaatattcaactctttcaacaattgctctgaaatatgtaaagagagaaagaaatctaaattacctagactttattattggtcctagatggttgtcactcccctcaaatttatacagaaaagttttatgagtttcaaataatgctcatgttgcaaactatgtggtatcccctagaacagaatttttattggcaagccccttgagcattatccttccacactgcatctca

SEQ ID NO: 427033 - DNA, 1371 bp, Homo sapiens
ttatttgcacccgccccccgcccgcgtcggtctggggcttttgacttctccccgaacacatttcccctcccgtcgctgggtccctgcgatcgcccccagctggtggggctcgcggagctcaggggagcggggtcctctgcgccgctgcagcgcgagttaataaacagttaagtttggaagactctgcagacacgttgagggggagttaccaagcccaggcagcaaaaacatcctggcacattcctggggagtcctcagctgccagcatctgattagaaccatatctctcgccgggagtggccgcgcggctccgaagctcccggccggcggctatttaagcgaggcccgccgcatccgctgcgctgtagcctggaggctccgggcgcggggaagtcatgctcgcttcacggaggcaatagctagccggtgtctgtgggaggttatgtttatttgagacttctccatcgggatcgcctggtgtcaccaagtgtccactggtactgaggtttgctgcctgccttcttgccatgtctaacgaagtagaaacaagtgcaaccaatggtcagcccgaccaacaggccgcaccaaaagcaccctcaaagaaggaaaaaaagaaaggccctgaaaagacagatgaatatctcttagcaaggttcaaaggcgatggtgtaaaatataaggccaagctgattggcattgatgatgtgccagatgcaagaggggataaaatgagccaagactctatgatgaaactaaagggaatggcggcagctggtcggtctcagggacaacacaaacaaaggatctgggtcaacatttccctttctgggataaaaataattgatgagaaaactggggtaatagagcatgaacatccagtaaataagatttctttcattgcccgtgatgtgacagacaaccgggcatttggttacgtgtgtggaggagaaggccagcatcagttttttgccataaaaaccgggcaacaggctgaaccattagttgttgatcttaaagacctttttcaagttatctataatgtaaagaaaaaggaagaagaaaagaaaaagatagaggaagccagcaaagcagttgagaatgggagtgaggccctaatgattctagatgaccaaactaacaaactgaaatcgggtgttgaccagatggatttgtttggggacatgtctacacctcctgacctaaatagtccaacaggtgactattcagaagtctaacattgtggctcctgtttggtgtcctaagaacttcttctgaagtatttgaaaacgagaactctaccagctgtgaacactcaactgttctaacccagaggtggctcaaaacaaataaataaatattgaaatcacaagc

SEQ ID NO: 427034 - DNA, 527 bp, Homo sapiens
aggcttccgttgcccaacacccaggcttcaggcattacttcaaggcaaccagggcagtgcctgccaggatgctgctggtgcccaggccagagccgtggggcagctcagaccaggtgtgcagctcaggttcttgtgggagttaatcagccacatccaacgttaccttgagggggaagaagagggtgatgctcagaagctaaacaagacaggggccacatgaccctctattgattagccccaagtagaaagtcctgtggttttatgtttaatggtaatagttgatcatatatggcataattttctatcagcttcctactcagtcactataaacacagacttgaaatagtactttaaatgtccaaatacctaaatgtgctaaactggaggtaactatttctaggtagttgaatttttgaaagtcatgatcagccacacaactgttttgtacatacttattttctcatgcacttttctgtatgcaaataaagctataaatttactcatttcaataaactggagtggcagaa

SEQ ID NO: 427035 - DNA, 1025 bp, Homo sapiens
  misc_feature (20)..(20): n is a, c, g, or t
  misc_feature (1001)..(1002): n is a, c, g, or t
tgaatgagctggtacctctngatgcaagtgtccatggtggtggtataaaattctcgagcttatctcctcttttaaatactgagtaaatacataagctttttctaagcttatgtatttactattaccactatgatctcagctttatttaagagcaatttaaaatgcagttcccataggtgtctttttttacctctcctaagaatatacaggcttgcctggattaagaccctatgatctctatgtagactgacttaaaatccaatggaatgaacaaaaatatttaggatgcttattggtagttgccccttttacacacttgctcccccaacttcaagcatttagcgatgagaccagaccaatgtgagtgtgtaaaggaatatagtagatttcactttgcaagtcctaggtagtgtcagacactaagactcagtagtccgtccgttgtaggaatctgtgtctttttttggaggactctttttctgtagtagtagttgttgttgttcatctgtcaagaaaaaagttttcctttttgtggctctcaaattggggtatagggtaggagacaaaatgaggctgtatttcactgttagtgagtaactaaggcttctccctccctccctgtcctgtcagtcttcagccaatgacttgcttgcatcagacatctttgctcctcccgtctcagaaccttcaggccaggcgtcacccacaggacaacctacagccctgcagcccaaccctctggatctcttcaaaacaagtgctcctgccccagtggggcccctggtgggtctaggtggtgtaactgtcacactccctcaggcaggaccatggaacacagcatctttggtcttcaatcagtccccttcaatggctccgggagccatgatgggtggtcaaccttcaggttttagtcagcccgtcatttttggtacaagtccagctgtttcaggttggaaccagccttcaccctttgcagcctcaactccccttttccagagctnnggatcctagatcgaccagcaaca

SEQ ID NO: 427036 - DNA, 912 bp, Homo sapiens
  misc_feature (20)..(20): n is a, c, g, or t
tgaatgagctggtacctctngatgcaagtgtccatggtggtggtataaaattctcgagcttatctcctcttttaaatactgagtaaatacataagctttttctaagcttatgtatttactattaccactatgatctcagctttatttaagagcaatttaaaatgcagttcccataggtgtctttttttacctctcctaagaatatacaggcttgcctggattaagaccctatgatctctatgtagactgacttaaaatccaatggaatgaacaaaaatatttaggatgcttattggtagttgccccttttacacacttgctcccccaacttcaagcatttagcgatgagaccagaccaatgtgagtgtgtaaaggaatatagtagatttcactttgcaagtcctaggtagtgtcagacactaagactcagtagtccgtccgttgtaggaatctgtgtctttttttggaggactctttttctgtagtagtagttgttgttgttcatctgtcaagaaaaaagttttcctttttgtggctctcaaattggggtatagggtaggagacaaaatgaggctgtatttcactgttagtgagtaactaaggcttctccctccctccctgtcctgtcagtcttcagccaatgacttgcttgcatcagacatctttgctcctcccgtctcagaaccttcaggccaggcgtcacccacaggacaacctacagccctgcagcccaaccctctggatctcttcaaaacaagtgctcctgccccagtggggcccctggtgggtctaggtaggtgcctagagataaaattaagtatgactcttttgcttttgctcataaaatgatgatgcatcggaagagatttcatactcccagagggttttacagcataagatttgagcatccca

SEQ ID NO: 427037 - DNA, 759 bp, Homo sapiens
ttatttgcacccgccccccgcccgcgtcggtctggggcttttgacttctccccgaacacatttcccctcccgtcgctgggtccctgcgatcgcccccagctggtggggctcgcggagctcaggggagcggggtcctctgcgccgctgcagcgcgagttaataaacagttaagtttggaagactctgcagacacgttgagggggagttaccaagcccaggcagcaaaaacatcctggcacattcctggggagtcctcagctgccagcatctgattagaaccatatctctcgccgggagtggccgcgcggctccgaagctcccggccggcggctatttaagcgaggcccgccgcatccgctgcgctgtagcctggaggctccgggcgcggggaagtcatgctcgcttcacggaggcaatagctagccggtgagtagcttcgaaacccttcttccctctggctccattttttttttaaagatctccttctctcctttgctccccctctctcacccccccgccccccgctacccttctttgagtacagaccttgggctgtggggaatcttagaaatgagaccctgtgcttggggaaaccagcagttttgtggcctgacatctgaggaatgcttccgcggaatgtatttacctttcgaatccgactccagatgcccagcttgtgacatttaacaaacgcctccttttgtgtcgtgtgtgtgtgtgtgtgtgtgtgtgtgtgtgtgtgtgtgtgtgtgtgtgtgt

SEQ ID NO: 427038 - DNA, 189 bp, Homo sapiens
taactaagggatgccctggttcaacgtcttctatgccgtcttgctgtcccggatgaaaagtgccgaatcctctcatcgatggcagatcaagtcgaaaacaaagctgactgactttgaaaattttaatattaaaaccattgtaggatgtttttaaaaattcaacttctcttgtttttccaccctcatcag

SEQ ID NO: 427039 - DNA, 296 bp, Homo sapiens
catattcccatacgtttcccataacgctgtcaattttgtacttctaacagtttattttctccccacctcaactccatacacagttgattgtggaacatgattttgctcaaaggaagtaagaataagacaggacagaatattacatacatgatcagttgtagtataatcaggatttatattacttaaattttggagagtctagagcatatttggtcataattagaactagcattcttcatcctgtattcctttcttttctcaggccctgaaaagacagatgaatatctcttagcaag

SEQ ID NO: 427040 - DNA, 4354 bp, Homo sapiens
cgatctgactacgcggctcgatctgactacgcggctcgatctgactacgcggctcgatctggccgcgcggctccgaagctcccggccggcggctatttaagcgaggcccgccgcatccgctgcgctgtagcctggaggctccgggcgcggggaagtcatgctcgcttcacggaggcaatagctagccggtgtctgtgggaggttatgtttatttgagacttctccatcgggatcgcctggtgtcaccaagtgtccactggtactgaggtttgctgcctgccttcttgccatgtctaacgaagtagaaacaagtgcaaccaatggtcagcccgaccaacaggccgcaccaaaagcaccctcaaagaaggaaaaaaagaaaggccctgaaaagacagatgaatatctcttagcaaggttcaaaggcgatggtgtaaaatataaggccaagctgattggcattgatgatgtgccagatgcaagaggggataaaatgagccaagactctatgatgaaactaaagggaatggcggcagctggtcggtctcagggacaacacaaacaaaggatctgggtcaacatttccctttctgggataaaaataattgatgagaaaactggggtaatagagcatgaacatccagtaaataagatttctttcattgcccgtgatgtgacagacaaccgggcatttggttacgtgtgtggaggagaaggccagcatcagttttttgccataaaaaccgggcaacaggctgaaccattagttgttgatcttaaagacctttttcaagttatctataatgtaaagaaaaaggaagaagaaaagaaaaagatagaggaagccagcaaagcagttgagaatgggagtgaggccctaatgattctagatgaccaaactaacaaactgaaatcgggtgttgaccagatggatttgtttggggacatgtctacacctcctgacctaaatagtccaacagaaagcaaagatatcctgttagtggatctaaactctgaaatcgacaccaatcagaattctttaagagaaaatccattcttaacaaacggcatcacctcctgttctcttcctcgaccaacgcctcaggcatccttcttgcctgaaaatgccttttctgccaatctcaacttctttcccacccctaatcctgatcctttccgtgacgatcctttcacacagccagaccaatcgacaccttcttcgtttgattctctcaaatctccagatcagaagaaagagaattcgagtagctcgtctactccgctgagtaatgggcccctgaatggtgatgttgactactttggtcagcaatttgaccagatctctaaccggactggcaaacaggaagctcaggcaggcccatggcccttttcaagttcgcaaacccagccagcagtgagaactcaaaatggggtatctgaaagagaacagaacggcttctctgtcaaatcctccccgaacccttttgtgggaagccctcccaaaggactgtccatacagaatggcgtaaagcaggacttggaaagctctgtccagtcctcaccacatgactccatagccattatcccacctccacaaagtaccaaaccaggaagaggcagaaggactgctaagtcttcagccaatgacttgcttgcatcagacatctttgctcctcccgtctcagaaccttcaggccaggcgtcacccacaggacaacctacagccctgcagcccaaccctctggatctcttcaaaacaagtgctcctgccccagtggggcccctggtgggtctaggtggtgtaactgtcacactccctcaggcaggaccatggaacacagcatctttggtcttcaatcagtccccttcaatggctccgggagccatgatgggtggtcaaccttcaggttttagtcagcccgtcatttttggtacaagtccagctgtttcaggttggaaccagccttcaccctttgcagcctcaactccccctccagtgcctgttgtctggggcccttctgcatctgtggcacccaatgcttggtcaacaacaagccctttggggaatccttttcagagcaatatttttccagctcctgctgtgtccactcagcccccatccatgcactcctctctcctggtcactcctcctcagccacctcccagagctggccctcccaaggacatctccagtgatgccttcactgccttagacccacttggggataaagagatcaaggatgtgaaagaaatgtttaaggatttccaactgcggcagccacctgctgtgcccgcgcggaagggagagcagacttcttctgggactttgagtgcctttgccagttatttcaacagcaaggttggcattcctcaggagaatgcagaccatgatgactttgatgctaatcaactattgaacaagatcaatgaaccaccaaagccagctcccagacaagtttccctgccagttaccaaatctactgacaatgcatttgagaaccctttctttaaagattcttttggttcatcacaagcctctgtggcttcttctcaacctgtatcttctgagatgtatagggatccatttggaaatccttttgcctaaattctgaacttggtctgcagaccatccagaggaataaaaaggttggccttagtagtcaaaaacaaagctgatagccagacacgttctgatttctgcccttgttccagctttgacgtattatctgttgccttatttctcattgcctcttctacttgtaaaatgcttttcactttctgtctaggttaaagctaaactgaatctatggctttaaataaattaagatcctaaactctctagcttaagtgtaaatgaagtacagtagtttccctactgaaccctgcctcttgtgtccctggaaccttctagaacacctgccttctaccctctggttgggagatgcagccaccacatcccttcatatcatactgttttgaataaattttcaaatccttattgttcagagttgtttgggggttctgtttcagagcataaaacctaaaggttatagtagaacaaggcaccttcttaaaagaaatcttgcttcagaccatcagttacagagaatttctaaagtaaaattgaagcaactacaacttctccttagacactttggaatctaaccacttaaggacctttttaaagagatagcttctcttctttctgaagatcaatttctcccaaggccaagattgtccttttctcccatttcttgctagctattgcaaatgagggaagaacattattcatctctcctccccttttttttctgattcttttttcagtcagttttgctcctgggttcaagtagtattaccaccctttcacaagcaacagactctcacagggcaaaaaaaaaaaaaaatctaatgattcacagacagatctggagcctctcttcattctcagtaattgctagtcccaagaactagaattgcaaatgggcacaacctatatccttcctgtggaagaggaggccactctcttgagctgaagttccagaagagcagttaatgttcaagagaaattgaactcaactcagcaacaaaggactctattttgaagagcaacatatcacaaagctaaatgtgattgtgccaaacacattaggtgcttatttggggtcatgctaggcctttatcaagtaactggaaaacttttcttgcagccacaatctcaatgtcgttagtaggaagataagaggggagaaaaagctgtagaacaaatgtttggggttaccattgaaaatctaatgtctgcaatatttttctcctcacaacttggaaacgttcccagttcattttcagtcctgttgtgagcacagttctgaagggtttattattgtcaaaataagttttgttttgttttgtttatgttgggtttttaatgttgtctcttgacccttaatgctcaggttcttgtgggagttaatcagccacatccaacgttaccttgagggggaagaagagggtgatgctcagaagctaaacaagacaggggccacatgaccctctattgattagccccaagtagaaagtcctgtggttttatgtttaatggtaatagttgatcatatatggcataattttctatcagcttcctactcagtcactataaacacagacttgaaatagtactttaaatgtccaaatacctaaatgtgctaaactggaggtaactatttctaggtagttgaatttttgaaagtcatgatcagccacacaactgttttgtacatacttattttctcatgcacttttctgtatgcaaataaagctataaatttactcatttcaataaactggagtggcagaa

SEQ ID NO: 427041 - DNA, 4824 bp, Homo sapiens
ttatttgcacccgccccccgcccgcgtcggtctggggcttttgacttctccccgaacacatttcccctcccgtcgctgggtccctgcgatcgcccccagctggtggggctcgcggagctcaggggagcggggtcctctgcgccgctgcagcgcgagttaataaacagttaagtttggaagactctgcagacacgttgagggggagttaccaagcccaggcagcaaaaacatcctggcacattcctggggagtcctcagctgccagcatctgattagaaccatatctctcgccgggagtggccgcgcggctccgaagctcccggccggcggctatttaagcgaggcccgccgcatccgctgcgctgtagcctggaggctccgggcgcggggaagtcatgctcgcttcacggaggcaatagctagccggtgtctgtgggaggttatgtttatttgagacttctccatcgggatcgcctggtgtcaccaagtgtccactggtactgaggtttgctgcctgccttcttgccatgtctaacgaagtagaaacaagtgcaaccaatggtcagcccgaccaacaggccgcaccaaaagcaccctcaaagaaggaaaaaaagaaaggccctgaaaagacagatgaatatctcttagcaaggttcaaaggcgatggtgtaaaatataaggccaagctgattggcattgatgatgtgccagatgcaagaggggataaaatgagccaagactctatgatgaaactaaagggaatggcggcagctggtcggtctcagggacaacacaaacaaaggatctgggtcaacatttccctttctgggataaaaataattgatgagaaaactggggtaatagagcatgaacatccagtaaataagatttctttcattgcccgtgatgtgacagacaaccgggcatttggttacgtgtgtggaggagaaggccagcatcagttttttgccataaaaaccgggcaacaggctgaaccattagttgttgatcttaaagacctttttcaagttatctataatgtaaagaaaaaggaagaagaaaagaaaaagatagaggaagccagcaaagcagttgagaatgggagtgaggccctaatgattctagatgaccaaactaacaaactgaaatcgggtgttgaccagatggatttgtttggggacatgtctacacctcctgacctaaatagtccaacagaaagcaaagatatcctgttagtggatctaaactctgaaatcgacaccaatcagaattctttaagagaaaatccattcttaacaaacggcatcacctcctgttctcttcctcgaccaacgcctcaggcatccttcttgcctgaaaatgccttttctgccaatctcaacttctttcccacccctaatcctgatcctttccgtgacgatcctttcacacagccagaccaatcgacaccttcttcgtttgattctctcaaatctccagatcagaagaaagagaattcgagtagctcgtctactccgctgagtaatgggcccctgaatggtgatgttgactactttggtcagcaatttgaccagatctctaaccggactggcaaacaggaagctcaggcaggcccatggcccttttcaagttcgcaaacccagccagcagtgagaactcaaaatggggtatctgaaagagaacagaacggcttctctgtcaaatcctccccgaacccttttgtgggaagccctcccaaaggactgtccatacagaatggcgtaaagcaggacttggaaagctctgtccagtcctcaccacatgactccatagccattatcccacctccacaaagtaccaaaccaggaagaggcagaaggactgctaagtcttcagccaatgacttgcttgcatcagacatctttgctcctcccgtctcagaaccttcaggccaggcgtcacccacaggacaacctacagccctgcagcccaaccctctggatctcttcaaaacaagtgctcctgccccagtggggcccctggtgggtctaggtggtgtaactgtcacactccctcaggcaggaccatggaacacagcatctttggtcttcaatcagtccccttcaatggctccgggagccatgatgggtggtcaaccttcaggttttagtcagcccgtcatttttggtacaagtccagctgtttcaggttggaaccagccttcaccctttgcagcctcaactccccctccagtgcctgttgtctggggcccttctgcatctgtggcacccaatgcttggtcaacaacaagccctttggggaatccttttcagagcaatatttttccagctcctgctgtgtccactcagcccccatccatgcactcctctctcctggtcactcctcctcagccacctcccagagctggccctcccaaggacatctccagtgatgccttcactgccttagacccacttggggataaagagatcaaggatgtgaaagaaatgtttaaggatttccaactgcggcagccacctgctgtgcccgcgcggaagggagagcagacttcttctgggactttgagtgcctttgccagttatttcaacagcaaggttggcattcctcaggagaatgcagaccatgatgactttgatgctaatcaactattgaacaagatcaatgaaccaccaaagccagctcccagacaagtttccctgccagttaccaaatctactgacaatgcatttgagaaccctttctttaaagattcttttggttcatcacaagcctctgtggcttcttctcaacctgtatcttctgagatgtatagggatccatttggaaatccttttgcctaaattctgaacttggtctgcagaccatccagaggaataaaaaggttggccttagtagtcaaaaacaaagctgatagccagacacgttctgatttctgcccttgttccagctttgacgtattatctgttgccttatttctcattgcctcttctacttgtaaaatgcttttcactttctgtctaggttaaagctaaactgaatctatggctttaaataaattaagatcctaaactctctagcttaagtgtaaatgaagtacagtagtttccctactgaaccctgcctcttgtgtccctggaaccttctagaacacctgccttctaccctctggttgggagatgcagccaccacatcccttcatatcatactgttttgaataaattttcaaatccttattgttcagagttgtttgggggttctgtttcagagcataaaacctaaaggttatagtagaacaaggcaccttcttaaaagaaatcttgcttcagaccatcagttacagagaatttctaaagtaaaattgaagcaactacaacttctccttagacactttggaatctaaccacttaaggacctttttaaagagatagcttctcttctttctgaagatcaatttctcccaaggccaagattgtccttttctcccatttcttgctagctattgcaaatgagggaagaacattattcatctctcctccccttttttttctgattcttttttcagtcagttttgctcctgggttcaagtagtattaccaccctttcacaagcaacagactctcacagggcaaaaaaaaaaaaaaatctaatgattcacagacagatctggagcctctcttcattctcagtaattgctagtcccaagaactagaattgcaaatgggcacaacctatatccttcctgtggaagaggaggccactctcttgagctgaagttccagaagagcagttaatgttcaagagaaattgaactcaactcagcaacaaaggactctattttgaagagcaacatatcacaaagctaaatgtgattgtgccaaacacattaggtgcttatttggggtcatgctaggcctttatcaagtaactggaaaacttttcttgcagccacaatctcaatgtcgttagtaggaagataagaggggagaaaaagctgtagaacaaatgtttggggttaccattgaaaatctaatgtctgcaatatttttctcctcacaacttggaaacgttcccagttcattttcagtcctgttgtgagcacagttctgaagggtttattattgtcaaaataagttttgttttgttttgtttatgttgggtttttaatgttgtctcttgacccttaatgctcaggttcttgtgggagttaatcagccacatccaacgttaccttgagggggaagaagagggtgatgctcagaagctaaacaagacaggggccacatgaccctctattgattagccccaagtagaaagtcctgtggttttatgtttaatggtaatagttgatcatatatggcataattttctatcagcttcctactcagtcactataaacacagacttgaaatagtactttaaatgtccaaatacctaaatgtgctaaactggaggtaactatttctaggtagttgaatttttgaaagtcatgatcagccacacaactgttttgtacatacttattttctcatgcacttttctgtatgcaaataaagctataaatttactcatttcaataaactggagtggcagaaaaatcacaaacatctataacaatgttataaacccaagtgctgtcttgatgactgcatgaatataactggaatggaaacattaaagctgtaaagtgtaaatggctttgggagatagaactctcataagcctttaccataccactttgagaggcggcaaggactataatgaagactaaaactgcctatctccttatcctacagatacagtcagcagactagtgctgtggatcag

SEQ ID NO: 427042 - DNA, 4658 bp, Homo sapiens
aatttatcaatgtgaataagatacaggtcataactctactctagtcactgcctttatagttaagcaattttccgaagaactgaaatttataatgcccaatctcaaatggcatttgcagtcttaccaggcttaacattcaatttatttctgttttgcaataatgcctagcaagttttcgatccctatctttaatacttgctttttatgtgaaagttctaataaaaactgcttagctagataatcattaaatgttaccagatatcaagtgcttaaagaaaaaactaataggcacacatgttccattttggaaactacaaaggaaacactcctacccactcccctgctttcagtcttcagtctaatacagcaggagaaggaacaaaatgagtccaaagaactacaaaagaaagtcactagttgtaagcctattctggcataaagtctgggtctgctgtgttctgatctcaatatgcctctaaactctgcctacaggtgtctgtgggaggttatgtttatttgagacttctccatcgggatcgcctggtgtcaccaagtgtccactggtactgaggtttgctgcctgccttcttgccatgtctaacgaagtagaaacaagtgcaaccaatggtcagcccgaccaacaggccgcaccaaaagcaccctcaaagaaggaaaaaaagaaaggccctgaaaagacagatgaatatctcttagcaaggttcaaaggcgatggtgtaaaatataaggccaagctgattggcattgatgatgtgccagatgcaagaggggataaaatgagccaagactctatgatgaaactaaagggaatggcggcagctggtcggtctcagggacaacacaaacaaaggatctgggtcaacatttccctttctgggataaaaataattgatgagaaaactggggtaatagagcatgaacatccagtaaataagatttctttcattgcccgtgatgtgacagacaaccgggcatttggttacgtgtgtggaggagaaggccagcatcagttttttgccataaaaaccgggcaacaggctgaaccattagttgttgatcttaaagacctttttcaagttatctataatgtaaagaaaaaggaagaagaaaagaaaaagatagaggaagccagcaaagcagttgagaatgggagtgaggccctaatgattctagatgaccaaactaacaaactgaaatcgggtgttgaccagatggatttgtttggggacatgtctacacctcctgacctaaatagtccaacagaaagcaaagatatcctgttagtggatctaaactctgaaatcgacaccaatcagaattctttaagagaaaatccattcttaacaaacggcatcacctcctgttctcttcctcgaccaacgcctcaggcatccttcttgcctgaaaatgccttttctgccaatctcaacttctttcccacccctaatcctgatcctttccgtgacgatcctttcacacagccagaccaatcgacaccttcttcgtttgattctctcaaatctccagatcagaagaaagagaattcgagtagctcgtctactccgctgagtaatgggcccctgaatggtgatgttgactactttggtcagcaatttgaccagatctctaaccggactggcaaacaggaagctcaggcaggcccatggcccttttcaagttcgcaaacccagccagcagtgagaactcaaaatggggtatctgaaagagaacagaacggcttctctgtcaaatcctccccgaacccttttgtgggaagccctcccaaaggactgtccatacagaatggcgtaaagcaggacttggaaagctctgtccagtcctcaccacatgactccatagccattatcccacctccacaaagtaccaaaccaggaagaggcagaaggactgctaagtcttcagccaatgacttgcttgcatcagacatctttgctcctcccgtctcagaaccttcaggccaggcgtcacccacaggacaacctacagccctgcagcccaaccctctggatctcttcaaaacaagtgctcctgccccagtggggcccctggtgggtctaggtggtgtaactgtcacactccctcaggcaggaccatggaacacagcatctttggtcttcaatcagtccccttcaatggctccgggagccatgatgggtggtcaaccttcaggttttagtcagcccgtcatttttggtacaagtccagctgtttcaggttggaaccagccttcaccctttgcagcctcaactccccctccagtgcctgttgtctggggcccttctgcatctgtggcacccaatgcttggtcaacaacaagccctttggggaatccttttcagagcaatatttttccagctcctgctgtgtccactcagcccccatccatgcactcctctctcctggtcactcctcctcagccacctcccagagctggccctcccaaggacatctccagtgatgccttcactgccttagacccacttggggataaagagatcaaggatgtgaaagaaatgtttaaggatttccaactgcggcagccacctgctgtgcccgcgcggaagggagagcagacttcttctgggactttgagtgcctttgccagttatttcaacagcaaggttggcattcctcaggagaatgcagaccatgatgactttgatgctaatcaactattgaacaagatcaatgaaccaccaaagccagctcccagacaagtttccctgccagttaccaaatctactgacaatgcatttgagaaccctttctttaaagattcttttggttcatcacaagcctctgtggcttcttctcaacctgtatcttctgagatgtatagggatccatttggaaatccttttgcctaaattctgaacttggtctgcagaccatccagaggaataaaaaggttggccttagtagtcaaaaacaaagctgatagccagacacgttctgatttctgcccttgttccagctttgacgtattatctgttgccttatttctcattgcctcttctacttgtaaaatgcttttcactttctgtctaggttaaagctaaactgaatctatggctttaaataaattaagatcctaaactctctagcttaagtgtaaatgaagtacagtagtttccctactgaaccctgcctcttgtgtccctggaaccttctagaacacctgccttctaccctctggttgggagatgcagccaccacatcccttcatatcatactgttttgaataaattttcaaatccttattgttcagagttgtttgggggttctgtttcagagcataaaacctaaaggttatagtagaacaaggcaccttcttaaaagaaatcttgcttcagaccatcagttacagagaatttctaaagtaaaattgaagcaactacaacttctccttagacactttggaatctaaccacttaaggacctttttaaagagatagcttctcttctttctgaagatcaatttctcccaaggccaagattgtccttttctcccatttcttgctagctattgcaaatgagggaagaacattattcatctctcctccccttttttttctgattcttttttcagtcagttttgctcctgggttcaagtagtattaccaccctttcacaagcaacagactctcacagggcaaaaaaaaaaaaaaatctaatgattcacagacagatctggagcctctcttcattctcagtaattgctagtcccaagaactagaattgcaaatgggcacaacctatatccttcctgtggaagaggaggccactctcttgagctgaagttccagaagagcagttaatgttcaagagaaattgaactcaactcagcaacaaaggactctattttgaagagcaacatatcacaaagctaaatgtgattgtgccaaacacattaggtgcttatttggggtcatgctaggcctttatcaagtaactggaaaacttttcttgcagccacaatctcaatgtcgttagtaggaagataagaggggagaaaaagctgtagaacaaatgtttggggttaccattgaaaatctaatgtctgcaatatttttctcctcacaacttggaaacgttcccagttcattttcagtcctgttgtgagcacagttctgaagggtttattattgtcaaaataagttttgttttgttttgtttatgttgggtttttaatgttgtctcttgacccttaatgctcaggttcttgtgggagttaatcagccacatccaacgttaccttgagggggaagaagagggtgatgctcagaagctaaacaagacaggggccacatgaccctctattgattagccccaagtagaaagtcctgtggttttatgtttaatggtaatagttgatcatatatggcataattttctatcagcttcctactcagtcactataaacacagacttgaaatagtactttaaatgtccaaatacctaaatgtgctaaactggaggtaactatttctaggtagttgaatttttgaaagtcatgatcagccacacaactgttttgtacatacttattttctcatgcacttttctgtatgcaaataaagctataaatttactcatttcaataaactggagtggcagaa

SEQ ID NO: 427043 - DNA, 4538 bp, Homo sapiens
ttatttgcacccgccccccgcccgcgtcggtctggggcttttgacttctccccgaacacatttcccctcccgtcgctgggtccctgcgatcgcccccagctggtggggctcgcggagctcaggggagcggggtcctctgcgccgctgcagcgcgagttaataaacagttaagtttggaagactctgcagacacgttgagggggagttaccaagcccaggcagcaaaaacatcctggcacattcctggggagtcctcagctgccagcatctgattagaaccatatctctcgccgggagtggccgcgcggctccgaagctcccggccggcggctatttaagcgaggcccgccgcatccgctgcgctgtagcctggaggctccgggcgcggggaagtcatgctcgcttcacggaggcaatagctagccggtgtctgtgggaggttatgtttatttgagacttctccatcgggatcgcctggtgtcaccaagtgtccactggtactgaggtttgctgcctgccttcttgccatgtctaacgaagtagaaacaagtgcaaccaatggtcagcccgaccaacaggccgcaccaaaagcaccctcaaagaaggaaaaaaagaaaggccctgaaaagacagatgaatatctcttagcaaggttcaaaggcgatggtgtaaaatataaggccaagctgattggcattgatgatgtgccagatgcaagaggggataaaatgagccaagactctatgatgaaactaaagggaatggcggcagctggtcggtctcagggacaacacaaacaaaggatctgggtcaacatttccctttctgggataaaaataattgatgagaaaactggggtaatagagcatgaacatccagtaaataagatttctttcattgcccgtgatgtgacagacaaccgggcatttggttacgtgtgtggaggagaaggccagcatcagttttttgccataaaaaccgggcaacaggctgaaccattagttgttgatcttaaagacctttttcaagttatctataatgtaaagaaaaaggaagaagaaaagaaaaagatagaggaagccagcaaagcagttgagaatgggagtgaggccctaatgattctagatgaccaaactaacaaactgaaatcgggtgttgaccagatggatttgtttggggacatgtctacacctcctgacctaaatagtccaacagaaagcaaagatatcctgttagtggatctaaactctgaaatcgacaccaatcagaattctttaagagaaaatccattcttaacaaacggcatcacctcctgttctcttcctcgaccaacgcctcaggcatccttcttgcctgaaaatgccttttctgccaatctcaacttctttcccacccctaatcctgatcctttccgtgacgatcctttcacacagccagaccaatcgacaccttcttcgtttgattctctcaaatctccagatcagaagaaagagaattcgagtagctcgtctactccgctgagtaatgggcccctgaatggtgatgttgactactttggtcagcaatttgaccagatctctaaccggactggcaaacaggaagctcaggcaggcccatggcccttttcaagttcgcaaacccagccagcagtgagaactcaaccttttgtgggaagccctcccaaaggactgtccatacagaatggcgtaaagcaggacttggaaagctctgtccagtcctcaccacatgactccatagccattatcccacctccacaaagtaccaaaccaggaagaggcagaaggactgctaagtcttcagccaatgacttgcttgcatcagacatctttgctcctcccgtctcagaaccttcaggccaggcgtcacccacaggacaacctacagccctgcagcccaaccctctggatctcttcaaaacaagtgctcctgccccagtggggcccctggtgggtctaggtggtgtaactgtcacactccctcaggcaggaccatggaacacagcatctttggtcttcaatcagtccccttcaatggctccgggagccatgatgggtggtcaaccttcaggttttagtcagcccgtcatttttggtacaagtccagctgtttcaggttggaaccagccttcaccctttgcagcctcaactccccctccagtgcctgttgtctggggcccttctgcatctgtggcacccaatgcttggtcaacaacaagccctttggggaatccttttcagagcaatatttttccagctcctgctgtgtccactcagcccccatccatgcactcctctctcctggtcactcctcctcagccacctcccagagctggccctcccaaggacatctccagtgatgccttcactgccttagacccacttggggataaagagatcaaggatgtgaaagaaatgtttaaggatttccaactgcggcagccacctgctgtgcccgcgcggaagggagagcagacttcttctgggactttgagtgcctttgccagttatttcaacagcaaggttggcattcctcaggagaatgcagaccatgatgactttgatgctaatcaactattgaacaagatcaatgaaccaccaaagccagctcccagacaagtttccctgccagttaccaaatctactgacaatgcatttgagaaccctttctttaaagattcttttggttcatcacaagcctctgtggcttcttctcaacctgtatcttctgagatgtatagggatccatttggaaatccttttgcctaaattctgaacttggtctgcagaccatccagaggaataaaaaggttggccttagtagtcaaaaacaaagctgatagccagacacgttctgatttctgcccttgttccagctttgacgtattatctgttgccttatttctcattgcctcttctacttgtaaaatgcttttcactttctgtctaggttaaagctaaactgaatctatggctttaaataaattaagatcctaaactctctagcttaagtgtaaatgaagtacagtagtttccctactgaaccctgcctcttgtgtccctggaaccttctagaacacctgccttctaccctctggttgggagatgcagccaccacatcccttcatatcatactgttttgaataaattttcaaatccttattgttcagagttgtttgggggttctgtttcagagcataaaacctaaaggttatagtagaacaaggcaccttcttaaaagaaatcttgcttcagaccatcagttacagagaatttctaaagtaaaattgaagcaactacaacttctccttagacactttggaatctaaccacttaaggacctttttaaagagatagcttctcttctttctgaagatcaatttctcccaaggccaagattgtccttttctcccatttcttgctagctattgcaaatgagggaagaacattattcatctctcctccccttttttttctgattcttttttcagtcagttttgctcctgggttcaagtagtattaccaccctttcacaagcaacagactctcacagggcaaaaaaaaaaaaaaatctaatgattcacagacagatctggagcctctcttcattctcagtaattgctagtcccaagaactagaattgcaaatgggcacaacctatatccttcctgtggaagaggaggccactctcttgagctgaagttccagaagagcagttaatgttcaagagaaattgaactcaactcagcaacaaaggactctattttgaagagcaacatatcacaaagctaaatgtgattgtgccaaacacattaggtgcttatttggggtcatgctaggcctttatcaagtaactggaaaacttttcttgcagccacaatctcaatgtcgttagtaggaagataagaggggagaaaaagctgtagaacaaatgtttggggttaccattgaaaatctaatgtctgcaatatttttctcctcacaacttggaaacgttcccagttcattttcagtcctgttgtgagcacagttctgaagggtttattattgtcaaaataagttttgttttgttttgtttatgttgggtttttaatgttgtctcttgacccttaatgctcaggttcttgtgggagttaatcagccacatccaacgttaccttgagggggaagaagagggtgatgctcagaagctaaacaagacaggggccacatgaccctctattgattagccccaagtagaaagtcctgtggttttatgtttaatggtaatagttgatcatatatggcataattttctatcagcttcctactcagtcactataaacacagacttgaaatagtactttaaatgtccaaatacctaaatgtgctaaactggaggtaactatttctaggtagttgaatttttgaaagtcatgatcagccacacaactgttttgtacatacttattttctcatgcacttttctgtatgcaaataaagctataaatttactcatttcaataaactggagtggcagaa

SEQ ID NO: 427044 - DNA, 3479 bp, Homo sapiens
  misc_feature (87)..(87): n is a, c, g, or t
gcctgcaatggtagttgtagacccgtgtggataccgtcgagttctattgtgtcactataaacgttgggacatgtctacactcctganctaaatagtccacagaaagcaaagatatcctgttagtggatctaaactctgaaatcgacaccaatcagaattctttaagagaaaatccattcttaacaaacggcatcacctcctgttctcttcctcgaccaacgcctcaggcatccttcttgcctgaaaatgccttttctgccaatctcaacttctttcccacccctaatcctgatcctttccgtgacgatcctttcacacagccagaccaatcgacaccttcttcgtttgattctctcaaatctccagatcagaagaaagagaattcgagtagctcgtctactccgctgagtaatgggcccctgaatggtgatgttgactactttggtcagcaatttgaccagatctctaaccggactggcaaacaggaagctcaggcaggcccatggcccttttcaagttcgcaaacccagccagcagtgagaactcaaaatggggtatctgaaagagaacagaacggcttctctgtcaaatcctccccgaacccttttgtgggaagccctcccaaaggactgtccatacagaatggcgtaaagcaggacttggaaagctctgtccagtcctcaccacatgactccatagccattatcccacctccacaaagtaccaaaccaggaagaggcagaaggactgctaagtcttcagccaatgacttgcttgcatcagacatctttgctcctcccgtctcagaaccttcaggccaggcgtcacccacaggacaacctacagccctgcagcccaaccctctggatctcttcaaaacaagtgctcctgccccagtggggcccctggtgggtctaggtggtgtaactgtcacactccctcaggcaggaccatggaacacagcatctttggtcttcaatcagtccccttcaatggctccgggagccatgatgggtggtcaaccttcaggttttagtcagcccgtcatttttggtacaagtccagctgtttcaggttggaaccagccttcaccctttgcagcctcaactccccctccagtgcctgttgtctggggcccttctgcatctgtggcacccaatgcttggtcaacaacaagccctttggggaatccttttcagagcaatatttttccagctcctgctgtgtccactcagcccccatccatgcactcctctctcctggtcactcctcctcagccacctcccagagctggccctcccaaggacatctccagtgatgccttcactgccttagacccacttggggataaagagatcaaggatgtgaaagaaatgtttaaggatttccaactgcggcagccacctgctgtgcccgcgcggaagggagagcagacttcttctgggactttgagtgcctttgccagttatttcaacagcaaggttggcattcctcaggagaatgcagaccatgatgactttgatgctaatcaactattgaacaagatcaatgaaccaccaaagccagctcccagacaagtttccctgccagttaccaaatctactgacaatgcatttgagaaccctttctttaaagattcttttggttcatcacaagcctctgtggcttcttctcaacctgtatcttctgagatgtatagggatccatttggaaatccttttgcctaaattctgaacttggtctgcagaccatccagaggaataaaaaggttggccttagtagtcaaaaacaaagctgatagccagacacgttctgatttctgcccttgttccagctttgacgtattatctgttgccttatttctcattgcctcttctacttgtaaaatgcttttcactttctgtctaggttaaagctaaactgaatctatggctttaaataaattaagatcctaaactctctagcttaagtgtaaatgaagtacagtagtttccctactgaaccctgcctcttgtgtccctggaaccttctagaacacctgccttctaccctctggttgggagatgcagccaccacatcccttcatatcatactgttttgaataaattttcaaatccttattgttcagagttgtttgggggttctgtttcagagcataaaacctaaaggttatagtagaacaaggcaccttcttaaaagaaatcttgcttcagaccatcagttacagagaatttctaaagtaaaattgaagcaactacaacttctccttagacactttggaatctaaccacttaaggacctttttaaagagatagcttctcttctttctgaagatcaatttctcccaaggccaagattgtccttttctcccatttcttgctagctattgcaaatgagggaagaacattattcatctctcctccccttttttttctgattcttttttcagtcagttttgctcctgggttcaagtagtattaccaccctttcacaagcaacagactctcacagggcaaaaaaaaaaaaaaatctaatgattcacagacagatctggagcctctcttcattctcagtaattgctagtcccaagaactagaattgcaaatgggcacaacctatatccttcctgtggaagaggaggccactctcttgagctgaagttccagaagagcagttaatgttcaagagaaattgaactcaactcagcaacaaaggactctattttgaagagcaacatatcacaaagctaaatgtgattgtgccaaacacattaggtgcttatttggggtcatgctaggcctttatcaagtaactggaaaacttttcttgcagccacaatctcaatgtcgttagtaggaagataagaggggagaaaaagctgtagaacaaatgtttggggttaccattgaaaatctaatgtctgcaatatttttctcctcacaacttggaaacgttcccagttcattttcagtcctgttgtgagcacagttctgaagggtttattattgtcaaaataagttttgttttgttttgtttatgttgggtttttaatgttgtctcttgacccttaatgctcaggttcttgtgggagttaatcagccacatccaacgttaccttgagggggaagaagagggtgatgctcagaagctaaacaagacaggggccacatgaccctctattgattagccccaagtagaaagtcctgtggttttatgtttaatggtaatagttgatcatatatggcataattttctatcagcttcctactcagtcactataaacacagacttgaaatagtactttaaatgtccaaatacctaaatgtgctaaactggaggtaactatttctaggtagttgaatttttgaaagtcatgatcagccacacaactgttttgtacatacttattttctcatgcacttttctgtatgcaaataaagctataaatttactcatttcaataaactggagtggcagaa

SEQ ID NO: 427045 - DNA, 3938 bp, Homo sapiens
ttatttgcacccgccccccgcccgcgtcggtctggggcttttgacttctccccgaacacatttcccctcccgtcgctgggtccctgcgatcgcccccagctggtggggctcgcggagctcaggggagcggggtcctctgcgccgctgcagcgcgagttaataaacagttaagtttggaagactctgcagacacgttgagggggagttaccaagcccaggcagcaaaaacatcctggcacattcctggggagtcctcagctgccagcatctgattagaaccatatctctcgccgggagtggccgcgcggctccgaagctcccggccggcggctatttaagcgaggcccgccgcatccgctgcgctgtagcctggaggctccgggcgcggggaagtcatgctcgcttcacggaggcaatagctagccggtgtctgtgggaggttatgtttatttgagacttctccatcgggatcgcctggtgtcaccaagtgtccactggtactgaggtttgctgcctgccttcttgccatgtctaacgaagtagaaacaagtgcaaccaatggtcagcccgaccaacaggccgcaccaaaagcaccctcaaagaaggaaaaaaagaaaggccctgaaaagacagatgaatatctcttagcaaggttcaaaggcgatggtgtaaaatataaggccaagctgattggcattgatgatgtgccagatgcaagaggggataaaatgagccaagactctatgatgaaactaaagggaatggcggcagctggtcggtctcagggacaacacaaacaaaggatctgggtcaacatttccctttctgggataaaaataattgatgagaaaactggggtaatagagcatgaacatccagtaaataagatttctttcattgcccgtgatgtgacagacaaccgggcatttggttacgtgtgtggaggagaaggccagcatcagttttttgccataaaaaccgggcaacaggctgaaccattagttgttgatcttaaagacctttttcaagttatctataatgtaaagaaaaaggaagaagaaaagaaaaagatagaggaagccagcaaagcagttgagaatgggagtgaggccctaatgattctagatgaccaaactaacaaactgaaatcgggtgttgaccagatggatttgtttggggacatgtctacacctcctgacctaaatagtccaacatcttcagccaatgacttgcttgcatcagacatctttgctcctcccgtctcagaaccttcaggccaggcgtcacccacaggacaacctacagccctgcagcccaaccctctggatctcttcaaaacaagtgctcctgccccagtggggcccctggtgggtctaggtggtgtaactgtcacactccctcaggcaggaccatggaacacagcatctttggtcttcaatcagtccccttcaatggctccgggagccatgatgggtggtcaaccttcaggttttagtcagcccgtcatttttggtacaagtccagctgtttcaggttggaaccagccttcaccctttgcagcctcaactccccctccagtgcctgttgtctggggcccttctgcatctgtggcacccaatgcttggtcaacaacaagccctttggggaatccttttcagagcaatatttttccagctcctgctgtgtccactcagcccccatccatgcactcctctctcctggtcactcctcctcagccacctcccagagctggccctcccaaggacatctccagtgatgccttcactgccttagacccacttggggataaagagatcaaggatgtgaaagaaatgtttaaggatttccaactgcggcagccacctgctgtgcccgcgcggaagggagagcagacttcttctgggactttgagtgcctttgccagttatttcaacagcaaggttggcattcctcaggagaatgcagaccatgatgactttgatgctaatcaactattgaacaagatcaatgaaccaccaaagccagctcccagacaagtttccctgccagttaccaaatctactgacaatgcatttgagaaccctttctttaaagattcttttggttcatcacaagcctctgtggcttcttctcaacctgtatcttctgagatgtatagggatccatttggaaatccttttgcctaaattctgaacttggtctgcagaccatccagaggaataaaaaggttggccttagtagtcaaaaacaaagctgatagccagacacgttctgatttctgcccttgttccagctttgacgtattatctgttgccttatttctcattgcctcttctacttgtaaaatgcttttcactttctgtctaggttaaagctaaactgaatctatggctttaaataaattaagatcctaaactctctagcttaagtgtaaatgaagtacagtagtttccctactgaaccctgcctcttgtgtccctggaaccttctagaacacctgccttctaccctctggttgggagatgcagccaccacatcccttcatatcatactgttttgaataaattttcaaatccttattgttcagagttgtttgggggttctgtttcagagcataaaacctaaaggttatagtagaacaaggcaccttcttaaaagaaatcttgcttcagaccatcagttacagagaatttctaaagtaaaattgaagcaactacaacttctccttagacactttggaatctaaccacttaaggacctttttaaagagatagcttctcttctttctgaagatcaatttctcccaaggccaagattgtccttttctcccatttcttgctagctattgcaaatgagggaagaacattattcatctctcctccccttttttttctgattcttttttcagtcagttttgctcctgggttcaagtagtattaccaccctttcacaagcaacagactctcacagggcaaaaaaaaaaaaaaatctaatgattcacagacagatctggagcctctcttcattctcagtaattgctagtcccaagaactagaattgcaaatgggcacaacctatatccttcctgtggaagaggaggccactctcttgagctgaagttccagaagagcagttaatgttcaagagaaattgaactcaactcagcaacaaaggactctattttgaagagcaacatatcacaaagctaaatgtgattgtgccaaacacattaggtgcttatttggggtcatgctaggcctttatcaagtaactggaaaacttttcttgcagccacaatctcaatgtcgttagtaggaagataagaggggagaaaaagctgtagaacaaatgtttggggttaccattgaaaatctaatgtctgcaatatttttctcctcacaacttggaaacgttcccagttcattttcagtcctgttgtgagcacagttctgaagggtttattattgtcaaaataagttttgttttgttttgtttatgttgggtttttaatgttgtctcttgacccttaatgctcaggttcttgtgggagttaatcagccacatccaacgttaccttgagggggaagaagagggtgatgctcagaagctaaacaagacaggggccacatgaccctctattgattagccccaagtagaaagtcctgtggttttatgtttaatggtaatagttgatcatatatggcataattttctatcagcttcctactcagtcactataaacacagacttgaaatagtactttaaatgtccaaatacctaaatgtgctaaactggaggtaactatttctaggtagttgaatttttgaaagtcatgatcagccacacaactgttttgtacatacttattttctcatgcacttttctgtatgcaaataaagctataaatttactcatttcaataaactggagtggcagaa

SEQ ID NO: 427046 - DNA, 2902 bp, Homo sapiens
agctcggtacccgtgttcccttacaaccacagtcttctcaggcgaagactgtggaccgcccgtatcccgagcgcctcgatcaggcgaagactctgtccagtcctcaccacatgactccatagccattatcccacctccacaaagtaccaaaccaggaagaggcagaaggactgctaagtcttcagccaatgacttgcttgcatcagacatctttgctcctcccgtctcagaaccttcaggccaggcgtcacccacaggacaacctacagccctgcagcccaaccctctggatctcttcaaaacaagtgctcctgccccagtggggcccctggtgggtctaggtggtgtaactgtcacactccctcaggcaggaccatggaacacagcatctttggtcttcaatcagtccccttcaatggctccgggagccatgatgggtggtcaaccttcaggttttagtcagcccgtcatttttggtacaagtccagctgtttcaggttggaaccagccttcaccctttgcagcctcaactccccctccagtgcctgttgtctggggcccttctgcatctgtggcacccaatgcttggtcaacaacaagccctttggggaatccttttcagagcaatatttttccagctcctgctgtgtccactcagcccccatccatgcactcctctctcctggtcactcctcctcagccacctcccagagctggccctcccaaggacatctccagtgatgccttcactgccttagacccacttggggataaagagatcaaggatgtgaaagaaatgtttaaggatttccaactgcggcagccacctgctgtgcccgcgcggaagggagagcagacttcttctgggactttgagtgcctttgccagttatttcaacagcaaggttggcattcctcaggagaatgcagaccatgatgactttgatgctaatcaactattgaacaagatcaatgaaccaccaaagccagctcccagacaagtttccctgccagttaccaaatctactgacaatgcatttgagaaccctttctttaaagattcttttggttcatcacaagcctctgtggcttcttctcaacctgtatcttctgagatgtatagggatccatttggaaatccttttgcctaaattctgaacttggtctgcagaccatccagaggaataaaaaggttggccttagtagtcaaaaacaaagctgatagccagacacgttctgatttctgcccttgttccagctttgacgtattatctgttgccttatttctcattgcctcttctacttgtaaaatgcttttcactttctgtctaggttaaagctaaactgaatctatggctttaaataaattaagatcctaaactctctagcttaagtgtaaatgaagtacagtagtttccctactgaaccctgcctcttgtgtccctggaaccttctagaacacctgccttctaccctctggttgggagatgcagccaccacatcccttcatatcatactgttttgaataaattttcaaatccttattgttcagagttgtttgggggttctgtttcagagcataaaacctaaaggttatagtagaacaaggcaccttcttaaaagaaatcttgcttcagaccatcagttacagagaatttctaaagtaaaattgaagcaactacaacttctccttagacactttggaatctaaccacttaaggacctttttaaagagatagcttctcttctttctgaagatcaatttctcccaaggccaagattgtccttttctcccatttcttgctagctattgcaaatgagggaagaacattattcatctctcctccccttttttttctgattcttttttcagtcagttttgctcctgggttcaagtagtattaccaccctttcacaagcaacagactctcacagggcaaaaaaaaaaaaaaatctaatgattcacagacagatctggagcctctcttcattctcagtaattgctagtcccaagaactagaattgcaaatgggcacaacctatatccttcctgtggaagaggaggccactctcttgagctgaagttccagaagagcagttaatgttcaagagaaattgaactcaactcagcaacaaaggactctattttgaagagcaacatatcacaaagctaaatgtgattgtgccaaacacattaggtgcttatttggggtcatgctaggcctttatcaagtaactggaaaacttttcttgcagccacaatctcaatgtcgttagtaggaagataagaggggagaaaaagctgtagaacaaatgtttggggttaccattgaaaatctaatgtctgcaatatttttctcctcacaacttggaaacgttcccagttcattttcagtcctgttgtgagcacagttctgaagggtttattattgtcaaaataagttttgttttgttttgtttatgttgggtttttaatgttgtctcttgacccttaatgctcaggttcttgtgggagttaatcagccacatccaacgttaccttgagggggaagaagagggtgatgctcagaagctaaacaagacaggggccacatgaccctctattgattagccccaagtagaaagtcctgtggttttatgtttaatggtaatagttgatcatatatggcataattttctatcagcttcctactcagtcactataaacacagacttgaaatagtactttaaatgtccaaatacctaaatgtgctaaactggaggtaactatttctaggtagttgaatttttgaaagtcatgatcagccacacaactgttttgtacatacttattttctcatgcacttttctgtatgcaaataaagctataaatttactcatttcaataaactggagtggcagaa

SEQ ID NO: 427047 - DNA, 2950 bp, Homo sapiens
tatattcacttaaataagttcctgctattaacaggctctgttctagttgtttgagatgtatcagacaactagtgtctgtatgataagggcttatttttttgatgagtagatacttatggaccgtactacccttctaatcaggaaagttaaaaagacatggtaggaagaacatgggcctcaaaatgcaaccagcatttgaatgctcactatacagtgttagctggctaacttttacagtgattaatctgtcatattcttcccatatcagcctcagggctcaatggaggtgttagctgtggagaggctttccagagagttgtgctctctgaaattcaagaatcttcttcaagcttgactcctgataagtatttttcttcctcttacttcaggtggtgtaactgtcacactccctcaggcaggaccatggaacacagcatctttggtcttcaatcagtccccttcaatggctccgggagccatgatgggtggtcaaccttcaggttttagtcagcccgtcatttttggtacaagtccagctgtttcaggttggaaccagccttcaccctttgcagcctcaactccccctccagtgcctgttgtctggggcccttctgcatctgtggcacccaatgcttggtcaacaacaagccctttggggaatccttttcagagcaatatttttccagctcctgctgtgtccactcagcccccatccatgcactcctctctcctggtcactcctcctcagccacctcccagagctggccctcccaaggacatctccagtgatgccttcactgccttagacccacttggggataaagagatcaaggatgtgaaagaaatgtttaaggatttccaactgcggcagccacctgctgtgcccgcgcggaagggagagcagacttcttctgggactttgagtgcctttgccagttatttcaacagcaaggttggcattcctcaggagaatgcagaccatgatgactttgatgctaatcaactattgaacaagatcaatgaaccaccaaagccagctcccagacaagtttccctgccagttaccaaatctactgacaatgcatttgagaaccctttctttaaagattcttttggttcatcacaagcctctgtggcttcttctcaacctgtatcttctgagatgtatagggatccatttggaaatccttttgcctaaattctgaacttggtctgcagaccatccagaggaataaaaaggttggccttagtagtcaaaaacaaagctgatagccagacacgttctgatttctgcccttgttccagctttgacgtattatctgttgccttatttctcattgcctcttctacttgtaaaatgcttttcactttctgtctaggttaaagctaaactgaatctatggctttaaataaattaagatcctaaactctctagcttaagtgtaaatgaagtacagtagtttccctactgaaccctgcctcttgtgtccctggaaccttctagaacacctgccttctaccctctggttgggagatgcagccaccacatcccttcatatcatactgttttgaataaattttcaaatccttattgttcagagttgtttgggggttctgtttcagagcataaaacctaaaggttatagtagaacaaggcaccttcttaaaagaaatcttgcttcagaccatcagttacagagaatttctaaagtaaaattgaagcaactacaacttctccttagacactttggaatctaaccacttaaggacctttttaaagagatagcttctcttctttctgaagatcaatttctcccaaggccaagattgtccttttctcccatttcttgctagctattgcaaatgagggaagaacattattcatctctcctccccttttttttctgattcttttttcagtcagttttgctcctgggttcaagtagtattaccaccctttcacaagcaacagactctcacagggcaaaaaaaaaaaaaaatctaatgattcacagacagatctggagcctctcttcattctcagtaattgctagtcccaagaactagaattgcaaatgggcacaacctatatccttcctgtggaagaggaggccactctcttgagctgaagttccagaagagcagttaatgttcaagagaaattgaactcaactcagcaacaaaggactctattttgaagagcaacatatcacaaagctaaatgtgattgtgccaaacacattaggtgcttatttggggtcatgctaggcctttatcaagtaactggaaaacttttcttgcagccacaatctcaatgtcgttagtaggaagataagaggggagaaaaagctgtagaacaaatgtttggggttaccattgaaaatctaatgtctgcaatatttttctcctcacaacttggaaacgttcccagttcattttcagtcctgttgtgagcacagttctgaagggtttattattgtcaaaataagttttgttttgttttgtttatgttgggtttttaatgttgtctcttgacccttaatgctcaggttcttgtgggagttaatcagccacatccaacgttaccttgagggggaagaagagggtgatgctcagaagctaaacaagacaggggccacatgaccctctattgattagccccaagtagaaagtcctgtggttttatgtttaatggtaatagttgatcatatatggcataattttctatcagcttcctactcagtcactataaacacagacttgaaatagtactttaaatgtccaaatacctaaatgtgctaaactggaggtaactatttctaggtagttgaatttttgaaagtcatgatcagccacacaactgttttgtacatacttattttctcatgcacttttctgtatgcaaataaagctataaatttactcatttcaataaactggagtggcagaa

SEQ ID NO: 427048 - DNA, 3543 bp, Homo sapiens
ttatttgcacccgccccccgcccgcgtcggtctggggcttttgacttctccccgaacacatttcccctcccgtcgctgggtccctgcgatcgcccccagctggtggggctcgcggagctcaggggagcggggtcctctgcgccgctgcagcgcgagttaataaacagttaagtttggaagactctgcagacacgttgagggggagttaccaagcccaggcagcaaaaacatcctggcacattcctggggagtcctcagctgccagcatctgattagaaccatatctctcgccgggagtggccgcgcggctccgaagctcccggccggcggctatttaagcgaggcccgccgcatccgctgcgctgtagcctggaggctccgggcgcggggaagtcatgctcgcttcacggaggcaatagctagccggtgtctgtgggaggttatgtttatttgagacttctccatcgggatcgcctggtgtcaccaagtgtccactggtactgaggtttgctgcctgccttcttgccatgtctaacgaagtagaaacaagtgcaaccaatggtcagcccgaccaacaggccgcaccaaaagcaccctcaaagaaggaaaaaaagaaaggccctgaaaagacagatgaatatctcttagcaaggttcaaaggcgatggtgtaaaatataaggccaagctgattggcattgatgatgtgccagatgcaagaggggataaaatgagccaagactctatgatgaaactaaagggaatggcggcagctggtcggtctcagggacaacacaaacaaaggatctgggtcaacatttccctttctgggataaaaataattgatgagaaaactggggtaatagagcatgaacatccagtaaataagatttctttcattgcccgtgatgtgacagacaaccgggcatttggttacgtgtgtggaggagaaggccagcatcagttttttgccataaaaaccgggcaacaggctgaaccattagttgttgatcttaaagacctttttcaagttatctataatgtaaagaaaaaggaagaagaaaagaaaaagatagaggaagccagcaaagcagttgagaatgggagtgaggccctaatgattctagatgaccaaactaacaaactgaaatcggaaagcaaagatatcctgttagtggatctaaactctgaaatcgacaccaatcagaattctttaagagaaaatccattcttaacaaacggcatcacctcctgttctcttcctcgaccaacgcctcaggcatccttcttgcctgaaaatgccttttctgccaatctcaacttctttcccacccctaatcctgatcctttccgtgacgatcctttcacacagccagaccaatcgacaccttcttcgtttgattctctcaaatctccagatcagaagaaagagaattcgagtagctcgtctactccgctgagtaatgggcccctgaatggtgatgttgactactttggtcagcaatttgaccagatctctaaccggactggcaaacaggaagctcaggcaggcccatggcccttttcaagttcgcaaacccagccagcagtgagaactcaaaatggggtatctgaaagagaacagaacggcttctctgtcaaatcctccccgaacccttttgtgggaagccctcccaaaggactgtccatacagaatggcgtaaagcaggacttggaaagctctgtccagtcctcaccacatgactccatagccattatcccacctccacaaagtaccaaaccaggaagaggcagaaggactgctaagtcttcagccaatgacttgcttgcatcagacatctttgctcctcccgtctcagaaccttcaggccaggcgtcacccacaggacaacctacagccctgcagcccaaccctctggatctcttcaaaacaagtgctcctgccccagtggggcccctggtgggtctaggtggtgtaactgtcacactccctcaggcaggaccatggaacacagcatctttggtcttcaatcagtccccttcaatggctccgggagccatgatgggtggtcaaccttcaggttttagtcagcccgtcatttttggtacaagtccagctgtttcaggttggaaccagccttcaccctttgcagcctcaactccccctccagtgcctgttgtctggggcccttctgcatctgtggcacccaatgcttggtcaacaacaagccctttggggaatccttttcagagcaatatttttccagctcctgctgtgtccactcagcccccatccatgcactcctctctcctggtcactcctcctcagccacctcccagagctggccctcccaaggacatctccagtgatgccttcactgccttagacccacttggggataaagagatcaaggatgtgaaagaaatgtttaaggatttccaactgcggcagccacctgctgtgcccgcgcggaagggagagcagacttcttctgggactttgagtgcctttgccagttatttcaacagcaaggttggcattcctcaggagaatgcagaccatgatgactttgatgctaatcaactattgaacaagatcaatgaaccaccaaagccagctcccagacaagtttccctgccagttaccaaatctactgacaatgcatttgagaaccctttctttaaagattcttttggttcatcacaagcctctgtggcttcttctcaacctgtatcttctgagatgtatagggatccatttggaaatccttttgcctaaattctgaacttggtctgcagaccatccagaggaataaaaaggttggccttagtagtcaaaaacaaagctgatagccagacacgttctgatttctgcccttgttccagctttgacgtattatctgttgccttatttctcattgcctcttctacttgtaaaatgcttttcactttctgtctaggttaaagctaaactgaatctatggctttaaataaattaagatcctaaactctctagcttaagtgtaaatgaagtacagtagtttccctactgaaccctgcctcttgtgtccctggaaccttctagaacacctgccttctaccctctggttgggagatgcagccaccacatcccttcatatcatactgttttgaataaattttcaaatccttattgttcagagttgtttgggggttctgtttcagagcataaaacctaaaggttatagtagaacaaggcaccttcttaaaagaaatcttgcttcagaccatcagttacagagaatttctaaagtaaaattgaagcaactacaacttctccttagacactttggaatctaaccacttaaggacctttttaaagagatagcagggttttttcaggcagaacaattgttaacgaggccgagagtgcgtgttataccatttacttataggctaatagtggatagacgggcacgcaccttagacgatctgatcgtatccgataagtttgaaatcgaattccagccgctcggggcatctcactactttagagaccacccatt

SEQ ID NO: 427049 - DNA, 3348 bp, Homo sapiens
  misc_feature (2243)..(2243): n is a, c, g, or t
ttatttgcacccgccccccgcccgcgtcggtctggggcttttgacttctccccgaacacatttcccctcccgtcgctgggtccctgcgatcgcccccagctggtggggctcgcggagctcaggggagcggggtcctctgcgccgctgcagcgcgagttaataaacagttaagtttggaagactctgcagacacgttgagggggagttaccaagcccaggcagcaaaaacatcctggcacattcctggggagtcctcagctgccagcatctgattagaaccatatctctcgccgggagtggccgcgcggctccgaagctcccggccggcggctatttaagcgaggcccgccgcatccgctgcgctgtagcctggaggctccgggcgcggggaagtcatgctcgcttcacggaggcaatagctagccggtgtctgtgggaggttatgtttatttgagacttctccatcgggatcgcctggtgtcaccaagtgtccactggtactgaggtttgctgcctgccttcttgccatgtctaacgaagtagaaacaagtgcaaccaatggtcagcccgaccaacaggccgcaccaaaagcaccctcaaagaaggaaaaaaagaaaggccctgaaaagacagatgaatatctcttagcaaggttcaaaggcgatggtgtaaaatataaggccaagctgattggcattgatgatgtgccagatgcaagaggggataaaatgagccaagactctatgatgaaactaaagggaatggcggcagctggtcggtctcagggacaacacaaacaaaggatctgggtcaacatttccctttctgggataaaaataattgatgagaaaactggggtaatagagcatgaacatccagtaaataagatttctttcattgcccgtgatgtgacagacaaccgggcatttggttacgtgtgtggaggagaaggccagcatcagttttttgccataaaaaccgggcaacaggctgaaccattagttgttgatcttaaagacctttttcaagttatctataatgtaaagaaaaaggaagaagaaaagaaaaagatagaggaagccagcaaagcagttgagaatgggagtgaggccctaatgattctagatgaccaaactaacaaactgaaatcgggtgttgaccagatggatttgtttggggacatgtctacacctcctgacctaaatagtccaacagtaagtgtttgtttttaaatttgcaatgtaataaaatgacatctataactcaaattggcaataaccagaaatcttaagcatctcattgaaacttggaaggtgactgttgatttttgcaaatgaagtgtcaatggtttttagaataaatgtgaatcttaagtcaccatgggaacctatccacactaattcagttatattaatattgcttacagattaaacctgaacaataagtcagcaatgtagtccttcttggtatcacttaggattagaaggaggaggtgaataatagtccttgaataagcctacttgaagaaagtatgactgttagatggttaatcataaagcctcctggcctcttcatttcttttgcattctgtctgttgcaatttagcagcataaatttggtgtgaagtaagatttaaaacaaacaagtggctcagttatattccaccaaagcttgtccttgttagaaagctgcccattctcataggattttataccatatccagtctgctcaatattgaatgatctgtaacaaccctgtaagaacagaacagtattttcctttataaattaaaaaaaaatggtggttcagggaaaaaaaaagaagaaaaaaaaataaaaaggaaagaggtccagattcaagacttaggcccaagtcttcagaccttccaaaacatacctctaatgaaaatgtccatgacattttgaatgacttcttgcaacttcttttatttatgtaacagtttcctgagcacctgctatttgcaaggcatagcagtaagatgcacaacatcaatgacatcatggaatttactctccggcagggagaccaacattaaaactaatcacatcgttagtaattgatgttactacagggtatttatctagttcagattcaggtaatgcttctgcaggagtgagtttctagatttgaacataaaagatgagaaggcaataaacagacaaaaagagaattagtctagaataatggggggaaatgtctagaaaggactctcttgtatcagnaaattatcatggaagcctatgtgaccaaggttacaggagttgaagcaatggatcaaagattggataaaattctcccttcagacttctgcagagaatttgaggcctgtgaatccttactgcataaaactttcaggtcaaatgagatggagaggagcagggacttcatgcattcttctctgaccctaaccatatgagtatcacaatgcatggtagcattctaaaatgcctttaagagagaagcctgtttaatattcattttagcagtgagccctaactcacttgcctatagaacctttcattcttcataatttttgttatagttctgaggataaactttttaaagtactagactagattatcctgacaggtccatcctaactctgaggtccttttgatttgtagtcaactttgtgctctcctccattagtgatgttttctcaaataaatcagtatctgaacacttacttcccaagtataaatgacattcaaacaagtaatattcaaagagagcaaagcactcaagatatgaagtggaattccactggaataggcaaggaagtactgcctatataatctacttctgtagacttctagaatgttctaaaaaaggaaatggaaaacaacatggataatcttcagtctcatttttattagactttatgaagtctaagaattttttatttataggaattcaagttttagttaaactaacaataaagtaataaataccatcaaaatatatactctctgataaccaaaagaaggctaacagatctaattatgtgctggttaggctttgacatgttcttatctattgactctatagtcataggtcaaaaatagatttatctctacttggtaaagccagcatgtttaaaaatattcaactctttcaacaattgctctgaaatatgtaaagagagaaagaaatctaaattacctagactttattattggtcctagatggttgtcactcccctcaaatttatacagaaaagttttatgagtttcaaataatgctcatgttgcaaactatgtggtatcccctagaacagaatttttattggcaagccccttgagcattatccttccacactgcatctca

SEQ ID NO: 427050 - DNA, 3026 bp, Homo sapiens
  misc_feature (2243)..(2243): n is a, c, g, or t
ttatttgcacccgccccccgcccgcgtcggtctggggcttttgacttctccccgaacacatttcccctcccgtcgctgggtccctgcgatcgcccccagctggtggggctcgcggagctcaggggagcggggtcctctgcgccgctgcagcgcgagttaataaacagttaagtttggaagactctgcagacacgttgagggggagttaccaagcccaggcagcaaaaacatcctggcacattcctggggagtcctcagctgccagcatctgattagaaccatatctctcgccgggagtggccgcgcggctccgaagctcccggccggcggctatttaagcgaggcccgccgcatccgctgcgctgtagcctggaggctccgggcgcggggaagtcatgctcgcttcacggaggcaatagctagccggtgtctgtgggaggttatgtttatttgagacttctccatcgggatcgcctggtgtcaccaagtgtccactggtactgaggtttgctgcctgccttcttgccatgtctaacgaagtagaaacaagtgcaaccaatggtcagcccgaccaacaggccgcaccaaaagcaccctcaaagaaggaaaaaaagaaaggccctgaaaagacagatgaatatctcttagcaaggttcaaaggcgatggtgtaaaatataaggccaagctgattggcattgatgatgtgccagatgcaagaggggataaaatgagccaagactctatgatgaaactaaagggaatggcggcagctggtcggtctcagggacaacacaaacaaaggatctgggtcaacatttccctttctgggataaaaataattgatgagaaaactggggtaatagagcatgaacatccagtaaataagatttctttcattgcccgtgatgtgacagacaaccgggcatttggttacgtgtgtggaggagaaggccagcatcagttttttgccataaaaaccgggcaacaggctgaaccattagttgttgatcttaaagacctttttcaagttatctataatgtaaagaaaaaggaagaagaaaagaaaaagatagaggaagccagcaaagcagttgagaatgggagtgaggccctaatgattctagatgaccaaactaacaaactgaaatcgggtgttgaccagatggatttgtttggggacatgtctacacctcctgacctaaatagtccaacagtaagtgtttgtttttaaatttgcaatgtaataaaatgacatctataactcaaattggcaataaccagaaatcttaagcatctcattgaaacttggaaggtgactgttgatttttgcaaatgaagtgtcaatggtttttagaataaatgtgaatcttaagtcaccatgggaacctatccacactaattcagttatattaatattgcttacagattaaacctgaacaataagtcagcaatgtagtccttcttggtatcacttaggattagaaggaggaggtgaataatagtccttgaataagcctacttgaagaaagtatgactgttagatggttaatcataaagcctcctggcctcttcatttcttttgcattctgtctgttgcaatttagcagcataaatttggtgtgaagtaagatttaaaacaaacaagtggctcagttatattccaccaaagcttgtccttgttagaaagctgcccattctcataggattttataccatatccagtctgctcaatattgaatgatctgtaacaaccctgtaagaacagaacagtattttcctttataaattaaaaaaaaatggtggttcagggaaaaaaaaagaagaaaaaaaaataaaaaggaaagaggtccagattcaagacttaggcccaagtcttcagaccttccaaaacatacctctaatgaaaatgtccatgacattttgaatgacttcttgcaacttcttttatttatgtaacagtttcctgagcacctgctatttgcaaggcatagcagtaagatgcacaacatcaatgacatcatggaatttactctccggcagggagaccaacattaaaactaatcacatcgttagtaattgatgttactacagggtatttatctagttcagattcaggtaatgcttctgcaggagtgagtttctagatttgaacataaaagatgagaaggcaataaacagacaaaaagagaattagtctagaataatggggggaaatgtctagaaaggactctcttgtatcagnaaattatcatggaagcctatgtgaccaaggttacaggagttgaagcaatggatcaaagattggataaaattctcccttcagacttctgcagagaatttgaggcctgtgaatccttactgcataaaactttcaggtcaaatgagatggagaggagcagggacttcatgcattcttctctgaccctaaccatatgagtatcacaatgcatggtagcattctaaaatgcctttaagagagaagcctgtttaatattcattttagcagtgagccctaactcacttgcctatagaacctttcattcttcataatttttgttatagttctgaggataaactttttaaagtactagactagattatcctgacaggtccatcctaactctgaggtccttttgatttgtagtcaactttgtgctctcctccattagtgatgttttctcaaataaatcagtatctgaacacttacttcccaagtataaatgacattcaaacaagtaatattcaaagagagcaaagcactcaagatatgaagtggaattccactggaataggcaaggaagtactgcctatataatctacttctgtagacttctagaatgttctaaaaaaggaaatggaaaacaacatggataatcttcagtctcatttttattagactttatgaagtctaagaattttttatttataggaattcaagttttagttaaactaacaataaagtaggatgcgcgcctgaccactcacaacttcacttcgttacctgacgcgctaacacccgtacagc

SEQ ID NO: 427051 - DNA, 852 bp, Homo sapiens
  misc_feature (852)..(852): n is a, c, g, or t
ttatttgcacccgccccccgcccgcgtcggtctggggcttttgacttctccccgaacacatttcccctcccgtcgctgggtccctgcgatcgcccccagctggtggggctcgcggagctcaggggagcggggtcctctgcgccgctgcagcgcgagttaataaacagttaagtttggaagactctgcagacacgttgagggggagttaccaagcccaggcagcaaaaacatcctggcacattcctggggagtcctcagctgccagcatctgattagaaccatatctctcgccgggagtggccgcgcggctccgaagctcccggccggcggctatttaagcgaggcccgccgcatccgctgcgctgtagcctggaggctccgggcgcggggaagtcatgctcgcttcacggaggcaatagctagccggtgtctgtgggaggttatgtttatttgagacttctccatcgggatcgcctggtgtcaccaagtgtccactggtactgaggtttgctgcctgccttcttgccatgtctaacgaagtagaaacaagtgcaaccaatggtcagcccgaccaacaggccgcaccaaaagcaccctcaaagaaggaaaaaaagaaaggccctgaaaagacagatgaatatctcttagcaaggttcaaaggcgatggtgtaaaatataaggccaagctgattggcattgatgatgtgccagatgcaagaggggataaaatgagccacctacccaccagcttcactctgaagagtttcaagagccggggcaactgtcagacccaaggggactccatcctggactcgtgcccaagacgggcagaacacttgcatacagagggtn

SEQ ID NO: 427052 - DNA, 2277 bp, Homo sapiens
tatcgatgcaccaggcgtgagccacggcccggccctacctatttctttctagagtgtttgaagcaaatcttagttccatctgtaaatacttaagtatgtgtctgtagtgtctgtctcaaaacatgatcatgataccattatgtttttttaaaattgcttaatatcaaatatctctgtcagtgtttgaatttaccgagttatctcataactggtttttactgatattttttaaaaataagattcagttgaggtccatttaccacaaatggttggtaatgatcttgattattcatctgtttcttttttccctttacaattatgggggaatcggaggacaaatagtttagcatgtaaattttcccacagtctgaattttgttgatggaatccctgtggtcgtttattattttgtgtttatcgatgccaccttccctggaagggaaggtggcttcttccagcttgccagtcagtgctgaaaaatcacacctggttcccctcatggatgccaggatcaatgcttacattgaagaagaagtccaaagacgccttcaggatttgcatcgtgtgattagtgaaggctgcagtacatctgcagacacgatgaaggataatgagaaacttcacaatggcaccattcaacgtaaactaaaatatgagcggatggtttctcgctctttgggcgcaaatccagatgacctgaaggacccaattaaaattagtatcccacgctacgtcctctgcgggcaaggaaaggatgcacacttcgagtttgaggtcaagattactgtcctagatgagacatggactgtattcaggcgttacagtcgttttcgagaaatgcataaaacattgaagttaaagtatgcagagcttgctgcccttgaatttcctccaaagaaactatttggaaataaggatgaacgtgtgattgctgagagacgaagtcacttagagaaatacctcagggactttttcagcgtgatgctccagtccgcaacatctcccctccacatcaacaaagtgggactgactctctcgaaacataccatttgtgagttttcaccattcttcaagaaaggagtctttgactacagcagccacgggacggggtagagccaggggtgatggaggaaccaccacagcagtgccttctcgtcgaagcgggctccgatgcagggcagctcccccatgcgaggatccgggtctgcctcctcctgctgaagacagacatgcagcagcgggcccgggccacctcacgtttccatacctagtgcctgagtttggggatgggatgctctgcctgctgatgtggccctgacaggcagccgttaccgttccattgcggttgaacgtggccttttcccacagtgcttccttctcactgcgcagcaaagttcgtcccctgtggcaagatagatgtggttgggccatcgtgggttccctgagcccagccagcctgggacctcccaaagtgggtggcttaccagaccacccttaaatgactttcatctggtttcctctttcaccaaaatatactcgtattttttatatttcttccatgtggctggctatattccaagaaaagcattttaaattatttcattgtatttttttctttttttccctcatttgaatcagaacttttatataaaacccaaacactgatgtttacacagaatttcatattctgcaaaagggattttttgatccaatcatgactgtagtcttccatgcttgacaaattggatgtagacaacattacttaaaacttctataaatccctacaattaggatatttatttaaccttgaatattcaagaacattctcccaaatctaaatggctactgtgcattcttgagctttttctgctaagcacaaaatgaacgcaaagctaaatgcatatttttaagtattattcacattttttgttacagaatctattggatctttggctggaaaactagaatttatagcagtttattaatgataccttaaattactcaggacttaatgtagcattgcacttctgtgtacagtaaaactgctttgttttactaaagagaaaaatgtgagtggaaaaaatatgtatgtggtatatactcaaatgtatataattctatctatagatttatatatgtatacattctgtacagtagttccatcaaaatatgtaataattcacaccaattttattaaatgtatttgctttttcaaaatttaaattgagctgctatcaatattaaatgaagttatggcatctaccctgtagctcagctt

SEQ ID NO: 427053 - DNA, 491 bp, Homo sapiens
actacatacttccgttcacaagaaatggttttcaaaaccctcggcacagatgtcgtgaagtctgcatttgaaggttataatgcttgtgtctttgcatatgggcaaactggatctggaaagtcatacactatgatgggaaattctggagattctggcttaatacctcggatctgtgaaggactcttcagtcggataaatgaaaccaccagatgggatgaagcttcttttcgaactgaagtcagctacttagaaatttataacgaacgtgtgagagatctacttcggcggaagtcatctaaaaccttcaatttgagagtccgtgagcatcccaaagaaggcccttatgttgaggatttatccaaacatttaggactacatacttccgggctaccataggtagcactgacaaagttatttaataactgaagaattttcataggtatgacaaatgggccactaagatttggtgcagctggatttagagttgtcag

SEQ ID NO: 427054 - DNA, 697 bp, Homo sapiens
  misc_feature (467)..(467): n is a, c, g, or t
  misc_feature (500)..(500): n is a, c, g, or t
  misc_feature (503)..(503): n is a, c, g, or t
  misc_feature (548)..(548): n is a, c, g, or t
  misc_feature (558)..(558): n is a, c, g, or t
  misc_feature (604)..(604): n is a, c, g, or t
  misc_feature (617)..(617): n is a, c, g, or t
  misc_feature (662)..(662): n is a, c, g, or t
  misc_feature (668)..(668): n is a, c, g, or t
  misc_feature (691)..(691): n is a, c, g, or t
ggcgggagccgcgatctgagtagccagcgtcgccggcgaccgcggagttctgggctagtgggaccccgcgcgggctggttcgggatgagcgatggcatcggtcaaggtggccgtgagggtccggcccatgaatcgcagggaaaaggacttggaggccaagttcattattcagatggagaaaagcaaaacgacaatcacaaacttaaagataccagaaggaggcactggggactcaggaagagaacggaccaagaccttcacctatgacttttctttttattctgctgatacaaaaagcccagattacgtttcacaagaaatggttttcaaaaccctcggcacagatgtcgtgaagtctgcatttgaaggttataatgcttgtgtctttgcatatgggcaaactggatctggaaagtcatacactatgatgggaaattctggaaatctgcttaatactccgatctgtnaaagaccctccctccggattaatgaaacccccnatnggatgaactctttccaactgaattccctccttaaaaatttttacnaactttttanaattactccgcggaattcctaaaaccccatttgaaattcttaactncccaaaaggcctnttttaagatttccaacttttttccaaattttgtgacttaaaaatntgatgnggcattcacccgacccccccaangggtta

SEQ ID NO: 427055 - DNA, 4573 bp, Homo sapiens
  misc_feature (3171)..(3171): n is a, c, g, or t
  misc_feature (4419)..(4419): n is a, c, g, or t
  misc_feature (4471)..(4471): n is a, c, g, or t
ggcgggagccgcgatctgagtagccagcgtcgccggcgaccgcggagttctgggctagtgggaccccgcgcgggctggttcgggatgagcgatggcatcggtcaaggtggccgtgagggtccggcccatgaatcgcagggaaaaggacttggaggccaagttcattattcagatggagaaaagcaaaacgacaatcacaaacttaaagataccagaaggaggcactggggactcaggaagagaacggaccaagaccttcacctatgacttttctttttattctgctgatacaaaaagcccagattacgtttcacaagaaatggttttcaaaaccctcggcacagatgtcgtgaagtctgcatttgaaggttataatgcttgtgtctttgcatatgggcaaactggatctggaaagtcatacactatgatgggaaattctggagattctggcttaatacctcggatctgtgaaggactcttcagtcggataaatgaaaccaccagatgggatgaagcttcttttcgaactgaagtcagctacttagaaatttataacgaacgtgtgagagatctacttcggcggaagtcatctaaaaccttcaatttgagagtccgtgagcatcccaaagaaggcccttatgttgaggatttatccaaacatttagtacagaattatggtgacgtagaagaacttatggatgcgggcaatatcaaccggaccaccgcagcgactgggatgaacgacgtcagtagcaggtctcatgccatcttcaccatcaagttcactcaggctaaatttgattctgaaatgccatgtgaaaccgtcagtaagatccacttggttgatcttgccggaagtgagcgtgcagatgccaccggagccaccggggttaggctaaaggaagggggaaatattaacaagtccctcgtgactctggggaacgtcatttctgccttagctgatttatctcaggatgctgcaaatactcttgcaaagaagaagcaagttttcgtgccttacagggattctgtgttgacttggttgttaaaagatagccttggaggaaactctaaaactatcatgattgccaccatttcacctgctgatgtcaattatggagaaaccctaagtactcttcgctatgcaaatagagccaaaaacatcatcaacaagcctaccattaatgaggatgccaacgtcaaacttatccgtgagctgcgagctgaaatagccagactgaaaacgctgcttgctcaagggaatcagattgccctcttagactcccccacagctttaagtatggaggaaaaacttcagcagaatgaagcaagagttcaagaattgaccaaggaatggacaaataagtggaatgaaacccaaaatattttgaaagaacaaactctagccctcaggaaagaagggattggagttgttttggattctgaactgcctcatttgattggcatcgatgatgaccttttgagtactggaatcatcttatatcatttaaaggaaggtcagacatacgttggtagagacgatgcttccacggagcaagatattgttcttcatggccttgacttggagagtgagcattgcatctttgaaaatatcggggggacagtgactctgatacccctgagtgggtcccagtgctctgtgaatggtgttcagatcgtggaggccacacatctaaatcaaggtgctgtgattctcttgggaagaaccaatatgtttcgctttaaccatccaaaggaagccgccaagctcagggagaagaggaagagtggccttctgtcctccttcagcttgtccatgaccgacctctcgaagtcccgtgagaacctgtctgcagtcatgttgtataaccccggacttgaatttgagaggcaacagcgtgaagaacttgaaaaattagaaagtaaaaggaaactcatagaagaaatggaggaaaagcagaaatcagacaaggctgaactggagcggatgcagcaggaggtggagacccagcgcaaggagacagaaatcgtgcagctccagattcgcaagcaggaggagagcctcaaacgccgcagcttccacatcgagaacaagctaaaggatttacttgcggagaaggaaaaatttgaagaggagaggctgagggaacagcaggaaatcgagctgcagaagaagagacaagaagaagagacctttctccgcgtccaagaagaactccaacgactcaaagaactcaacaacaacgagaaggctgagaagtttcagatatttcaagaactggaccagctccaaaaggaaaaagatgaacagtatgccaagcttgaactggaaaaaaagagactagaggagcaggagaaggagcaggtcatgctcgtggcccatctggaagagcagctccgagagaagcaggagatgatccagctcctgcggcgtggggaggtacagtgggtggaagaggagaagagggacctggaaggcattcgggaatccctcctgcgggtgaaggaggctcgtgccggaggggatgaagatggcgaggagttagaaaaggctcaactgcgtttcttcgaattcaagagaaggcagcttgtcaagctagtgaacttggagaaggacctggttcagcagaaagacatcctgaaaaaagaagtccaagaagaacaggagatcctagagtgtttaaaatgtgaacatgacaaagaatctagattgttggaaaaacatgatgagagtgtcacagatgtcacggaagtgcctcaagatttcgagaaaataaagccagtggagtacaggctgcaatataaagaacgccagctacagtacctcctgcagaatcacttgccaactctgttggaagaaaagcagagagcatttgaaattcttgacagaggccctctcagcttagacaacactctttatcaagtagaaaaggaaatggaagaaaaagaagaacagcttgcacagtaccaggccaatgcaaaccagctgcaaaagctccaagccacctttgaattcactgccaacattgcacgtcaggaggaaaaagtgaggaaaaaggaaaaggagattttggagtccagagagaagcagcagagagaggcgctggagcgggccctggccaggctggagaggagacattctgcgctgcagaggcactccaccctgggcanggagattgaagagcagaggcagaaacttgccagtctgaacagtggcagcagagagcagtcagggctccaggctagcctggaggctgagcaggaagccctggagaaggaccaggagaggttagaatatgaaatccagcagctgaaacagaagatttatgaggtcgatggtgttcaaaaagatcatcatgggaccctggaagggaaggtggcttcttccagcttgccagtcagtgctgaaaaatcacacctggttcccctcatggatgccaggatcaatgcttacattgaagaagaagtccaaagacgccttcaggatttgcatcgtgtgattagtgaaggctgcagtacatctgcagacacgatgaaggataatgagaaacttcacaatggcaccattcaacgtaaactaaaatatgagctgtgtcgtgacctcctgtgtgtcctgatgccagagcctgatgccgctgcctgcgctaatcatcccttgctccagcaagatctggttcagctttctcttgattggaaaacagaaatccctgatttagttttgccaaatggagttcaggtgtcatccaaattccagactaccttggttgacatgatttactttcttcatggaaatatggaagtcaatgtcccttccctggcagaagttcagttactgctctacacaacagtgaaagtcatgggtgactctggccatgaccagtgccagtcgctagtccttctgaacacccacattgcactggtgaaggaagactgtgttttttatccacgcattcgatctcgaaacatacctcctccgggtgcacaatttgatgtgatcaaatgccatgctttaagtgaattcaggtgtgttgttgttccagaaaagaaaaatgtgtcaacagtagaactagtcttcttacagaaactcaaaccttcagtgggttccagaaatagtccacctgagcaccttcaggaagccccaaatgtccagttgttcaccaccccattgtatcttcaaggcagtcagaatgtcgcacctgaggtctggaaacttactttcaattctcaagatgaggctctttggctaatctcacatttgacaagactctaaggaggagacttttaaagatgcactacatgttttttgagatcattaataaaataagcattgtgaaaacagtcaaggcaatatgaatatctccgtgtagctaattgaattggaactggaaaaatgcagacctctaaaattgaaaatgtaantattttaaatatctacaataaaataaaaacagctaatagcagagccccaatnaaatatctttatcatcaccttgcttcattttcttgaaactcaggcttgtaaatttgtgcctgcttcattatttgtgaggtgattaaagcatttctgattgtt

SEQ ID NO: 427056 - DNA, 5120 bp, Homo sapiens
  misc_feature (3171)..(3171): n is a, c, g, or t
ggcgggagccgcgatctgagtagccagcgtcgccggcgaccgcggagttctgggctagtgggaccccgcgcgggctggttcgggatgagcgatggcatcggtcaaggtggccgtgagggtccggcccatgaatcgcagggaaaaggacttggaggccaagttcattattcagatggagaaaagcaaaacgacaatcacaaacttaaagataccagaaggaggcactggggactcaggaagagaacggaccaagaccttcacctatgacttttctttttattctgctgatacaaaaagcccagattacgtttcacaagaaatggttttcaaaaccctcggcacagatgtcgtgaagtctgcatttgaaggttataatgcttgtgtctttgcatatgggcaaactggatctggaaagtcatacactatgatgggaaattctggagattctggcttaatacctcggatctgtgaaggactcttcagtcggataaatgaaaccaccagatgggatgaagcttcttttcgaactgaagtcagctacttagaaatttataacgaacgtgtgagagatctacttcggcggaagtcatctaaaaccttcaatttgagagtccgtgagcatcccaaagaaggcccttatgttgaggatttatccaaacatttagtacagaattatggtgacgtagaagaacttatggatgcgggcaatatcaaccggaccaccgcagcgactgggatgaacgacgtcagtagcaggtctcatgccatcttcaccatcaagttcactcaggctaaatttgattctgaaatgccatgtgaaaccgtcagtaagatccacttggttgatcttgccggaagtgagcgtgcagatgccaccggagccaccggggttaggctaaaggaagggggaaatattaacaagtccctcgtgactctggggaacgtcatttctgccttagctgatttatctcaggatgctgcaaatactcttgcaaagaagaagcaagttttcgtgccttacagggattctgtgttgacttggttgttaaaagatagccttggaggaaactctaaaactatcatgattgccaccatttcacctgctgatgtcaattatggagaaaccctaagtactcttcgctatgcaaatagagccaaaaacatcatcaacaagcctaccattaatgaggatgccaacgtcaaacttatccgtgagctgcgagctgaaatagccagactgaaaacgctgcttgctcaagggaatcagattgccctcttagactcccccacagctttaagtatggaggaaaaacttcagcagaatgaagcaagagttcaagaattgaccaaggaatggacaaataagtggaatgaaacccaaaatattttgaaagaacaaactctagccctcaggaaagaagggattggagttgttttggattctgaactgcctcatttgattggcatcgatgatgaccttttgagtactggaatcatcttatatcatttaaaggaaggtcagacatacgttggtagagacgatgcttccacggagcaagatattgttcttcatggccttgacttggagagtgagcattgcatctttgaaaatatcggggggacagtgactctgatacccctgagtgggtcccagtgctctgtgaatggtgttcagatcgtggaggccacacatctaaatcaaggtgctgtgattctcttgggaagaaccaatatgtttcgctttaaccatccaaaggaagccgccaagctcagggagaagaggaagagtggccttctgtcctccttcagcttgtccatgaccgacctctcgaagtcccgtgagaacctgtctgcagtcatgttgtataaccccggacttgaatttgagaggcaacagcgtgaagaacttgaaaaattagaaagtaaaaggaaactcatagaagaaatggaggaaaagcagaaatcagacaaggctgaactggagcggatgcagcaggaggtggagacccagcgcaaggagacagaaatcgtgcagctccagattcgcaagcaggaggagagcctcaaacgccgcagcttccacatcgagaacaagctaaaggatttacttgcggagaaggaaaaatttgaagaggagaggctgagggaacagcaggaaatcgagctgcagaagaagagacaagaagaagagacctttctccgcgtccaagaagaactccaacgactcaaagaactcaacaacaacgagaaggctgagaagtttcagatatttcaagaactggaccagctccaaaaggaaaaagatgaacagtatgccaagcttgaactggaaaaaaagagactagaggagcaggagaaggagcaggtcatgctcgtggcccatctggaagagcagctccgagagaagcaggagatgatccagctcctgcggcgtggggaggtacagtgggtggaagaggagaagagggacctggaaggcattcgggaatccctcctgcgggtgaaggaggctcgtgccggaggggatgaagatggcgaggagttagaaaaggctcaactgcgtttcttcgaattcaagagaaggcagcttgtcaagctagtgaacttggagaaggacctggttcagcagaaagacatcctgaaaaaagaagtccaagaagaacaggagatcctagagtgtttaaaatgtgaacatgacaaagaatctagattgttggaaaaacatgatgagagtgtcacagatgtcacggaagtgcctcaagatttcgagaaaataaagccagtggagtacaggctgcaatataaagaacgccagctacagtacctcctgcagaatcacttgccaactctgttggaagaaaagcagagagcatttgaaattcttgacagaggccctctcagcttagacaacactctttatcaagtagaaaaggaaatggaagaaaaagaagaacagcttgcacagtaccaggccaatgcaaaccagctgcaaaagctccaagccacctttgaattcactgccaacattgcacgtcaggaggaaaaagtgaggaaaaaggaaaaggagattttggagtccagagagaagcagcagagagaggcgctggagcgggccctggccaggctggagaggagacattctgcgctgcagaggcactccaccctgggcanggagattgaagagcagaggcagaaacttgccagtctgaacagtggcagcagagagcagtcagggctccaggctagcctggaggctgagcaggaagccctggagaaggaccaggagaggttagaatatgaaatccagcagctgaaacagaagatttatgaggtcgatggtgttcaaaaagatcatcatgggaccctggaagggaaggtggcttcttccagcttgccagtcagtgctgaaaaatcacacctggttcccctcatggatgccaggatcaatgcttacattgaagaagaagtccaaagacgccttcaggatttgcatcgtgtgattagtgaaggctgcagtacatctgcagacacgatgaaggataatgagaaacttcacaatggcaccattcaacgtaaactaaaatatgagcggatggtttctcgctctttgggcgcaaatccagatgacctgaaggacccaattaaaattagtatcccacgctacgtcctctgcgggcaaggaaaggatgcacacttcgagtttgaggtcaagcttgctgcccttgaatttcctccaaagaaactatttggaaataaggatgaacgtgtgattgctgagagacgaagtcacttagagaaatacctcagggactttttcagcgtgatgctccagtccgcaacatctcccctccacatcaacaaagtgggactgactctctcgaaacataccatttgtgagttttcaccattcttcaagaaaggagtctttgactacagcagccacgggacggggtagagccaggggtgatggaggaaccaccacagcagtgccttctcgtcgaagcgggctccgatgcagggcagctcccccatgcgaggatccgggtctgcctcctcctgctgaagacagacatgcagcagcgggcccgggccacctcacgtttccatacctagtgcctgagtttggggatgggatgctctgcctgctgatgtggccctgacaggcagccgttaccgttccattgcggttgaacgtggccttttcccacagtgcttccttctcactgcgcagcaaagttcgtcccctgtggcaagatagatgtggttgggccatcgtgggttccctgagcccagccagcctgggacctcccaaagtgggtggcttaccagaccacccttaaatgactttcatctggtttcctctttcaccaaaatatactcgtattttttatatttcttccatgtggctggctatattccaagaaaagcattttaaattatttcattgtatttttttctttttttccctcatttgaatcagaacttttatataaaacccaaacactgatgtttacacagaatttcatattctgcaaaagggattttttgatccaatcatgactgtagtcttccatgcttgacaaattggatgtagacaacattacttaaaacttctataaatccctacaattaggatatttatttaaccttgaatattcaagaacattctcccaaatctaaatggctactgtgcattcttgagctttttctgctaagcacaaaatgaacgcaaagctaaatgcatatttttaagtattattcacattttttgttacagaatctattggatctttggctggaaaactagaatttatagcagtttattaatgataccttaaattactcaggacttaatgtagcattgcacttctgtgtacagtaaaactgctttgttttactaaagagaaaaatgtgagtggaaaaaatatgtatgtggtatatactcaaatgtatataattctatctatagatttatatatgtatacattctgtacagtagttccatcaaaatatgtaataattcacaccaattttattaaatgtatttgctttttcaaaatttaaattgagctgctatcaatattaaatgaagttatggcatctaccctgtagctcagctt

SEQ ID NO: 427057 - DNA, 5087 bp, Homo sapiens
  misc_feature (3171)..(3171): n is a, c, g, or t
ggcgggagccgcgatctgagtagccagcgtcgccggcgaccgcggagttctgggctagtgggaccccgcgcgggctggttcgggatgagcgatggcatcggtcaaggtggccgtgagggtccggcccatgaatcgcagggaaaaggacttggaggccaagttcattattcagatggagaaaagcaaaacgacaatcacaaacttaaagataccagaaggaggcactggggactcaggaagagaacggaccaagaccttcacctatgacttttctttttattctgctgatacaaaaagcccagattacgtttcacaagaaatggttttcaaaaccctcggcacagatgtcgtgaagtctgcatttgaaggttataatgcttgtgtctttgcatatgggcaaactggatctggaaagtcatacactatgatgggaaattctggagattctggcttaatacctcggatctgtgaaggactcttcagtcggataaatgaaaccaccagatgggatgaagcttcttttcgaactgaagtcagctacttagaaatttataacgaacgtgtgagagatctacttcggcggaagtcatctaaaaccttcaatttgagagtccgtgagcatcccaaagaaggcccttatgttgaggatttatccaaacatttagtacagaattatggtgacgtagaagaacttatggatgcgggcaatatcaaccggaccaccgcagcgactgggatgaacgacgtcagtagcaggtctcatgccatcttcaccatcaagttcactcaggctaaatttgattctgaaatgccatgtgaaaccgtcagtaagatccacttggttgatcttgccggaagtgagcgtgcagatgccaccggagccaccggggttaggctaaaggaagggggaaatattaacaagtccctcgtgactctggggaacgtcatttctgccttagctgatttatctcaggatgctgcaaatactcttgcaaagaagaagcaagttttcgtgccttacagggattctgtgttgacttggttgttaaaagatagccttggaggaaactctaaaactatcatgattgccaccatttcacctgctgatgtcaattatggagaaaccctaagtactcttcgctatgcaaatagagccaaaaacatcatcaacaagcctaccattaatgaggatgccaacgtcaaacttatccgtgagctgcgagctgaaatagccagactgaaaacgctgcttgctcaagggaatcagattgccctcttagactcccccacagctttaagtatggaggaaaaacttcagcagaatgaagcaagagttcaagaattgaccaaggaatggacaaataagtggaatgaaacccaaaatattttgaaagaacaaactctagccctcaggaaagaagggattggagttgttttggattctgaactgcctcatttgattggcatcgatgatgaccttttgagtactggaatcatcttatatcatttaaaggaaggtcagacatacgttggtagagacgatgcttccacggagcaagatattgttcttcatggccttgacttggagagtgagcattgcatctttgaaaatatcggggggacagtgactctgatacccctgagtgggtcccagtgctctgtgaatggtgttcagatcgtggaggccacacatctaaatcaaggtgctgtgattctcttgggaagaaccaatatgtttcgctttaaccatccaaaggaagccgccaagctcagggagaagaggaagagtggccttctgtcctccttcagcttgtccatgaccgacctctcgaagtcccgtgagaacctgtctgcagtcatgttgtataaccccggacttgaatttgagaggcaacagcgtgaagaacttgaaaaattagaaagtaaaaggaaactcatagaagaaatggaggaaaagcagaaatcagacaaggctgaactggagcggatgcagcaggaggtggagacccagcgcaaggagacagaaatcgtgcagctccagattcgcaagcaggaggagagcctcaaacgccgcagcttccacatcgagaacaagctaaaggatttacttgcggagaaggaaaaatttgaagaggagaggctgagggaacagcaggaaatcgagctgcagaagaagagacaagaagaagagacctttctccgcgtccaagaagaactccaacgactcaaagaactcaacaacaacgagaaggctgagaagtttcagatatttcaagaactggaccagctccaaaaggaaaaagatgaacagtatgccaagcttgaactggaaaaaaagagactagaggagcaggagaaggagcaggtcatgctcgtggcccatctggaagagcagctccgagagaagcaggagatgatccagctcctgcggcgtggggaggtacagtgggtggaagaggagaagagggacctggaaggcattcgggaatccctcctgcgggtgaaggaggctcgtgccggaggggatgaagatggcgaggagttagaaaaggctcaactgcgtttcttcgaattcaagagaaggcagcttgtcaagctagtgaacttggagaaggacctggttcagcagaaagacatcctgaaaaaagaagtccaagaagaacaggagatcctagagtgtttaaaatgtgaacatgacaaagaatctagattgttggaaaaacatgatgagagtgtcacagatgtcacggaagtgcctcaagatttcgagaaaataaagccagtggagtacaggctgcaatataaagaacgccagctacagtacctcctgcagaatcacttgccaactctgttggaagaaaagcagagagcatttgaaattcttgacagaggccctctcagcttagacaacactctttatcaagtagaaaaggaaatggaagaaaaagaagaacagcttgcacagtaccaggccaatgcaaaccagctgcaaaagctccaagccacctttgaattcactgccaacattgcacgtcaggaggaaaaagtgaggaaaaaggaaaaggagattttggagtccagagagaagcagcagagagaggcgctggagcgggccctggccaggctggagaggagacattctgcgctgcagaggcactccaccctgggcanggagattgaagagcagaggcagaaacttgccagtctgaacagtggcagcagagagcagtcagggctccaggctagcctggaggctgagcaggaagccctggagaaggaccaggagaggttagaatatgaaatccagcagctgaaacagaagatttatgaggtcgatggtgttcaaaaagatcatcatgggaccctggaagggaaggtggcttcttccagcttgccagtcagtgctgaaaaatcacacctggttcccctcatggatgccaggatcaatgcttacattgaagaagaagtccaaagacgccttcaggatttgcatcgtgtgattagtgaaggctgcagtacatctgcagacacgatgaaggataatgagaaacttcacaatggcaccattcaacgtaaactaaaatatgagattactgtcctagatgagacatggactgtattcaggcgttacagtcgttttcgagaaatgcataaaacattgaagttaaagtatgcagagcttgctgcccttgaatttcctccaaagaaactatttggaaataaggatgaacgtgtgattgctgagagacgaagtcacttagagaaatacctcagggactttttcagcgtgatgctccagtccgcaacatctcccctccacatcaacaaagtgggactgactctctcgaaacataccatttgtgagttttcaccattcttcaagaaaggagtctttgactacagcagccacgggacggggtagagccaggggtgatggaggaaccaccacagcagtgccttctcgtcgaagcgggctccgatgcagggcagctcccccatgcgaggatccgggtctgcctcctcctgctgaagacagacatgcagcagcgggcccgggccacctcacgtttccatacctagtgcctgagtttggggatgggatgctctgcctgctgatgtggccctgacaggcagccgttaccgttccattgcggttgaacgtggccttttcccacagtgcttccttctcactgcgcagcaaagttcgtcccctgtggcaagatagatgtggttgggccatcgtgggttccctgagcccagccagcctgggacctcccaaagtgggtggcttaccagaccacccttaaatgactttcatctggtttcctctttcaccaaaatatactcgtattttttatatttcttccatgtggctggctatattccaagaaaagcattttaaattatttcattgtatttttttctttttttccctcatttgaatcagaacttttatataaaacccaaacactgatgtttacacagaatttcatattctgcaaaagggattttttgatccaatcatgactgtagtcttccatgcttgacaaattggatgtagacaacattacttaaaacttctataaatccctacaattaggatatttatttaaccttgaatattcaagaacattctcccaaatctaaatggctactgtgcattcttgagctttttctgctaagcacaaaatgaacgcaaagctaaatgcatatttttaagtattattcacattttttgttacagaatctattggatctttggctggaaaactagaatttatagcagtttattaatgataccttaaattactcaggacttaatgtagcattgcacttctgtgtacagtaaaactgctttgttttactaaagagaaaaatgtgagtggaaaaaatatgtatgtggtatatactcaaatgtatataattctatctatagatttatatatgtatacattctgtacagtagttccatcaaaatatgtaataattcacaccaattttattaaatgtatttgctttttcaaaatttaaattgagctgctatcaatattaaatgaagttatggcatctaccctgtagctcagctt

SEQ ID NO: 427058 - DNA, 1658 bp, Homo sapiens
ggcgggagccgcgatctgagtagccagcgtcgccggcgaccgcggagttctgggctagtgggaccccgcgcgggctggttcgggatgagcgatggcatcggtcaaggtggccgtgagggtccggcccatgaatcgcagggaaaaggacttggaggccaagttcattattcagatggagaaaagcaaaacgacaatcacaaacttaaagataccagaaggaggcactggggactcaggaagagaacggaccaagaccttcacctatgacttttctttttattctgctgatacaaaaagcccagattacgtttcacaagaaatggttttcaaaaccctcggcacagatgtcgtgaagtctgcatttgaaggttataatgcttgtgtctttgcatatgggcaaactggatctggaaagtcatacactatgatgggaaattctggagattctggcttaatacctcggatctgtgaaggactcttcagtcggataaatgaaaccaccagatgggatgaagcttcttttcgaactgaagtcagctacttagaaatttataacgaacgtgtgagagatctacttcggcggaagtcatctaaaaccttcaatttgagagtccgtgagcatcccaaagaaggcccttatgttgaggatttatccaaacatttagtacagaattatggtgacgtagaagaacttatggatgcgggcaatatcaaccggaccaccgcagcgactgggatgaacgacgtcagtagcaggtctcatgccatcttcaccatcaagttcactcaggctaaatttgattctgaaatgccatgtgaaaccgtcagtaagatccacttggttgatcttgccggaagtgagcgtgcagatgccaccggagccaccggggttaggctaaaggaagggggaaatattaacaagtccctcgtgactctggggaacgtcatttctgccttagctgatttatctcaggatgctgcaaatactcttgcaaagaagaagcaagttttcgtgccttacagggattctgtgttgacttggttgttaaaagatagccttggaggaaactctaaaactatcatgattgccaccatttcacctgctgatgtcaattatggagaaaccctaagtactcttcgctatgcaaatagagccaaaaacatcatcaacaagcctaccattaatgaggatgccaacgtcaaacttatccgtgagctgcgagctgaaatagccagactgaaaacgctgcttgctcaagggaatcaggggtttttctgagatttatggataattttctttgagtaatggcatctatttctagatcttaatgagacaattttctcactcatgctattgatttgagtaaataagtgctaagtaaagctttgaatgagttagccagtccctcgtttacatcaacctcttgtcagcctttgcattcattacgggctgcatgtgtaagattttatccactaaacctgaaatgattaactctctaatagttatcaattatgaatggaaatgtactatgcaataggattaatggcataatctctttaagtggaaagaaattgatatgcttagaatagtatttaaaatttcacccatgcattttatgactttaaaatgtgttttaacagaataaaagacttgttcg

SEQ ID NO: 427059 - DNA, 1883 bp, Homo sapiens
ggcgggagccgcgatctgagtagccagcgtcgccggcgaccgcggagttctgggctagtgggaccccgcgcgggctggttcgggatgagcgatggcatcggtcaaggtggccgtgagggtccggcccatgaatcgcagggaaaaggacttggaggccaagttcattattcagatggagaaaagcaaaacgacaatcacaaacttaaagataccagaaggaggcactggggactcaggaagagaacggaccaagaccttcacctatgacttttctttttattctgctgatacaaaaagcccagattacgtttcacaagaaatggttttcaaaaccctcggcacagatgtcgtgaagtctgcatttgaaggttataatgcttgtgtctttgcatatgggcaaactggatctggaaagtcatacactatgatgggaaattctggagattctggcttaatacctcggatctgtgaaggactcttcagtcggataaatgaaaccaccagatgggatgaagcttcttttcgaactgaagtcagctacttagaaatttataacgaacgtgtgagagatctacttcggcggaagtcatctaaaaccttcaatttgagagtccgtgagcatcccaaagaaggcccttatgttgaggatttatccaaacatttagtacagaattatggtgacgtagaagaacttatggatgcgggcaatatcaaccggaccaccgcagcgactgggatgaacgacgtcagtagcaggtctcatgccatcttcaccatcaagttcactcaggctaaatttgattctgaaatgccatgtgaaaccgtcagtaagatccacttggttgatcttgccggaagtgagcgtgcagatgccaccggagccaccggggttaggctaaaggaagggggaaatattaacaagtccctcgtgactctggggaacgtcatttctgccttagctgatttatctcaggatgctgcaaatactcttgcaaagaagaagcaagttttcgtgccttacagggattctgtgttgacttggttgttaaaagatagccttggaggaaactctaaaactatcatgattgccaccatttcacctgctgatgtcaattatggagaaaccctaagtactcttcgctatgcaaatagagccaaaaacatcatcaacaagcctaccattaatgaggatgccaacgtcaaacttatccgtgagctgcgagctgaaatagccagactgaaaacgctgcttgctcaagggaatcagagtggtcccgttggagcagtgctttccacgtgggattatgtggcacttgaagctcttggcatcccataaatgttttgaaaatactgatgggatgaaaacctcactgaatttcctgtgtcctgaaatgtacctggcagttctttcccacaagatggtggacagcagttgaataggaattgttcattgtgcttaaaaatatctccacatgcattttgctctatggtggaagttgtcagaatgaagagtccagctccacgtgatgaggcccttataacatgaaccacaatagtcatttttatttatacaccttgttattggaatctttttcttttcttttctttttgagatagagtctcactgtgttgcccaggctggagtgcagtgatgcaatctgggctcactgcaacctccacctccagggttcaagtaattctcatgcctcagcctcctgagtagctgggaggtgcctgccaccatgcctggctaatttttttgtatttttggtagagacggggtttcacgacgtgaccagtctggtctggaactcctgacctcaagtgatctgcccgccttggcctcccaaagtgttgggattacaggtgtgagccaccgcgcc

SEQ ID NO: 427060 - DNA, 1614 bp, Homo sapiens
ggcgggagccgcgatctgagtagccagcgtcgccggcgaccgcggagttctgggctagtgggaccccgcgcgggctggttcgggatgagcgatggcatcggtcaaggtggccgtgagggtccggcccatgaatcgcagggaaaaggacttggaggccaagttcattattcagatggagaaaagcaaaacgacaatcacaaacttaaagataccagaaggaggcactggggactcaggaagagaacggaccaagaccttcacctatgacttttctttttattctgctgatacaaaaagcccagattacgtttcacaagaaatggttttcaaaaccctcggcacagatgtcgtgaagtctgcatttgaaggttataatgcttgtgtctttgcatatgggcaaactggatctggaaagtcatacactatgatgggaaattctggagattctggcttaatacctcggatctgtgaaggactcttcagtcggataaatgaaaccaccagatgggatgaagcttcttttcgaactgaagtcagctacttagaaatttataacgaacgtgtgagagatctacttcggcggaagtcatctaaaaccttcaatttgagagtccgtgagcatcccaaagaaggcccttatgttgaggatttatccaaacatttagtacagaattatggtgacgtagaagaacttatggatgcgggcaatatcaaccggaccaccgcagcgactgggatgaacgacgtcagtagcaggtctcatgccatcttcaccatcaagttcactcaggctaaatttgattctgaaatgccatgtgaaaccgtcagtaagatccacttggttgatcttgccggaagtgagcgtgcagatgccaccggagccaccggggttaggctaaaggaagggggaaatattaacaagtccctcgtgactctggggaacgtcatttctgccttagctgatttatctcaggatgctgcaaatactcttgcaaagaagaagcaagttttcgtgccttacagggattctgtgttgacttggttgttaaaagatagccttggaggaaactctaaaactatcatgattgccaccatttcacctgctgatgtcaattatggagaaaccctaagtactcttcgctatgcaaatagagccaaaaacatcatcaacaagcctaccattaatgaggatgccaacgtcaaacttatccgtgagctgcgaggggtttttctgagatttatggataattttctttgagtaatggcatctatttctagatcttaatgagacaattttctcactcatgctattgatttgagtaaataagtgctaagtaaagctttgaatgagttagccagtccctcgtttacatcaacctcttgtcagcctttgcattcattacgggctgcatgtgtaagattttatccactaaacctgaaatgattaactctctaatagttatcaattatgaatggaaatgtactatgcaataggattaatggcataatctctttaagtggaaagaaattgatatgcttagaatagtatttaaaatttcacccatgcattttatgactttaaaatgtgttttaacagaataaaagacttgttcg

SEQ ID NO: 427061 - DNA, 389 bp, Homo sapiens
tggacagagtgttcgattcctgagctctgcagagggtcttctgctcactgtattcagttacaacaaatacctctctcaacagctgtgtcgtgacctcctgtgtgtcctgatgccagagcctgatgccgctgcctgcgctaatcatcccttgctccagcaagatctggttcagctttctcttgattggaaaacagaaatccctgatttagttttgccaaatggagttcaggtgtcatccaaattccagactaccttggttgacatgatttactttcttcatggaaatatggaagtcaatgtcccttccctggcagaagttcagttactgctctacacaacagtgaaagtcatgggtgactctggccatgaccagtgccagtcgctagtcc

SEQ ID NO: 427062 - DNA, 1661 bp, Homo sapiens
  misc_feature (22)..(22): n is a, c, g, or t
  misc_feature (24)..(24): n is a, c, g, or t
  misc_feature (29)..(29): n is a, c, g, or t
aattaggctaggtacgaggccngngtttnagcagcggctccctcccggaaagcgagcgtatctcccgagccgttgccactgacagccgcgggcgctcccatctgagtaagagccagcccgtccgcggcctctccagccccgggttcgcgctctcgactctcctgcctgcccagctgcgcggcggagcggagcgaggcgcggcctgcgagtccccggcagcccccgacccctccctcggcgctgcgtgtaggccgcgccctcaggcccagtccgcggtgccccggcgggtgatgccaaatacagccatgaagaaaaaggtgctgctgatggggaagagcgggtcggggaagaccagcatgaggtcgataatcttcgccaattacattgctcgcgacacccggcgcctgggggccaccattgacgtggaacactcccacgtccgattcctagggaacctggtgctgaacctgtgggactgtggcggtcaggacaccttcatggaaaattacttcaccagccagcgagacaatatcttccgtaacgtggaagttttgatttacgtgtttgacgtggagagccgcgaactggaaaaggacatgcattattaccagtcgtgtctggaggccatcctccagaactctcctgacgccaaaatcttctgcctggtgcacaaaatggatctggttcaggaggatcagcgtgacctgatttttaaagagcgagaggaagacctgaggcgtctgtctcgcccgctggagtgtgcttgttttcgaacgtccatctgggatgagacgctctacaaagcctggtccagcatcgtctaccagctgattcccaacgttcagcagctggagatgaacctcaggaattttgcccaaatcattgaggccgatgaagttctgctgttcgaaagagctacattcttggttatttcccactaccagtgcaaagagcagcgcgacgtccaccggtttgagaagatcagcaacatcatcaaacagttcaagctgagctgcagtaaattggccgcttccttccagagcatggaagttaggaattccaacttcgctgctttcatcgacatcttcacctcaaatacgtacgtgatggtggtcatgtcagatccgtcgatcccttctgcggccactctgatcaacattcgcaatgcccggaaacactttgagaagctggagagagtggatggccccaagcacagtctccttatgcgttgaatattgccaaatgctctttctgaaaatgctgaattgccttttttgtttgcatcctttatttttaatattcataatgtcgtgtgcttaaaagtgggctttgaagtgtgtgctgcttactcctttcatctttctccccgcttccccagtctttaaacattggacgctatttactcagctacccagtagagcttgaagctgacctttctgagaagttggtatggtgtaacactaaagtaggtggttcgtgtgtgttctcattacctggttatgatagatatgcacatcaaagcctttaccagtatcttcctgtattccgtatcagattgcaaagacggaatgttactattttatcagcaaggtattaaaatgcatttataaattcttcttggcttcattcatgaataaacgtgttagcaatttaaaaaaaat

SEQ ID NO: 427063 - DNA, 1628 bp, Homo sapiens
ggaaagagataggctaggtcaggctggtgttaattggcaacgaggctgacagccgcgggcgctcccatctgagtaagagccagcccgtccgcggcctctccagccccgggttcgcgctctcgactctcctgcctgcccagctgcgcggcggagcggagcgaggcgcggcctgcgagtccccggcagcccccgacccctccctcggcgctgcgtgtaggccgcgccctcaggcccagtccgcggtgccccggcgggtgatgccaaatacagccatgaagaaaaaggtgctgctgatggggaagagcgggtcggggaagaccagcatgaggtcgataatcttcgccaattacattgctcgcgacacccggcgcctgggggccaccattgacgtggaacactcccacgtccgattcctagggaacctggtgctgaacctgtgggactgtggcggtcaggacaccttcatggaaaattacttcaccagccagcgagacaatatcttccgtaacgtggaagttttgatttacgtgtttgacgtggagagccgcgaactggaaaaggacatgcattattaccagtcgtgtctggaggccatcctccagaactctcctgacgccaaaatcttctgcctggtgcacaaaatggatctggttcaggaggatcagcgtgacctgatttttaaagagcgagaggaagacctgaggcgtctgtctcgcccgctggagtgtgcttgttttcgaacgtccatctgggatgagacgctctacaaagcctggtccagcatcgtctaccagctgattcccaacgttcagcagctggagatgaacctcaggaattttgcccaaatcattgaggccgatgaagttctgctgttcgaaagagctacattcttggttatttcccactaccagtgcaaagagcagcgcgacgtccaccggtttgagaagatcagcaacatcatcaaacagttcaagctgagctgcagtaaattggccgcttccttccagagcatggaagttaggaattccaacttcgctgctttcatcgacatcttcacctcaaatacgtacgtgatggtggtcatgtcagatccgtcgatcccttctgcggccactctgatcaacattcgcaatgcccggaaacactttgagaagctggagagagtggatggccccaagcacagtctccttatgcgttgaatattgccaaatgctctttctgaaaatgctgaattgccttttttgtttgcatcctttatttttaatattcataatgtcgtgtgcttaaaagtgggctttgaagtgtgtgctgcttactcctttcatctttctccccgcttccccagtctttaaacattggacgctatttactcagctacccagtagagcttgaagctgacctttctgagaagttggtatggtgtaacactaaagtaggtggttcgtgtgtgttctcattacctggttatgatagatatgcacatcaaagcctttaccagtatcttcctgtattccgtatcagattgcaaagacggaatgttactattttatcagcaaggtattaaaatgcatttataaattcttcttggcttcattcatgaataaacgtgttagcaatttaaaaaaaat

SEQ ID NO: 427064 - DNA, 1567 bp, Homo sapiens
tgtacgggtcggaagttatgggcccgtccgcggcctctccagccccgggttcgcgctctcgactctcctgcctgcccagctgcgcggcggagcggagcgaggcgcggcctgcgagtccccggcagcccccgacccctccctcggcgctgcgtgtaggccgcgccctcaggcccagtccgcggtgccccggcgggtgatgccaaatacagccatgaagaaaaaggtgctgctgatggggaagagcgggtcggggaagaccagcatgaggtcgataatcttcgccaattacattgctcgcgacacccggcgcctgggggccaccattgacgtggaacactcccacgtccgattcctagggaacctggtgctgaacctgtgggactgtggcggtcaggacaccttcatggaaaattacttcaccagccagcgagacaatatcttccgtaacgtggaagttttgatttacgtgtttgacgtggagagccgcgaactggaaaaggacatgcattattaccagtcgtgtctggaggccatcctccagaactctcctgacgccaaaatcttctgcctggtgcacaaaatggatctggttcaggaggatcagcgtgacctgatttttaaagagcgagaggaagacctgaggcgtctgtctcgcccgctggagtgtgcttgttttcgaacgtccatctgggatgagacgctctacaaagcctggtccagcatcgtctaccagctgattcccaacgttcagcagctggagatgaacctcaggaattttgcccaaatcattgaggccgatgaagttctgctgttcgaaagagctacattcttggttatttcccactaccagtgcaaagagcagcgcgacgtccaccggtttgagaagatcagcaacatcatcaaacagttcaagctgagctgcagtaaattggccgcttccttccagagcatggaagttaggaattccaacttcgctgctttcatcgacatcttcacctcaaatacgtacgtgatggtggtcatgtcagatccgtcgatcccttctgcggccactctgatcaacattcgcaatgcccggaaacactttgagaagctggagagagtggatggccccaagcacagtctccttatgcgttgaatattgccaaatgctctttctgaaaatgctgaattgccttttttgtttgcatcctttatttttaatattcataatgtcgtgtgcttaaaagtgggctttgaagtgtgtgctgcttactcctttcatctttctccccgcttccccagtctttaaacattggacgctatttactcagctacccagtagagcttgaagctgacctttctgagaagttggtatggtgtaacactaaagtaggtggttcgtgtgtgttctcattacctggttatgatagatatgcacatcaaagcctttaccagtatcttcctgtattccgtatcagattgcaaagacggaatgttactattttatcagcaaggtattaaaatgcatttataaattcttcttggcttcattcatgaataaacgtgttagcaatttaaaaaaaat

SEQ ID NO: 427065 - DNA, 1696 bp, Homo sapiens
  misc_feature (22)..(22): n is a, c, g, or t
  misc_feature (24)..(24): n is a, c, g, or t
  misc_feature (29)..(29): n is a, c, g, or t
aattaggctaggtacgaggccngngtttnagcagcggctccctcccggaaagcgagcgtatctcccgagccgttgccactgacagccgcgggcgctcccatctgagtaagagccagcccgtccgcggcctctccagccccgggttcgcgctctcgactctcctgcctgcccagctgcgcggcggagcggagcgaggcgcggcctgcgagtccccggcagcccccgacccctccctcggcgctgcgtgtaggccgcgccctcaggcccagtccgcggtgccccggcgggtgatgccaaatacagccatgaagaaaaaggtgctgctgatggggaagagcgggtcggggaagaccagcatgaggtcgataatcttcgccaattacattgctcgcgacacccggcgcctgggggccaccattgacgtggaacactcccacgtccgattcctagggaacctggtgctgaacctgtgggactgtggcggtcaggacaccttcatggaaaattacttcaccagccagcgagacaatatcttccgtaacgtggaagttttgatttacgtgtttgacgtggagagccgcgaactggaaaaggacatgcattattaccagtcgtgtctggaggccatcctccagaactctcctgacgccaaaatcttctgcctggtgcacaaaatggatctggttcaggaggatcagcgtgacctgatttttaaagagcgagaggaagacctgaggcgtctgtctcgcccgctggagtgtgcttgttttcgaacgtccatctgggatgagacgctctacaaagcctggtccagcatcgtctaccagctgattcccaacgttcagcagctggagatgaacctcaggaattttgcccaaatcattgaggccgatgaagttctgctgttcgaaagagctacattcttggttatttcccactaccagtgcaaagagcagcgcgacgtccaccggtttgagaagatcagcaacatcatcaaacagttcaagctgagctgcagtaaattggccgcttccttccagagcatggaagttaggaattccaacttcgctgctttcatcgacatcttcacctcaaatacgtacgtgatggtggtcatgtcagatccgtcgatcccttctgcggccactctgatcaacattcgcaatgcccggaaacactttgagaagctggagagagtggatggccccaagcacagtctccttatgcgttgaatattgccaaatgctctttctgaaaatgctgaattgccttttttgtttgcatcctttatttttaatattcataatgtcgtgtgcttaaaagtgggctttgaagtgtgtgctgcttactcctttcatctttctccccgcttccccagtctttaaacattggacgctatttactcagctacccagtagagcttgaagctgacctttctgagaagttggtatggtgtaacactaaagtaggtggttcgtgtgtgttctcattacctggttatgatagatatgcacatcaaagcctttaccagtatcttcctgtattccgtatcagattgcaaagacggaatgttactattttatcagcaaggtcagcttcaagctctactgggtagctgagtaaatagcgtccaatgtttaaagactggggaagcggggagaaagagtcgacgcgcctgcgaatttagtagtagtag

SEQ ID NO: 427066 - DNA, 1580 bp, Homo sapiens
  misc_feature (22)..(22): n is a, c, g, or t
  misc_feature (24)..(24): n is a, c, g, or t
  misc_feature (29)..(29): n is a, c, g, or t
aattaggctaggtacgaggccngngtttnagcagcggctccctcccggaaagcgagcgtatctcccgagccgttgccactgacagccgcgggcgctcccatctgagtaagagccagcccgtccgcggcctctccagccccgggttcgcgctctcgactctcctgcctgcccagctgcgcggcggagcggagcgaggcgcggcctgcgagtccccggcagcccccgacccctccctcggcgctgcgtgtaggccgcgccctcaggcccagtccgcggtgccccggcgggtgatgccaaatacagccatgaagaaaaaggtgctgctgatggggaagagcgggtcggggaagaccagcatgaggtcgataatcttcgccaattacattgctcgcgacacccggcgcctgggggccaccattgacgtggaacactcccacgtccgattcctagggaacctggtgctgaacctgtgggactgtggcggtcaggacaccttcatggaaaattacttcaccagccagcgagacaatatcttccgtaacgtggaagttttgatttacgtgtttgacgtggagagccgcgaactggaaaaggacatgcattattaccagtcgtgtctggaggccatcctccagaactctcctgacgccaaaatcttctgcctggtgcacaaaatggatctggttcaggaggatcagcgtgacctgatttttaaagagcgagaggaagacctgaggcgtctgtctcgcccgctggagtgtgcttgttttcgaacgtccatctgggatgagacgctctacaaagcctggtccagcatcgtctaccagctgattcccaacgttcagcagctggagatgaacctcaggaattttgcccaaatcattgaggccgatgaagttctgctgttcgaaagagctacattcttggttatttcccactaccagtgcaaagagcagcgcgacgtccaccggtttgagaagatcagcaacatcatcaaacagttcaagctgagctgcagtaaattggccgcttccttccagagcatggaagttaggaattccaacttcgctgctttcatcgacatcttcacctcaaatacgtacgtgatggtggtcatgtcagatccgtcgatcccttctgcggccactctgatcaacattcgcaatgcccggaaacactttgagaagctggagagagtggatggccccaagcacagtctccttatgcgttgaatattgccaaatgctctttctgaaaatgctgaattgccttttttgtttgcatcctttatttttaatattcataatgtcgtgtgcttaaaagtgggctttgaagtgtgtgctgcttactcctttcatctttctccccgcttccccagtctttaaacattggacgctatttactcagctacccagtagagcttgaagctgacctttctgagaagttggtatggtgtaacactaaagtaggtggttcgtgtgtacggaatgttactattttatcagcaaggtattaaaatgcatttataaattcttcttggcttcattcatgaataaacgtgttagcaatttaaaaaaaat

SEQ ID NO: 427067 - DNA, 1607 bp, Homo sapiens
  misc_feature (22)..(22): n is a, c, g, or t
  misc_feature (24)..(24): n is a, c, g, or t
  misc_feature (29)..(29): n is a, c, g, or t
aattaggctaggtacgaggccngngtttnagcagcggctccctcccggaaagcgagcgtatctcccgagccgttgccactgacagccgcgggcgctcccatctgagtaagagccagcccgtccgcggcctctccagccccgggttcgcgctctcgactctcctgcctgcccagctgcgcggcggagcggagcgaggcgcggcctgcgagtccccggcagcccccgacccctccctcggcgctgcgtgtaggccgcgccctcaggcccagtccgcggtgccccggcgggtgatgccaaatacagccatgaagaaaaaggtgctgctgatggggaagagcgggtcggggaagaccagcatgaggtcgataatcttcgccaattacattgctcgcgacacccggcgcctgggggccaccattgacgtggaacactcccacgtccgattcctagggaacctggtgctgaacctgtgggactgtggcggtcaggacaccttcatggaaaattacttcaccagccagcgagacaatatcttccgtaacgtggaagttttgatttacgtgtttgacgtggagagccgcgaactggaaaaggacatgcattattaccagtcgtgtctggaggccatcctccagaactctcctgacgccaaaatcttctgcctggtgcacgaagacctgaggcgtctgtctcgcccgctggagtgtgcttgttttcgaacgtccatctgggatgagacgctctacaaagcctggtccagcatcgtctaccagctgattcccaacgttcagcagctggagatgaacctcaggaattttgcccaaatcattgaggccgatgaagttctgctgttcgaaagagctacattcttggttatttcccactaccagtgcaaagagcagcgcgacgtccaccggtttgagaagatcagcaacatcatcaaacagttcaagctgagctgcagtaaattggccgcttccttccagagcatggaagttaggaattccaacttcgctgctttcatcgacatcttcacctcaaatacgtacgtgatggtggtcatgtcagatccgtcgatcccttctgcggccactctgatcaacattcgcaatgcccggaaacactttgagaagctggagagagtggatggccccaagcacagtctccttatgcgttgaatattgccaaatgctctttctgaaaatgctgaattgccttttttgtttgcatcctttatttttaatattcataatgtcgtgtgcttaaaagtgggctttgaagtgtgtgctgcttactcctttcatctttctccccgcttccccagtctttaaacattggacgctatttactcagctacccagtagagcttgaagctgacctttctgagaagttggtatggtgtaacactaaagtaggtggttcgtgtgtgttctcattacctggttatgatagatatgcacatcaaagcctttaccagtatcttcctgtattccgtatcagattgcaaagacggaatgttactattttatcagcaaggtattaaaatgcatttataaattcttcttggcttcattcatgaataaacgtgttagcaatttaaaaaaaat

SEQ ID NO: 427068 - DNA, 918 bp, Homo sapiens
caggggttacaatgagtgtgatgcgtattataccatagccgcctactgtcaagagtactgcggcagtactattgacccagcgatgggggcttcgacatgggctttagcggagtcataagtggagtccgaaaacggcatcttcatcgggatgaagatgccgtgttcgaaagagctacattcttggttatttcccactaccagtgcaaagagcagcgcgacgtccaccggtttgagaagatcagcaacatcatcaaacagttcaagctgagctgcagtaaattggccgcttccttccagagcatggaagttaggaattccaacttcgctgctttcatcgacatcttcacctcaaatacgtacgtgatggtggtcatgtcagatccgtcgatcccttctgcggccactctgatcaacattcgcaatgcccggaaacactttgagaagctggagagagtggatggccccaagcacagtctccttatgcgttgaatattgccaaatgctctttctgaaaatgctgaattgccttttttgtttgcatcctttatttttaatattcataatgtcgtgtgcttaaaagtgggctttgaagtgtgtgctgcttactcctttcatctttctccccgcttccccagtctttaaacattggacgctatttactcagctacccagtagagcttgaagctgacctttctgagaagttggtatggtgtaacactaaagtaggtggttcgtgtgtgttctcattacctggttatgatagatatgcacatcaaagcctttaccagtatcttcctgtattccgtatcagattgcaaagacggaatgttactattttatcagcaaggtattaaaatgcatttataaattcttcttggcttcattcatgaataaacgtgttagcaatttaaaaaaaat

SEQ ID NO: 427069 - DNA, 2427 bp, Homo sapiens
cggaagctgggcatctgcagctggctcggcgcactccactgaccgtcccgacgatgctacgcgcgcccggctgcctcctccggacctccgtagcgcctgccgcggccctggctgcggcgctgctctcgtcgcttgcgcgctgctctcttctagagccgagggacccggtggcctcgtcgctcagcccctatttcggcaccaagactcgctacgaggatgtcaaccccgtgctattgtcgggccccgaggctccgtggcgggaccctgagctgctggaggggacctgcaccccggtgcagctggtcgccctcattcgccacggcacccgctaccccacggtcaaacagatccgcaagctgaggcagctgcacgggttgctgcaggcccgcgggtccagggatggcggggctagtagtaccggcagccgcgacctgggtgcagcgctggccgactggcctttgtggtacgcggactggatggacgggcagctagtagagaagggacggcaggatatgcgacagctggcgctgcgtctggcctcgctcttcccggcccttttcagccgtgagaactacggccgcctgcggctcatcaccagttccaagcaccgctgcatggatagcagcgccgccttcctgcaggggctgtggcagcactaccaccctggcttgccgccgccggacgtcgcagatatggagtttggacctccaacagttaatgataaactaatgagattttttgatcactgtgagaagtttttaactgaagtagaaaaaaatgctacagctctttatcacgtggaagccttcaaaactggaccagaaatgcagaacattttaaaaaaagttgcagctactttgcaagtgccagtaaatgatttaaatgcagatttaattcaagtagcctttttcacctgttcatttgacctggcaattaaaggtgttaaatctccttggtgtgatgtttttgacatagatgatgcaaaggtattagaatatttaaatgatctgaaacaatattggaaaagaggatatgggtatactattaacagtcgatccagctgcaccttgtttcaggatatctttcagcacttggacaaagcagttgaacagaaacaaaggtctcagccaatttcttctccagtcatcctccagtttggtcatgcagagactcttcttccactgctttctctcatgggctacttcaaagacaaggaacccctaacagcgtacaattacaaaaaacaaatgcatcggaagttccgaagtggtctcattgtaccttatgcctcgaacctgatatttgtgctttaccactgtgaaaatgctaagactcctaaagaacaattccgagtgcagatgttattaaatgaaaaggtgttacctttggcttactcacaagaaactgtttcattttatgaagatctgaagaaccactacaaggacatccttcagagttgtcaaaccagtgaagaatgtgaattagcaagggctaacagtacatctgatgaactatgagtaactgaagaacatttttaattctttaggaatctgcaatgagtgattacatgcttgtaataggtaggcaattccttgattacaggaagcttttatattacttgagtatttctgtcttttcacagaaaaacattgggtttctctctgggtttggacatgaaatgtaagaaaagatttttcactggagcagctctcttaaggagaaacaaatctatttagagaaacagctggccctgcaaatgtttacagaaatgaaattcttcctacttatataagaaatctcacactgagatagaattgtgatttcataataacacttgaaaagtgctggagtaacaaaatatctcagttggaccatccttaacttgattgaactgtctaggaactttacagattgttctgcagttctctcttcttttcctcaggtaggacagctctagcattttcttaatcaggaatattgtggtaagctgggagtatcactctggaagaaagtaacatctccagatgagaatttgaaacaagaaacagagtgttgtaaaaggacaccttcactgaagcaagtcggaaagtacaatgaaaataaatatttttggtatttatttatgaaatatttgaacattttttcaataattcctttttacttctaggaagtctcaaaagaccatcttaaattattatatgtttggacaattagcaacaagtcagatagttagaatcgaagtttttcaaatccattgcttagctaactttttcattctgtcacttggcttcgatttttatattttcctattatatgaaatgtatcttttggttgtttgatttttctttctttctttgtaaatagttctgagttctgtcaaatgccgtgaaagtatttgctataataaagaaaattcttgtgacttta

SEQ ID NO: 427070 - DNA, 2195 bp, Homo sapiens
cggaagctgggcatctgcagctggctcggcgcactccactgaccgtcccgacgatgctacgcgcgcccggctgcctcctccggacctccgtagcgcctgccgcggccctggctgcggcgctgctctcgtcgcttgcgcgctgctctcttctagagccgagggacccggtggcctcgtcgctcagcccctatttcggcaccaagactcgctacgaggatgtcaaccccgtgctattgtcgggccccgaggctccgtggcgggaccctgagctgctggaggggacctgcaccccggtgcagctggtcgccctcattcgccacggcacccgctaccccacggtcaaacagatccgcaagctgaggcagctgcacgggttgctgcaggcccgcgggtccagggatggcggggctagtagtaccggcagccgcgacctgggtgcagcgctggccgactggcctttgtggtacgcggactggatggacgggcagctagtagagaagggacggcaggatatgcgacagctggcgctgcgtctggcctcgctcttcccggcccttttcagccgtgagaactacggccgcctgcggctcatcaccagttccaagcaccgctgcatggatagcagcgccgccttcctgcaggggctgtggcagcactaccaccctggcttgccgccgccggacgtcgcagatatggagtttggacctccaacagttaatgataaactaatgagattttttgatcactgtgagaagtttttaactgaagtagaaaaaaatgctacagctctttatcacgtggaagccttcaaaactggaccagaaatgcagaacattttaaaaaaagttgcagctactttgcaagtgccagtaaatgatttaaatgcaggtctcagccaatttcttctccagtcatcctccagtttggtcatgcagagactcttcttccactgctttctctcatgggctacttcaaagacaaggaacccctaacagcgtacaattacaaaaaacaaatgcatcggaagttccgaagtggtctcattgtaccttatgcctcgaacctgatatttgtgctttaccactgtgaaaatgctaagactcctaaagaacaattccgagtgcagatgttattaaatgaaaaggtgttacctttggcttactcacaagaaactgtttcattttatgaagatctgaagaaccactacaaggacatccttcagagttgtcaaaccagtgaagaatgtgaattagcaagggctaacagtacatctgatgaactatgagtaactgaagaacatttttaattctttaggaatctgcaatgagtgattacatgcttgtaataggtaggcaattccttgattacaggaagcttttatattacttgagtatttctgtcttttcacagaaaaacattgggtttctctctgggtttggacatgaaatgtaagaaaagatttttcactggagcagctctcttaaggagaaacaaatctatttagagaaacagctggccctgcaaatgtttacagaaatgaaattcttcctacttatataagaaatctcacactgagatagaattgtgatttcataataacacttgaaaagtgctggagtaacaaaatatctcagttggaccatccttaacttgattgaactgtctaggaactttacagattgttctgcagttctctcttcttttcctcaggtaggacagctctagcattttcttaatcaggaatattgtggtaagctgggagtatcactctggaagaaagtaacatctccagatgagaatttgaaacaagaaacagagtgttgtaaaaggacaccttcactgaagcaagtcggaaagtacaatgaaaataaatatttttggtatttatttatgaaatatttgaacattttttcaataattcctttttacttctaggaagtctcaaaagaccatcttaaattattatatgtttggacaattagcaacaagtcagatagttagaatcgaagtttttcaaatccattgcttagctaactttttcattctgtcacttggcttcgatttttatattttcctattatatgaaatgtatcttttggttgtttgatttttctttctttctttgtaaatagttctgagttctgtcaaatgccgtgaaagtatttgctataataaagaaaattcttgtgacttta

SEQ ID NO: 427071 - DNA, 1623 bp, Homo sapiens
ataaatctctctgtggtatgaaccttagggaccaactcttaaatgctggaaaggacaaatactatattttgtgcagaatggtaattaaacattgtaaccatttcttagagaatcattattaaatcagggaatcttgttatatttttgaaaatatattagaaattatttttgaatttttttaggtattagaatatttaaatgatctgaaacaatattggaaaagaggatatgggtatactattaacagtcgatccagctgcaccttgtttcaggatatctttcagcacttggacaaagcagttgaacagaaacaaaggtctcagccaatttcttctccagtcatcctccagtttggtcatgcagagactcttcttccactgctttctctcatgggctacttcaaagacaaggaacccctaacagcgtacaattacaaaaaacaaatgcatcggaagttccgaagtggtctcattgtaccttatgcctcgaacctgatatttgtgctttaccactgtgaaaatgctaagactcctaaagaacaattccgagtgcagatgttattaaatgaaaaggtgttacctttggcttactcacaagaaactgtttcattttatgaagatctgaagaaccactacaaggacatccttcagagttgtcaaaccagtgaagaatgtgaattagcaagggctaacagtacatctgatgaactatgagtaactgaagaacatttttaattctttaggaatctgcaatgagtgattacatgcttgtaataggtaggcaattccttgattacaggaagcttttatattacttgagtatttctgtcttttcacagaaaaacattgggtttctctctgggtttggacatgaaatgtaagaaaagatttttcactggagcagctctcttaaggagaaacaaatctatttagagaaacagctggccctgcaaatgtttacagaaatgaaattcttcctacttatataagaaatctcacactgagatagaattgtgatttcataataacacttgaaaagtgctggagtaacaaaatatctcagttggaccatccttaacttgattgaactgtctaggaactttacagattgttctgcagttctctcttcttttcctcaggtaggacagctctagcattttcttaatcaggaatattgtggtaagctgggagtatcactctggaagaaagtaacatctccagatgagaatttgaaacaagaaacagagtgttgtaaaaggacaccttcactgaagcaagtcggaaagtacaatgaaaataaatatttttggtatttatttatgaaatatttgaacattttttcaataattcctttttacttctaggaagtctcaaaagaccatcttaaattattatatgtttggacaattagcaacaagtcagatagttagaatcgaagtttttcaaatccattgcttagctaactttttcattctgtcacttggcttcgatttttatattttcctattatatgaaatgtatcttttggttgtttgatttttctttctttctttgtaaatagttctgagttctgtcaaatgccgtgaaagtatttgctataataaagaaaattcttgtgacttta

SEQ ID NO: 427072 - DNA, 369 bp, Homo sapiens
ttttcaataattcctttttacttctaggaagtctcaaaagaccatcttaaattattatatgtttggacaattagcaacaagtcagatagttagaatcgaagtttttcaaatccattgcttagctaactttttcattctgtcacttggcttcgatttttatattttcctattatatgaaatgtatcttttggttgtttgatttttctttctttctttgtaaatagttctgagttctgtcaaatgccgtgaaagtatttgctataataaagaaaattcttgtgactttactaccaggacttttctcttccccatgtcaaaatacaatcaataattgatggtaaaagtttggaaattcaagcagatttgact

SEQ ID NO: 427073 - DNA, 2411 bp, Homo sapiens
cggaagctgggcatctgcagctggctcggcgcactccactgaccgtcccgacgatgctacgcgcgcccggctgcctcctccggacctccgtagcgcctgccgcggccctggctgcggcgctgctctcgtcgcttgcgcgctgctctcttctagagccgagggacccggtggcctcgtcgctcagcccctatttcggcaccaagactcgctacgaggatgtcaaccccgtgctattgtcgggccccgaggctccgtggcgggaccctgagctgctggaggggacctgcaccccggtgcagctggtcgccctcattcgccacggcacccgctaccccacggtcaaacagatccgcaagctgaggcagctgcacgggttgctgcaggcccgcgggtccagggatggcggggctagtagtaccggcagccgcgacctgggtgcagcgctggccgactggcctttgtggtacgcggactggatggacgggcagctagtagagaagggacggcaggatatgcgacagctggcgctgcgtctggcctcgctcttcccggcccttttcagccgtgagaactacggccgcctgcggctcatcaccagttccaagcaccgctgcatggatagcagcgccgccttcctgcaggggctgtggcagcactaccaccctggcttgccgccgccggacgtcgcagatatggagtttggacctccaacagttaatgataaactaatgagattttttgatcactgtgagaagtttttaactgaagtagaaaaaaatgctacagctctttatcacgtggaagccttcaaaactggaccagaaatgcagaacattttaaaaaaagttgcagctactttgcaagtgccagtaaatgatttaaatgcagatttaattcaagtagcctttttcacctgttcatttgacctggcaattaaaggtgttaaatctccttggtgtgatgtttttgacatagatgatgcaaaggtattagaatatttaaatgatctgaaacaatattggaaaagaggatatgggtatactattaacagtcgatccagctgcaccttgtttcaggatatctttcagcacttggacaaagcagttgaacagaaacaaaggtctcagccaatttcttctccagtcatgcagagactcttcttccactgctttctctcatgggctacttcaaagacaaggaacccctaacagcgtacaattacaaaaaacaaatgcatcggaagttccgaagtggtctcattgtaccttatgcctcgaacctgatatttgtgctttaccactgtgaaaatgctaagactcctaaagaacaattccgagtgcagatgttattaaatgaaaaggtgttacctttggcttactcacaagaaactgtttcattttatgaagatctgaagaaccactacaaggacatccttcagagttgtcaaaccagtgaagaatgtgaattagcaagggctaacagtacatctgatgaactatgagtaactgaagaacatttttaattctttaggaatctgcaatgagtgattacatgcttgtaataggtaggcaattccttgattacaggaagcttttatattacttgagtatttctgtcttttcacagaaaaacattgggtttctctctgggtttggacatgaaatgtaagaaaagatttttcactggagcagctctcttaaggagaaacaaatctatttagagaaacagctggccctgcaaatgtttacagaaatgaaattcttcctacttatataagaaatctcacactgagatagaattgtgatttcataataacacttgaaaagtgctggagtaacaaaatatctcagttggaccatccttaacttgattgaactgtctaggaactttacagattgttctgcagttctctcttcttttcctcaggtaggacagctctagcattttcttaatcaggaatattgtggtaagctgggagtatcactctggaagaaagtaacatctccagatgagaatttgaaacaagaaacagagtgttgtaaaaggacaccttcactgaagcaagtcggaaagtacaatgaaaataaatatttttggtatttatttatgaaatatttgaacattttttcaataattcctttttacttctaggaagtctcaaaagaccatcttaaattattatatgtttggacaattagcaacaagtcagatagttagaatcgaagtttttcaaatccattgcttagctaactttttcattctgtcacttggcttcgatttttatattttcctattatatgaaatgtatcttttggttgtttgatttttctttctttctttgtaaatagttctgagttctgtcaaatgccgtgaaagtatttgctataataaagaaaattcttgtgacttta

SEQ ID NO: 427074 - DNA, 2845 bp, Homo sapiens
ggggctgctggtggctgcaggtttcccacggagctttgagtttgcactcagggctgtgaggtcatggaggccagcattgccttctcatggcaggtgtcccggagtccctgaatctgtgggtttcccccaagccagcacctttgctgcaaacctctgagtttcctgttagcagtttttgggttgctgtgatgaatgagacaatatccgtaatatcacagcgtgtatttctgtctttccaaggatgtgtgaccggaatggtggtcggcggcttcgacagtggctgatcgagcagattgacagtagcatgtatccaggactgatttgggagaatgaggagaagagcatgttccggatcccttggaaacacgctggcaagcaagattataatcaggaagtggatgcctccatttttaaggcctgggcagtttttaaagggaagtttaaagaaggggacaaagctgaaccagccacttggaagacgaggttacgctgtgctttgaataagagcccagattttgaggaagtgacggaccggtcccaactggacatttccgagccatacaaagtttaccgaattgttcctgaggaagagcaaaaatgcaaactaggcgtggcaactgctggctgcgtgaatgaagttacagagatggagtgcggtcgctctgaaatcgacgagctgatcaaggagccttctgtggacgattacatggggatgatcaaaaggagcccttccccgccggaggcctgtcggagtcagctccttccagactggtgggcgcagcagcccagcacaggcgtgccgctggtgacggggtacaccacctacgacgcgcaccattcagcattctcccagatggtgatcagcttctactatgggggcaagctggtgggccaggccaccaccacctgccccgagggctgccgcctgtccctgagccagcctgggctgcccggcaccaagctgtatgggcccgagggcctggagctggtgcgcttcccgccggccgacgccatccccagcgagcgacagaggcaggtgacgcggaagctgttcgggcacctggagcgcggggtgctgctgcacagcagccggcagggcgtgttcgtcaagcggctgtgccagggccgcgtgttctgcagcggcaacgccgtggtgtgcaaaggcaggcccaacaagctggagcgtgatgaggtggtccaggtcttcgacaccagccagttcttccgagagctgcagcagttctataacagccagggccggcttcctgacggcagggtggtgctgtgctttggggaagagtttccggatatggcccccttgcgctccaaactcattctcgtgcagattgagcagctgtatgtccggcaactggcagaagaggctgggaagagctgtggagccggctctgtgatgcaggcccccgaggagccgccgccagaccaggtcttccggatgtttccagatatttgtgcctcacaccagagatcatttttcagagaaaaccaacagatcaccgtctaagtgcgtcgcttgggcgccccaccccgtctgcgtcctgcatccatctccctgttacagtggcccgcatcatgattaaagaatgtggatccctctgtctggggtgggatgccttactttgcacttaatttaataagggcattctcggaggagtagacgtttaatacgaagtggcggcatagccctgccgagatgtcggtgatggcctggatgctgtaaccacaacctgtggctaaaaattttattttctatcctttacccgtcattatcattagttgctatgattctttctgcattttcggttaactatcatttccaaagacttgtcattcagtaatattagcagatagctgcttcgataaaggaatttggagtttaaaaatcaacttgtgaaaacaaggttgtttttgtctttatcgtttgttagagttatagatttatgatttcataggcttgattctatgtgaaatatctttttacttttatgcattttaataagatttaaaaatatttagattaaagccccctttaatgagtacaagaaaaactcttggcttgttagaagaaagtatattctttctagaatttggtgcaggaatatgtgttcatatccaggcaaacgggtgtgtttttatcttcagacaatgaaaccttctcctctggggctttgttgccaggaagattagaactaaatttatttttttcatttctgtcatgaaatcattccagatacctcttttcttctttccaaatggttttcacatgtgtttgaaatatttgtacttcgaattgtcggattttccatgtcctcctttctcctttgtgcccagcctgagtcagcaccatcccgcattcagaacctcccagtgaaagggcagccttcattttgagaaggtggaaggtgttagggtttgggagacagctcatccaatctcccaagtctcatggtggatttgtgactgtgagagtttccggtttaaaatctgaaaagccagatatgcctgtttccttttcccagcaccatgcctgtggaggggacagtcagacccagaggtcctttacgtgtggatggagttcacaggcgaatagaggagaggaccaggggacgtggcttgtcccttttgtccaacaaagcattatatttttaagaatggcagacctgtttgctgaagtgttcataagataacaataggcttgaatctccaattcaaatgaatgtcaaagcacatatctttaatatgctgaatgaatatttatttttgtatccattaaaacagtatattgatctcttttattctttattaaaataaaatgctcttttttaaa

SEQ ID NO: 427075 - DNA, 2304 bp, Homo sapiens
ggggctgctggtggctgcaggtttcccacggagctttgagtttgcactcagggctgtgaggtcatggaggccagcattgccttctcatggcaggtgtcccggagtccctgaatctgtgggtttcccccaagccagcacctttgctgcaaacctctgagtttcctgttagcagtttttgggttgctgtgatgaatgagacaatatccgtaatatcacagcgtgtatttctgtctttccaaggatgtgtgaccggaatggtggtcggcggcttcgacagtggctgatcgagcagattgacagtagcatgtatccaggactgatttgggagaatgaggagaagagcatgttccggatcccttggaaacacgctggcaagcaagattataatcaggaagtggatgcctccatttttaaggcctgggcagtttttaaagggaagtttaaagaaggggacaaagctgaaccagccacttggaagacgaggttacgctgtgctttgaataagagcccagattttgaggaagtgacggaccggtcccaactggacatttccgagccatacaaagtttaccgaattgttcctgaggaagagcaaaaatgcaaactaggcgtggcaactgctggctgcgtgaatgaagttacagagatggagtgcggtcgctctgaaatcgacgagctgatcaaggagagctgcagcagttctataacagccagggccggcttcctgacggcagggtggtgctgtgctttggggaagagtttccggatatggcccccttgcgctccaaactcattctcgtgcagattgagcagctgtatgtccggcaactggcagaagaggctgggaagagctgtggagccggctctgtgatgcaggcccccgaggagccgccgccagaccaggtcttccggatgtttccagatatttgtgcctcacaccagagatcatttttcagagaaaaccaacagatcaccgtctaagtgcgtcgcttgggcgccccaccccgtctgcgtcctgcatccatctccctgttacagtggcccgcatcatgattaaagaatgtggatccctctgtctggggtgggatgccttactttgcacttaatttaataagggcattctcggaggagtagacgtttaatacgaagtggcggcatagccctgccgagatgtcggtgatggcctggatgctgtaaccacaacctgtggctaaaaattttattttctatcctttacccgtcattatcattagttgctatgattctttctgcattttcggttaactatcatttccaaagacttgtcattcagtaatattagcagatagctgcttcgataaaggaatttggagtttaaaaatcaacttgtgaaaacaaggttgtttttgtctttatcgtttgttagagttatagatttatgatttcataggcttgattctatgtgaaatatctttttacttttatgcattttaataagatttaaaaatatttagattaaagccccctttaatgagtacaagaaaaactcttggcttgttagaagaaagtatattctttctagaatttggtgcaggaatatgtgttcatatccaggcaaacgggtgtgtttttatcttcagacaatgaaaccttctcctctggggctttgttgccaggaagattagaactaaatttatttttttcatttctgtcatgaaatcattccagatacctcttttcttctttccaaatggttttcacatgtgtttgaaatatttgtacttcgaattgtcggattttccatgtcctcctttctcctttgtgcccagcctgagtcagcaccatcccgcattcagaacctcccagtgaaagggcagccttcattttgagaaggtggaaggtgttagggtttgggagacagctcatccaatctcccaagtctcatggtggatttgtgactgtgagagtttccggtttaaaatctgaaaagccagatatgcctgtttccttttcccagcaccatgcctgtggaggggacagtcagacccagaggtcctttacgtgtggatggagttcacaggcgaatagaggagaggaccaggggacgtggcttgtcccttttgtccaacaaagcattatatttttaagaatggcagacctgtttgctgaagtgttcataagataacaataggcttgaatctccaattcaaatgaatgtcaaagcacatatctttaatatgctgaatgaatatttatttttgtatccattaaaacagtatattgatctcttttattctttattaaaataaaatgctcttttttaaa

SEQ ID NO: 427076 - DNA, 2689 bp, Homo sapiens
gacttcttcaggcggggacgtcatgatccacccggtgaccaaccggccggtcgacgagcgcagcttcagtcccgctccctggtggagaaggagaaggtctctcgcagtggtggctactgccatcaatggatggagctggatcctagtcctcgcactggcctctggagaccaccactccccaagcttctattgatccttgtgggaccctaggatggactcccaatctgccagtgctctgggcgccacaagatgcgcgtatctgctcccaggctggcccttgccaggaccacgcctgagtcgtacaagccaccccctgaataccttgctcgagcgaaggatgtgatgcggcttggctgtcgggaacaggcacggaagctaggagctatttccgagccatacaaagtttaggcggaagttgttcctagaggaaagagcacaaaattgcaaactaggcgtggcaactgctggctgcgtgaatgaagttacagagatggagtgcggtcgctctgaaatcgacgagctgatcaaggagccttctgtggacgattacatggggatgatcaaaaggagcccttccccgccggaggcctgtcggagtcagctccttccagactggtgggcgcagcagcccagcacaggcgtgccgctggtgacggggtacaccacctacgacgcgcaccattcagcattctcccagatggtgatcagcttctactatgggggcaagctggtgggccaggccaccaccacctgccccgagggctgccgcctgtccctgagccagcctgggctgcccggcaccaagctgtatgggcccgagggcctggagctggtgcgcttcccgccggccgacgccatccccagcgagcgacagaggcaggtgacgcggaagctgttcgggcacctggagcgcggggtgctgctgcacagcagccggcagggcgtgttcgtcaagcggctgtgccagggccgcgtgttctgcagcggcaacgccgtggtgtgcaaaggcaggcccaacaagctggagcgtgatgaggtggtccaggtcttcgacaccagccagttcttccgagagctgcagcagttctataacagccagggccggcttcctgacggcagggtggtgctgtgctttggggaagagtttccggatatggcccccttgcgctccaaactcattctcgtgcagattgagcagctgtatgtccggcaactggcagaagaggctgggaagagctgtggagccggctctgtgatgcaggcccccgaggagccgccgccagaccaggtcttccggatgtttccagatatttgtgcctcacaccagagatcatttttcagagaaaaccaacagatcaccgtctaagtgcgtcgcttgggcgccccaccccgtctgcgtcctgcatccatctccctgttacagtggcccgcatcatgattaaagaatgtggatccctctgtctggggtgggatgccttactttgcacttaatttaataagggcattctcggaggagtagacgtttaatacgaagtggcggcatagccctgccgagatgtcggtgatggcctggatgctgtaaccacaacctgtggctaaaaattttattttctatcctttacccgtcattatcattagttgctatgattctttctgcattttcggttaactatcatttccaaagacttgtcattcagtaatattagcagatagctgcttcgataaaggaatttggagtttaaaaatcaacttgtgaaaacaaggttgtttttgtctttatcgtttgttagagttatagatttatgatttcataggcttgattctatgtgaaatatctttttacttttatgcattttaataagatttaaaaatatttagattaaagccccctttaatgagtacaagaaaaactcttggcttgttagaagaaagtatattctttctagaatttggtgcaggaatatgtgttcatatccaggcaaacgggtgtgtttttatcttcagacaatgaaaccttctcctctggggctttgttgccaggaagattagaactaaatttatttttttcatttctgtcatgaaatcattccagatacctcttttcttctttccaaatggttttcacatgtgtttgaaatatttgtacttcgaattgtcggattttccatgtcctcctttctcctttgtgcccagcctgagtcagcaccatcccgcattcagaacctcccagtgaaagggcagccttcattttgagaaggtggaaggtgttagggtttgggagacagctcatccaatctcccaagtctcatggtggatttgtgactgtgagagtttccggtttaaaatctgaaaagccagatatgcctgtttccttttcccagcaccatgcctgtggaggggacagtcagacccagaggtcctttacgtgtggatggagttcacaggcgaatagaggagaggaccaggggacgtggcttgtcccttttgtccaacaaagcattatatttttaagaatggcagacctgtttgctgaagtgttcataagataacaataggcttgaatctccaattcaaatgaatgtcaaagcacatatctttaatatgctgaatgaatatttatttttgtatccattaaaacagtatattgatctcttttattctttattaaaataaaatgctcttttttaaa

SEQ ID NO: 427077 - DNA, 2219 bp, Homo sapiens
tgtgggagtctgggaggtggcagctggccccggaggccttgaaggttgccaggccttgggtgtcgagtaagaggtccctggaaaggcacctctgtctgtgctgcaggaacaccatccggaaagctagcttgcacccccaggctctcccccagagataagccctgggtggcgtgccgctggtgacggggtacaccacctacgacgcgcaccattcagcattctcccagatggtgatcagcttctactatgggggcaagctggtgggccaggccaccaccacctgccccgagggctgccgcctgtccctgagccagcctgggctgcccggcaccaagctgtatgggcccgagggcctggagctggtgcgcttcccgccggccgacgccatccccagcgagcgacagaggcaggtgacgcggaagctgttcgggcacctggagcgcggggtgctgctgcacagcagccggcagggcgtgttcgtcaagcggctgtgccagggccgcgtgttctgcagcggcaacgccgtggtgtgcaaaggcaggcccaacaagctggagcgtgatgaggtggtccaggtcttcgacaccagccagttcttccgagagctgcagcagttctataacagccagggccggcttcctgacggcagggtggtgctgtgctttggggaagagtttccggatatggcccccttgcgctccaaactcattctcgtgcagattgagcagctgtatgtccggcaactggcagaagaggctgggaagagctgtggagccggctctgtgatgcaggcccccgaggagccgccgccagaccaggtcttccggatgtttccagatatttgtgcctcacaccagagatcatttttcagagaaaaccaacagatcaccgtctaagtgcgtcgcttgggcgccccaccccgtctgcgtcctgcatccatctccctgttacagtggcccgcatcatgattaaagaatgtggatccctctgtctggggtgggatgccttactttgcacttaatttaataagggcattctcggaggagtagacgtttaatacgaagtggcggcatagccctgccgagatgtcggtgatggcctggatgctgtaaccacaacctgtggctaaaaattttattttctatcctttacccgtcattatcattagttgctatgattctttctgcattttcggttaactatcatttccaaagacttgtcattcagtaatattagcagatagctgcttcgataaaggaatttggagtttaaaaatcaacttgtgaaaacaaggttgtttttgtctttatcgtttgttagagttatagatttatgatttcataggcttgattctatgtgaaatatctttttacttttatgcattttaataagatttaaaaatatttagattaaagccccctttaatgagtacaagaaaaactcttggcttgttagaagaaagtatattctttctagaatttggtgcaggaatatgtgttcatatccaggcaaacgggtgtgtttttatcttcagacaatgaaaccttctcctctggggctttgttgccaggaagattagaactaaatttatttttttcatttctgtcatgaaatcattccagatacctcttttcttctttccaaatggttttcacatgtgtttgaaatatttgtacttcgaattgtcggattttccatgtcctcctttctcctttgtgcccagcctgagtcagcaccatcccgcattcagaacctcccagtgaaagggcagccttcattttgagaaggtggaaggtgttagggtttgggagacagctcatccaatctcccaagtctcatggtggatttgtgactgtgagagtttccggtttaaaatctgaaaagccagatatgcctgtttccttttcccagcaccatgcctgtggaggggacagtcagacccagaggtcctttacgtgtggatggagttcacaggcgaatagaggagaggaccaggggacgtggcttgtcccttttgtccaacaaagcattatatttttaagaatggcagacctgtttgctgaagtgttcataagataacaataggcttgaatctccaattcaaatgaatgtcaaagcacatatctttaatatgctgaatgaatatttatttttgtatccattaaaacagtatattgatctcttttattctttattaaaataaaatgctcttttttaaa

SEQ ID NO: 427078 - DNA, 2661 bp, Homo sapiens
agcgcggcagcaagcgtgggaacgcgggcggcgagacggcggcaggacggcggcaggatgtgtgaccggaatggtggtcggcggcttcgacagtggctgatcgagcagattgacagtagcatgtatccaggactgatttgggagaatgaggagaagagcatgttccggatcccttggaaacacgctggcaagcaagattataatcaggaagtggatgcctccatttttaaggcctgggcagtttttaaagggaagtttaaagaaggggacaaagctgaaccagccacttggaagacgaggttacgctgtgctttgaataagagcccagattttgaggaagtgacggaccggtcccaactggacatttccgagccatacaaagtttaccgaattgttcctgaggaagagcaaaaatgcaaactaggcgtggcaactgctggctgcgtgaatgaagttacagagatggagtgcggtcgctctgaaatcgacgagctgatcaaggagccttctgtggacgattacatggggatgatcaaaaggagcccttccccgccggaggcctgtcggagtcagctccttccagactggtgggcgcagcagcccagcacaggcgtgccgctggtgacggggtacaccacctacgacgcgcaccattcagcattctcccagatggtgatcagcttctactatgggggcaagctggtgggccaggccaccaccacctgccccgagggctgccgcctgtccctgagccagcctgggctgcccggcaccaagctgtatgggcccgagggcctggagctggtgcgcttcccgccggccgacgccatccccagcgagcgacagaggcaggtgacgcggaagctgttcgggcacctggagcgcggggtgctgctgcacagcagccggcagggcgtgttcgtcaagcggctgtgccagggccgcgtgttctgcagcggcaacgccgtggtgtgcaaaggcaggcccaacaagctggagcgtgatgaggtggtccaggtcttcgacaccagccagttcttccgagagctgcagcagttctataacagccagggccggcttcctgacggcagggtggtgctgtgctttggggaagagtttccggatatggcccccttgcgctccaaactcattctcgtgcagattgagcagctgtatgtccggcaactggcagaagaggctgggaagagctgtggagccggctctgtgatgcaggcccccgaggagccgccgccagaccaggtcttccggatgtttccagatatttgtgcctcacaccagagatcatttttcagagaaaaccaacagatcaccgtctaagtgcgtcgcttgggcgccccaccccgtctgcgtcctgcatccatctccctgttacagtggcccgcatcatgattaaagaatgtggatccctctgtctggggtgggatgccttactttgcacttaatttaataagggcattctcggaggagtagacgtttaatacgaagtggcggcatagccctgccgagatgtcggtgatggcctggatgctgtaaccacaacctgtggctaaaaattttattttctatcctttacccgtcattatcattagttgctatgattctttctgcattttcggttaactatcatttccaaagacttgtcattcagtaatattagcagatagctgcttcgataaaggaatttggagtttaaaaatcaacttgtgaaaacaaggttgtttttgtctttatcgtttgttagagttatagatttatgatttcataggcttgattctatgtgaaatatctttttacttttatgcattttaataagatttaaaaatatttagattaaagccccctttaatgagtacaagaaaaactcttggcttgttagaagaaagtatattctttctagaatttggtgcaggaatatgtgttcatatccaggcaaacgggtgtgtttttatcttcagacaatgaaaccttctcctctggggctttgttgccaggaagattagaactaaatttatttttttcatttctgtcatgaaatcattccagatacctcttttcttctttccaaatggttttcacatgtgtttgaaatatttgtacttcgaattgtcggattttccatgtcctcctttctcctttgtgcccagcctgagtcagcaccatcccgcattcagaacctcccagtgaaagggcagccttcattttgagaaggtggaaggtgttagggtttgggagacagctcatccaatctcccaagtctcatggtggatttgtgactgtgagagtttccggtttaaaatctgaaaagccagatatgcctgtttccttttcccagcaccatgcctgtggaggggacagtcagacccagaggtcctttacgtgtggatggagttcacaggcgaatagaggagaggaccaggggacgtggcttgtcccttttgtccaacaaagcattatatttttaagaatggcagacctgtttgctgaagtgttcataagataacaataggcttgaatctccaattcaaatgaatgtcaaagcacatatctttaatatgctgaatgaatatttatttttgtatccattaaaacagtatattgatctcttttattctttattaaaataaaatgctcttttttaaa

SEQ ID NO: 427079 - DNA, 2720 bp, Homo sapiens
ggggctgctggtggctgcaggtttcccacggagctttgagtttgcactcagggctgtgaggtcatggaggccagcattgccttctcatggcaggtgtcccggagtccctgaatctgatgtgtgaccggaatggtggtcggcggcttcgacagtggctgatcgagcagattgacagtagcatgtatccaggactgatttgggagaatgaggagaagagcatgttccggatcccttggaaacacgctggcaagcaagattataatcaggaagtggatgcctccatttttaaggcctgggcagtttttaaagggaagtttaaagaaggggacaaagctgaaccagccacttggaagacgaggttacgctgtgctttgaataagagcccagattttgaggaagtgacggaccggtcccaactggacatttccgagccatacaaagtttaccgaattgttcctgaggaagagcaaaaatgcaaactaggcgtggcaactgctggctgcgtgaatgaagttacagagatggagtgcggtcgctctgaaatcgacgagctgatcaaggagccttctgtggacgattacatggggatgatcaaaaggagcccttccccgccggaggcctgtcggagtcagctccttccagactggtgggcgcagcagcccagcacaggcgtgccgctggtgacggggtacaccacctacgacgcgcaccattcagcattctcccagatggtgatcagcttctactatgggggcaagctggtgggccaggccaccaccacctgccccgagggctgccgcctgtccctgagccagcctgggctgcccggcaccaagctgtatgggcccgagggcctggagctggtgcgcttcccgccggccgacgccatccccagcgagcgacagaggcaggtgacgcggaagctgttcgggcacctggagcgcggggtgctgctgcacagcagccggcagggcgtgttcgtcaagcggctgtgccagggccgcgtgttctgcagcggcaacgccgtggtgtgcaaaggcaggcccaacaagctggagcgtgatgaggtggtccaggtcttcgacaccagccagttcttccgagagctgcagcagttctataacagccagggccggcttcctgacggcagggtggtgctgtgctttggggaagagtttccggatatggcccccttgcgctccaaactcattctcgtgcagattgagcagctgtatgtccggcaactggcagaagaggctgggaagagctgtggagccggctctgtgatgcaggcccccgaggagccgccgccagaccaggtcttccggatgtttccagatatttgtgcctcacaccagagatcatttttcagagaaaaccaacagatcaccgtctaagtgcgtcgcttgggcgccccaccccgtctgcgtcctgcatccatctccctgttacagtggcccgcatcatgattaaagaatgtggatccctctgtctggggtgggatgccttactttgcacttaatttaataagggcattctcggaggagtagacgtttaatacgaagtggcggcatagccctgccgagatgtcggtgatggcctggatgctgtaaccacaacctgtggctaaaaattttattttctatcctttacccgtcattatcattagttgctatgattctttctgcattttcggttaactatcatttccaaagacttgtcattcagtaatattagcagatagctgcttcgataaaggaatttggagtttaaaaatcaacttgtgaaaacaaggttgtttttgtctttatcgtttgttagagttatagatttatgatttcataggcttgattctatgtgaaatatctttttacttttatgcattttaataagatttaaaaatatttagattaaagccccctttaatgagtacaagaaaaactcttggcttgttagaagaaagtatattctttctagaatttggtgcaggaatatgtgttcatatccaggcaaacgggtgtgtttttatcttcagacaatgaaaccttctcctctggggctttgttgccaggaagattagaactaaatttatttttttcatttctgtcatgaaatcattccagatacctcttttcttctttccaaatggttttcacatgtgtttgaaatatttgtacttcgaattgtcggattttccatgtcctcctttctcctttgtgcccagcctgagtcagcaccatcccgcattcagaacctcccagtgaaagggcagccttcattttgagaaggtggaaggtgttagggtttgggagacagctcatccaatctcccaagtctcatggtggatttgtgactgtgagagtttccggtttaaaatctgaaaagccagatatgcctgtttccttttcccagcaccatgcctgtggaggggacagtcagacccagaggtcctttacgtgtggatggagttcacaggcgaatagaggagaggaccaggggacgtggcttgtcccttttgtccaacaaagcattatatttttaagaatggcagacctgtttgctgaagtgttcataagataacaataggcttgaatctccaattcaaatgaatgtcaaagcacatatctttaatatgctgaatgaatatttatttttgtatccattaaaacagtatattgatctcttttattctttattaaaataaaatgctcttttttaaa

SEQ ID NO: 427080 - DNA, 2249 bp, Homo sapiens
tgtgggagtctgggaggtggcagctggccccggaggccttgaaggttgccaggccttgggtgtcgagtaagaggtccctggaaaggcacctctgtctgtgctgcaggaacaccatccggaaagctagcttgcacccccaggctctcccccagagataagccctgggtggtgggtatgcagtccagtggtattctgggggcgtgccgctggtgacggggtacaccacctacgacgcgcaccattcagcattctcccagatggtgatcagcttctactatgggggcaagctggtgggccaggccaccaccacctgccccgagggctgccgcctgtccctgagccagcctgggctgcccggcaccaagctgtatgggcccgagggcctggagctggtgcgcttcccgccggccgacgccatccccagcgagcgacagaggcaggtgacgcggaagctgttcgggcacctggagcgcggggtgctgctgcacagcagccggcagggcgtgttcgtcaagcggctgtgccagggccgcgtgttctgcagcggcaacgccgtggtgtgcaaaggcaggcccaacaagctggagcgtgatgaggtggtccaggtcttcgacaccagccagttcttccgagagctgcagcagttctataacagccagggccggcttcctgacggcagggtggtgctgtgctttggggaagagtttccggatatggcccccttgcgctccaaactcattctcgtgcagattgagcagctgtatgtccggcaactggcagaagaggctgggaagagctgtggagccggctctgtgatgcaggcccccgaggagccgccgccagaccaggtcttccggatgtttccagatatttgtgcctcacaccagagatcatttttcagagaaaaccaacagatcaccgtctaagtgcgtcgcttgggcgccccaccccgtctgcgtcctgcatccatctccctgttacagtggcccgcatcatgattaaagaatgtggatccctctgtctggggtgggatgccttactttgcacttaatttaataagggcattctcggaggagtagacgtttaatacgaagtggcggcatagccctgccgagatgtcggtgatggcctggatgctgtaaccacaacctgtggctaaaaattttattttctatcctttacccgtcattatcattagttgctatgattctttctgcattttcggttaactatcatttccaaagacttgtcattcagtaatattagcagatagctgcttcgataaaggaatttggagtttaaaaatcaacttgtgaaaacaaggttgtttttgtctttatcgtttgttagagttatagatttatgatttcataggcttgattctatgtgaaatatctttttacttttatgcattttaataagatttaaaaatatttagattaaagccccctttaatgagtacaagaaaaactcttggcttgttagaagaaagtatattctttctagaatttggtgcaggaatatgtgttcatatccaggcaaacgggtgtgtttttatcttcagacaatgaaaccttctcctctggggctttgttgccaggaagattagaactaaatttatttttttcatttctgtcatgaaatcattccagatacctcttttcttctttccaaatggttttcacatgtgtttgaaatatttgtacttcgaattgtcggattttccatgtcctcctttctcctttgtgcccagcctgagtcagcaccatcccgcattcagaacctcccagtgaaagggcagccttcattttgagaaggtggaaggtgttagggtttgggagacagctcatccaatctcccaagtctcatggtggatttgtgactgtgagagtttccggtttaaaatctgaaaagccagatatgcctgtttccttttcccagcaccatgcctgtggaggggacagtcagacccagaggtcctttacgtgtggatggagttcacaggcgaatagaggagaggaccaggggacgtggcttgtcccttttgtccaacaaagcattatatttttaagaatggcagacctgtttgctgaagtgttcataagataacaataggcttgaatctccaattcaaatgaatgtcaaagcacatatctttaatatgctgaatgaatatttatttttgtatccattaaaacagtatattgatctcttttattctttattaaaataaaatgctcttttttaaa

SEQ ID NO: 427081 - DNA, 3132 bp, Homo sapiens
cggacaggagccattgtgggcgagagcaagttaaggggagggggtgtaagagccagcgaataagagagagagtaagagggagagagaagaagaggaagaagaggaggcggcggcagcggaggaggaggaggactagtgtggggtggaaaggaagagtgagcgagagcaagttaaggggagggggtgtaagagccagcgaattctttttctttttctattattattttgacgactcctgagttgcgcccatgctcttgtcagcttcgttttaggcgtagcatggccaggcagaagaaaatggggcaaagcgtgctccgggcggtcttctttttagtcctggggcttttgggtcattctcacggaggattccccaacaccatcagcataggtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgctttctgctcccagttctcgagaggggtgtatgccatctttggattctatgaccagatgtcaatgaacaccctgacctccttctgtggggccctgcacacatcctttgttacgcctagcttccccactgacgcagatgtgcagtttgtcatccagatgcgcccagccttgaagggcgctattctgagtcttctgggtcattacaagtgggagaagtttgtgtacctctatgacacagaacgaggattttccatcctccaagcgattatggaagcagcagtgcaaaacaactggcaagtaacagcaaggtctgtgggaaacataaaggacgtccaagaattcaggcgcatcattgaagaaatggacaggaggcaggaaaagcgatacttgattgactgcgaagtcgaaaggattaacacaattttggaacaggttgtgatcctagggaaacactcaagaggttatcactacatgctcgctaacctgggttttactgatattttactggaaagagtcatgcatgggggagccaacattacaggtttccagattgtcaacaatgaaaaccctatggttcagcagttcatacagcgctgggtgaggctggatgaaagggaattccctgaagccaagaatgcaccactaaagtatacatctgcattgacacacgacgcaatactggtcatagcagaagctttccgctacctgaggaggcagcgagtagatgtgtcccggagaggaagtgctggagactgcttagcaaatcctgctgtgccctggagtcaaggaattgatattgagagagctctgaaaatggtgcaagtacaaggaatgactggaaatattcaatttgacacttatggacgtaggacaaattataccatcgatgtgtatgaaatgaaagtcagtggctctcgaaaagctggctactggaacgagtatgaaaggtttgtgcctttctcagatcagcaaatcagcaatgacagtgcatcctcagagaatcggaccatagtagtgactaccattctggaatcaccatatgtaatgtacaagaagaaccatgagcaactggaaggaaatgaacgatatgaaggctattgtgtagacctagcctatgaaatagccaaacatgtaaggatcaaatacaaattgtccatcgttggtgacgggaaatatggtgcaagggatccagagactaaaatatggaacggcatggttggggaacttgtctatgggagagctgatatagctgttgctccactcactataacattggtccgtgaagaagtcatagatttttcaaagccattcatgagcctgggcatctccatcatgataaagaagcctcagaaatcaaaaccaggcgtattctcatttctggatcccctggcttatgaaatctggatgtgcattgtctttgcttacattggagtcagcgtagttcttttcctagtcagcaggttcagtccttatgaatggcacttggaagacaacaatgaagaacctcgtgacccacaaagtcctcctgatcctccaaatgaatttggaatatttaacagtctttggttttccttgggtgcctttatgcagcaaggatgtgatatttctccaagatcactctccgggcgcattgttggaggggtttggtggttcttcaccctgatcataatttcttcctatactgccaatctcgctgctttcctgactgtggagaggatggtttctcccatagagagtgctgaagacttagctaaacagactgaaattgcatatgggaccctggactccggttcaacaaaagaatttttcagaagatccaaaattgctgtgtacgagaaaatgtggtcttacatgaaatcagcggagccatctgtgtttaccaaaacaacagcagacggagtggcccgagtgcgaaagtccaagggaaagttcgccttcctgctggagtcaaccatgaatgagtacattgagcagagaaaaccatgtgatacgatgaaagttggtggaaatctggattccaaaggctatggtgtggcaacccctaaaggctcagcattaggaaatgctgttaacctggcagtattaaaactgaatgagcaaggcctcttggacaaattgaaaaacaaatggtggtacgacaaaggagagtgcggcagcgggggcggtgactccaaggacaagaccagcgctctgagcctgagcaatgtggcaggcgttttctatatacttgtcggaggtctggggctggccatgatggtggctttgatagaattctgttacaaatcacgggcagagtccaaacgcatgaaactcacaaagaacacccaaaactttaagcctgctcctgccaccaacactcagaattatgctacatacagagaaggctacaacgtgtatggaacagagagtgttaagatctagggatcccttcccactggaggcatgtgatgagaggaaatcaccgaaaacggcgtgcatggcatgcacgttcagacagctgcattgtaagagttctgtcatgcagtctgaaaagggaagaaacaggatggctttctgtagccacacctgtgaggcgtgatgattgttggg

SEQ ID NO: 427082 - DNA, 631 bp, Homo sapiens
tgttaactttttataaggtaatgctcaggttgcctgcagtgtctaaaattactctgtggccagggccccctgctttatcgctttctatagttttaaagtagtttgaagcttgaataacataaaataacataatataatgttatttatgttatttcccacgtgaagaacgcctgtaaaccttgcagtattgaaactcagtgaacaaggcatcttagacaagctgaaaaacaaatggtggtacgataagggggaatgtggagccaaggactccgggagtaaggtcagtcgctgaaggtctttttgtactgattagcaatcacattttgacccactgtttattttctaccctaaaacggctttccttcccaacacacactccctgacacagtgggacccctttataacaacagtgctaaaggaataagacaaatgccagcctcagaggcctgccacatgacatcaattgttgactctatagaacagttatgatgattaggaaactcaatctggcctactgcatttccaaagttataaaataatgagctgtgttataagggggttttactgtatttcacatttcaaaagttcaaagagaaaatataataacaataacaacaacaacaaccaaaaa

SEQ ID NO: 427083 - DNA, 3281 bp, Homo sapiens
cggacaggagccattgtgggcgagagcaagttaaggggagggggtgtaagagccagcgaataagagagagagtaagagggagagagaagaagaggaagaagaggaggcggcggcagcggaggaggaggaggactagtgtggggtggaaaggaagagtgagcgagagcaagttaaggggagggggtgtaagagccagcgaattctttttctttttctattattattttgacgactcctgagttgcgcccatgctcttgtcagcttcgttttaggcgtagcatggccaggcagaagaaaatggggcaaagcgtgctccgggcggtcttctttttagtcctggggcttttgggtcattctcacggaggattccccaacaccatcagcataggtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgctttctgctcccagttctcgagaggggtgtatgccatctttggattctatgaccagatgtcaatgaacaccctgacctccttctgtggggccctgcacacatcctttgttacgcctagcttccccactgacgcagatgtgcagtttgtcatccagatgcgcccagccttgaagggcgctattctgagtcttctgggtcattacaagtgggagaagtttgtgtacctctatgacacagaacgaggattttccatcctccaagcgattatggaagcagcagtgcaaaacaactggcaagtaacagcaaggtctgtgggaaacataaaggacgtccaagaattcaggcgcatcattgaagaaatggacaggaggcaggaaaagcgatacttgattgactgcgaagtcgaaaggattaacacaattttggaacaggttgtgatcctagggaaacactcaagaggttatcactacatgctcgctaacctgggttttactgatattttactggaaagagtcatgcatgggggagccaacattacaggtttccagattgtcaacaatgaaaaccctatggttcagcagttcatacagcgctgggtgaggctggatgaaagggaattccctgaagccaagaatgcaccactaaagtatacatctgcattgacacacgacgcaatactggtcatagcagaagctttccgctacctgaggaggcagcgagtagatgtgtcccggagaggaagtgctggagactgcttagcaaatcctgctgtgccctggagtcaaggaattgatattgagagagctctgaaaatggtgcaagtacaaggaatgactggaaatattcaatttgacacttatggacgtaggacaaattataccatcgatgtgtatgaaatgaaagtcagtggctctcgaaaagctggctactggaacgagtatgaaaggtttgtgcctttctcagatcagcaaatcagcaatgacagtgcatcctcagagaatcggaccatagtagtgactaccattctggaatcaccatatgtaatgtacaagaagaaccatgagcaactggaaggaaatgaacgatatgaaggctattgtgtagacctagcctatgaaatagccaaacatgtaaggatcaaatacaaattgtccatcgttggtgacgggaaatatggtgcaagggatccagagactaaaatatggaacggcatggttggggaacttgtctatgggagagctgatatagctgttgctccactcactataacattggtccgtgaagaagtcatagatttttcaaagccattcatgagcctgggcatctccatcatgataaagaagcctcagaaatcaaaaccaggcgtattctcatttctggatcccctggcttatgaaatctggatgtgcattgtctttgcttacattggagtcagcgtagttcttttcctagtcagcaggttcagtccttatgaatggcacttggaagacaacaatgaagaacctcgtgacccacaaagtcctcctgatcctccaaatgaatttggaatatttaacagtctttggttttccttgggtgcctttatgcagcaaggatgtgatatttctccaagatcactctccgggcgcattgttggaggggtttggtggttcttcaccctgatcataatttcttcctatactgccaatctcgctgctttcctgactgtggagaggatggtttctcccatagagagtgctgaagacttagctaaacagactgaaattgcatatgggaccctggactccggttcaacaaaagaatttttcagaagatccaaaattgctgtgtacgagaaaatgtggtcttacatgaaatcagcggagccatctgtgtttaccaaaacaacagcagacggagtggcccgagtgcgaaagtccaagggaaagttcgccttcctgctggagtcaaccatgaatgagtacattgagcagagaaaaccatgtgatacgatgaaagttggtggaaatctggattccaaaggctatggtgtggcaacccctaaaggctcagcattaggaacgcctgtaaaccttgcagtattgaaactcagtgaacaaggcatcttagacaagctgaaaaacaaatggtggtacgataagggggaatgtggagccaaggactccgggagtaaggacaagaccagcgctctgagcctgagcaatgtggcaggcgttttctatatacttgtcggaggtctggggctggccatgatggtggctttgatagaattctgttacaaatcacgggcagagtccaaacgcatgaaactcacaaagaacacccaaaactttaagcctgctcctgccaccaacactcagaattatgctacatacagagaaggctacaacgtgtatggaacagagagtgttaagatctagggatcccttcccactggaggcatgtgatgagaggaaatcaccgaaaacgtggctgcttcaaggatcctgagccagatttcactctccttggtgtcgggcatgacacgaatattgctgatggtgcaatgacctttcaataggaaaaactgatttttttttccttcagtgccttatggaacactctgagactcgcgacaatgcaaaccatcattgaaatctttttgctttgcttgaaaaaaaataattaaaataaaaaccaacaaaaatggacatgcatcaaacccttgatgtattaatatttattatagttttcatta

SEQ ID NO: 427084 - DNA, 2874 bp, Homo sapiens
tcacaaggcagtacaagttgtattataaggtagcaaaaacacactattaggaaaagaaagcagagtcggttgctctaagccaatgtgtctcagaagacaaaaggccagcaccctttctttaatttaccatcaagttaaagcactttagaacccactgaatgctaccacttttctaacctaagcattgataattcaattggttgtaaagatttaggacttgatattttcaccaaagaagtatattaagcgacaaataactgattaaagactgtctctaaaagtcatatatgttttcttttttttcttttttttcagagagctgatatagctgttgctccactcactataacattggtccgtgaagaagtcatagatttttcaaagccattcatgagcctgggcatctccatcatgataaagaagcctcagaaatcaaaaccaggcgtattctcatttctggatcccctggcttatgaaatctggatgtgcattgtctttgcttacattggagtcagcgtagttcttttcctagtcagcaggttcagtccttatgaatggcacttggaagacaacaatgaagaacctcgtgacccacaaagtcctcctgatcctccaaatgaatttggaatatttaacagtctttggttttccttgggtgcctttatgcagcaaggatgtgatatttctccaagatcactctccgggcgcattgttggaggggtttggtggttcttcaccctgatcataatttcttcctatactgccaatctcgctgctttcctgactgtggagaggatggtttctcccatagagagtgctgaagacttagctaaacagactgaaattgcatatgggaccctggactccggttcaacaaaagaatttttcagaagatccaaaattgctgtgtacgagaaaatgtggtcttacatgaaatcagcggagccatctgtgtttaccaaaacaacagcagacggagtggcccgagtgcgaaagtccaagggaaagttcgccttcctgctggagtcaaccatgaatgagtacattgagcagagaaaaccatgtgatacgatgaaagttggtggaaatctggattccaaaggctatggtgtggcaacccctaaaggctcagcattaggaacgcctgtaaaccttgcagtattgaaactcagtgaacaaggcatcttagacaagctgaaaaacaaatggtggtacgataagggggaatgtggagccaaggactccgggagtaaggacaagaccagcgctctgagcctgagcaatgtggcaggcgttttctatatacttgtcggaggtctggggctggccatgatggtggctttgatagaattctgttacaaatcacgggcagagtccaaacgcatgaaactcacaaagaacacccaaaactttaagcctgctcctgccaccaacactcagaattatgctacatacagagaaggctacaacgtgtatggaacagagagtgttaagatctagggatcccttcccactggaggcatgtgatgagaggaaatcaccgaaaacgtggctgcttcaaggatcctgagccagatttcactctccttggtgtcgggcatgacacgaatattgctgatggtgcaatgacctttcaataggaaaaactgatttttttttccttcagtgccttatggaacactctgagactcgcgacaatgcaaaccatcattgaaatctttttgctttgcttgaaaaaaaataattaaaataaaaaccaacaaaaatggacatgcaagattccagtatgcgaaaaaaaatcttattaagtcaattcaacaaaagccattctttgataccactgcagagtatataaacaccatgttctttaatacacacacacacacacacacacacacacacacacatttaaattccaattcagcaaagaggcccatctaagctaaaaaaattaattcttcctgattaaaaagaaaaaatctgtctcccagtgtttgggaagacggactggcatttcttctaggatctgctgaccagatgtttttggtatttcctgttggtggtgatgttctgtgcactctatttcctttcaatgttgctgaaatgtgtatatctttagaatgtaaatgcaacacttaagaaaattcaaacactttggaaaagggactaaacagtgatttctctgtgttcttgaaatggttttgtgaaaatgctttgataacttcccactcaaagaagagatttacagagctttcgaaattgactttgtgtgtagcaagggacggggcactatcaggatacctcttggtgctttcctaaaatggatcccggggctttccaaggagcctggaatttcagctcacagatctgtttttcttgcttcagtgtgcattttaagtcaatagagctgagtatctagcattgaggtgagggaaatgctgcctatactcccagatgtgtttagaatatctcagaaacaacactgtgtttagctcggctttctctgctaagtatgcctttcaagtgtacaccacggagacaggaccgcgttgcaaggcgggacagcaggttcagaccacagttctcagtctgactttactcttgctaggtctgtcctactagctgttgcctgctaccgcccatggctctccatcggactgcatgtgtccttttctagtttgcaaagactaaaatgcattcccaaacctactgctaatctgagggcctcagcatcacttccagatccttgcttggagcagtctctctattgactctctcagatcgctccactgctccatgggctatcaagtaactaactgcatacctgccgttggcatcatcagaacagtccgaagaaatagtctccactcacta

SEQ ID NO: 427085 - DNA, 897 bp, Homo sapiens
cggacaggagccattgtgggcgagagcaagttaaggggagggggtgtaagagccagcgaataagagagagagtaagagggagagagaagaagaggaagaagaggaggcggcggcagcggaggaggaggaggactagtgtggggtggaaaggaagagtgagcgagagcaagttaaggggagggggtgtaagagccagcgaattctttttctttttctattattattttgacgactcctgagttgcgcccatgctcttgtcagcttcgttttaggcgtagcatggccaggcagaagaaaatggggcaaagcgtgctccgggcggtcttctttttagtcctggggcttttgggtcattctcacggaggattccccaacaccatcagcataggtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgctttctgctcccagttctcgagaggggtgtatgccatctttggattctatgaccagatgtcaatgaacaccctgacctccttctgtggggccctgcacacatcctttgttacgcctagcttccccactgacgcagatgtgcagtttgtcatccagatgcgcccagccttgaagggcgctattctgagtcttctgggtcattacaagtgggagaagtttgtgtacctctatgacacagaacgaggtaagaagaggcacctgctctgctctttagatattcatgtaattgtgttcaaacttcctcagcttatgtgccctttgcttccaataaataaaatctaattctgttttaaa

SEQ ID NO: 427086 - DNA, 418 bp, Homo sapiens
aagaaacagtattgagagcaagagagagattgccttgagccatttgattgtaataattgtaacacatgcacacatgaggtaagaactatcactgtagaatgaatcgaattcaggcttgcccagagagatctcttaaataaataggggggtgactgcatagaacaataggtagaaatgaatgaaaattataagaaacaaggcaaattttgagggtatcatttatcatgatatcttgtttttcatgcatccatttcagtatacatctgcattgacacacgacgcaatactggtcatagcagaagctttccgctacctgaggaggcagcgagtagatgtgtcccggagaggaagtgctggagactgcttagcaaatcctgctgtgccctggagtcaaggaattgatattgagagagctctg

SEQ ID NO: 427087 - DNA, 4338 bp, Homo sapiens
cggacaggagccattgtgggcgagagcaagttaaggggagggggtgtaagagccagcgaataagagagagagtaagagggagagagaagaagaggaagaagaggaggcggcggcagcggaggaggaggaggactagtgtggggtggaaaggaagagtgagcgagagcaagttaaggggagggggtgtaagagccagcgaattctttttctttttctattattattttgacgactcctgagttgcgcccatgctcttgtcagcttcgttttaggcgtagcatggccaggcagaagaaaatggggcaaagcgtgctccgggcggtcttctttttagtcctggggcttttgggtcattctcacggaggattccccaacaccatcagcataggtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgctttctgctcccagttctcgagaggggtgtatgccatctttggattctatgaccagatgtcaatgaacaccctgacctccttctgtggggccctgcacacatcctttgttacgcctagcttccccactgacgcagatgtgcagtttgtcatccagatgcgcccagccttgaagggcgctattctgagtcttctgggtcattacaagtgggagaagtttgtgtacctctatgacacagaacgaggattttccatcctccaagcgattatggaagcagcagtgcaaaacaactggcaagtaacagcaaggtctgtgggaaacataaaggacgtccaagaattcaggcgcatcattgaagaaatggacaggaggcaggaaaagcgatacttgattgactgcgaagtcgaaaggattaacacaattttggaacaggttgtgatcctagggaaacactcaagaggttatcactacatgctcgctaacctgggttttactgatattttactggaaagagtcatgcatgggggagccaacattacaggtttccagattgtcaacaatgaaaaccctatggttcagcagttcatacagcgctgggtgaggctggatgaaagggaattccctgaagccaagaatgcaccactaaagtatacatctgcattgacacacgacgcaatactggtcatagcagaagctttccgctacctgaggaggcagcgagtagatgtgtcccggagaggaagtgctggagactgcttagcaaatcctgctgtgccctggagtcaaggaattgatattgagagagctctgaaaatggtgcaagtacaaggaatgactggaaatattcaatttgacacttatggacgtaggacaaattataccatcgatgtgtatgaaatgaaagtcagtggctctcgaaaagctggctactggaacgagtatgaaaggtttgtgcctttctcagatcagcaaatcagcaatgacagtgcatcctcagagaatcggaccatagtagtgactaccattctggaatcaccatatgtaatgtacaagaagaaccatgagcaactggaaggaaatgaacgatatgaaggctattgtgtagacctagcctatgaaatagccaaacatgtaaggatcaaatacaaattgtccatcgttggtgacgggaaatatggtgcaagggatccagagactaaaatatggaacggcatggttggggaacttgtctatgggagagctgatatagctgttgctccactcactataacattggtccgtgaagaagtcatagatttttcaaagccattcatgagcctgggcatctccatcatgataaagaagcctcagaaatcaaaaccaggcgtattctcatttctggatcccctggcttatgaaatctggatgtgcattgtctttgcttacattggagtcagcgtagttcttttcctagtcagcaggttcagtccttatgaatggcacttggaagacaacaatgaagaacctcgtgacccacaaagtcctcctgatcctccaaatgaatttggaatatttaacagtctttggttttccttgggtgcctttatgcagcaaggatgtgatatttctccaagatcactctccgggcgcattgttggaggggtttggtggttcttcaccctgatcataatttcttcctatactgccaatctcgctgctttcctgactgtggagaggatggtttctcccatagagagtgctgaagacttagctaaacagactgaaattgcatatgggaccctggactccggttcaacaaaagaatttttcagaagatccaaaattgctgtgtacgagaaaatgtggtcttacatgaaatcagcggagccatctgtgtttaccaaaacaacagcagacggagtggcccgagtgcgaaagtccaagggaaagttcgccttcctgctggagtcaaccatgaatgagtacattgagcagagaaaaccatgtgatacgatgaaagttggtggaaatctggattccaaaggctatggtgtggcaacccctaaaggctcagcattaggaaatgctgttaacctggcagtattaaaactgaatgagcaaggcctcttggacaaattgaaaaacaaatggtggtacgacaaaggagagtgcggcagcgggggcggtgactccaaggacaagaccagcgctctgagcctgagcaatgtggcaggcgttttctatatacttgtcggaggtctggggctggccatgatggtggctttgatagaattctgttacaaatcacgggcagagtccaaacgcatgaaactcacaaagaacacccaaaactttaagcctgctcctgccaccaacactcagaattatgctacatacagagaaggctacaacgtgtatggaacagagagtgttaagatctagggatcccttcccactggaggcatgtgatgagaggaaatcaccgaaaacgtggctgcttcaaggatcctgagccagatttcactctccttggtgtcgggcatgacacgaatattgctgatggtgcaatgacctttcaataggaaaaactgatttttttttccttcagtgccttatggaacactctgagactcgcgacaatgcaaaccatcattgaaatctttttgctttgcttgaaaaaaaataattaaaataaaaaccaacaaaaatggacatgcaagattccagtatgcgaaaaaaaatcttattaagtcaattcaacaaaagccattctttgataccactgcagagtatataaacaccatgttctttaatacacacacacacacacacacacacacacacacacatttaaattccaattcagcaaagaggcccatctaagctaaaaaaattaattcttcctgattaaaaagaaaaaatctgtctcccagtgtttgggaagacggactggcatttcttctaggatctgctgaccagatgtttttggtatttcctgttggtggtgatgttctgtgcactctatttcctttcaatgttgctgaaatgtgtatatctttagaatgtaaatgcaacacttaagaaaattcaaacactttggaaaagggactaaacagtgatttctctgtgttcttgaaatggttttgtgaaaatgctttgataacttcccactcaaagaagagatttacagagctttcgaaattgactttgtgtgtagcaagggacggggcactatcaggatacctcttggtgctttcctaaaatggatcccggggctttccaaggagcctggaatttcagctcacagatctgtttttcttgcttcagtgtgcattttaagtcaatagagctgagtatctagcattgaggtgagggaaatgctgcctatactcccagatgtgtttagaatatctcagaaacaacactgtgtttagctcggctttctctgctaagtatgcctttcaagtgtacaccacggagacaggaccgcgttgcaaggcgggacagcaggttcagaccacagttctcagtctgactttactcttgctaggtctgtcctactagctgttgcctgctaccgcccatggctctccatcggactgcatgtgtccttttctagtttgcaaagactaaaatgcattcccaaacctactgctaatctgagggcctcagcatcacttccagatccttgcttggagcagtctctctattgactctctcagatcgctccactgctccatgggctatcaagtaactaactgcatacctgccgttggcatcatcagaacagtccgaagaaatagtctccactcacta

SEQ ID NO: 427088 - DNA, 978 bp, Homo sapiens
cggacaggagccattgtgggcgagagcaagttaaggggagggggtgtaagagccagcgaataagagagagagtaagagggagagagaagaagaggaagaagaggaggcggcggcagcggaggaggaggaggactagtgtggggtggaaaggaagagtgagcgagagcaagttaaggggagggggtgtaagagccagcgaattctttttctttttctattattattttgacgactcctgagttgcgcccatgctcttgtcagcttcgttttaggcgtagcatggccaggcagaagaaaatggggcaaagcgtgctccgggcggtcttctttttagtcctggggcttttgggtcattctcacggaggattccccaacaccatcagcataggtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgcttgtcctgctgaaagggactacctgccttggccaggaagcatcagggaaaacaattggacagctctgccgtgctgcaaagatcatgggctgctgcacctaaaatgttcaccaggtggggcccgccaaaactgggcctattgtatctggggcgttacaggtgaactgtaagatgagaacaagatcacaagtcagcactacctcctcccttcttgagttctcaactgagtgagcatcatggagggagaagaaagaaagaagttcagcctgggtgtgtgaagctgtaaagttgcaggttgaacccaaacccattttagagacagaagaaactaccctctggagataaaataaaaagatgaagctgagatgggacaggatcaaagttgatgaaatatcaagagaggttaataaaggaacattaatttattcctcaaa

SEQ ID NO: 427089 - DNA, 1494 bp, Homo sapiens
cggacaggagccattgtgggcgagagcaagttaaggggagggggtgtaagagccagcgaataagagagagagtaagagggagagagaagaagaggaagaagaggaggcggcggcagcggaggaggaggaggactagtgtggggtggaaaggaagagtgagcgagagcaagttaaggggagggggtgtaagagccagcgaattctttttctttttctattattattttgacgactcctgagttgcgcccatgctcttgtcagcttcgttttaggcgtagcatggccaggcagaagaaaatggggcaaagcgtgctccgggcggtcttctttttagtcctggggcttttgggtcattctcacggaggattccccaacaccatcagcataggtggacttttcatgagaaacacagtgcaggagcacagcgctttccgctttgccgtgcagttatacaacaccaaccagaacaccaccgagaagcccttccatttgaattaccacgtagatcacttggattcctccaatagtttttccgtgacaaatgctttctgctcccagttctcgagaggggtgtatgccatctttggattctatgaccagatgtcaatgaacaccctgacctccttctgtggggccctgcacacatcctttgttacgcctagcttccccactgacgcagatgtgcagtttgtcatccagatgcgcccagccttgaagggcgctattctgagtcttctgggtcattacaagtgggagaagtttgtgtacctctatgacacagaacgaggattttccatcctccaagcgattatggaagcagcagtgcaaaacaactggcaagtaacagcaaggtctgtgggaaacataaaggacgtccaagaattcaggcgcatcattgaagaaatggacaggaggcaggaaaagcgatacttgattgactgcgaagtcgaaaggattaacacaattttggaacaggttgtgatcctagggaaacactcaagaggttatcactacatgctcgctaacctgttccctttgatactgagctctatctggcaaagacatctttgtacatttacatggaacttcccctggtaacaatcctaaagtgagaagacttggatattccatgaatgctttaacgaagacctctcagaggtcaagatgtacatttcagagtggacaatgagctgcagaaaattctagcttgttgaaatcccggaaagaaacagaagatttcaccaggagtacaacccagagatgtgatctactcaggctagaagtggacatcccaatagagcaagactctctctaacatggcgctgtttgtcaacgttagtcccagaattagccatcatgtgtacaatctgtcagtcaagcagcctctcaatctctcatggtcttcttcttctgttctctactttccctttctttgttccgacattttttatgttctaaataaaaaattcaaatgctcaaagccacgtgttgtga

SEQ ID NO: 427090 - DNA, 2626 bp, Homo sapiens
ggaattccaatgaatgaatgaatgaatgagtgaatgaatcaacgaaggagtgagtcaaggcccgggaaccacagactccaagcctacgcagagcccgggaagggggattccggaggggcggggcctctttccggaagcgcccgccgggggcggggagggggcggggccatccgcgtgaggcgaccctgttggtccggaggggcggggcgaggaggaggaccggccttgggcggttcggctgcccacagtaaccgctgggtggacctggccagcgctccgaaccttgtcctcgctgcgcgccggcccctcggagccccacagcccgggaaggaggccgccgcgggccgggcgcccgctctgccaagcggacccgcaacccggaaaggcggcgcggcggagcctggagccggatcctgctcagaccgggccccggccggccagagccgcgggcatgtcggaggcgcggaaggggccggacgaggcggaggagagccagtacgactctggcattgagtctctgcgctctctgcgctccctacccgagtccacctcggctccagcctccgggccctcggacggcagcccccagccctgcacccatcctccgggacccgtcaaggaaccacaggagaaggaagacgcggatggggagcgggctgattccacctatggctcctcctcgctcacctacaccctgtccttgctggggggccccgaggctgaggacccggccccacgcctgccactcccccacgtgggggcgctgagccctcagcagctggaagcactcacttacatctccgaggacggagacacgctggtccacctggcagtgattcatgaggccccagcggtgctgctctgttgcctggctttgctgccccaggaggtcctggacattcaaaataacctttaccagacagcactccatctggctgtacatctggaccaaccgggcgcagttcgggcactggtgctgaagggggccagccgggcactacaggaccggcatggtgacacagcccttcatgtggcctgccagcgccagcacttggcctgtgcccgctgcctgctggaagggcggccagagccaggcagaggaacatctcactctctggacctccagctgcaaaactggcaaggtctggcttgtctccacattgccacccttcagaagaaccaaccactcatggaattgctgcttcggaatggagctgacattgatgtgcaggagggcaccagtggtaagacagcgctgcacctggctgtggaaacccaagagcggggcctggtacagttcctgctccaggctggtgcccaggtagatgcccgcatgctgaacgggtgcacacccctgcacctggcagctggccggggtctcatgggcatctcatccactctgtgcaaggcgggtgctgactccctgctgcggaatgtggaggatgagacgccccaggacctgactgaggaatcccttgtccttttgccctttgatgacctgaagatctcagggaaactgctgctgtgtaccgactgaagccaggcagggtctgggatcctcagggctccacctctccatctggaagccggagccataactgctgcagtttgggcccaggctatgtgctcttctggtgccctagggactgctgtggccagagcctggggccagccagtacagtcctgagccgaggaggagggactgcaagtggaagagagccagtctggaaggaagagctttccaggtggacagggcttcttggaagacccccaaagccccaggtatcctgggtgaagcctgtttgcctctcttgaaaatggcaggtgctcttgttttacccatgttgggtcagcctgaaactgccaaccagtaggaagcatggactctcctgagtgagaagagactgaaataggagcaagcagaaccctgagaggtgtcccatcttattgctgttgaggaccctgaaacaccgttgtttaaagacttcacacagaaggctctgaactgagccactggggaagggaagtttcagtaacatgacactaaaatggcagagacgttaaaaaaagtttttcccttctagagctgttttgcgcgcatgcatgtctgtgtgcattggggctttttagacaggcctgccctgtgactttgtggtagaggcagagagaaggaaattgtcccctgagcacggtagggccttgctgggtggggtcagaggccagtagttccaggcctttctctgtgtccagcacagacccttgtccttgctgtggaaatgatgagggatggagggacaagaggaagaatgagaggacacacgccctggagccctcaccactgccctgggggttgccatctggaggagcctggggataagggtaacccagggaggctgggcacgagggagctgactccacgtttttccccccgttcctcaccttcgagggccctgctaggtcacccctatgctggcatgaagagcatggggcaataaaccagcacagtctctgaccacttggagcgtctcatccagtgagagagacagccgttaaaagcataaacatccaaataaagatgcctttccaagttgcagtgggtgctatgaagggaaaagaatagtgggaa

SEQ ID NO: 427091 - DNA, 1966 bp, Homo sapiens
ggaattccaatgaatgaatgaatgaatgagtgaatgaatcaacgaaggagtgagtcaaggcccgggaaccacagactccaagcctacgcagagcccgggaagggggattccggaggggcggggcctctttccggaagcgcccgccgggggcggggagggggcggggccatccgcgtgaggcgaccctgttggtccggaggggcggggcgaggaggaggaccggccttgggcggttcggctgcccacagtaaccgctgggtggacctggccagcgctccgaaccttgtcctcgctgcgcgccggcccctcggagccccacagcccgggaaggaggccgccgcgggccgggcgcccgctctgccaagcggacccgcaacccggaaaggcggcgcggcggagcctggagccggatcctgctcagaccgggccccggccggccagagccgcgggcatgtcggaggcgcggaaggggccggacgaggcggaggagagccagtacgactctggcattgagtctctgcgctctctgcgctccctacccgagtccacctcggctccagcctccgggccctcggacggcagcccccagccctgcacccatcctccgggacccgtcaaggaaccacaggagaaggaagacgcggatggggagcgggctgattccacctatggctcctcctcgctcacctacaccctgtccttgctggggggccccgaggctgaggacccggccccacgcctgccactcccccacgtgggggcgctgagccctcagcagctggaagcactcacttacatctccgaggacggagacacacagcactccatctggctgtacatctggaccaaccgggcgcagttcgggcactggtgctgaagggggccagccgggcactacaggaccggcatggtgacacagcccttcatgtggcctgccagcgccagcacttggcctgtgcccgctgcctgctggaagggcggccagagccaggcagaggaacatctcactctctggacctccagctgcaaaactggcaaggtctggcttgtctccacattgccacccttcagaagaaccaaccactcatggaattgctgcttcggaatggagctgacattgatgtgcaggagggcaccagtggtaagacagcgctgcacctggctgtggaaacccaagagcggggcctggtacagttcctgctccaggctggtgcccaggtagatgcccgcatgctgaacgggtgcacacccctgcacctggcagctggccggggtctcatgggcatctcatccactctgtgcaaggcgggtgctgactccctgctgcggaatgtggaggatgagacgccccaggacctgactgaggaatcccttgtccttttgccctttgatgacctgaagatctcagggaaactgctgctgtgtaccgactgaagccaggcagggtctgggatcctcagggctccacctctccatctggaagccggagccataactgctgcagtttgggcccaggctatgtgctcttctggtgccctagggactgctgtggccagagcctggggccagccagtacagtcctgagccgaggaggagggactgcaagtggaagagagccagtctggaaggaagagctttccaggtggacagggcttcttggaagacccccaaagccccaggtatcctgggtgaagcctgtttgcctctcttgaaaatggcaggtgctcttgttttacccatgttgggtcagcctgaaactgccaaccagtaggaagcatggactctcctgagtgagaagagactgaaataggagcaagcagaaccctgagaggtgtcccatcttattgctgttgaggaccctgaaacaccgttgtttaaagacttcacacagaaggctctgaactgagccactggggaagggaagtttcagtaacatgacactaaaatggcagagacgttaaaaaaa

SEQ ID NO: 427092 - DNA, 1936 bp, Homo sapiens
ggaattccaatgaatgaatgaatgaatgagtgaatgaatcaacgaaggagtgagtcaaggcccgggaaccacagactccaagcctacgcagagcccgggaagggggattccggaggggcggggcctctttccggaagcgcccgccgggggcggggagggggcggggccatccgcgtgaggcgaccctgttggtccggaggggcggggcgaggaggaggaccggccttgggcggttcggctgcccacagtaaccgctgggtggacctggccagcgctccgaaccttgtcctcgctgcgcgccggcccctcggagccccacagcccgggaaggaggccgccgcgggccgggcgcccgctctgccaagcggacccgcaacccggaaaggcggcgcggcggagcctggagccggatcctgctcagaccgggccccggccggccagagccgcgggcatgtcggaggcgcggaaggggccggacgaggcggaggagagccagtacgactctggcattgagtctctgcgctctctgcgctccctacccgagtccacctcggctccagcctccgggccctcggacggcagcccccagccctgcacccatcctccgggacccgtcaaggaaccacaggagaaggaagacgcggatggggagcgggctgattccacctatggctcctcctcgctcacctacaccctgtccttgctggggggccccgaggctgaggacccggccccacgcctgccactcccccacgtgggggcgctgagccctcagcagctggaagcactcacttacatctccgaggacggagacacgctggtccacctggcagtgattcatgaggccccagcggtgctgctctgttgcctggctttgctgccccaggaggtcctggacattcaaaataacctttaccagacagcactccatctggctgtacatctggaccaaccgggcgcagttcgggcactggtgctgaagggggccagccgggcactacaggaccggcatggtgacacagcccttcatgtggcctgccagcgccagcacttggcctgtgcccgctgcctgctggaagggcggccagagccaggcagaggaacatctcactctctggacctccagctgcaaaactggcaaggtctggcttgtctccacattgccacccttcagaagaaccaaccactcatggaattgctgcttcggaatggagctgacattgatgtgcaggagggcaccagtggtaagacagcgctgcacctggctgtggaaacccaagagcggggcctggtacagttcctgctccaggctggtgcccaggtagatgcccgcatgctgaacgggtgcacacccctgcacctggcagctggccggggtctcatgggcatctcatccactctgtgcaaggcgggtgctgactccctgctgcggaatgtggaggatgagacgccccaggacctgactgaggaatcccttgtccttttgccctttgatgacctgaagatctcagggaaactgctgctgtgtaccgactgaagccagtacagtcctgagccgaggaggagggactgcaagtggaagagagccagtctggaaggaagagctttccaggtggacagggcttcttggaagacccccaaagccccaggtatcctgggtgaagcctgtttgcctctcttgaaaatggcaggtgctcttgttttacccatgttgggtcagcctgaaactgccaaccagtaggaagcatggactctcctgagtgagaagagactgaaataggagcaagcagaaccctgagaggtgtcccatcttattgctgttgaggaccctgaaacaccgttgtttaaagacttcacacagaaggctctgaactgagccactggggaagggaagtttcagtaacatgacactaaaatggcagagacgttaaaaaaa

SEQ ID NO: 427093 - DNA, 680 bp, Homo sapiens
caacaggtttccctgggtcccctttcccaagtcaccttttcccatgtcctctgatcttgcttctctccattctccttctcagtcccttgtccttttgccctttgatgacctgaagatctcagggaaactgctgctgtgtaccgactgaagccaggcagggtctgggatcctcagggctccacctctccatctggaagccggagccataactgctgcagtttgggcccaggctatgtgctcttctggtgccctagggactgctgtggccagagcctggggccagccagtacagtcctgagccgaggaggagggactgcaagtggaagagagccagtctggaaggaagagctttccaggtggacagggcttcttggaagacccccaaagccccaggtatcctgggtgaagcctgtttgcctctcttgaaaatggcaggtgctcttgttttacccatgttgggtcagcctgaaactgccaaccagtaggaagcatggactctcctgagtgagaagagactgaaataggagcaagcagaaccctgagaggtgtcccatcttattgctgttgaggaccctgaaacaccgttgtttaaagacttcacacagaaggctctgaactgagccactggggaagggaagtttcagtaacatgacactaaaatggcagagacgttaaaaaaa

SEQ ID NO: 427094 - DNA, 2069 bp, Homo sapiens
ggaattccaatgaatgaatgaatgaatgagtgaatgaatcaacgaaggagtgagtcaaggcccgggaaccacagactccaagcctacgcagagcccgggaagggggattccggaggggcggggcctctttccggaagcgcccgccgggggcggggagggggcggggccatccgcgtgaggcgaccctgttggtccggaggggcggggcgaggaggaggaccggccttgggcggttcggctgcccacagtaaccgctgggtggacctggccagcgctccgaaccttgtcctcgctgcgcgccggcccctcggagccccacagcccgggaaggaggccgccgcgggccgggcgcccgctctgccaagcggacccgcaacccggaaaggcggcgcggcggagcctggagccggatcctgctcagaccgggccccggccggccagagccgcgggcatgtcggaggcgcggaaggggccggacgaggcggaggagagccagtacgactctggcattgagtctctgcgctctctgcgctccctacccgagtccacctcggctccagcctccgggccctcggacggcagcccccagccctgcacccatcctccgggacccgtcaaggaaccacaggagaaggaagacgcggatggggagcgggctgattccacctatggctcctcctcgctcacctacaccctgtccttgctggggggccccgaggctgaggacccggccccacgcctgccactcccccacgtgggggcgctgagccctcagcagctggaagcactcacttacatctccgaggacggagacacgctggtccacctggcagtgattcatgaggccccagcggtgctgctctgttgcctggctttgctgccccaggaggtcctggacattcaaaataacctttaccagacagcactccatctggctgtacatctggaccaaccgggcgcagttcgggcactggtgctgaagggggccagccgggcactacaggaccggcatggtgacacagcccttcatgtggcctgccagcgccagcacttggcctgtgcccgctgcctgctggaagggcggccagagccaggcagaggaacatctcactctctggacctccagctgcaaaactggcaaggtctggcttgtctccacattgccacccttcagaagaaccaaccactcatggaattgctgcttcggaatggagctgacattgatgtgcaggagggcaccagtggtaagacagcgctgcacctggctgtggaaacccaagagcggggcctggtacagttcctgctccaggctggtgcccaggtagatgcccgcatgctgaacgggtgcacacccctgcacctggcagctggccggggtctcatgggcatctcatccactctgtgcaaggcgggtgctgactccctgctgcggaatgtggaggatgagacgccccaggacctgactgaggaatcccttgtccttttgccctttgatgacctgaagatctcagggaaactgctgctgtgtaccgactgaagccaggcagggtctgggatcctcagggctccacctctccatctggaagccggagccataactgctgcagtttgggcccaggctatgtgctcttctggtgccctagggactgctgtggccagagcctggggccagccagtacagtcctgagccgaggaggagggactgcaagtggaagagagccagtctggaaggaagagctttccaggtggacagggcttcttggaagacccccaaagccccaggtatcctgggtgaagcctgtttgcctctcttgaaaatggcaggtgctcttgttttacccatgttgggtcagcctgaaactgccaaccagtaggaagcatggactctcctgagtgagaagagactgaaataggagcaagcagaaccctgagaggtgtcccatcttattgctgttgaggaccctgaaacaccgttgtttaaagacttcacacagaaggctctgaactgagccactggggaagggaagtttcagtaacatgacactaaaatggcagagacgttaaaaaaa

SEQ ID NO: 427095 - DNA, 2123 bp, Homo sapiens
ggaattccaatgaatgaatgaatgaatgagtgaatgaatcaacgaaggagtgagtcaaggcccgggaaccacagactccaagcctacgcagagcccgggaagggggattccggaggggcggggcctctttccggaagcgcccgccgggggcggggagggggcggggccatccgcgtgaggcgaccctgttggtccggaggggcggggcgaggaggaggaccggccttgggcggttcggctgcccacagtaaccgctgggtggacctggccagcgctccgaaccttgtcctcgctgcgcgccggcccctcggagccccacagcccgggaaggaggccgccgcgggccgggcgcccgctctgccaagcggacccgcaacccggaaaggcggcgcggcggagcctggagccggatcctgctcagaccgggccccggccggccagagccgcgggcatgtcggaggcgcggaaggggccggacgaggcggaggagagccagtacgactctggcattgagtctctgcgctctctgcgctccctacccgagtccacctcggctccagcctccgggccctcggacggcagcccccagccctgcacccatcctccgggacccgtcaaggaaccacaggagaaggaagacgcggatggggagcgggctgattccacctatggctcctcctcgctcacctacaccctgtccttgctggggggccccgaggctgaggacccggccccacgcctgccactcccccacgtgggggcgctgagccctcagcagctggaagcactcacttacatctccgaggacggagacacgctggtccacctggcagtgattcatgaggccccagcggtgctgctctgttgcctggctttgctgccccaggaggtcctggacattcaaaataacctttaccagacagcactccatctggctgtacatctggaccaaccgggcgcagttcgggcactggtgctgaagggggccagccgggcactacaggaccggcatggtgacacagcccttcatgtggcctgccagcgccagcacttggcctgtgcccgctgcctgctggaagggcggccagagccaggcagaggaacatctcactctctggacctccagctgcaaaactggcaaggtctggcttgtctccacattgccacccttcagaagaaccaaccactcatggaattgctgcttcggaatggagctgacattgatgtgcaggagggcaccagtggtaagacagcgctgcacctggctgtggaaacccaagagcggggcctggtacagttcctgctccaggctggtgcccaggtagatgcccgcatgctgaacgggtgcacacccctgcacctggcagctggccggggtctcatgggcatctcatccactctgtgcaaggcgggtgctgactccctgctgcggaatgtggaggatgagacgccccaggacctgactgaggaatcccttgtccttttgccctttgatgacctgaagatctcagggaaactgctgctgtgtaccgactgaagccaggcagggtctgggatcctcagggctccacctctccatctggaagccggagccataactgctgcagtttgggcccaggctatgtgctcttctggtgccctagggactgctgtggccagagcctggggccagccagtacagtcctgagccgaggaggagggactgcaagtggaagagagccagtctggaaggaagagctttccaggtggacagggcttcttggaagacccccaaagccccaggtatcctgggtgaagcctgtttgcctctcttgaaaatggcaggtgctcttgttttacccatgttgggtcagcctgaaactgccaaccagtaggaagcatggactctcctgagtgagaagagactgaaataggagcaagcagaaccctgagaggtgtcccatcttattgctgttgaggaccctgaaacaccgttgtttaaagacttcacacagaaggctctgaactgagccactggggaagggaagtttcagtaacatgacactaaaatggcagagacgttaaaaaaaaaaatggttataagatagattaaaaaaactttagggggggcccggtccccaatg

SEQ ID NO: 427096 - DNA, 1306 bp, Homo sapiens
  misc_feature (1236)..(1236): n is a, c, g, or t
  misc_feature (1291)..(1291): n is a, c, g, or t
ggaattccaatgaatgaatgaatgaatgagtgaatgaatcaacgaaggagtgagtcaaggcccgggaaccacagactccaagcctacgcagagcccgggaagggggattccggaggggcggggcctctttccggaagcgcccgccgggggcggggagggggcggggccatccgcgtgaggcgaccctgttggtccggaggggcggggcgaggaggaggaccggccttgggcggttcggctgcccacagtaaccgctgggtggacctggccagcgctccgaaccttgtcctcgctgcgcgccggcccctcggagccccacagcccgggaaggaggccgccgcgggccgggcgcccgctctgccaagcggacccgcaacccggaaaggcggcgcggcggagcctggagccggatcctgctcagaccgggccccggccggccagagccgcgggcatgtcggaggcgcggaaggggccggacgaggcggaggagagccagtacgactctggcattgagtctctgcgctctctgcgctccctacccgagtccacctcggctccagcctccgggccctcggacggcagcccccagccctgcacccatcctccgggacccgtcaaggaaccacaggagaaggaagacgcggatggggagcgggctgattccacctatggctcctcctcgctcacctacaccctgtccttgctggggggccccgaggctgaggacccggccccacgcctgccactcccccacgtgggggcgctgagccctcagcagctggaagcactcacttacatctccgaggacggagacacgctggtccacctggcagtgattcatgaggccccagcggtgctgctctgttgcctggctttgctgccccaggaggtcctggacattcaaaataacctttaccagacagcactccatctggctgtacatctggaccaaccgggcgcagttcgggcactggtgctgaagggggccagccgggcactacaggaccggcatggtgacacagcccttcatgtggcctgccagcgccagcacttggcctgtgcccgctgcctgctggaagggcggccagagccaggcagaggaacatctcactctctggacctccagctgcaaaactggcaaggtctggcttgtctccacattgccacccttcagaagaaccaaccactcatggaattgctgcttcggaatggagctgacattgatgtgcaggaggnacagtggtaaaaacctgcactggctgtgaaaccaaaacgggctggtaattctgcncagctgtgccagtaa

SEQ ID NO: 427097 - DNA, 1265 bp, Homo sapiens
gtggaggttgtaatgagccaagatcactccaccctgggccacagaggaagactccgtctcaaaaaaacaaaaattcccataaaaaaaatagatgtttctcacatgttgagcatatatggatttcatttttaatatgattgtagaaacattagatttaaagcatattgaaaaagaaaacagtatattctttaggagcttcaaaaaagggttttggtttagttcaaagggtgaaagaagatcttttattattttggtaaataacttctaaggaaacaaaccaccctcacatgcactatctcatttgtatttctgtcaattctgaaaggccagcatttggccagtattatttgaatctgtattgtattttttaaccagaagaatgaaggtttatagcttcattcttttggaagaggaggctggagaccacaggttaaatgcaggtgcatcgctcttggccggccctggcagggtcctttctccctccttttacactcgcagacaagcttgtggatgctcaataaggacagctgccgtttggacagagattaatcatttatttgtgaaggttttttctgccttgctttcttgttcttttttaaatcttcacattgttttgatcccaaaatgtttgtgttgtccttactcaaaactaggaaaaacaattatgtggtaagaggctcagagccacttacttaaatctcaactagatttatttgtgagaacatctgttttctgatatttagacacttcctcttccattgctgtttcctatgactcatgcacagttatttgttcaggtttcatggaatttcccaagtgtatttacctttgtttggtttttaaaatgtaaattatattgccccaataaatgagtatgtgtgtcagggggactgtggctgggtcattgcatgtggaaggggagtttacagaagagaactcctagaagagctttacttaactatgaaaattttcaaagaataggacatttctaataagtccctaagagtgtcctgaaggacatgttttggttctgaaacatagtttctataatcatccttaaaaaataacttgtttctgcttaataggctttactatgaatatacctccatatattattgagttagaatgtgagaaaaggagattaatttttgaagtacaaatatagtgagttagtgagtgtaggcatcctgactgcctagtcataactttgatgaagtagaaataccaacatcctcaatatgaagatatgcagcagccccaccaaa

SEQ ID NO: 427098 - DNA, 252 bp, Homo sapiens
aaaacattcaatgactccttgataccatcaggataaagctttaaaaatttcccaaagtgctgagattacaggcatgagcaaccacacctggccgatacatacctatattaaacattagtatgttcatgttagaataatgtaccttttgaatttcataaacttggagaacatttatattgatgatggatgaaagaactttcttggatggatgaagagagtaacgctgtgaaacaaccagcaggtggcgaaaac

SEQ ID NO: 427099 - DNA, 455 bp, Homo sapiens
ataatcaatctgatgtaccatttccatgtaaagggaaaaaaaattgaataaaagtggccctttacttagagtaactaagcaagactctcctgaaattactccactagctttgattttaagtattaaggcagaattaggctgggtgtggtggctcacgccagtaatcccagcactttgggaggctgagacaggcgaatcacgaggtcaggagttcgagaccagcctggccaacatggtgaaaccccgtctctatcccaaagtgctgagattacaggcatgagcaaccacacctggccgatacatacctatattaaacattagtatgttcatgttagaataatgtaccttttgaatttcataaacttggagaacatttatattgatgatggatgaaagaactttcttggatggatgaagagagtaacgctgtgaaacaaccagcaggtggcgaaaac

SEQ ID NO: 427100 - DNA, 1218 bp, Homo sapiens
aaactgcctgtcatagtctgctctctggtctccagtaatttacatacctccatgtcgaaaatacactgaccccctcccaggtctcatcccattgtagcgttagctcagagtccagagttttattacctaaattaggtccggttggatgagccccccaggtatagttccttaagcacagctcctcaagtacagttcttctcaatctgtgaacttgtggaaccaaagagacaagttatcctttccccatgtacctagcatacaatggtgagacaggcattagataaccaatatacacatttctgtacataaaaggggagaatgggaggcacaaaaaggagtcattgattttatttgctgttccaaaatccaggaaatgttggagtttcttttatcaggcctcaaagcagaagaataattctccgtggttcttggctctaccctctagactcttggttttgtcttctgagtcttcctttttcatcaaagctagagtgtgtttttacctgagttcttttctcaggctgcttctttccagtagaattttaggggaactagtggtctctattttgtactgtttctgtcctttttgatccaagatggcagtgtttctactgatacagaagattttgtgggcctcctgtgattctccttgggatttactccattagacaaaagccacactcataaatatcttctttatgagacctaagcttcttacagactctgtttttcggttgaaaggatctgtgaaacataatcttctgaacagccttttgtatgactgaatagcacaatcagccctccgtatccacaggttccacatcccagattcaaccaactgtggactgaaaatacttgagagcctggtgtggtggctcatgcctgtaatcccaccactttgggaggctgaggtgggaggattgcttgaggcagtttgagaccagcctggtcaatataacgagaccccatccctttgaaaaaaaaaaagaaagaaacgaaaaaatactggaaaaaaaaaaaaaagtcgtgaaaatgttatgttgttgctgatatgtactgtacagttaggcctgtacttaacatgtacagacttttcttgtcattatttcctgaacaatatagtataacaactatttacatagcatttgcattgtattagttatcataaatatctaggaatgatttaaagtatatggagggccagaatattagggtcac

SEQ ID NO: 427101 - DNA, 852 bp, Homo sapiens
gcccctttctccatataatcttatctctcttttcaagtccttggaaacctctataatttgattgcatcataataaattaccccaaagattagtggcttaaaataacaaacatatatcatactttctgtgggtcaggaatccaggcccagcttagctgggtcctctggctcaagatttctcatgaggtggcatttaagctgttggccagggctggggtctcatctgaaggctcaaacaggaagatctgcttttaagcttatttatgtggttactggtaggattctgttccttgtgggttgctgaactgagggccttagttccttgctggctgttgtctgggggcttccctcagttctttgctacatggacttctccataggacagctcagaacatggcacctgggctatctgacaagtgaacaagagagcatgtgcctatgcagaaaccatggcctcttataacttaatctcagaattgacattctacttgtgctacattctgttcactaaatgcagcccacactcaagaggaaggaattacccatgggtgtgaataccaggaggtgcagggatcattgtgagccatcttagaaactgcctgtcatagtctgctctctggtctccagtaatttacatacctccatgtcgaaaatacactgaccccctcccaggtctcatcccattgtagcgttagctcagagtccagagttttattacctaaattaggtccggttggatgagccccccaggtatagttccttaagcacagctcctcaagtacagttcttctcaatctgtgaacttgtggaaccaaagagacaagttatcctttccccatgtacctagcataca

SEQ ID NO: 427102 - DNA, 1800 bp, Homo sapiens
cttgtatgtatagcagcatacttggacatgaaacacacttctggttagattccagtcaagttctataggtgttattggtaggcagaaaggctgttgtagaattcttctggtgattttcagtccctgacccaggtatattgtcctttgagtcccagattaactaactatagcagctaagcatttgaatcagacttctcatagcaatgttatgggctgtctgatatattcaggatttgttgagcagataagctgtgtgtgatcttactcattctcagccatgccgcagacatacccatttccctttagtaattttttaatacagagaatgctattaactgttactggatatcaaataattttatttttctaatagtattttccaaatatttcttaaaattcttaaaatttaggttaaagtttgctggtctcttacatttaataaagctgggacttgaagacttaccatagttttcaactgcctttgcaagttcataaacttctaagggtaaaaagtgaataagataaattcagagttttaaggtaaaggctttatattagctttttttttttttaaaggttttttgtggggtttttttgttttttttttttttgggatggagtctcgctctgtcacccatgattgtgccacttcaccctgggcaacagagaaagaccctgtctcaataaaaaagaagagaaaaactggagtgagaactctcctcctctcataatcatagtatccacgttaggaaaatgcttctgagagtaacttaaagtactgtgtgtgcatcttccttcaaaaccttgcttttttctccgtttttgtaaggtgagaaagggaaaaaccttcaccgtagaaatactgtcttgagattaagatacaaataaaacatgttaaacctccatctaaagacattgcaacttattaaaacagaaaaatgtacctttgttatgtctttccaaatatccacacccacaccctgttcagctttgttaataatacagagatcagaaatgtgaagcacaaatgctgcttctccccctcctgttcccatgtcagagatggagaagaaagcacagtgagctgttcaccagtccagcggtgacctcggagtcctttgtaacagtgtttccaataacttctgccaataaaacagaatttgagttagaacctatctgctgtccctcaactagtgtctgatagctgagaatgtaattcgtttgtgtgtctattagaaaattaggcaggcaccacagacagtagcaacataaaggaacctgcttagaagaggtttttatggtgtgattgtgtttttttttttttaatttttgtttcctgaagtagaatccatagctcaaaacaagttttaagcctgagaaaatataatttgaggtgttttttatgctcctaatgaaaagatgaatgaatgcatcattaaaccttaacagtagagcagaatttcactgttacaaaccacatgggttctcctggttgtgctgctgttctctacctgtgtgtcactgagtttgagcatcattattgtttgaatcagaggacccactggaatcaaggcttcttggaattgcgcaagaatctgagaaaacttcaatctttaccagcatttcttaatgctttccatgacttttgtgcaattatataagttcagtttagacaaaatgctgttactttttaaggcattactaataactgaaaatagttacgtcattgcccatcaagggaaaagcacttgtaactgtcatttaaaaaaaataaaactataaaacaatataaaaaaaaat

SEQ ID NO: 427103 - DNA, 1419 bp, Homo sapiens
gtcaactagtacacgactctggtctgggggcgtggtcatgctgtaatcccagcagtttgggaagctgaggtgggtgtgatcacaatggtcaggagatcaagaccagcgcgggtctgggcaacatggagagaccttgtctcaacaaaaaaatttaaagttagccaggtgtggtggtttgcacctatagtcccagctactcaggaggctgaggtgggaggatcgcttgagcttaggaggtcaaggctgcagtgagccatgattgtgccacttcaccctgggcaacagagaaagaccctgtctcaataaaaaagaagagaaaaactggagtgagaactctcctcctctcataatcatagtatccacgttaggaaaatgcttctgagagtaacttaaagtactgtgtgtgcatcttccttcaaaaccttgcttttttctccgtttttgtaaggtgagaaagggaaaaaccttcaccgtagaaatactgtcttgagattaagatacaaataaaacatgttaaacctccatctaaagacattgcaacttattaaaacagaaaaatgtacctttgttatgtctttccaaatatccacacccacaccctgttcagctttgttaataatacagagatcagaaatgtgaagcacaaatgctgcttctccccctcctgttcccatgtcagagatggagaagaaagcacagtgagctgttcaccagtccagcggtgacctcggagtcctttgtaacagtgtttccaataacttctgccaataaaacagaatttgagttagaacctatctgctgtccctcaactagtgtctgatagctgagaatgtaattcgtttgtgtgtctattagaaaattaggcaggcaccacagacagtagcaacataaaggaacctgcttagaagaggtttttatggtgtgattgtgtttttttttttttaatttttgtttcctgaagtagaatccatagctcaaaacaagttttaagcctgagaaaatataatttgaggtgttttttatgctcctaatgaaaagatgaatgaatgcatcattaaaccttaacagtagagcagaatttcactgttacaaaccacatgggttctcctggttgtgctgctgttctctacctgtgtgtcactgagtttgagcatcattattgtttgaatcagaggacccactggaatcaaggcttcttggaattgcgcaagaatctgagaaaacttcaatctttaccagcatttcttaatgctttccatgacttttgtgcaattatataagttcagtttagacaaaatgctgttactttttaaggcattactaataactgaaaatagttacgtcattgcccatcaagggaaaagcacttgtaactgtcatttaaaaaaaataaaactataaaacaatataaaaaaaaat

SEQ ID NO: 427104 - DNA, 1248 bp, Homo sapiens
gttttgatacatatataatgatcagatcagaacaattagcatatccatcacattgaacatttatcatttatttgtgttgagcccatgattgtgccacttcaccctgggcaacagagaaagaccctgtctcaataaaaaagaagagaaaaactggagtgagaactctcctcctctcataatcatagtatccacgttaggaaaatgcttctgagagtaacttaaagtactgtgtgtgcatcttccttcaaaaccttgcttttttctccgtttttgtaaggtgagaaagggaaaaaccttcaccgtagaaatactgtcttgagattaagatacaaataaaacatgttaaacctccatctaaagacattgcaacttattaaaacagaaaaatgtacctttgttatgtctttccaaatatccacacccacaccctgttcagctttgttaataatacagagatcagaaatgtgaagcacaaatgctgcttctccccctcctgttcccatgtcagagatggagaagaaagcacagtgagctgttcaccagtccagcggtgacctcggagtcctttgtaacagtgtttccaataacttctgccaataaaacagaatttgagttagaacctatctgctgtccctcaactagtgtctgatagctgagaatgtaattcgtttgtgtgtctattagaaaattaggcaggcaccacagacagtagcaacataaaggaacctgcttagaagaggtttttatggtgtgattgtgtttttttttttttaatttttgtttcctgaagtagaatccatagctcaaaacaagttttaagcctgagaaaatataatttgaggtgttttttatgctcctaatgaaaagatgaatgaatgcatcattaaaccttaacagtagagcagaatttcactgttacaaaccacatgggttctcctggttgtgctgctgttctctacctgtgtgtcactgagtttgagcatcattattgtttgaatcagaggacccactggaatcaaggcttcttggaattgcgcaagaatctgagaaaacttcaatctttaccagcatttcttaatgctttccatgacttttgtgcaattatataagttcagtttagacaaaatgctgttactttttaaggcattactaataactgaaaatagttacgtcattgcccatcaagggaaaagcacttgtaactgtcatttaaaaaaaataaaactataaaacaatataaaaaaaaat

SEQ ID NO: 427105 - DNA, 661 bp, Homo sapiens
cttgtatgtatagcagcatacttggacatgaaacacacttctggttagattccagtcaagttctataggtgttattggtaggcagaaaggctgttgtagaattcttctggtgattttcagtccctgacccaggtatattgtcctttgagtcccagattaactaactatagcagctaagcatttgaatcagacttctcatagcaatgttatgggctgtctgatatattcaggatttgttgagcagataagctgtgtgtgatcttactcattctcagccatgccgcagacatacccatttccctttagtaattttttaatacagagaatgctattaactgttactggatatcaaataattttatttttctaatagtattttccaaatatttcttaaaattcttaaaatttaggttaaagtttgctggtctcttacatttaataaagctgggacttgaagacttaccatagttttcaactgcctttgcaagttcataaacttctaagggtaaaaagtgaataagataaattcagagttttaaggtaaaggctttatattagctttttttttttttaaaggttttttgtggggtttttttgttttttttttttttgggatggagtctcgctctgtcacccaggctggagtgcagtggcacgatct

SEQ ID NO: 427106 - DNA, 2342 bp, Homo sapiens
gttttgatacatatataatgatcagatcagaacaattagcatatccatcacattgaacatttatcatttatttgtgttgagcctttagttcttttttttttttgagatagagtctcactctgtcacccaggctggagtacagtggtgtgatcttggctcactgcaacctccacccaccggcttcaaccaattctcctgcctcagcctccctagtaactgggattacaggcacctgccaccacacccaatttttgtatttttagtagagacggggtttcaccatcttggccaggccaggctggtcttgatctcctgaccttgtgatccacccacctcagcttcccaaactgctgggattacaggcatgagccacggcccccagccagagacagtcttgctttgtcgccaggctggagtgtagtggcgccatcttggctcactgcaacctccaactccctggttcaagcagttctcctgcctcagcctcccaagtagctgggattacaggcacgcaccaccatgcccagctaatttttgtatttttagtagagacagggtttcaccatgttggccaggatggtcttgatctcctgacctcgtgatctgcccactttggcctcccaaagtgctgggattacaggtgtgagccaccgtgcccagccgagcctttagttctaagtataataaataatatatataccaggcattcctattaaaaatcttaacttaaaaaaaattactcaaatgttactactggaatttttctccctgaattgaagatacatggttagatcattaacaataccacctaaatgaaggaaacatatctggatatccagtgtcacatacttttatgtatttatttcaggaattactattttgtcaccataattaggaaacagactgtgttctttatttgaaacacaacagtataaatactatagtaaagttgggtgcagtggatcacggctgtaatcccagcactttgggagaccgaggagggatggtcacttgagcccaggagtttgagaccagcctaggcaacatggagagaccttgtctcaacaaaaaaatttaaagttagccaggtgtggtggtttgcacctatagtcccagctactcaggaggctgaggtgggaggatcgcttgagcttaggaggtcaaggctgcagtgagccatgattgtgccacttcaccctgggcaacagagaaagaccctgtctcaataaaaaagaagagaaaaactggagtgagaactctcctcctctcataatcatagtatccacgttaggaaaatgcttctgagagtaacttaaagtactgtgtgtgcatcttccttcaaaaccttgcttttttctccgtttttgtaaggtgagaaagggaaaaaccttcaccgtagaaatactgtcttgagattaagatacaaataaaacatgttaaacctccatctaaagacattgcaacttattaaaacagaaaaatgtacctttgttatgtctttccaaatatccacacccacaccctgttcagctttgttaataatacagagatcagaaatgtgaagcacaaatgctgcttctccccctcctgttcccatgtcagagatggagaagaaagcacagtgagctgttcaccagtccagcggtgacctcggagtcctttgtaacagtgtttccaataacttctgccaataaaacagaatttgagttagaacctatctgctgtccctcaactagtgtctgatagctgagaatgtaattcgtttgtgtgtctattagaaaattaggcaggcaccacagacagtagcaacataaaggaacctgcttagaagaggtttttatggtgtgattgtgtttttttttttttaatttttgtttcctgaagtagaatccatagctcaaaacaagttttaagcctgagaaaatataatttgaggtgttttttatgctcctaatgaaaagatgaatgaatgcatcattaaaccttaacagtagagcagaatttcactgttacaaaccacatgggttctcctggttgtgctgctgttctctacctgtgtgtcactgagtttgagcatcattattgtttgaatcagaggacccactggaatcaaggcttcttggaattgcgcaagaatctgagaaaacttcaatctttaccagcatttcttaatgctttccatgacttttgtgcaattatataagttcagtttagacaaaatgctgttactttttaaggcattactaataactgaaaatagttacgtcattgcccatcaagggaaaagcacttgtaactgtcatttaaaaaaaataaaactataaaacaatataaaaaaaaat

SEQ ID NO: 427107 - DNA, 6666 bp, Homo sapiens
tgctggccagaaggttcggttgcgcgtgtgccatggactcagccgcccggtgatattgacaataggagagagaaaggggcattgactgggacccaccgcgggtagcgaaaggtggctctggcagcggcggctccagctcctgcggctcctcctccttattctgtccccttctcttgctgccgctgcagatccagtcttcctccctcccttccccccctccccacgtcgtcgccgccgccgccgggtccggggcaacgagctgaggcgccgcccgccaggaatgtgagcgaggagccaccggcggagccgcaacggggtcggtgccgatttgatgggacgggcccgcgggggaggatcgtgaggccgccgccgccaccggaacgctgaggttcgggtccggccgtgaggcctagaggctccgccgccgcggaaccggagggaccccgtaccggacagccgtcgccccaggctccccgcagctgcccggacctccccctgcacgtcccggtcccgccgcccgcccccgctgcggccacctcgcccgtctcccgcccctccaagccacagatcatcttcggattcttccccagaagcttcaagtagggatatgtcctcagcaccaactactcctccatcagtggataaagtagacggattttctcggaagtccgtcagaaaagccagacagaagaggtcgcaaagttcctcacagtttaggtctcaaggcaagcctattgagttaacacctctgccgctgctaaaagacgttccatcctcagagcagcctgaactgttcctaaagaaacttcagcagtgctgtgtcatttttgacttcatggacacgctatctgatcttaaaatgaaagaatacaagcgctccactcttaatgaactggtggactacattacaataagcagaggctgtttgacagagcagacttaccctgaagtagttagaatggtatcttgcaatatattcagaactctccctcctagtgacagcaatgaatttgatccagaagaagatgaacctacccttgaggcatcgtggccacacttacagcttgtatatgaatttttcatacgatttttggaaagccaagaattccaacccagcattgccaaaaaatatatagatcagaaatttgtattacagcttctggagctatttgacagcgaagaccctcgggaacgggactacttaaaaacagtcttacacagaatttatggcaagtttcttggtcttagagcatttatccgaaaacagattaacaatatttttctaaggtttgtttatgaaacagaacacttcaatggtgtagctgaactgctggaaatattaggaagtattatcaatggctttgctttacctcttaaggcagaacacaaacagtttctggtgaaagtattgatccctttacacactgtcaggagcttatcactcttccatgcacagctggcatattgtatagtacagtttctggagaaagatccttcactcacagaaccagttattagggggttaatgaaattttggcctaaaacatgtagtcaaaaagaggtcatgttccttggggaactggaagaaatattggatgtgattgaaccttcacaatttgttaaaatccaagaacctttgtttaaacaaatcgccaagtgtgtatctagcccccattttcaggtggcagaaagagcactctattattggaataatgaatacatcatgagtttgatagaagaaaactctaacgtcatccttcccatcatgttttccagcctttataggatttcaaaagaacattggaatccggctattgtggcgttggtgtacaatgtgttgaaggcatttatggaaatgaacagcaccatgtttgacgagctgacagccacatacaagtcagatcgtcagcgtgagaaaaagaaagaaaaggagcgtgaagaattgtggaaaaaattggaggatctggagttaaagagaggtcttagacgtgatggaataattccaacttaacaaaaacaatgacaacaacattactaacctgtggagtcacacgtttatgtagtagaagatggagcaacagttttctgtattgtgcaactttacagtagatttcacctttgtttcattattacagcagcactgtatatacctgtctctaagtaaaggaaaaaacaaaataaggacttcaatccaaagtttggacagtagatggacttctcagaactttgcaaacataatcattgttctcaccctcttttaaaaaaaaaaaatcggtcttcaaagatctgttgatgaaattgctatgttaaaattccattatcgggagttccttatttatcactagcagagagtatgatacaattttcaaatgtgaacaatcttaaatttagcttgtctttctgctaagctgttaaatgtatttatagtaaaggaagaaaaaaagactgtcatttccttataagtttgtgtaacatcctcctctggataacttgactgtaatttaacatctttttcttttgcacatcttcctgagttgaatgtccacgtggaatggggtcatgaattataaaagtccctgataaaagttttgtttactggggtgaacatctttccagtaaccaggtagtcctggtactcctttagttttaaaattaggagttaagagagaagaggtgataaacatagtagggaagggaatatcggattcatgcatcagtttatggtgaatccaaatcaatgtcttgaatcctttgaaaacaggcactgggacatcacaggcttcagtacctgaccagtattagttgcatatatcattgaacacacataccagagatgttttagaaatgtgagaaaaacatccttttggaccatttgaaataagaaagacaaacactaaacaatacaaccatgaaattgatcaccgggattgcaaatctaattgggaaaagagttgagcaaacagcttggactgtttggagttgttgccttactttttaatatgtatttataaagtattccagcaaaagaggatgtagcctctgggaaaaaacaaacatgttacagtgttttttgtagattctcgttctatatctcatcacagcgccagccctgtttttagccggaaaggattcaggataaacattattatgcattctgaattggatgcatattcctaactactgtatttgttaccaaaagtggttctacaaatgctactgaaaaaaatctggaaattcctaatgtcctgagtattaataataaagtttaaaaatgcttttatatcaaaggtgcatcgtgaccaaattgtttaagaaaaaaaaacaaaaaaaaaaaatctagggctgtattttatatatatatatatatatatatatatatatatatcttattggctctctgctttgtatttaaatgaagaatcttacatcttgggtaggtaaactgctgataaaatttgtgtacagtatgtacttacctaatgcagttgcattattacgtactgaaagatatgtgtttggaggtttatttccaggatgcatttgcttgttttggtcatggcagcagtgagttggtaatcctaaaccatcacttccagcagtattcatggtatagagctgatctgtgttcatatgttgaattgtgatagtagcaaacatgaacatatgaactattgttgctcttaatagaaatacaatataaatatgggcttgtatattttcttccttacatttaaatataaagtagaatacgcagttttattattttcaagaaaaagaaagagaagctgctgacctttctcccccataaagtttttcaggatgatcaggtcacagtgtgtacgtaagagtcagctaattatggatattgtcatctcggtaactttgtaaaaaaacaaacaaaactggcattgttaattccaaaaagaaaaaaaaaagcagtaaaaaaaaaaagtcatatgcaacaccagacgcaacatggtttaatggaattaatagttttttttttttttttttttaaagaacattgatggggattcactgtaaagttggcagaggctgccaaagacgaaacaactgactttaaaaatgctggaacaatgtgataaaaaataaatttgtaacaaatcttctcctttttagcccttgtcattttagccctttagtttcaactctgcattatatttagtttatatagtgtaaacttttgtttgccattaattcatctttttaggtagaagacattaaaatcacaggtttatgaagaatctctgctcattggaatgaaatgcagtcatttgaaatgagaaaggccaggatccttttttgtaccttaccctgtcttcaagagtaaaggtgaacacttacagctctcctccttgatgtcaattttgtatgttgatcattccaaactgagaagaataaagccacattttagacatatttatagaatcaattaaagctatatgtctaaaattcgtagggcaacttctgagaagaaacaccgtctttttcttttttaatggaaagtgacaatgtgacattagtcatgttgtgtgcggtgacgcagagtaactgaggtaatctgactgttgcactatgtgacatatttcaggacgtacttgctgcatttgcagcagccctctctctctgtcccttcccacaattctgctgttgctgcaacttgagttaattgtgacaaatgcatctttgtgttatattttgtttgcttcataatttccagaactatatataaatatattttttaaatagcaaatattgtagttagtgagtgatgatcactccaaccttatccttaccatattggtttcagggataggattaagagtgtctttggaagagaaaaatacacacaaccctgtggtttagaatgacgctgaggccttaggctgtgggcctagaacaactatgtgagtgaattcacccatctcatactttgaatcaagcatgcattcctgtttctcattgtgaagtatccccagttgttttccttcagtgttgagtttttgtccttttaaattttattatattttgctctccctaacatttgactgttttttataaaagaaaagaaaaaaaaagaaataaataataccctcgatgccactggatactcacaagcagggttatgctccttcatcttgggcttgtttgcctaaatgaaagggtttaatttattttgtacctcctatgcgtgggatagtccagggtgcagagccaggacttgcttgtaattgcacctgctatacttaaatgtatagccctaggctcaatcacactatggaaagaaacaaaaaaagtatatttagagctttaaaagcttttttattttttgtggggatgagggtgggatgggaaagggatgtatggatgttattggcatttttaagtgtttagagttttttggggtttggggtggttttttttccttgttttccttttttccttttaattggatgcactgacctggcccaggaaatgaagagattctcttttgatgctattaccaatgttatcataaagtgacagtcacctgtaacaaaaaggtggcaccagacatgatcactgatgttttatttgcacatcaatatttttatttttgtattctggctcagctgcttctctgagtggagttaaggaatgagccacaaagatttttgtagtaggtatattggcattgcattttatattcctctatatttaattttgaaaacctaaaagaaggattgtgcatcttgagagaaagttgagcaaattgtgatctagcggaatgttaatttgtgctgcttcttgtgcacgatagcagcagtagtatctctcttggaaataaacatcccatattatgatgtctatgaatataggtttccttttcttccttccctccctccttcccccacctttctcttttttttttctctctcagcttctcttttcctccttccctcttcccttcctctttctttactttttttgaaatcacttattgtaaataagttgtaatccaaacctcatgtatcaatggggaattttcaaatataaatattaccaatgcattttctggttgttgtctgatttttgattgaagtataatgagaatgacatgtctgttgcttttggtttgaggacttcgctttagcttcataaatcttttggtattttagtatttcattgttttagcaggagagggcagcaaaagttcattttccctgttagtaatgctgtggttcatgatcggttttaaatttagctgtgtgtgtgtttttttaaacagcatctctttgtgagtagaggtaaaaatgaaacatttttgatatgaaaagttgcatatgaaaattatagactggttcaaccagacagtgaagacttctgatccacatcaaacttaaaatgccacaaaacaatcttccacctctggctaaaacatgctacttccttttcaaacaccacaaaatacaagctgagtcttaaacacttggaatttaaaatgtttttctttggaaatgatttgctttcttcaaagtggtaacagaaacaaaaatgaaggtgctccccaaaaagaaatgtaaccttcccctttcacagatgtgtgagaggttctgtactgtgggtgcatcataataaagaagcagtgaagagttttcaggtgac

SEQ ID NO: 427108 - DNA, 6645 bp, Homo sapiens
tgctggccagaaggttcggttgcgcgtgtgccatggactcagccgcccggtgatattgacaataggagagagaaaggggcattgactgggacccaccgcgggtagcgaaaggtggctctggcagcggcggctccagctcctgcggctcctcctccttattctgtccccttctcttgctgccgctgcagatccagtcttcctccctcccttccccccctccccacgtcgtcgccgccgccgccgggtccggggcaacgagctgaggcgccgcccgccaggaatgtgagcgaggagccaccggcggagccgcaacggggtcggtgccgatttgatgggacgggcccgcgggggaggatcgtgaggccgccgccgccaccggaacgctgaggttcgggtccggccgtgaggcctagaggctccgccgccgcggaaccggagggaccccgtaccggacagccgtcgccccaggctccccgcagctgcccggacctccccctgcacgtcccggtcccgccgcccgcccccgctgcggccacctcgcccgtctcccgcccctccaagccacagatcatcttcggattcttccccagaagcttcaagtagggatatgtcctcagcaccaactactcctccatcagtggataaagtagacggattttctcggaagtccgtcagaaaagccagacagaagaggtcgcaaagttcctcacagtttaggtctcaaggcaagcctattgagttaacacctctgccgctgctaaaagacgttccatcctcagagcagcctgaactgttcctaaagaaacttcagcagtgctgtgtcatttttgacttcatggacacgctatctgatcttaaaatgaaagaatacaagcgctccactcttaatgaactggtggactacattacaataagcagaggctgtttgacagagcagacttaccctgaagtagttagaatggtatcttgcaatatattcagaactctccctcctagtgacagcaatgaatttgatccagaagaagatgaacctacccttgaggcatcgtggccacacttacagcttgtatatgaatttttcatacgatttttggaaagccaagaattccaacccagcattgccaaaaaatatatagatcagaaatttgtattacagcttctggagctatttgacagcgaagaccctcgggaacgggactacttaaaaacagtcttacacagaatttatggcaagtttcttggtcttagagcatttatccgaaaacagattaacaatatttttctaaggtttgtttatgaaacagaacacttcaatggtgtagctgaactgctggaaatattaggaagtattatcaatggctttgctttacctcttaaggcagaacacaaacagtttctggtgaaagtattgatccctttacacactgtcaggagcttatcactcttccatgcacagctggcatattgtatagtacagtttctggagaaagatccttcactcacagaaccagttattagggggttaatgaaattttggcctaaaacatgtagtcaaaaagaggtcatgttccttggggaactggaagaaatattggatgtgattgaaccttcacaatttgttaaaatccaagaacctttgtttaaacaaatcgccaagtgtgtatctagcccccattttcaggtggcagaaagagcactctattattggaataatgaatacatcatgagtttgatagaagaaaactctaacgtcatccttcccatcatgttttccagcctttataggatttcaaaagaacattggaatccggctattgtggcgttggtgtacaatgtgttgaaggcatttatggaaatgaacagcaccatgtttgacgagctgacagccacatacaagtcagatcgtcagcgtgagaaaaagaaagaaaaggagcgtgaagaattgtggaaaaaattggaggatctggagttaaagagaggtcttagacgtgatggaataattccaacttaacaaaaacaatgacaacaacattactaacctgtggagtcacacgtttatgtagtagaagatggagcaacagttttctgtattgtgcaactttacagtagatttcacctttgtttcattattacagcagcactgtatatacctgtctctaagtaaaggaaaaaacaaaataaggacttcaatccaaagtttggacagtagatggacttctcagaactttgcaaacataatcattgttctcaccctcttttaaaaaaaaaaaatcggtcttcaaagatctgttgatgaaattgctatgttaaaattccattatcgggagttccttatttatcactagcagagagtatgatacaattttcaaatgtgaacaatcttaaatttagcttgtctttctgctaagctgttaaatgtatttatagtaaaggaagaaaaaaagactgtcatttccttataagtttgtgtaacatcctcctctggataacttgactgtaatttaacatctttttcttttgcacatcttcctgagttgaatgtccacgtggaatggggtcatgaattataaaagtccctgataaaagttttgtttactggggtgaacatctttccagtaaccaggtagtcctggtactcctttagttttaaaattaggagttaagagagaagaggtgataaacatagtagggaagggaatatcggattcatgcatcagtttatggtgaatccaaatcaatgtcttgaatcctttgaaaacaggcactgggacatcacaggcttcagtacctgaccagtattagttgcatatatcattgaacacacataccagagatgttttagaaatgtgagaaaaacatccttttggaccatttgaaataagaaagacaaacactaaacaatacaaccatgaaattgatcaccgggattgcaaatctaattgggaaaagagttgagcaaacagcttggactgtttggagttgttgccttactttttaatatgtatttataaagtattccagcaaaagaggatgtagcctctgggaaaaaacaaacatgttacagtgttttttgtagattctcgttctatatctcatcacagcgccagccctgtttttagccggaaaggattcaggataaacattattatgcattctgaattggatgcatattcctaactactgtatttgttaccaaaagtggttctacaaatgctactgaaaaaaatctggaaattcctaatgtcctgagtattaataataaagtttaaaaatgcttttatatcaaaggtgcatcgtgaccaaattgtttaagaaaaaaaaacaaaaaaaaaaaatctagggctgtattttatatatatataatcttattggctctctgctttgtatttaaatgaagaatcttacatcttgggtaggtaaactgctgataaaatttgtgtacagtatgtacttacctaatgcagttgcattattacgtactgaaagatatgtgtttggaggtttatttccaggatgcatttgcttgttttggtcatggcagcagtgagttggtaatcctaaaccatcacttccagcagtattcatggtatagagctgatctgtgttcatatgttgaattgtgatagtagcaaacatgaacatatgaactattgttgctcttaatagaaatacaatataaatatgggcttgtatattttcttccttacatttaaatataaagtagaatacgcagttttattattttcaagaaaaagaaagagaagctgctgacctttctcccccataaagtttttcaggatgatcaggtcacagtgtgtacgtaagagtcagctaattatggatattgtcatctcggtaactttgtaaaaaaacaaacaaaactggcattgttaattccaaaaagaaaaaaaaaagcagtaaaaaaaaaaagtcatatgcaacaccagacgcaacatggtttaatggaattaatagttttttttttttttttttttaaagaacattgatggggattcactgtaaagttggcagaggctgccaaagacgaaacaactgactttaaaaatgctggaacaatgtgataaaaaataaatttgtaacaaatcttctcctttttagcccttgtcattttagccctttagtttcaactctgcattatatttagtttatatagtgtaaacttttgtttgccattaattcatctttttaggtagaagacattaaaatcacaggtttatgaagaatctctgctcattggaatgaaatgcagtcatttgaaatgagaaaggccaggatccttttttgtaccttaccctgtcttcaagagtaaaggtgaacacttacagctctcctccttgatgtcaattttgtatgttgatcattccaaactgagaagaataaagccacattttagacatatttatagaatcaattaaagctatatgtctaaaattcgtagggcaacttctgagaagaaacaccgtctttttcttttttaatggaaagtgacaatgtgacattagtcatgttgtgtgcggtgacgcagagtaactgaggtaatctgactgttgcactatgtgacatatttcaggacgtacttgctgcatttgcagcagccctctctctctgtcccttcccacaattctgctgttgctgcaacttgagttaattgtgacaaatgcatctttgtgttatattttgtttgcttcataatttccagaactatatataaatatattttttaaatagcaaatattgtagttagtgagtgatgatcactccaaccttatccttaccatattggtttcagggataggattaagagtgtctttggaagagaaaaatacacacaaccctgtggtttagaatgacgctgaggccttaggctgtgggcctagaacaactatgtgagtgaattcacccatctcatactttgaatcaagcatgcattcctgtttctcattgtgaagtatccccagttgttttccttcagtgttgagtttttgtccttttaaattttattatattttgctctccctaacatttgactgttttttataaaagaaaagaaaaaaaaagaaataaataataccctcgatgccactggatactcacaagcagggttatgctccttcatcttgggcttgtttgcctaaatgaaagggtttaatttattttgtacctcctatgcgtgggatagtccagggtgcagagccaggacttgcttgtaattgcacctgctatacttaaatgtatagccctaggctcaatcacactatggaaagaaacaaaaaaagtatatttagagctttaaaagcttttttattttttgtggggatgagggtgggatgggaaagggatgtatggatgttattggcatttttaagtgtttagagttttttggggtttggggtggttttttttccttgttttccttttttccttttaattggatgcactgacctggcccaggaaatgaagagattctcttttgatgctattaccaatgttatcataaagtgacagtcacctgtaacaaaaaggtggcaccagacatgatcactgatgttttatttgcacatcaatatttttatttttgtattctggctcagctgcttctctgagtggagttaaggaatgagccacaaagatttttgtagtaggtatattggcattgcattttatattcctctatatttaattttgaaaacctaaaagaaggattgtgcatcttgagagaaagttgagcaaattgtgatctagcggaatgttaatttgtgctgcttcttgtgcacgatagcagcagtagtatctctcttggaaataaacatcccatattatgatgtctatgaatataggtttccttttcttccttccctccctccttcccccacctttctcttttttttttctctctcagcttctcttttcctccttccctcttcccttcctctttctttactttttttgaaatcacttattgtaaataagttgtaatccaaacctcatgtatcaatggggaattttcaaatataaatattaccaatgcattttctggttgttgtctgatttttgattgaagtataatgagaatgacatgtctgttgcttttggtttgaggacttcgctttagcttcataaatcttttggtattttagtatttcattgttttagcaggagagggcagcaaaagttcattttccctgttagtaatgctgtggttcatgatcggttttaaatttagctgtgtgtgtgtttttttaaacagcatctctttgtgagtagaggtaaaaatgaaacatttttgatatgaaaagttgcatatgaaaattatagactggttcaaccagacagtgaagacttctgatccacatcaaacttaaaatgccacaaaacaatcttccacctctggctaaaacatgctacttccttttcaaacaccacaaaatacaagctgagtcttaaacacttggaatttaaaatgtttttctttggaaatgatttgctttcttcaaagtggtaacagaaacaaaaatgaaggtgctccccaaaaagaaatgtaaccttcccctttcacagatgtgtgagaggttctgtactgtgggtgcatcataataaagaagcagtgaagagttttcaggtgac

SEQ ID NO: 427109 - DNA, 4678 bp, Homo sapiens
tgctggccagaaggttcggttgcgcgtgtgccatggactcagccgcccggtgatattgacaataggagagagaaaggggcattgactgggacccaccgcgggtagcgaaaggtggctctggcagcggcggctccagctcctgcggctcctcctccttattctgtccccttctcttgctgccgctgcagatccagtcttcctccctcccttccccccctccccacgtcgtcgccgccgccgccgggtccggggcaacgagctgaggcgccgcccgccaggaatgtgagcgaggagccaccggcggagccgcaacggggtcggtgccgatttgatgggacgggcccgcgggggaggatcgtgaggccgccgccgccaccggaacgctgaggttcgggtccggccgtgaggcctagaggctccgccgccgcggaaccggagggaccccgtaccggacagccgtcgccccaggctccccgcagctgcccggacctccccctgcacgtcccggtcccgccgcccgcccccgctgcggccacctcgcccgtctcccgcccctccaagccacagatcatcttcggattcttccccagaagcttcaagtagggatatgtcctcagcaccaactactcctccatcagtggataaagtagacggattttctcggaagtccgtcagaaaagccagacagaagaggtcgcaaagttcctcacagtttaggtctcaaggcaagcctattgagttaacacctctgccgctgctaaaagacgttccatcctcagagcagcctgaactgttcctaaagaaacttcagcagtgctgtgtcatttttgacttcatggacacgctatctgatcttaaaatgaaagaatacaagcgctccactcttaatgaactggtggactacattacaataagcagaggctgtttgacagagcagacttaccctgaagtagttagaatggtatcttgcaatatattcagaactctccctcctagtgacagcaatgaatttgatccagaagaagatgaacctacccttgaggcatcgtggccacacttacagcttgtatatgaatttttcatacgatttttggaaagccaagaattccaacccagcattgccaaaaaatatatagatcagaaatttgtattacagcttctggagctatttgacagcgaagaccctcgggaacgggactacttaaaaacagtcttacacagaatttatggcaagtttcttggtcttagagcatttatccgaaaacagattaacaatatttttctaaggtttgtttatgaaacagaacacttcaatggtgtagctgaactgctggaaatattaggaagtattatcaatggctttgctttacctcttaaggcagaacacaaacagtttctggtgaaagtattgatccctttacacactgtcaggagcttatcactcttccatgcacagctggcatattgtatagtacagtttctggagaaagatccttcactcacagaaccagttattagggggttaatgaaattttggcctaaaacatgtagtcaaaaagaggtcatgttccttggggaactggaagaaatattggatgtgattgaaccttcacaatttgttaaaatccaagaacctttgtttaaacaaatcgccaagtgtgtatctagcccccattttcaggtggcagaaagagcactctattattggaataatgaatacatcatgagtttgatagaagaaaactctaacgtcatccttcccatcatgttttccagcctttataggatttcaaaagaacattggaatccggctattgtggcgttggtgtacaatgtgttgaaggcatttatggaaatgaacagcaccatgtttgacgagctgacagccacatacaagtcagatcgtcagcgtgagaaaaagaaagaaaaggagcgtgaagaattgtggaaaaaattggaggatctggagttaaagagaggtcttagacgtgatggaataattccaacttaacaaaaacaatgacaacaacattactaacctgtggagtcacacgtttatgtagtagaagatggagcaacagttttctgtattgtgcaactttacagtagatttcacctttgtttcattattacagcagcactgtatatacctgtctctaagtaaaggaaaaaacaaaataaggacttcaatccaaagtttggacagtagatggacttctcagaactttgcaaacataatcattgttctcaccctcttttaaaaaaaaaaaatcggtcttcaaagatctgttgatgaaattgctatgttaaaattccattatcgggagttccttatttatcactagcagagagtatgatacaattttcaaatgtgaacaatcttaaatttagcttgtctttctgctaagctgttaaatgtatttatagtaaaggaagaaaaaaagactgtcatttccttataagtttgtgtaacatcctcctctggataacttgactgtaatttaacatctttttcttttgcacatcttcctgagttgaatgtccacgtggaatggggtcatgaattataaaagtccctgataaaagttttgtttactggggtgaacatctttccagtaaccaggtagtcctggtactcctttagttttaaaattaggagttaagagagaagaggtgataaacatagtagggaagggaatatcggattcatgcatcagtttatggtgaatccaaatcaatgtcttgaatcctttgaaaacaggcactgggacatcacaggcttcagtacctgaccagtattagttgcatatatcattgaacacacataccagagatgttttagaaatgtgagaaaaacatccttttggaccatttgaaataagaaagacaaacactaaacaatacaaccatgaaattgatcaccgggattgcaaatctaattgggaaaagagttgagcaaacagcttggactgtttggagttgttgccttactttttaatatgtatttataaagtattccagcaaaagaggatgtagcctctgggaaaaaacaaacatgttacagtgttttttgtagattctcgttctatatctcatcacagcgccagccctgtttttagccggaaaggattcaggataaacattattatgcattctgaattggatgcatattcctaactactgtatttgttaccaaaagtggttctacaaatgctactgaaaaaaatctggaaattcctaatgtcctgagtattaataataaagtttaaaaatgcttttatatcaaaggtgcatcgtgaccaaattgtttaagaaaaaaaaacaaaaaaaaaaaatctagggctgtattttatatatatataatcttattggctctctgctttgtatttaaatgaagaatcttacatcttgggtaggtaaactgctgataaaatttgtgtacagtatgtacttacctaatgcagttgcattattacgtactgaaagatatgtgtttggaggtttatttccaggatgcatttgcttgttttggtcatggcagcagtgagttggtaatcctaaaccatcacttccagcagtattcatggtatagagctgatctgtgttcatatgttgaattgtgatagtagcaaacatgaacatatgaactattgttgctcttaatagaaatacaatataaatatgggcttgtatattttcttccttacatttaaatataaagtagaatacgcagttttattattttcaagaaaaagaaagagaagctgctgacctttctcccccataaagtttttcaggatgatcaggtcacagtgtgtacgtaagagtcagctaattatggatattgtcatctcggtaactttgtaaaaaaacaaacaaaactggcattgttaatttccatatgaagaagaagttaagaacccgcagtcaatgacaaaaagaaaggtcgttttgcaaacacacagcatgcgacagggttgtcaagtgggaaaatttacatcacgtttttctctggtttgtgtctttttctctttgaaaaaacagccttcttgccggggcgaattccgaccggcttaatgtatgtggccataaggagtgtgctacacagtaataacacacctaactcgagtatttgtacaaaacctgggctggaggactccaagtcgtgagttgattcaaaacgaaaaaataactctctggggataacccaattctttctgccccttctgttcaacgcgcctatggtcttattctctataggggcccctgtttttaagttgtctcaaaactctctcgtgttctaaattatctttaacgattgcagtcaccttgcgggggaaacacgtttgggggggggcgcccaccattcgaatgttcgcatgctttttcgacagggcgtgagagacgtgactattacacacttgcgccggcgcgtgttttatgcgcgaaagacattgctcctgggctccccatgggcgaaagttgaagataccgggccggctcctttgttggacttttcgtgacaccggcgcgccgagtgagtcctccttgttggggaagctctgtaaacgccgtggccttacccagcgggcgtaaccgctgtgcgaatccgcttttggacgaggcggtcctctcctccttggggggtgggccagcctccggggtttgtggtgcggca

SEQ ID NO: 427110 - DNA, 6469 bp, Homo sapiens
tgctggccagaaggttcggttgcgcgtgtgccatggactcagccgcccggtgatattgacaataggagagagaaaggggcattgactgggacccaccgcgggtagcgaaaggtggctctggcagcggcggctccagctcctgcggctcctcctccttattctgtccccttctcttgctgccgctgcagatccagtcttcctccctcccttccccccctccccacgtcgtcgccgccgccgccgggtccggggcaacgagctgaggcgccgcccgccaggaatgtgagcgaggagccaccggcggagccgcaacggggtcggtgccgatttgatgggacgggcccgcgggggaggatcgtgaggccgccgccgccaccggaacgctgaggttcgggtccggccgtgaggcctagaggctccgccgccgcggaaccggagggaccccgtaccggacagccgtcgccccaggctccccgcagctgcccggacctccccctgcacgtcccggtcccgccgcccgcccccgctgcggccacctcgcccgtctcccgcccctccaagccacagatcatcttcggattcttccccagaagcttcaagtagggatatgtcctcagcaccaactactcctccatcagtggataaagtagacggattttctcggaagtccgtcagaaaagccagacagaagaggtcgcaaagttcctcacagtttaggtctcaaggcaagcctattgagttaacacctctgccgctgctaaaaggtatcttgcaatatattcagaactctccctcctagtgacagcaatgaatttgatccagaagaagatgaacctacccttgaggcatcgtggccacacttacagcttgtatatgaatttttcatacgatttttggaaagccaagaattccaacccagcattgccaaaaaatatatagatcagaaatttgtattacagcttctggagctatttgacagcgaagaccctcgggaacgggactacttaaaaacagtcttacacagaatttatggcaagtttcttggtcttagagcatttatccgaaaacagattaacaatatttttctaaggtttgtttatgaaacagaacacttcaatggtgtagctgaactgctggaaatattaggaagtattatcaatggctttgctttacctcttaaggcagaacacaaacagtttctggtgaaagtattgatccctttacacactgtcaggagcttatcactcttccatgcacagctggcatattgtatagtacagtttctggagaaagatccttcactcacagaaccagttattagggggttaatgaaattttggcctaaaacatgtagtcaaaaagaggtcatgttccttggggaactggaagaaatattggatgtgattgaaccttcacaatttgttaaaatccaagaacctttgtttaaacaaatcgccaagtgtgtatctagcccccattttcaggtggcagaaagagcactctattattggaataatgaatacatcatgagtttgatagaagaaaactctaacgtcatccttcccatcatgttttccagcctttataggatttcaaaagaacattggaatccggctattgtggcgttggtgtacaatgtgttgaaggcatttatggaaatgaacagcaccatgtttgacgagctgacagccacatacaagtcagatcgtcagcgtgagaaaaagaaagaaaaggagcgtgaagaattgtggaaaaaattggaggatctggagttaaagagaggtcttagacgtgatggaataattccaacttaacaaaaacaatgacaacaacattactaacctgtggagtcacacgtttatgtagtagaagatggagcaacagttttctgtattgtgcaactttacagtagatttcacctttgtttcattattacagcagcactgtatatacctgtctctaagtaaaggaaaaaacaaaataaggacttcaatccaaagtttggacagtagatggacttctcagaactttgcaaacataatcattgttctcaccctcttttaaaaaaaaaaaatcggtcttcaaagatctgttgatgaaattgctatgttaaaattccattatcgggagttccttatttatcactagcagagagtatgatacaattttcaaatgtgaacaatcttaaatttagcttgtctttctgctaagctgttaaatgtatttatagtaaaggaagaaaaaaagactgtcatttccttataagtttgtgtaacatcctcctctggataacttgactgtaatttaacatctttttcttttgcacatcttcctgagttgaatgtccacgtggaatggggtcatgaattataaaagtccctgataaaagttttgtttactggggtgaacatctttccagtaaccaggtagtcctggtactcctttagttttaaaattaggagttaagagagaagaggtgataaacatagtagggaagggaatatcggattcatgcatcagtttatggtgaatccaaatcaatgtcttgaatcctttgaaaacaggcactgggacatcacaggcttcagtacctgaccagtattagttgcatatatcattgaacacacataccagagatgttttagaaatgtgagaaaaacatccttttggaccatttgaaataagaaagacaaacactaaacaatacaaccatgaaattgatcaccgggattgcaaatctaattgggaaaagagttgagcaaacagcttggactgtttggagttgttgccttactttttaatatgtatttataaagtattccagcaaaagaggatgtagcctctgggaaaaaacaaacatgttacagtgttttttgtagattctcgttctatatctcatcacagcgccagccctgtttttagccggaaaggattcaggataaacattattatgcattctgaattggatgcatattcctaactactgtatttgttaccaaaagtggttctacaaatgctactgaaaaaaatctggaaattcctaatgtcctgagtattaataataaagtttaaaaatgcttttatatcaaaggtgcatcgtgaccaaattgtttaagaaaaaaaaacaaaaaaaaaaaatctagggctgtattttatatatatatatatatatatatatatatatatatcttattggctctctgctttgtatttaaatgaagaatcttacatcttgggtaggtaaactgctgataaaatttgtgtacagtatgtacttacctaatgcagttgcattattacgtactgaaagatatgtgtttggaggtttatttccaggatgcatttgcttgttttggtcatggcagcagtgagttggtaatcctaaaccatcacttccagcagtattcatggtatagagctgatctgtgttcatatgttgaattgtgatagtagcaaacatgaacatatgaactattgttgctcttaatagaaatacaatataaatatgggcttgtatattttcttccttacatttaaatataaagtagaatacgcagttttattattttcaagaaaaagaaagagaagctgctgacctttctcccccataaagtttttcaggatgatcaggtcacagtgtgtacgtaagagtcagctaattatggatattgtcatctcggtaactttgtaaaaaaacaaacaaaactggcattgttaattccaaaaagaaaaaaaaaagcagtaaaaaaaaaaagtcatatgcaacaccagacgcaacatggtttaatggaattaatagttttttttttttttttttttaaagaacattgatggggattcactgtaaagttggcagaggctgccaaagacgaaacaactgactttaaaaatgctggaacaatgtgataaaaaataaatttgtaacaaatcttctcctttttagcccttgtcattttagccctttagtttcaactctgcattatatttagtttatatagtgtaaacttttgtttgccattaattcatctttttaggtagaagacattaaaatcacaggtttatgaagaatctctgctcattggaatgaaatgcagtcatttgaaatgagaaaggccaggatccttttttgtaccttaccctgtcttcaagagtaaaggtgaacacttacagctctcctccttgatgtcaattttgtatgttgatcattccaaactgagaagaataaagccacattttagacatatttatagaatcaattaaagctatatgtctaaaattcgtagggcaacttctgagaagaaacaccgtctttttcttttttaatggaaagtgacaatgtgacattagtcatgttgtgtgcggtgacgcagagtaactgaggtaatctgactgttgcactatgtgacatatttcaggacgtacttgctgcatttgcagcagccctctctctctgtcccttcccacaattctgctgttgctgcaacttgagttaattgtgacaaatgcatctttgtgttatattttgtttgcttcataatttccagaactatatataaatatattttttaaatagcaaatattgtagttagtgagtgatgatcactccaaccttatccttaccatattggtttcagggataggattaagagtgtctttggaagagaaaaatacacacaaccctgtggtttagaatgacgctgaggccttaggctgtgggcctagaacaactatgtgagtgaattcacccatctcatactttgaatcaagcatgcattcctgtttctcattgtgaagtatccccagttgttttccttcagtgttgagtttttgtccttttaaattttattatattttgctctccctaacatttgactgttttttataaaagaaaagaaaaaaaaagaaataaataataccctcgatgccactggatactcacaagcagggttatgctccttcatcttgggcttgtttgcctaaatgaaagggtttaatttattttgtacctcctatgcgtgggatagtccagggtgcagagccaggacttgcttgtaattgcacctgctatacttaaatgtatagccctaggctcaatcacactatggaaagaaacaaaaaaagtatatttagagctttaaaagcttttttattttttgtggggatgagggtgggatgggaaagggatgtatggatgttattggcatttttaagtgtttagagttttttggggtttggggtggttttttttccttgttttccttttttccttttaattggatgcactgacctggcccaggaaatgaagagattctcttttgatgctattaccaatgttatcataaagtgacagtcacctgtaacaaaaaggtggcaccagacatgatcactgatgttttatttgcacatcaatatttttatttttgtattctggctcagctgcttctctgagtggagttaaggaatgagccacaaagatttttgtagtaggtatattggcattgcattttatattcctctatatttaattttgaaaacctaaaagaaggattgtgcatcttgagagaaagttgagcaaattgtgatctagcggaatgttaatttgtgctgcttcttgtgcacgatagcagcagtagtatctctcttggaaataaacatcccatattatgatgtctatgaatataggtttccttttcttccttccctccctccttcccccacctttctcttttttttttctctctcagcttctcttttcctccttccctcttcccttcctctttctttactttttttgaaatcacttattgtaaataagttgtaatccaaacctcatgtatcaatggggaattttcaaatataaatattaccaatgcattttctggttgttgtctgatttttgattgaagtataatgagaatgacatgtctgttgcttttggtttgaggacttcgctttagcttcataaatcttttggtattttagtatttcattgttttagcaggagagggcagcaaaagttcattttccctgttagtaatgctgtggttcatgatcggttttaaatttagctgtgtgtgtgtttttttaaacagcatctctttgtgagtagaggtaaaaatgaaacatttttgatatgaaaagttgcatatgaaaattatagactggttcaaccagacagtgaagacttctgatccacatcaaacttaaaatgccacaaaacaatcttccacctctggctaaaacatgctacttccttttcaaacaccacaaaatacaagctgagtcttaaacacttggaatttaaaatgtttttctttggaaatgatttgctttcttcaaagtggtaacagaaacaaaaatgaaggtgctccccaaaaagaaatgtaaccttcccctttcacagatgtgtgagaggttctgtactgtgggtgcatcataataaagaagcagtgaagagttttcaggtgac

SEQ ID NO: 427111 - DNA, 6576 bp, Homo sapiens
tgctggccagaaggttcggttgcgcgtgtgccatggactcagccgcccggtgatattgacaataggagagagaaaggggcattgactgggacccaccgcgggtagcgaaaggtggctctggcagcggcggctccagctcctgcggctcctcctccttattctgtccccttctcttgctgccgctgcagatccagtcttcctccctcccttccccccctccccacgtcgtcgccgccgccgccgggtccggggcaacgagctgaggcgccgcccgccaggaatgtgagcgaggagccaccggcggagccgcaacggggtcggtgccgatttgatgggacgggcccgcgggggaggatcgtgaggccgccgccgccaccggaacgctgaggttcgggtccggccgtgaggcctagaggctccgccgccgcggaaccggagggaccccgtaccggacagccgtcgccccaggctccccgcagctgcccggacctccccctgcacgtcccggtcccgccgcccgcccccgctgcggccacctcgcccgtctcccgcccctccaagccacagatcatcttcggattcttccccagaagcttcaagtagggatatgtcctcagcaccaactactcctccatcagtggataaagtagacggattttctcggaagtccgtcagaaaagccagacagaagaggtcgcaaagttcctcacagtttaggtctcaaggcaagcctattgagttaacacctctgccgctgctaaaaggtatcttgcaatatattcagaactctccctcctagtgacagcaatgaatttgatccagaagaagatgaacctacccttgaggcatcgtggccacacttacagcttgtatatgaatttttcatacgatttttggaaagccaagaattccaacccagcattgccaaaaaatatatagatcagaaatttgtattacagcttctggagctatttgacagcgaagaccctcgggaacgggactacttaaaaacagtcttacacagaatttatggcaagtttcttggtcttagagcatttatccgaaaacagattaacaatatttttctaaggtttgtttatgaaacagaacacttcaatggtgtagctgaactgctggaaatattaggaagtattatcaatggctttgctttacctcttaaggcagaacacaaacagtttctggtgaaagtattgatccctttacacactgtcaggagcttatcactcttccatgcacagctggcatattgtatagtacagtttctggagaaagatccttcactcacagaaccagttattagggggttaatgaaattttggcctaaaacatgtagtcaaaaagaggtcatgttccttggggaactggaagaaatattggatgtgattgaaccttcacaatttgttaaaatccaagaacctttgtttaaacaaatcgccaagtgtgtatctagcccccattttcaggtggcagaaagagcactctattattggaataatgaatacatcatgagtttgatagaagaaaactctaacgtcatccttcccatcatgttttccagcctttataggatttcaaaagaacattggaatccggctattgtggcgttggtgtacaatgtgttgaaggcatttatggaaatgaacagcaccatgtttgacgagctgacagccacatacaagtcagatcgtcagcgtgagaaaaagaaagaaaaggagcgtgaagaattgtggaaaaaattggaggatctggagttaaagagaggtcttagacgtgatggaataattccaacttaacaaaaacaatgacaacaacattactaacctgtggagtcacacgtttatgtagtagaagatggagcaacagttttctgtattgtgcaactttacagtagatttcacctttgtttcattattacagcagcactgtatatacctgtctctaagtaaaggaaaaaacaaaataaggacttcaatccaaagtttggacagtagatggacttctcagaactttgcaaacataatcattgttctcaccctcttttaaaaaaaaaaaatcggtcttcaaagatctgttgatgaaattgctatgttaaaattccattatcgggagttccttatttatcactagcagagagtatgatacaattttcaaatgtgaacaatcttaaatttagcttgtctttctgctaagctgttaaatgtatttatagtaaaggaagaaaaaaagactgtcatttccttataagtttgtgtaacatcctcctctggataacttgactgtaatttaacatctttttcttttgcacatcttcctgagttgaatgtccacgtggaatggggtcatgaattataaaagtccctgataaaagttttgtttactggggtgaacatctttccagtaaccaggtagtcctggtactcctttagttttaaaattaggagttaagagagaagaggtgataaacatagtagggaagggaatatcggattcatgcatcagtttatggtgaatccaaatcaatgtcttgaatcctttgaaaacaggcactgggacatcacaggcttcagtacctgaccagtattagttgcatatatcattgaacacacataccagagatgttttagaaatgtgagaaaaacatccttttggaccatttgaaataagaaagacaaacactaaacaatacaaccatgaaattgatcaccgggattgcaaatctaattgggaaaagagttgagcaaacagcttggactgtttggagttgttgccttactttttaatatgtatttataaagtattccagcaaaagaggatgtagcctctgggaaaaaacaaacatgttacagtgttttttgtagattctcgttctatatctcatcacagcgccagccctgtttttagccggaaaggattcaggataaacattattatgcattctgaattggatgcatattcctaactactgtatttgttaccaaaagtggttctacaaatgctactgaaaaaaatctggaaattcctaatgtcctgagtattaataataaagtttaaaaatgcttttatatcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaagaaaaaaaaacaaaaaaaaaaaatctagggctgtattttatatatatatatatatatatatatatatatatatcttattggctctctgctttgtatttaaatgaagaatcttacatcttgggtaggtaaactgctgataaaatttgtgtacagtatgtacttacctaatgcagttgcattattacgtactgaaagatatgtgtttggaggtttatttccaggatgcatttgcttgttttggtcatggcagcagtgagttggtaatcctaaaccatcacttccagcagtattcatggtatagagctgatctgtgttcatatgttgaattgtgatagtagcaaacatgaacatatgaactattgttgctcttaatagaaatacaatataaatatgggcttgtatattttcttccttacatttaaatataaagtagaatacgcagttttattattttcaagaaaaagaaagagaagctgctgacctttctcccccataaagtttttcaggatgatcaggtcacagtgtgtacgtaagagtcagctaattatggatattgtcatctcggtaactttgtaaaaaaacaaacaaaactggcattgttaattccaaaaagaaaaaaaaaagcagtaaaaaaaaaaagtcatatgcaacaccagacgcaacatggtttaatggaattaatagttttttttttttttttttttaaagaacattgatggggattcactgtaaagttggcagaggctgccaaagacgaaacaactgactttaaaaatgctggaacaatgtgataaaaaataaatttgtaacaaatcttctcctttttagcccttgtcattttagccctttagtttcaactctgcattatatttagtttatatagtgtaaacttttgtttgccattaattcatctttttaggtagaagacattaaaatcacaggtttatgaagaatctctgctcattggaatgaaatgcagtcatttgaaatgagaaaggccaggatccttttttgtaccttaccctgtcttcaagagtaaaggtgaacacttacagctctcctccttgatgtcaattttgtatgttgatcattccaaactgagaagaataaagccacattttagacatatttatagaatcaattaaagctatatgtctaaaattcgtagggcaacttctgagaagaaacaccgtctttttcttttttaatggaaagtgacaatgtgacattagtcatgttgtgtgcggtgacgcagagtaactgaggtaatctgactgttgcactatgtgacatatttcaggacgtacttgctgcatttgcagcagccctctctctctgtcccttcccacaattctgctgttgctgcaacttgagttaattgtgacaaatgcatctttgtgttatattttgtttgcttcataatttccagaactatatataaatatattttttaaatagcaaatattgtagttagtgagtgatgatcactccaaccttatccttaccatattggtttcagggataggattaagagtgtctttggaagagaaaaatacacacaaccctgtggtttagaatgacgctgaggccttaggctgtgggcctagaacaactatgtgagtgaattcacccatctcatactttgaatcaagcatgcattcctgtttctcattgtgaagtatccccagttgttttccttcagtgttgagtttttgtccttttaaattttattatattttgctctccctaacatttgactgttttttataaaagaaaagaaaaaaaaagaaataaataataccctcgatgccactggatactcacaagcagggttatgctccttcatcttgggcttgtttgcctaaatgaaagggtttaatttattttgtacctcctatgcgtgggatagtccagggtgcagagccaggacttgcttgtaattgcacctgctatacttaaatgtatagccctaggctcaatcacactatggaaagaaacaaaaaaagtatatttagagctttaaaagcttttttattttttgtggggatgagggtgggatgggaaagggatgtatggatgttattggcatttttaagtgtttagagttttttggggtttggggtggttttttttccttgttttccttttttccttttaattggatgcactgacctggcccaggaaatgaagagattctcttttgatgctattaccaatgttatcataaagtgacagtcacctgtaacaaaaaggtggcaccagacatgatcactgatgttttatttgcacatcaatatttttatttttgtattctggctcagctgcttctctgagtggagttaaggaatgagccacaaagatttttgtagtaggtatattggcattgcattttatattcctctatatttaattttgaaaacctaaaagaaggattgtgcatcttgagagaaagttgagcaaattgtgatctagcggaatgttaatttgtgctgcttcttgtgcacgatagcagcagtagtatctctcttggaaataaacatcccatattatgatgtctatgaatataggtttccttttcttccttccctccctccttcccccacctttctcttttttttttctctctcagcttctcttttcctccttccctcttcccttcctctttctttactttttttgaaatcacttattgtaaataagttgtaatccaaacctcatgtatcaatggggaattttcaaatataaatattaccaatgcattttctggttgttgtctgatttttgattgaagtataatgagaatgacatgtctgttgcttttggtttgaggacttcgctttagcttcataaatcttttggtattttagtatttcattgttttagcaggagagggcagcaaaagttcattttccctgttagtaatgctgtggttcatgatcggttttaaatttagctgtgtgtgtgtttttttaaacagcatctctttgtgagtagaggtaaaaatgaaacatttttgatatgaaaagttgcatatgaaaattatagactggttcaaccagacagtgaagacttctgatccacatcaaacttaaaatgccacaaaacaatcttccacctctggctaaaacatgctacttccttttcaaacaccacaaaatacaagctgagtcttaaacacttggaatttaaaatgtttttctttggaaatgatttgctttcttcaaagtggtaacagaaacaaaaatgaaggtgctccccaaaaagaaatgtaaccttcccctttcacagatgtgtgagaggttctgtactgtgggtgcatcataataaagaagcagtgaagagttttcaggtgac

SEQ ID NO: 427112 - DNA, 6639 bp, Homo sapiens
tgctggccagaaggttcggttgcgcgtgtgccatggactcagccgcccggtgatattgacaataggagagagaaaggggcattgactgggacccaccgcgggtagcgaaaggtggctctggcagctccttattctgtccccttctcttgctgccgctgcagatccagtcttcctccctcccttccccccctccccacgtcgtcgccgccgccgccgggtccggggcaacgagctgaggcgccgcccgccaggaatgtgagcgaggagccaccggcggagccgcaacggggtcggtgccgatttgatgggacgggcccgcgggggaggatcgtgaggccgccgccgccaccggaacgctgaggttcgggtccggccgtgaggcctagaggctccgccgccgcggaaccggagggaccccgtaccggacagccgtcgccccaggctccccgcagctgcccggacctccccctgcacgtcccggtcccgccgcccgcccccgctgcggccacctcgcccgtctcccgcccctccaagccacagatcatcttcggattcttccccagaagcttcaagtagggatatgtcctcagcaccaactactcctccatcagtggataaagtagacggattttctcggaagtccgtcagaaaagccagacagaagaggtcgcaaagttcctcacagtttaggtctcaaggcaagcctattgagttaacacctctgccgctgctaaaagacgttccatcctcagagcagcctgaactgttcctaaagaaacttcagcagtgctgtgtcatttttgacttcatggacacgctatctgatcttaaaatgaaagaatacaagcgctccactcttaatgaactggtggactacattacaataagcagaggctgtttgacagagcagacttaccctgaagtagttagaatggtatcttgcaatatattcagaactctccctcctagtgacagcaatgaatttgatccagaagaagatgaacctacccttgaggcatcgtggccacacttacagcttgtatatgaatttttcatacgatttttggaaagccaagaattccaacccagcattgccaaaaaatatatagatcagaaatttgtattacagcttctggagctatttgacagcgaagaccctcgggaacgggactacttaaaaacagtcttacacagaatttatggcaagtttcttggtcttagagcatttatccgaaaacagattaacaatatttttctaaggtttgtttatgaaacagaacacttcaatggtgtagctgaactgctggaaatattaggaagtattatcaatggctttgctttacctcttaaggcagaacacaaacagtttctggtgaaagtattgatccctttacacactgtcaggagcttatcactcttccatgcacagctggcatattgtatagtacagtttctggagaaagatccttcactcacagaaccagttattagggggttaatgaaattttggcctaaaacatgtagtcaaaaagaggtcatgttccttggggaactggaagaaatattggatgtgattgaaccttcacaatttgttaaaatccaagaacctttgtttaaacaaatcgccaagtgtgtatctagcccccattttcaggtggcagaaagagcactctattattggaataatgaatacatcatgagtttgatagaagaaaactctaacgtcatccttcccatcatgttttccagcctttataggatttcaaaagaacattggaatccggctattgtggcgttggtgtacaatgtgttgaaggcatttatggaaatgaacagcaccatgtttgacgagctgacagccacatacaagtcagatcgtcagcgtgagaaaaagaaagaaaaggagcgtgaagaattgtggaaaaaattggaggatctggagttaaagagaggtcttagacgtgatggaataattccaacttaacaaaaacaatgacaacaacattactaacctgtggagtcacacgtttatgtagtagaagatggagcaacagttttctgtattgtgcaactttacagtagatttcacctttgtttcattattacagcagcactgtatatacctgtctctaagtaaaggaaaaaacaaaataaggacttcaatccaaagtttggacagtagatggacttctcagaactttgcaaacataatcattgttctcaccctcttttaaaaaaaaaaaatcggtcttcaaagatctgttgatgaaattgctatgttaaaattccattatcgggagttccttatttatcactagcagagagtatgatacaattttcaaatgtgaacaatcttaaatttagcttgtctttctgctaagctgttaaatgtatttatagtaaaggaagaaaaaaagactgtcatttccttataagtttgtgtaacatcctcctctggataacttgactgtaatttaacatctttttcttttgcacatcttcctgagttgaatgtccacgtggaatggggtcatgaattataaaagtccctgataaaagttttgtttactggggtgaacatctttccagtaaccaggtagtcctggtactcctttagttttaaaattaggagttaagagagaagaggtgataaacatagtagggaagggaatatcggattcatgcatcagtttatggtgaatccaaatcaatgtcttgaatcctttgaaaacaggcactgggacatcacaggcttcagtacctgaccagtattagttgcatatatcattgaacacacataccagagatgttttagaaatgtgagaaaaacatccttttggaccatttgaaataagaaagacaaacactaaacaatacaaccatgaaattgatcaccgggattgcaaatctaattgggaaaagagttgagcaaacagcttggactgtttggagttgttgccttactttttaatatgtatttataaagtattccagcaaaagaggatgtagcctctgggaaaaaacaaacatgttacagtgttttttgtagattctcgttctatatctcatcacagcgccagccctgtttttagccggaaaggattcaggataaacattattatgcattctgaattggatgcatattcctaactactgtatttgttaccaaaagtggttctacaaatgctactgaaaaaaatctggaaattcctaatgtcctgagtattaataataaagtttaaaaatgcttttatatcaaaggtgcatcgtgaccaaattgtttaagaaaaaaaaacaaaaaaaaaaaatctagggctgtattttatatatatatatatatatatatatatatatatatcttattggctctctgctttgtatttaaatgaagaatcttacatcttgggtaggtaaactgctgataaaatttgtgtacagtatgtacttacctaatgcagttgcattattacgtactgaaagatatgtgtttggaggtttatttccaggatgcatttgcttgttttggtcatggcagcagtgagttggtaatcctaaaccatcacttccagcagtattcatggtatagagctgatctgtgttcatatgttgaattgtgatagtagcaaacatgaacatatgaactattgttgctcttaatagaaatacaatataaatatgggcttgtatattttcttccttacatttaaatataaagtagaatacgcagttttattattttcaagaaaaagaaagagaagctgctgacctttctcccccataaagtttttcaggatgatcaggtcacagtgtgtacgtaagagtcagctaattatggatattgtcatctcggtaactttgtaaaaaaacaaacaaaactggcattgttaattccaaaaagaaaaaaaaaagcagtaaaaaaaaaaagtcatatgcaacaccagacgcaacatggtttaatggaattaatagttttttttttttttttttttaaagaacattgatggggattcactgtaaagttggcagaggctgccaaagacgaaacaactgactttaaaaatgctggaacaatgtgataaaaaataaatttgtaacaaatcttctcctttttagcccttgtcattttagccctttagtttcaactctgcattatatttagtttatatagtgtaaacttttgtttgccattaattcatctttttaggtagaagacattaaaatcacaggtttatgaagaatctctgctcattggaatgaaatgcagtcatttgaaatgagaaaggccaggatccttttttgtaccttaccctgtcttcaagagtaaaggtgaacacttacagctctcctccttgatgtcaattttgtatgttgatcattccaaactgagaagaataaagccacattttagacatatttatagaatcaattaaagctatatgtctaaaattcgtagggcaacttctgagaagaaacaccgtctttttcttttttaatggaaagtgacaatgtgacattagtcatgttgtgtgcggtgacgcagagtaactgaggtaatctgactgttgcactatgtgacatatttcaggacgtacttgctgcatttgcagcagccctctctctctgtcccttcccacaattctgctgttgctgcaacttgagttaattgtgacaaatgcatctttgtgttatattttgtttgcttcataatttccagaactatatataaatatattttttaaatagcaaatattgtagttagtgagtgatgatcactccaaccttatccttaccatattggtttcagggataggattaagagtgtctttggaagagaaaaatacacacaaccctgtggtttagaatgacgctgaggccttaggctgtgggcctagaacaactatgtgagtgaattcacccatctcatactttgaatcaagcatgcattcctgtttctcattgtgaagtatccccagttgttttccttcagtgttgagtttttgtccttttaaattttattatattttgctctccctaacatttgactgttttttataaaagaaaagaaaaaaaaagaaataaataataccctcgatgccactggatactcacaagcagggttatgctccttcatcttgggcttgtttgcctaaatgaaagggtttaatttattttgtacctcctatgcgtgggatagtccagggtgcagagccaggacttgcttgtaattgcacctgctatacttaaatgtatagccctaggctcaatcacactatggaaagaaacaaaaaaagtatatttagagctttaaaagcttttttattttttgtggggatgagggtgggatgggaaagggatgtatggatgttattggcatttttaagtgtttagagttttttggggtttggggtggttttttttccttgttttccttttttccttttaattggatgcactgacctggcccaggaaatgaagagattctcttttgatgctattaccaatgttatcataaagtgacagtcacctgtaacaaaaaggtggcaccagacatgatcactgatgttttatttgcacatcaatatttttatttttgtattctggctcagctgcttctctgagtggagttaaggaatgagccacaaagatttttgtagtaggtatattggcattgcattttatattcctctatatttaattttgaaaacctaaaagaaggattgtgcatcttgagagaaagttgagcaaattgtgatctagcggaatgttaatttgtgctgcttcttgtgcacgatagcagcagtagtatctctcttggaaataaacatcccatattatgatgtctatgaatataggtttccttttcttccttccctccctccttcccccacctttctcttttttttttctctctcagcttctcttttcctccttccctcttcccttcctctttctttactttttttgaaatcacttattgtaaataagttgtaatccaaacctcatgtatcaatggggaattttcaaatataaatattaccaatgcattttctggttgttgtctgatttttgattgaagtataatgagaatgacatgtctgttgcttttggtttgaggacttcgctttagcttcataaatcttttggtattttagtatttcattgttttagcaggagagggcagcaaaagttcattttccctgttagtaatgctgtggttcatgatcggttttaaatttagctgtgtgtgtgtttttttaaacagcatctctttgtgagtagaggtaaaaatgaaacatttttgatatgaaaagttgcatatgaaaattatagactggttcaaccagacagtgaagacttctgatccacatcaaacttaaaatgccacaaaacaatcttccacctctggctaaaacatgctacttccttttcaaacaccacaaaatacaagctgagtcttaaacacttggaatttaaaatgtttttctttggaaatgatttgctttcttcaaagtggtaacagaaacaaaaatgaaggtgctccccaaaaagaaatgtaaccttcccctttcacagatgtgtgagaggttctgtactgtgggtgcatcataataaagaagcagtgaagagttttcaggtgac

SEQ ID NO: 427113 - DNA, 6546 bp, Homo sapiens
tgctggccagaaggttcggttgcgcgtgtgccatggactcagccgcccggtgatattgacaataggagagagaaaggggcattgactgggacccaccgcgggtagcgaaaggtggctctggcagcggcggctccagctcctgcggctcctcctccttattctgtccccttctcttgctgccgctgcagatccagtcttcctccctcccttccccccctccccacgtcgtcgccgccgccgccgggtccggggcaacgagctgaggcgccgcccgccaggaatgtgagcgaggagccaccggcggagccgcaacggggtcggtgccgatttgatgggacgggcccgcgggggaggatcgtgaggccgccgccgccaccggaacgctgaggttcgggtccggccgtgaggcctagaggctccgccgccgcggaaccggagggaccccgtaccggacagccgtcgccccaggctccccgcagctgcccggacctccccctgcacgtcccggtcccgccgcccgcccccgctgcggccacctcgcccgtctcccgcccctccaagccacagatcatcttcggattcttccccagaagcttcaagtagggatatgtcctcagcaccaactactcctccatcagtggataaagtagacggattttctcggaagtccgtcagaaaagccagacagaagaggtcgcaaagttcctcacagtttaggtctcaaggcaagcctattgagttaacacctctgccgctgctaaaagacgttccatcctcagagcagcctgaactgttcctaaagaaacttcagcagtgctgtgtcatttttgacttcatggacacgctatctgatcttaaaatgaaagaatacaagcgctccactcttaatgaactggtggactacattacaataagcagaggctgtttgacagagcagacttaccctgaagtagttagaatggtatcttgcaatatattcagaactctccctcctagtgacagcaatgaatttgatccagaagaagatgaacctacccttgaggcatcgtggccacacttacagcttgtatatgaatttttcatacgatttttggaaagccaagaattccaacccagcattgccaaaaaatatatagatcagaaatttgtattacagcttctggagctatttgacagcgaagaccctcgggaacgggactacttaaaaacagtcttacacagaatttatggcaagtttcttggtcttagagcatttatccgaaaacagattaacaatatttttctaaggtttgtttatgaaacagaacacttcaatggtgtagctgaactgctggaaatattaggaagtattatcaatggctttgctttacctcttaaggcagaacacaaacagtttctggtgaaagtattgatccctttacacactgtcaggagcttatcactcttccatgcacagctggcatattgtatagtacagtttctggagaaagatccttcactcacagaaccagttattagggggttaatgaaattttggcctaaaacatgtagtcaaaaagaggtggcagaaagagcactctattattggaataatgaatacatcatgagtttgatagaagaaaactctaacgtcatccttcccatcatgttttccagcctttataggatttcaaaagaacattggaatccggctattgtggcgttggtgtacaatgtgttgaaggcatttatggaaatgaacagcaccatgtttgacgagctgacagccacatacaagtcagatcgtcagcgtgagaaaaagaaagaaaaggagcgtgaagaattgtggaaaaaattggaggatctggagttaaagagaggtcttagacgtgatggaataattccaacttaacaaaaacaatgacaacaacattactaacctgtggagtcacacgtttatgtagtagaagatggagcaacagttttctgtattgtgcaactttacagtagatttcacctttgtttcattattacagcagcactgtatatacctgtctctaagtaaaggaaaaaacaaaataaggacttcaatccaaagtttggacagtagatggacttctcagaactttgcaaacataatcattgttctcaccctcttttaaaaaaaaaaaatcggtcttcaaagatctgttgatgaaattgctatgttaaaattccattatcgggagttccttatttatcactagcagagagtatgatacaattttcaaatgtgaacaatcttaaatttagcttgtctttctgctaagctgttaaatgtatttatagtaaaggaagaaaaaaagactgtcatttccttataagtttgtgtaacatcctcctctggataacttgactgtaatttaacatctttttcttttgcacatcttcctgagttgaatgtccacgtggaatggggtcatgaattataaaagtccctgataaaagttttgtttactggggtgaacatctttccagtaaccaggtagtcctggtactcctttagttttaaaattaggagttaagagagaagaggtgataaacatagtagggaagggaatatcggattcatgcatcagtttatggtgaatccaaatcaatgtcttgaatcctttgaaaacaggcactgggacatcacaggcttcagtacctgaccagtattagttgcatatatcattgaacacacataccagagatgttttagaaatgtgagaaaaacatccttttggaccatttgaaataagaaagacaaacactaaacaatacaaccatgaaattgatcaccgggattgcaaatctaattgggaaaagagttgagcaaacagcttggactgtttggagttgttgccttactttttaatatgtatttataaagtattccagcaaaagaggatgtagcctctgggaaaaaacaaacatgttacagtgttttttgtagattctcgttctatatctcatcacagcgccagccctgtttttagccggaaaggattcaggataaacattattatgcattctgaattggatgcatattcctaactactgtatttgttaccaaaagtggttctacaaatgctactgaaaaaaatctggaaattcctaatgtcctgagtattaataataaagtttaaaaatgcttttatatcaaaggtgcatcgtgaccaaattgtttaagaaaaaaaaacaaaaaaaaaaaatctagggctgtattttatatatatatatatatatatatatatatatatatcttattggctctctgctttgtatttaaatgaagaatcttacatcttgggtaggtaaactgctgataaaatttgtgtacagtatgtacttacctaatgcagttgcattattacgtactgaaagatatgtgtttggaggtttatttccaggatgcatttgcttgttttggtcatggcagcagtgagttggtaatcctaaaccatcacttccagcagtattcatggtatagagctgatctgtgttcatatgttgaattgtgatagtagcaaacatgaacatatgaactattgttgctcttaatagaaatacaatataaatatgggcttgtatattttcttccttacatttaaatataaagtagaatacgcagttttattattttcaagaaaaagaaagagaagctgctgacctttctcccccataaagtttttcaggatgatcaggtcacagtgtgtacgtaagagtcagctaattatggatattgtcatctcggtaactttgtaaaaaaacaaacaaaactggcattgttaattccaaaaagaaaaaaaaaagcagtaaaaaaaaaaagtcatatgcaacaccagacgcaacatggtttaatggaattaatagttttttttttttttttttttaaagaacattgatggggattcactgtaaagttggcagaggctgccaaagacgaaacaactgactttaaaaatgctggaacaatgtgataaaaaataaatttgtaacaaatcttctcctttttagcccttgtcattttagccctttagtttcaactctgcattatatttagtttatatagtgtaaacttttgtttgccattaattcatctttttaggtagaagacattaaaatcacaggtttatgaagaatctctgctcattggaatgaaatgcagtcatttgaaatgagaaaggccaggatccttttttgtaccttaccctgtcttcaagagtaaaggtgaacacttacagctctcctccttgatgtcaattttgtatgttgatcattccaaactgagaagaataaagccacattttagacatatttatagaatcaattaaagctatatgtctaaaattcgtagggcaacttctgagaagaaacaccgtctttttcttttttaatggaaagtgacaatgtgacattagtcatgttgtgtgcggtgacgcagagtaactgaggtaatctgactgttgcactatgtgacatatttcaggacgtacttgctgcatttgcagcagccctctctctctgtcccttcccacaattctgctgttgctgcaacttgagttaattgtgacaaatgcatctttgtgttatattttgtttgcttcataatttccagaactatatataaatatattttttaaatagcaaatattgtagttagtgagtgatgatcactccaaccttatccttaccatattggtttcagggataggattaagagtgtctttggaagagaaaaatacacacaaccctgtggtttagaatgacgctgaggccttaggctgtgggcctagaacaactatgtgagtgaattcacccatctcatactttgaatcaagcatgcattcctgtttctcattgtgaagtatccccagttgttttccttcagtgttgagtttttgtccttttaaattttattatattttgctctccctaacatttgactgttttttataaaagaaaagaaaaaaaaagaaataaataataccctcgatgccactggatactcacaagcagggttatgctccttcatcttgggcttgtttgcctaaatgaaagggtttaatttattttgtacctcctatgcgtgggatagtccagggtgcagagccaggacttgcttgtaattgcacctgctatacttaaatgtatagccctaggctcaatcacactatggaaagaaacaaaaaaagtatatttagagctttaaaagcttttttattttttgtggggatgagggtgggatgggaaagggatgtatggatgttattggcatttttaagtgtttagagttttttggggtttggggtggttttttttccttgttttccttttttccttttaattggatgcactgacctggcccaggaaatgaagagattctcttttgatgctattaccaatgttatcataaagtgacagtcacctgtaacaaaaaggtggcaccagacatgatcactgatgttttatttgcacatcaatatttttatttttgtattctggctcagctgcttctctgagtggagttaaggaatgagccacaaagatttttgtagtaggtatattggcattgcattttatattcctctatatttaattttgaaaacctaaaagaaggattgtgcatcttgagagaaagttgagcaaattgtgatctagcggaatgttaatttgtgctgcttcttgtgcacgatagcagcagtagtatctctcttggaaataaacatcccatattatgatgtctatgaatataggtttccttttcttccttccctccctccttcccccacctttctcttttttttttctctctcagcttctcttttcctccttccctcttcccttcctctttctttactttttttgaaatcacttattgtaaataagttgtaatccaaacctcatgtatcaatggggaattttcaaatataaatattaccaatgcattttctggttgttgtctgatttttgattgaagtataatgagaatgacatgtctgttgcttttggtttgaggacttcgctttagcttcataaatcttttggtattttagtatttcattgttttagcaggagagggcagcaaaagttcattttccctgttagtaatgctgtggttcatgatcggttttaaatttagctgtgtgtgtgtttttttaaacagcatctctttgtgagtagaggtaaaaatgaaacatttttgatatgaaaagttgcatatgaaaattatagactggttcaaccagacagtgaagacttctgatccacatcaaacttaaaatgccacaaaacaatcttccacctctggctaaaacatgctacttccttttcaaacaccacaaaatacaagctgagtcttaaacacttggaatttaaaatgtttttctttggaaatgatttgctttcttcaaagtggtaacagaaacaaaaatgaaggtgctccccaaaaagaaatgtaaccttcccctttcacagatgtgtgagaggttctgtactgtgggtgcatcataataaagaagcagtgaagagttttcaggtgac

SEQ ID NO: 427114 - DNA, 1418 bp, Homo sapiens
tgctggccagaaggttcggttgcgcgtgtgccatggactcagccgcccggtgatattgacaataggagagagaaaggggcattgactgggacccaccgcgggtagcgaaaggtggctctggcagcggcggctccagctcctgcggctcctcctccttattctgtccccttctcttgctgccgctgcagatccagtcttcctccctcccttccccccctccccacgtcgtcgccgccgccgccgggtccggggcaacgagctgaggcgccgcccgccaggaatgtgagcgaggagccaccggcggagccgcaacggggtcggtgccgatttgatgggacgggcccgcgggggaggatcgtgaggccgccgccgccaccggaacgctgaggttcgggtccggccgtgaggcctagaggctccgccgccgcggaaccggagggaccccgtaccggacagccgtcgccccaggctccccgcagctgcccggacctccccctgcacgtcccggtcccgccgcccgcccccgctgcggccacctcgcccgtctcccgcccctccaagccacagatcatcttcggattcttccccagaagcttcaagtagggatatgtcctcagcaccaactactcctccatcagtggataaagtagacggattttctcggaagtccgtcagaaaagccagacagaagaggtcgcaaagttcctcacagtttaggtctcaaggcaagcctattgagttaacacctctgccgctgctaaaagacgttccatcctcagagcagcctgaactgttcctaaagaaacttcagcagtgctgtgtcatttttgacttcatggacacgctatctgatcttaaaatgaaagaatacaagcgctccactcttaatgaactggtggactacattacaataagcagaggctgtttgacagagcagacttaccctgaagtagttagaatggtatcttgcaatatattcagaactctccctcctagtgacagcaatgaatttgatccagaagaagatgaacctacccttgaggcatcgtggccacacttacagcttgtatatgaatttttcatacgatttttggaaagccaagaattccaacccagcattgccaaaaaatatatagatcagaaatttgtattacagcttctggagctatttgacagcgaagaccctcgggaacgggactacttaaaaacagtcttacacagaatttatggcaagtttcttggtcttagagcatttatccgaaaacagattaacaatatttttctaaggtttgttacagaaaccaaagacctaaatcttgtcaccaagaaacatgttacatgattttaataagttccctgatagaagagctggggtgctctggggaaatattggagggtcatccattccacattaaaga

SEQ ID NO: 427115 - DNA, 274 bp, Homo sapiens
tattcatattattacttttattgttgttattttgtatttgtatttctttagtggaatataagctccttgtctgacttgtttatcatgatatgcccaaagactagcactgtgcttggcacataatagatattcaacacattttttgaggaaggaagaaggggattttaaataatagaattcctaaatccttttctgaaaccgcctttgacagctataatgtctttcatttacaacagcttctggagctatttgacagcgaagaccctcgggaacg

SEQ ID NO: 427116 - DNA, 436 bp, Homo sapiens
tagggatatgtcctcagcaccaactactcctccatcagtggataaagtagacggattttctcggaagtccgtcagaaaagccagacagaagaggtcgcaaagttcctcacagtttaggtctcaaggcaagcctattgagttaacacctctgccgctgctaaaaggtaaggctcatgaccaggtgatgcattctttttcaattgatctttctacatctatatataatttcctttttgtagagttttatatgtgttgcaaattgaagggatgggatacttcacatacattgaagttactaatgtgtgaccaaatatacccactctcctttttaaaggctcaatttagtctgtctttgggcaagttaaaagaaacattatcaggagaatatctcacattgatgagtaggtaaactaagtactagagaaactttaagatg

SEQ ID NO: 427117 - DNA, 962 bp, Homo sapiens
ctcccgccggcgcacccctccctcggctccgcccgcggcccgcttcttcctcccgcgggcggcccagccctagcgccccgcgctccgcgggcagccccctgccgccgcgccatgtccgccggctggttccggcgccgcttcctgcctggggagccgctccccgcgccgcggccgcctgggccgcatgccagccccgtgccctaccgacggccccgcttccttcgcggctccagctccagccccggggcggccgacgcctcgcgccgcccagactcccggcccgtgcgcagccccgcacgaggacgcacgctaccctggaatgcaggctacgccgagattatcaatgcagagaaatctgaattcaatgaggatcaagccgcctgtgggaagctgtgcatccggagatgtgagtttggggctgaagaagagtggctgaccctgtgcccagaggaggatgaggtgatcgggcgggagctggaggcctcaggccagatgggcggctgcacagccctggtggctgtgtccctgcagggaaagctgtacatggccaatgctggggatagcagggccatcttggtgcggagagatgagatacggccactgagcttcgagttcaccccagagactgagcggcagcggatccagcagctggcctttgtctatcctgagcttctggctggtgagttcacccgactggagttccctcggcggctgaagggggatgacttgggacagaaggttttgttcagggatcaccacatgagtggctggagctacaaacgtgtggagaaatcggatctcaagtacccactgatccatggacagggtaggcaggctcggttactaggaacactggctgtctcccggggcctgggagaccatcagctcagagtcctggacacaaacatccagctcaagcccttcttgctctctgtgccacaggtaagggggcaacgctgtcc

SEQ ID NO: 427118 - DNA, 2276 bp, Homo sapiens
ctcccgccggcgcacccctccctcggctccgcccgcggcccgcttcttcctcccgcgggcggcccagccctagcgccccgcgctccgcgggcagccccctgccgccgcgccatgtccgccggctggttccggcgccgcttcctgcctggggagccgctccccgcgccgcggccgcctgggccgcatgccagccccgtgccctaccgacggccccgcttccttcgcggctccagctccagccccggggcggccgacgcctcgcgccgcccagactcccggcccgtgcgcagccccgcacgaggacgcacgctaccctggaatgcaggctacgccgagattatcaatgcagagaaatctgaattcaatgaggatcaagccgcctgtgggaagctgtgcatccggagatgtgagtttggggctgaagaagagtggctgaccctgtgcccagaggagttcctgacaggccattactgggcactgttcgatgggcacggcggtcctgcagcagccatcttggctgccaacaccctgcactcctgcttgcgccggcagctggaggccgtggtggaaggcttggtggccactcagccccccatgcacctcaatggccgctgcatctgccccagtgaccctcagtttgtggaggaaaagggcatcagggcagaagacttggtgatcggggcattggagagtgcctttcaggaatgtgatgaggtgatcgggcgggagctggaggcctcaggccagatgggcggctgcacagccctggtggctgtgtccctgcagggaaagctgtacatggccaatgctggggatagcagggccatcttggtgcggagagatgagatacggccactgagcttcgagttcaccccagagactgagcggcagcggatccagcagctggcctttgtctatcctgagcttctggctggtgagttcacccgactggagttccctcggcggctgaagggggatgacttgggacagaaggttttgttcagggatcaccacatgagtggctggagctacaaacgtgtggagaaatcggatctcaagtacccactgatccatggacagggtaggcaggctcggttactaggaacactggctgtctcccggggcctgggagaccatcagctcagagtcctggacacaaacatccagctcaagcccttcttgctctctgtgccacaggtgactgtgctggatgtggaccagctggagctacaggaggatgatgtggttgtcatggcaactgatggactctgggatgtactgtccaacgagcaggtggcatggctggtgcggagcttcctccctgggaaccaagaggacccacacaggttctcaaagctggcccagatgctgatacacagcacacagggaaaggaagacagtctcacagaggaagggcaggtgtcctacgatgacgtctctgtgttcgtgattcccttgcacagtcagggccaagagagcagtgaccactgaggattcagacactgtatcccagaactgctctagtgcccgggtgtggtctgggcatccctccagtgtgaccaagagcaaatcctgcctgccctatccctagccaccgcccagtgctctcactatccacctcaacacacatccatctcaagaggaacatttataccaggcagtcagagctggaagtgtatggagagcccagcccaccaggtcctgccttttgcggtgataaccttctctggcagagtgactttacaacttaactaggaaacccatgtgaggctcctcagacaggatcttgaacagcccaaagtatcattctcagataggggcacccaagctaagggtattagccaaagatgccaggatgggtagctagcccatgtttagatccaggtctccaattcatggttatcagggcatgtgttcaacaacccccaaagtccacgcaggtggcttgtagaaacctttgggcagcctcatgtctgctaaaacagccatcttcaagacagcccctgaaaagagaccagttcaggtcctgccctgctgttctttgctggagatgaggaacaggtgctggggctaaagtttggggtagagcacaagggacaagaggaactcttggagttggctgggtgagagggctctccatttgctacctgtagtagcctgcctcttaactggttgcttctccctagttccagccctgccctggtctgatgccccaacactgcccttgctttgttttccctgtcacctccctattattaaatgttttctacagaaga

SEQ ID NO: 427119 - DNA, 2301 bp, Homo sapiens
ctcccgccggcgcacccctccctcggctccgcccgcggcccgcttcttcctcccgcgggcggcccagccctagcgccccgcgctccgcgggcagccccctgccgccgcgccatgtccgccggctggttccggcgccgcttcctgcctggggagccgctccccgcgccgcggccgcctgggccgcatgccagccccgtgccctaccgacggccccgcttccttcgcggctccagctccagccccggggcggccgacgcctcgcgccgcccagactcccggcccgtgcgcagccccgcacgaggacgcacgctaccctggaatgcaggctacgccgagattatcaatgcagagaaatctgaattcaatgaggatcaagccgcctgtgggaagctgtgcatccggagatgtgagtttggggctgaagaagagtggctgaccctgtgcccagaggagttcctgacaggccattactgggcactgttcgatgggcacggcggtcctgcagcagccatcttggctgccaacaccctgcactcctgcttgcgccggcagctggaggccgtggtggaaggcttggtggccactcagccccccatgcacctcaatggccgctgcatctgccccagtgaccctcagtttgtggaggaaaagggcatcagggcagaagacttggtgatcggggcattggagagtgcctttcaggaatgtgatgaggtgatcgggcgggagctggaggcctcaggccagatgggcggctgcacagccctggtggctgtgtccctgcagggaaagctgtacatggccaatgctggggatagcagggccatcttggtgcggagagatgagatacggccactgagcttcgagttcaccccagagactgagcggcagcggatccagcagctggcctttgtctatcctgagcttctggctggtgagttcacccgactggagttccctcggcggctgaagggggatgacttgggacagaaggttttgttcagggatcaccacatgagtggctggagctacaaacgtgtggagaaatcggatctcaagtacccactgatccatggacagggtaggcaggctcggttactaggaacactggctgtctcccggggcctgggagaccatcagctcagagtcctggacacaaacatccagctcaagcccttcttgctctctgtgccacaggtgactgtgctggatgtggaccagctggagctacaggaggatgatgtggttgtcatggcaactgatggactctgggatgtactgtccaacgagcaggtggcatggctggtgcggagcttcctccctgggaaccaagaggacccacacagtctatctgcaggatggtcttcacaggttctcaaagctggcccagatgctgatacacagcacacagggaaaggaagacagtctcacagaggaagggcaggtgtcctacgatgacgtctctgtgttcgtgattcccttgcacagtcagggccaagagagcagtgaccactgaggattcagacactgtatcccagaactgctctagtgcccgggtgtggtctgggcatccctccagtgtgaccaagagcaaatcctgcctgccctatccctagccaccgcccagtgctctcactatccacctcaacacacatccatctcaagaggaacatttataccaggcagtcagagctggaagtgtatggagagcccagcccaccaggtcctgccttttgcggtgataaccttctctggcagagtgactttacaacttaactaggaaacccatgtgaggctcctcagacaggatcttgaacagcccaaagtatcattctcagataggggcacccaagctaagggtattagccaaagatgccaggatgggtagctagcccatgtttagatccaggtctccaattcatggttatcagggcatgtgttcaacaacccccaaagtccacgcaggtggcttgtagaaacctttgggcagcctcatgtctgctaaaacagccatcttcaagacagcccctgaaaagagaccagttcaggtcctgccctgctgttctttgctggagatgaggaacaggtgctggggctaaagtttggggtagagcacaagggacaagaggaactcttggagttggctgggtgagagggctctccatttgctacctgtagtagcctgcctcttaactggttgcttctccctagttccagccctgccctggtctgatgccccaacactgcccttgctttgttttccctgtcacctccctattattaaatgttttctacagaaga

SEQ ID NO: 427120 - DNA, 2922 bp, Homo sapiens
ctcccgccggcgcacccctccctcggctccgcccgcggcccgcttcttcctcccgcgggcggcccagccctagcgccccgcgctccgcgggcagccccctgccgccgcgccatgtccgccggctggttccggcgccgcttcctgcctggggagccgctccccgcgccgcggccgcctgggccgcatgccagccccgtgccctaccgacggccccgcttccttcgcggctccagctccagccccggggcggccgacgcctcgcgccgcccagactcccggcccgtgcgcagccccgcacgaggacgcacgctaccctggaatgcaggctacgccgagtgagtgcccctccccgacccccagctcaggcccgggcctgaacccgcttcgggtcctgcgcccgcctagaaagcgggaggagctgagtgacagtccccacccacctgtggacagccccttcttgccctcacctccgaatcctgacaacttcccggtcatcccgacccagcgttttccttgggattccgacctccccctcagagaagacaggaggtcgggaaggacctgcagcccaggggcttccaagatgaggcccagagactcggtagagttccagcattcggggctttggagatttcccctcgccctctacccccaacatctcaccctgggtatgacctgcgctgtatggaacagggctttgggctgcgacaggacaggggcaggaatggcaacctacccttaccgtctagccctgggtcaccaggtaggctccagaggagctgggccctgacttttaccttagccatgaggccagtgaagttaggaagcttacatcgtggttgtctaagtgtgtgttagggacagcactggggagctgttgccccagagggaggggtcttctccctgtgctggcttgggtccctgtgcccatggggacataggtgtgtccctggagggtcgcttaccatttcccggcctcaggattatcaatgcagagaaatctgaattcaatgaggatcaagccgcctgtgggaagctgtgcatccggagatgtgagtttggggctgaagaagagtggctgaccctgtgcccagaggagttcctgacaggccattactgggcactgttcgatgggcacggcggtcctgcagcagccatcttggctgccaacaccctgcactcctgcttgcgccggcagctggaggccgtggtggaaggcttggtggccactcagccccccatgcacctcaatggccgctgcatctgccccagtgaccctcagtttgtggaggaaaagggcatcagggcagaagacttggtgatcggggcattggagagtgcctttcaggaatgtgatgaggtgatcgggcgggagctggaggcctcaggccagatgggcggctgcacagccctggtggctgtgtccctgcagggaaagctgtacatggccaatgctggggatagcagggccatcttggtgcggagagatgagatacggccactgagcttcgagttcaccccagagactgagcggcagcggatccagcagctggcctttgtctatcctgagcttctggctggtgagttcacccgactggagttccctcggcggctgaagggggatgacttgggacagaaggttttgttcagggatcaccacatgagtggctggagctacaaacgtgtggagaaatcggatctcaagtacccactgatccatggacagggtaggcaggctcggttactaggaacactggctgtctcccggggcctgggagaccatcagctcagagtcctggacacaaacatccagctcaagcccttcttgctctctgtgccacaggtgactgtgctggatgtggaccagctggagctacaggaggatgatgtggttgtcatggcaactgatggactctgggatgtactgtccaacgagcaggtggcatggctggtgcggagcttcctccctgggaaccaagaggacccacacaggttctcaaagctggcccagatgctgatacacagcacacagggaaaggaagacagtctcacagaggaagggcaggtgtcctacgatgacgtctctgtgttcgtgattcccttgcacagtcagggccaagagagcagtgaccactgaggattcagacactgtatcccagaactgctctagtgcccgggtgtggtctgggcatccctccagtgtgaccaagagcaaatcctgcctgccctatccctagccaccgcccagtgctctcactatccacctcaacacacatccatctcaagaggaacatttataccaggcagtcagagctggaagtgtatggagagcccagcccaccaggtcctgccttttgcggtgataaccttctctggcagagtgactttacaacttaactaggaaacccatgtgaggctcctcagacaggatcttgaacagcccaaagtatcattctcagataggggcacccaagctaagggtattagccaaagatgccaggatgggtagctagcccatgtttagatccaggtctccaattcatggttatcagggcatgtgttcaacaacccccaaagtccacgcaggtggcttgtagaaacctttgggcagcctcatgtctgctaaaacagccatcttcaagacagcccctgaaaagagaccagttcaggtcctgccctgctgttctttgctggagatgaggaacaggtgctggggctaaagtttggggtagagcacaagggacaagaggaactcttggagttggctgggtgagagggctctccatttgctacctgtagtagcctgcctcttaactggttgcttctccctagttccagccctgccctggtctgatgccccaacactgcccttgctttgttttccctgtcacctccctattattaaatgttttctacagaaga

SEQ ID NO: 427121 - DNA, 2623 bp, Homo sapiens
ctcccgccggcgcacccctccctcggctccgcccgcggcccgcttcttcctcccgcgggcggcccagccctagcgccccgcgctccgcgggcagccccctgccgccgcgccatgtccgccggctggttccggcgccgcttcctgcctggggagccgctccccgcgccgcggccgcctgggccgcatgccagccccgtgccctaccgacggccccgcttccttcgcggctccagctccagccccggggcggccgacgcctcgcgccgcccagactcccggcccgtgcgcagccccgcacgaggacgcacgctaccctggaatgcaggctacgccgagattatcaatgcagagaaatctgaattcaatgaggatcaagccgcctgtgggaagctgtgcatccggagatgtgagtttggggctgaagaagagtggctgaccctgtgcccagaggagttcctgacaggccattactgggcactgttcgatgggcacggcggtcctgcagcagccatcttggctgccaacaccctgcactcctgcttgcgccggcagctggaggccgtggtggaaggcttggtggccactcagccccccatgcacctcaatggccgctgcatctgccccagtgaccctcagtttgtggaggaaaagggcatcagggcagaagacttggtgatcggggcattggagagtgcctttcaggaatgtgatgaggtgatcgggcgggagctggaggcctcaggccagatgggcggctgcacagccctggtggctgtgtccctgcagggaaagctgtacatggccaatgctggggatagcagggccatcttggtgcggagagatgagatacggccactgagcttcgagttcaccccagagactgagcggcagcggatccagcagctggcctttgtctatcctgagcttctggctggtgagttcacccgactggagttccctcggcggctgaagggggatgacttgggacagaaggttttgttcagggatcaccacatgagtggctggagctacaaacgtgtggagaaatcggatctcaagtacccactgatccatggacagggtaggcaggctcggttactaggaacactggctgtctcccggggcctgggagaccatcagctcagagtcctggacacaaacatccagctcaagcccttcttgctctctgtgccacaggtgactgtgctggatgtggaccagctggagctacaggaggatgatgtggttgtcatggcaactgatggactctgggatgtactgtccaacgagcaggtggcatggctggtgcggagcttcctccctgggaaccaagaggacccacacaggtactgtagctgctggggacctgcctgggcctgggttggtgccagcagcaagcccaagtagttatggctgagaagacagagcactgacaatgagctggcagctggccaggatcagggctgtctcaagcttcttggaggaggcagggagaccgtgggttccgaaaatccctggatttagactctcatggtccagcccgtggccctcccagacttgctgcttgcttggtccacagtcggactgcattgcttgggtccccatgtccagccttgtgcagtgagttctcctaaggtctggccttgcccctttgctctgcccctgaagtctatctgcaggatggtcttcacaggttctcaaagctggcccagatgctgatacacagcacacagggaaaggaagacagtctcacagaggaagggcaggtgtcctacgatgacgtctctgtgttcgtgattcccttgcacagtcagggccaagagagcagtgaccactgaggattcagacactgtatcccagaactgctctagtgcccgggtgtggtctgggcatccctccagtgtgaccaagagcaaatcctgcctgccctatccctagccaccgcccagtgctctcactatccacctcaacacacatccatctcaagaggaacatttataccaggcagtcagagctggaagtgtatggagagcccagcccaccaggtcctgccttttgcggtgataaccttctctggcagagtgactttacaacttaactaggaaacccatgtgaggctcctcagacaggatcttgaacagcccaaagtatcattctcagataggggcacccaagctaagggtattagccaaagatgccaggatgggtagctagcccatgtttagatccaggtctccaattcatggttatcagggcatgtgttcaacaacccccaaagtccacgcaggtggcttgtagaaacctttgggcagcctcatgtctgctaaaacagccatcttcaagacagcccctgaaaagagaccagttcaggtcctgccctgctgttctttgctggagatgaggaacaggtgctggggctaaagtttggggtagagcacaagggacaagaggaactcttggagttggctgggtgagagggctctccatttgctacctgtagtagcctgcctcttaactggttgcttctccctagttccagccctgccctggtctgatgccccaacactgcccttgctttgttttccctgtcacctccctattattaaatgttttctacagaaga

SEQ ID NO: 427122 - DNA, 2882 bp, Homo sapiens
ctcccgccggcgcacccctccctcggctccgcccgcggcccgcttcttcctcccgcgggcggcccagccctagcgccccgcgctccgcgggcagccccctgccgccgcgccatgtccgccggctggttccggcgccgcttcctgcctggggagccgctccccgcgccgcggccgcctgggccgcatgccagccccgtgccctaccgacggccccgcttccttcgcggctccagctccagccccggggcggccgacgcctcgcgccgcccagactcccggcccgtgcgcagccccgcacgaggacgcacgctaccctggaatgcaggctacgccgagattatcaatgcagagaaatctgaattcaatgaggatcaagccgcctgtgggaagctgtgcatccggagatgtgagtttggggctgaagaagagtggctgaccctgtgcccagaggagttcctgacaggccattactgggcactgttcgatgggcacggcggtcctgcagcagccatcttggctgccaacaccctgcactcctgcttgcgccggcagctggaggccgtggtggaaggcttggtggccactcagccccccatgcacctcaatggccgctgcatctgccccagtgaccctcagtttgtggaggaaaagggcatcagggcagaagacttggtgatcggggcattggagagtgcctttcaggaatgtgatgaggtgatcgggcgggagctggaggcctcaggccagatgggcggctgcacagccctggtggctgtgtccctgcagggaaagctgtacatggccaatgctggggatagcagggccatcttggtgcggagagatgagatacggccactgagcttcgagttcaccccagagactgagcggcagcggatccagcagctggcctttgtctatcctgagcttctggctggtgagttcacccgactggagttccctcggcggctgaagggggatgacttgggacagaaggttttgttcagggatcaccacatgagtggctggagctacaaacgtgtggagaaatcggatctcaagtacccactgatccatggacagggtaggcaggctcggttactaggaacactggctgtctcccggggcctgggagaccatcagctcagagtcctggacacaaacatccagctcaagcccttcttgctctctgtgccacaggtgactgtgctggatgtggaccagctggagctacaggaggatgatgtggttgtcatggcaactgatggactctgggatgtactgtccaacgagcaggtggcatggctggtgcggagcttcctccctgggaaccaagaggacccacacaggttctcaaagctggcccagatgctgatacacagcacacagggaaaggaagacagtctcacagaggaagggcaggtgtcctacgatgacgtctctgtgttcgtgattcccttgcacagtcagggccaagagagcagtgaccactgaggattcagacactgtatcccagaactgctctagtgcccgggtgtggtctgggcatccctccagtgtgaccaagagcaaatcctgcctgccctatccctagccaccgcccagtgctctcactatccacctcaacacacatccatctcaagaggaacatttataccaggcagtcagagctggaagtgtatggagagcccagcccaccaggtcctgccttttgcggtgataaccttctctggcagagtgactttacaacttaactaggaaacccatgtgaggctcctcagacaggatcttgaacagcccaaagtatcattctcagataggggcacccaagctaagggtattagccaaagatgccaggatgggtagctagcccatgtttagatccaggtctccaattcatggttatcagggcatgtgttcaacaacccccaaagtccacgcaggtggcttgtagaaacctttgggcagcctcatgtctgctaaaacagccatcttcaagacagcccctgaaaagagaccagttcaggtcctgccctgctgttctttgctggagatgaggaacaggtgctggggctaaagtttggggtagagcacaagggacaagaggaactcttggagttggctgggtgagagggctctccatttgctacctgtagtagcctgcctcttaactggttgcttctccctagttccagccctgccctggtctgatgccccaacactgcccttgctttgttttccctgtcacctccctattattaaatgttttctacagaagaaaaaaaaacatggaaaaaaaaaatatcactaaaaaaaagaaactaagaaataggaaaaaacaggggcgcgcacaaagctggcccagggagaccttcaatacttctgaaccctcagctttcttgtgtgaagaaggccccctctcacgtcaggctaattatccaaaggacgaaacaagagtactatgtcctcgccccagtctattgaccatgaaagcgaggtggcgtcctcagagtgaccggcacacacttgtggacgagtccaccgcaatgtgcagctgtgctgaaaggaatcactttatacccacgctgggtgtattcttgcagtggcgtaatgttctgaattccactttagtgctgaacgacactactgaaccccattattgttttttcccagtacgatgaatataaatttgatgcaagccacttaactgcattggtctgtcctatatttgagacaagaaatctgaatcttgaagccaccgggcgaggcattttcttgcaaaaacgacgcccaggggacaattactaaagaacacgggcaacacaaaaaggccgtaacagacaggacattgaaagcaaggtgggtatcgcaggaagaccaaatcc

SEQ ID NO: 427123 - DNA, 2021 bp, Homo sapiens
ctcccgccggcgcacccctccctcggctccgcccgcggcccgcttcttcctcccgcgggcggcccagccctagcgccccgcgctccgcgggcagccccctgccgccgcgccatgtccgccggctggttccggcgccgcttcctgcctggggagccgctccccgcgccgcggccgcctgggccgcatgccagccccgtgccctaccgacggccccgcttccttcgcggctccagctccagccccggggcggccgacgcctcgcgccgcccagactcccggcccgtgcgcagccccgcacgaggacgcacgctaccctggaatgcaggctacgccgagattatcaatgcagagaaatctgaattcaatgaggatcaagccgcctgtgggaagctgtgcatccggagatgtgagtttggggctgaagaagagtggctgaccctgtgcccagaggaggatgaggtgatcgggcgggagctggaggcctcaggccagatgggcggctgcacagccctggtggctgtgtccctgcagggaaagctgtacatggccaatgctggggatagcagggccatcttggtgcggagagatgagatacggccactgagcttcgagttcaccccagagactgagcggcagcggatccagcagctggcctttgtctatcctgagcttctggctggtgagttcacccgactggagttccctcggcggctgaagggggatgacttgggacagaaggttttgttcagggatcaccacatgagtggctggagctacaaacgtgtggagaaatcggatctcaagtacccactgatccatggacagggtaggcaggctcggttactaggaacactggctgtctcccggggcctgggagaccatcagctcagagtcctggacacaaacatccagctcaagcccttcttgctctctgtgccacaggtgactgtgctggatgtggaccagctggagctacaggaggatgatgtggttgtcatggcaactgatggactctgggatgtactgtccaacgagcaggtggcatggctggtgcggagcttcctccctgggaaccaagaggacccacacaggttctcaaagctggcccagatgctgatacacagcacacagggaaaggaagacagtctcacagaggaagggcaggtgtcctacgatgacgtctctgtgttcgtgattcccttgcacagtcagggccaagagagcagtgaccactgaggattcagacactgtatcccagaactgctctagtgcccgggtgtggtctgggcatccctccagtgtgaccaagagcaaatcctgcctgccctatccctagccaccgcccagtgctctcactatccacctcaacacacatccatctcaagaggaacatttataccaggcagtcagagctggaagtgtatggagagcccagcccaccaggtcctgccttttgcggtgataaccttctctggcagagtgactttacaacttaactaggaaacccatgtgaggctcctcagacaggatcttgaacagcccaaagtatcattctcagataggggcacccaagctaagggtattagccaaagatgccaggatgggtagctagcccatgtttagatccaggtctccaattcatggttatcagggcatgtgttcaacaacccccaaagtccacgcaggtggcttgtagaaacctttgggcagcctcatgtctgctaaaacagccatcttcaagacagcccctgaaaagagaccagttcaggtcctgccctgctgttctttgctggagatgaggaacaggtgctggggctaaagtttggggtagagcacaagggacaagaggaactcttggagttggctgggtgagagggctctccatttgctacctgtagtagcctgcctcttaactggttgcttctccctagttccagccctgccctggtctgatgccccaacactgcccttgctttgttttccctgtcacctccctattattaaatgttttctacagaaga

SEQ ID NO: 427124 - DNA, 2287 bp, Homo sapiens
ctcccgccggcgcacccctccctcggctccgcccgcggcccgcttcttcctcccgcgggcggcccagccctagcgccccgcgctccgcgggcagccccctgccgccgcgccatgtccgccggctggttccggcgccgcttcctgcctggggagccgctccccgcgccgcggccgcctgggccgcatgccagccccgtgccctaccgacggccccgcttccttcgcggctccagctccagccccggggcggccgacgcctcgcgccgcccagactcccggcccgtgcgcagccccgcacgaggacgcacgctaccctggaatgcaggctacgccgagtgagtgcccctccccgacccccagctcaggcccgggcctgaacccgcttcgggtcctgcgcccgcctagaaagcgggaggagctgagtgacagtccccacccacctgtggacagccccttcttgccctcacctccgaatcctgacaacttcccggtcatcccgacccagcgttttccttgggattccgacctccccctcagagaagacaggaggtcgggaaggacctgcagcccaggggcttccaagatgaggcccagagactcggattatcaatgcagagaaatctgaattcaatgaggatcaagccgcctgtgggaagctgtgcatccggagatgtgagtttggggctgaagaagagtggctgaccctgtgcccagaggaggatgaggtgatcgggcgggagctggaggcctcaggccagatgggcggctgcacagccctggtggctgtgtccctgcagggaaagctgtacatggccaatgctggggatagcagggccatcttggtgcggagagatgagatacggccactgagcttcgagttcaccccagagactgagcggcagcggatccagcagctggcctttgtctatcctgagcttctggctggtgagttcacccgactggagttccctcggcggctgaagggggatgacttgggacagaaggttttgttcagggatcaccacatgagtggctggagctacaaacgtgtggagaaatcggatctcaagtacccactgatccatggacagggtaggcaggctcggttactaggaacactggctgtctcccggggcctgggagaccatcagctcagagtcctggacacaaacatccagctcaagcccttcttgctctctgtgccacaggtgactgtgctggatgtggaccagctggagctacaggaggatgatgtggttgtcatggcaactgatggactctgggatgtactgtccaacgagcaggtggcatggctggtgcggagcttcctccctgggaaccaagaggacccacacaggttctcaaagctggcccagatgctgatacacagcacacagggaaaggaagacagtctcacagaggaagggcaggtgtcctacgatgacgtctctgtgttcgtgattcccttgcacagtcagggccaagagagcagtgaccactgaggattcagacactgtatcccagaactgctctagtgcccgggtgtggtctgggcatccctccagtgtgaccaagagcaaatcctgcctgccctatccctagccaccgcccagtgctctcactatccacctcaacacacatccatctcaagaggaacatttataccaggcagtcagagctggaagtgtatggagagcccagcccaccaggtcctgccttttgcggtgataaccttctctggcagagtgactttacaacttaactaggaaacccatgtgaggctcctcagacaggatcttgaacagcccaaagtatcattctcagataggggcacccaagctaagggtattagccaaagatgccaggatgggtagctagcccatgtttagatccaggtctccaattcatggttatcagggcatgtgttcaacaacccccaaagtccacgcaggtggcttgtagaaacctttgggcagcctcatgtctgctaaaacagccatcttcaagacagcccctgaaaagagaccagttcaggtcctgccctgctgttctttgctggagatgaggaacaggtgctggggctaaagtttggggtagagcacaagggacaagaggaactcttggagttggctgggtgagagggctctccatttgctacctgtagtagcctgcctcttaactggttgcttctccctagttccagccctgccctggtctgatgccccaacactgcccttgctttgttttccctgtcacctccctattattaaatgttttctacagaaga

SEQ ID NO: 427125 - DNA, 2274 bp, Homo sapiens
  misc_feature (1561)..(1561): n is a, c, g, or t
  misc_feature (1600)..(1601): n is a, c, g, or t
  misc_feature (1688)..(1689): n is a, c, g, or t
  misc_feature (1694)..(1694): n is a, c, g, or t
  misc_feature (1705)..(1705): n is a, c, g, or t
  misc_feature (1707)..(1707): n is a, c, g, or t
  misc_feature (1709)..(1709): n is a, c, g, or t
  misc_feature (1722)..(1723): n is a, c, g, or t
  misc_feature (1732)..(1732): n is a, c, g, or t
  misc_feature (1763)..(1763): n is a, c, g, or t
  misc_feature (1797)..(1797): n is a, c, g, or t
  misc_feature (1803)..(1803): n is a, c, g, or t
  misc_feature (1806)..(1806): n is a, c, g, or t
  misc_feature (1812)..(1812): n is a, c, g, or t
  misc_feature (1822)..(1822): n is a, c, g, or t
  misc_feature (1869)..(1869): n is a, c, g, or t
  misc_feature (1883)..(1883): n is a, c, g, or t
  misc_feature (1899)..(1899): n is a, c, g, or t
  misc_feature (1927)..(1928): n is a, c, g, or t
  misc_feature (1947)..(1947): n is a, c, g, or t
ctcccgccggcgcacccctccctcggctccgcccgcggcccgcttcttcctcccgcgggcggcccagccctagcgccccgcgctccgcgggcagccccctgccgccgcgccatgtccgccggctggttccggcgccgcttcctgcctggggagccgctccccgcgccgcggccgcctgggccgcatgccagccccgtgccctaccgacggccccgcttccttcgcggctccagctccagccccggggcggccgacgcctcgcgccgcccagactcccggcccgtgcgcagccccgcacgaggacgcacgctaccctggaatgcaggctacgccgagattatcaatgcagagaaatctgaattcaatgaggatcaagccgcctgtgggaagctgtgcatccggagatgtgagtttggggctgaagaagagtggctgaccctgtgcccagaggagttcctgacaggccattactgggcactgttcgatgggcacggcggtcctgcagcagccatcttggctgccaacaccctgcactcctgcttgcgccggcagctggaggccgtggtggaaggcttggtggccactcagccccccatgcacctcaatggccgctgcatctgccccagtgaccctcagtttgtggaggaaaagggcatcagggcagaagacttggtgatcggggcattggagagtgcctttcaggaatgtgatgaggtgatcgggcgggagctggaggcctcaggccagatgggcggctgcacagccctggtggctgtgtccctgcagggaaagctgtacatggccaatgctggggatagcagggccatcttggtgcggagagatgagatacggccactgagcttcgagttcaccccagagactgagcggcagcggatccagcagctggcctttgtctatcctgagcttctggctggtgagttcacccgactggagttccctcggcggctgaagggggatgacttgggacagaaggttttgttcagggatcaccacatgagtggctggagctacaaacgtgtggagaaatcggatctcaagtacccactgatccatggacagggtaggcaggctcggttactaggaacactggctgtctcccggggcctgggagaccatcagctcagagtcctggacacaaacatccagctcaagcccttcttgctctctgtgccacaggtgactgtgctggatgtggaccagctggagctacaggaggatgatgtggttgtcatggcaactgatggactctgggatgtactgtccaacgagcaggtggcatggctggtgcggagcttcctccctgggaaccaagaggacccacacaggttctcaaagctggcccagatgctgatacacagcacacagggaaaggaagacagtctcacagaggaagggcaggtgtcctacgatgacgtctctgtgttcgtgattcccttgcacagtcagggccaagagagcagtgaccactgaggattcagacactgtatcccagaactgctctagtgcccgggtgtggtctgggcatccctccagagtaaanaaaaaaaaaaaatgaaaaaaaaaaaaaaaaaaaaaaacnnaaaactctaaaaaaaaaaaaaaaaaaaaaaaaaaaaaaaaaaaaaaaaaaaaaaaaaaaaaaaaaaacaaaaaatgaatgaaaaaannaacanacaaggtcctnantntaacggaaaaaannatctctggnaaaaaaaataaaaaaaaaaaaaaaaaaaaanaaaaaaaaaaaaaaaaaaaaaaactaaaaaaaancaaagnaanaaactnaaaaaggggnaacaaaacaaagggtataagaaaaaaaagcaaaaatgagaaacaaanaaatataaaaatcnaagacacaaaaaaaangaaaaaaagaaaaaaaaaaaaaaaaacnnaaaataaaaaaaagaagtnaaaaaaaaatttaggaaaaaaaaatataaaaaaacaccatcttcaagacagcccctgaaaagagaccagttcaggtcctgccctgctgttctttgctggagatgaggaacaggtgctggggctaaagtttggggtagagcacaagggacaagaggaactcttggagttggctgggtgagagggctctccatttgctacctgtagtagcctgcctcttaactggttgcttctccctagttccagccctgccctggtctgatgccccaacactgcccttgctttgttttccctgtcacctccctattattaaatgttttctacagaaga

SEQ ID NO: 427126 - DNA, 1122 bp, Homo sapiens
ctcccgccggcgcacccctccctcggctccgcccgcggcccgcttcttcctcccgcgggcggcccagccctagcgccccgcgctccgcgggcagccccctgccgccgcgccatgtccgccggctggttccggcgccgcttcctgcctggggagccgctccccgcgccgcggccgcctgggccgcatgccagccccgtgccctaccgacggccccgcttccttcgcggctccagctccagccccggggcggccgacgcctcgcgccgcccagactcccggcccgtgcgcagccccgcacgaggacgcacgctaccctggaatgcaggctacgccgagtgagtgcccctccccgacccccagctcaggcccgggcctgaacccgcttcgggtcctgcgcccgcctagaaagcgggaggagctgagtgacagtccccacccacctgtggacagccccttcttgccctcacctccgaatcctgacaacttcccggtcatcccgacccagcgttttccttgggattccgacctccccctcagagaagacaggaggtcgggaaggacctgcagcccaggggcttccaagatgaggcccagagactcggtagagttccagcattcggggctttggagatttcccctcgccctctacccccaacatctcaccctgggtatgacctgcgctgtatggaacagggctttgggctgcgacaggacaggggcaggaatggcaacctacccttaccgtctagccctgggtcaccaggtaggctccagaggagctgggccctgacttttaccttagccatgaggccagtgaagttaggaagcttacatcgtggttgtctaagtgtgtgttagggacagcactggggagctgttgccccagagggaggggtcttctccctgtgctggcttgggtccctgtgcccatggggacataggtgtgtccctggagggtcgcttaccatttcccggcctcaggattatcaatgcagagaaatctgaattcaatgaggatcaagccgcctgtgggaagctgtgcatccggagatgtgagtttggggctgaagaagagtggctgaccctgtgcccagaggaggggataatcactagtgaattcgc

SEQ ID NO: 427127 - DNA, 759 bp, Homo sapiens
tactccattttatttttcacattggccagtgtaaacttttaagtttacagttgctttgttatcttttcttacagggttacgactcactgattaaaaagagggactttttcaaatactttgcacttttgattgtgtattatggataccaaggaagagaagaaggaacggaaacaaagttattttgctcgactgaaaaagaaaaaacaagccaaacaaaatgcagagacagcctcagctgtagctacaaggactcatactgggaaggaagataataatacagtagttttagagccagacaagtgcaacattgctgtggaagaggaatatatgactgatgagaaaaaaaagagaaaaagtaatcagttaaaggagatcaggcgtacagaactaaagagatattatagtattggtgagtattcatggcgttactgcagtattttcatttaaaaaatctataagaatttttaaaagactatcatttgtgattgatcataataatggtaacagtttatggagcagctgctatgtgcccctggcccttgctttacatacataatcttgtgtaaggggatcacactaaaataatgtctcatttaaatttgtgttcccagcatttagcacagtgcccagaatgtattgtgtactactaaacgtttatctaatgaagagtcactttctctttatgagaaatatttttcttaatgtatgtagacatattcataaatatgctgatagaaatgcctgtactttttggcattt

SEQ ID NO: 427128 - DNA, 751 bp, Homo sapiens
caaaggtgaaagtgtccttttacagtctcacagcgatgcctggcaggaagtgtgtttgctctaaatcctaatttgggtgtgttcctgtagaaatgttgaaacttctcctgagggaaacagaaactcaatcatgcaggaaactagatactgagaaaacagttgtagctcagcgtggctacaagtaactgtggtgtggaagcagagtagagagaaaacttgttcctcattagagagagagccacacttctcactgctcacaatgagaggccaaagattacccttggacatccagattttctattgtgccagacctgacgaagagccttttgtgaaggtatgttggagtgcgtcccgagggctaataaggtgctggtgaattctcagtgatgtacctccgagtttcttttgaaagtcgttctaattagaaaggattgtgctgacatttctaccagcaggtgttttattcattgcggagagggttatggtgtggttggctcttctcattggagccagaaatccatatttgattttttttcattccacaggctcattttatacttgtgataaacacagagtttgctgaaaacagagggtttatttcattcatttaagctggttgtggagtctggatagtgtttcactcaggttccccagaaatggtgaactagaagttaattcttatgtaatctggcaaacccgcgatatttatgcaggaaatagaaacagtgaagcttcacagaatctggcgttc

SEQ ID NO: 427129 - DNA, 5407 bp, Homo sapiens
cgatccggacgcggggccccgcgggcgcgcgcctcggagctcccgcctcctcctcttgctcctcctcggcgtacggtcctcccctgacccctccttccacccgccgagaggatgcgctccccggcgcccagcagcagaggccaccgctcccagaaatgcatgcgaccgatccccttctcccggaccccaggagccggcgcccccgccctgtagggttacgactcactgattaaaaagagggactttttcaaatactttgcacttttgattgtgtattatggataccaaggaagagaagaaggaacggaaacaaagttattttgctcgactgaaaaagaaaaaacaagccaaacaaaatgcagagacagcctcagctgtagctacaaggactcatactgggaaggaagataataatacagtagttttagagccagacaagtgcaacattgctgtggaagaggaatatatgactgatgagaaaaaaaagagaaaaagtaatcagttaaaggagatcaggcgtacagaactaaagagatattatagtattgatgacaatcaaaacaaaacacatgataaaaaagagaagaagatggtggttcagaagccccatgggactatggaatacactgctggaaaccaggacaccctaaactccatagcactgaaatttaacatcactcccaataaattggtggaactgaataaacttttcacacatactattgttccaggccaggtcctttttgtgccagatgccaactctccttccagtaccttaaggctatcatcatccagtcctggtgctactgtctctccttcatcatcagatgcagaatatgataaattgcctgatgctgacttagcacgaaaggccttgaaacccattgaaagagtcttatcgtctacttctgaagaagatgagccaggtgtggtgaaatttttaaaaatgaattgtcgatacttcaccgatggaaagggtgtggttggcggtgttatgatagtgactcctaacaacatcatgtttgaccctcataaatctgatcctctggttattgaaaatgggtgtgaggagtatggtctcatctgccccatggaagaggttgtttccattgcgctctacaatgacatttctcacatgaagatcaaagatgccttgccatcgcctggagaatgggaagacctggcttcagaaaaggatatcaacccattcagtaagttcaaatctatcaacaaggaaaaacgacagcagaatggagagaaaattatgacttcggattccagaccaatagtacctttggagaagtccacaggacatacacctacaaagccctcaggcagctctgtgtcagagaaattaaagaaactggactcctctagggagacatcccatggttctcccacagtgactaagctcagcaaggaaccttccgacacttcttctgcatttgaatctacagccaaagaaaactttctaggggaagatgatgattttgttgacttggaagaactttcttctcaaactggtggtggaatgcacaaaaaagacaccttgaaggagtgcctttctcttgacccagaggaacgaaagaaagctgagtcacaaataaacaattctgccgtggaaatgcaggtgcagtcagccctagcctttttgggaacagagaatgatgttgaactgaagggggcgctagatttagaaacctgtgagaagcaagatataatgccagaagtggacaagcagtctggttcgccagaaagccgagtagaaaacacactgaacatacatgaagatttagataaagttaaactcattgaatattacctgactaagaacaaagaagggccacaggtatctgaaaatttgcagaaaacagaattaagtgatggaaaaagtattgaaccagggggaatagacattacccttagtagttctctttcccaggcgggtgatcccataactgagggcaataaagagccagataagacctgggtgaaaaagggagagcccctcccggtaaaactgaactcttctacagaagcaaatgtgattaaagaggctctagactcctctttggaatctactctggacaacagctgtcaaggtgcacaaatggataataaatctgaagttcagttgtggctgttaaagagaattcaggtacccattgaagatatacttccttcaaaagaagaaaaaagcaagaccccacccatgttcctgtgcatcaaagtgggaaaaccaatgagaaaatcctttgccactcacactgcagccatggtccagcagtacggcaaacggagaaagcagccagagtactggtttgctgttcctcgggagagggtggatcatttgtacacattctttgttcagtggtctcccgatgtctatggaaaagatgccaaagagcaaggctttgtggtggtggagaaggaagaactgaacatgattgacaacttcttcagtgagccaacaaccaagagctgggagatcatcactgttgaagaggcaaagcgcaggaagagcacatgcagctactatgaagacgaggacgaagaggtgctgcctgtcctacggccccacagcgcgctcctggagaatatgcacatcgagcagctggcccgacgccttcctgcaagggtgcaagggtatccatggagactggcctatagcacgttagagcacgggaccagcttaaagacgctctaccggaaatcggcatcactagacagtcctgtcctattggtcatcaaagatatggataatcagatttttggagcatatgcaactcatcctttcaagttcagtgaccactattatggcacaggcgaaacttttctctacacattcagccctcattttaaggtctttaagtggagtggagaaaattcatactttatcaatggagacataagttctttagaacttggtggtggagggggacgatttggtttatggctagatgctgatttataccacggacgaagcaactcttgcagcactttcaataatgatattctttccaaaaaggaagacttcatagttcaggatctggaggtgtgggcatttgattgaaattcagactgccttaaaatataacattaaaaagactgggttcgatcagccctcctaaagctggctggaaaaagaagccccagcccagcctgcctcatcccaccccaatgcttcctttctgccatcatctcagagcatgatcacattgcagaaagattctggaaggtccatgtagagggcagacattgaagaaagaaacttaaaatccaggttgttgaaaagactttgtactcccacttcctccaaatccatacagtgaggaatcagagtgtttatagatatatgagttgaatgcaatttttatttttggtaactgtgaaaaataagatactgtggatatatacatgccttgtgtatttatcagcataattttcattaccaaaatgtacagctattatttgccatggaaaaggttagtctcatttagaaaaatcgaaagtgcacagcacttaaagggaatatatgaggttttttttttaaaaaaaaaacttttatttattatttgtagtatattgtctgaaatgtgtcggcagttttttttcttttaatgtgtcaaatcttgaaatattaaatgtatacattttgtgctatgttttgggaacaaatctgtttgatttatatagttttatattgaattttttttgccctgattgtttagggtgataggtcttaagcagcatatatctatatatctgtatgtgggtatatagagatatatgtgtgtgtgtatgtatatgtacatatacatatatatgagtgtataattctaaatttctaaaaactcattatgaatgttcatcaatttgactattataggccagctttccatttagtcaataaaagcgtacatttttagttacttaccttgaacatattcgtgtgaaaaagaatacatcatttctcacagtcttaagttgatatttatagaaatgaatacctttgtgaacctagacttagaacaaatcctgcttttgaaaaaaaatgttttgcttcttacaaaatcatttgtgttaataacaaaaactttattttcggagtgttctttgtataacttttccaagcttttacattaacgagcaggcctctgtcttaaaagggactcagtatattaatttctgcattttttaaatcaaatgaaaaacgtcaaattggaccaattgtcttggtttcttgattcatttatttgagaaaaaaacaatacaaagaaatgcattcatatcaaaattggaatagaaaggaaaacctatttttaagatatcaacctattttcacatcataaaacatctattacataaaataaaggtccaggcatagtggctcttgcctgtaatcccagcactttgggaggccgaggcaggtggatcactcaaggtcacaagtttgagaccagtctggccaacatggtgaaaccccatctctactaaaagtacaaatattagccgactatgtggcgggcacctgtaatcccacctactcgggaggctgaggcaggagaattgcttgaatccgggaagcagaggttgtagtgagccaagatcgtgccactgcactctatcctgggtaacagcgagactctgtcttaaaaataataacaataataataataataaagacttacttaaccaatattattgattaccagacttttatgaaagccaaagactgcttgctagtaggaaaaaatttcaaataataaccaaagctgaaaaatggtctgtcataaattatttccccggtaatttttgaaaggaaaaatgtataacaagtactatttacatatctgcatttaaaaaagcaattcttagaatacttcctttacattattctcctattttagacattttgtgaaagagaacaaattgtccagtggcctcctgtcagatcaacaattattatactccttaattccatgcaaatttaaatgaatgctataaaattttaaatctgtagcctgggtgtacgtttcactcaagttctcctactgaggactcttgactaacagcatactggcagtttcaccttaacctgctcgttaaataatgtgttggtgtgagatatcaggaatgtctcatgatatcacgtttaccatttacaccatctgcaaccatatgctattaataaaatggaaaaaaacaaaatggtcattttgcatatacttcactctgacctagtttagtccatgatactataattgtgagagcatatccagatgctgtgttctctatgtaaaacagtattgtccattcagaaatgtgtgacccttcatttatggatattgactatatgtaatgcagtgctatcccaatattttcaataaaggactttatgcattca

SEQ ID NO: 427130 - DNA, 5407 bp, Homo sapiens
agaatttgcaagttaagacacatgtacctagccactgggacagggaggtcattgaggacctccagctgtgtgacccacagctgtgtgggtcagtttggtgtagttaaggggtctctgctggttctgttcttttaaatggtgccatgtgtacaaacaaggaacacttttctgatgattcaaaaaatactttgtcttcatcacagctcttttgagggttacgactcactgattaaaaagagggactttttcaaatactttgcacttttgattgtgtattatggataccaaggaagagaagaaggaacggaaacaaagttattttgctcgactgaaaaagaaaaaacaagccaaacaaaatgcagagacagcctcagctgtagctacaaggactcatactgggaaggaagataataatacagtagttttagagccagacaagtgcaacattgctgtggaagaggaatatatgactgatgagaaaaaaaagagaaaaagtaatcagttaaaggagatcaggcgtacagaactaaagagatattatagtattgatgacaatcaaaacaaaacacatgataaaaaagagaagaagatggtggttcagaagccccatgggactatggaatacactgctggaaaccaggacaccctaaactccatagcactgaaatttaacatcactcccaataaattggtggaactgaataaacttttcacacatactattgttccaggccaggtcctttttgtgccagatgccaactctccttccagtaccttaaggctatcatcatccagtcctggtgctactgtctctccttcatcatcagatgcagaatatgataaattgcctgatgctgacttagcacgaaaggccttgaaacccattgaaagagtcttatcgtctacttctgaagaagatgagccaggtgtggtgaaatttttaaaaatgaattgtcgatacttcaccgatggaaagggtgtggttggcggtgttatgatagtgactcctaacaacatcatgtttgaccctcataaatctgatcctctggttattgaaaatgggtgtgaggagtatggtctcatctgccccatggaagaggttgtttccattgcgctctacaatgacatttctcacatgaagatcaaagatgccttgccatcgcctggagaatgggaagacctggcttcagaaaaggatatcaacccattcagtaagttcaaatctatcaacaaggaaaaacgacagcagaatggagagaaaattatgacttcggattccagaccaatagtacctttggagaagtccacaggacatacacctacaaagccctcaggcagctctgtgtcagagaaattaaagaaactggactcctctagggagacatcccatggttctcccacagtgactaagctcagcaaggaaccttccgacacttcttctgcatttgaatctacagccaaagaaaactttctaggggaagatgatgattttgttgacttggaagaactttcttctcaaactggtggtggaatgcacaaaaaagacaccttgaaggagtgcctttctcttgacccagaggaacgaaagaaagctgagtcacaaataaacaattctgccgtggaaatgcaggtgcagtcagccctagcctttttgggaacagagaatgatgttgaactgaagggggcgctagatttagaaacctgtgagaagcaagatataatgccagaagtggacaagcagtctggttcgccagaaagccgagtagaaaacacactgaacatacatgaagatttagataaagttaaactcattgaatattacctgactaagaacaaagaagggccacaggtatctgaaaatttgcagaaaacagaattaagtgatggaaaaagtattgaaccagggggaatagacattacccttagtagttctctttcccaggcgggtgatcccataactgagggcaataaagagccagataagacctgggtgaaaaagggagagcccctcccggtaaaactgaactcttctacagaagcaaatgtgattaaagaggctctagactcctctttggaatctactctggacaacagctgtcaaggtgcacaaatggataataaatctgaagttcagttgtggctgttaaagagaattcaggtacccattgaagatatacttccttcaaaagaagaaaaaagcaagaccccacccatgttcctgtgcatcaaagtgggaaaaccaatgagaaaatcctttgccactcacactgcagccatggtccagcagtacggcaaacggagaaagcagccagagtactggtttgctgttcctcgggagagggtggatcatttgtacacattctttgttcagtggtctcccgatgtctatggaaaagatgccaaagagcaaggctttgtggtggtggagaaggaagaactgaacatgattgacaacttcttcagtgagccaacaaccaagagctgggagatcatcactgttgaagaggcaaagcgcaggaagagcacatgcagctactatgaagacgaggacgaagaggtgctgcctgtcctacggccccacagcgcgctcctggagaatatgcacatcgagcagctggcccgacgccttcctgcaagggtgcaagggtatccatggagactggcctatagcacgttagagcacgggaccagcttaaagacgctctaccggaaatcggcatcactagacagtcctgtcctattggtcatcaaagatatggataatcagatttttggagcatatgcaactcatcctttcaagttcagtgaccactattatggcacaggcgaaacttttctctacacattcagccctcattttaaggtctttaagtggagtggagaaaattcatactttatcaatggagacataagttctttagaacttggtggtggagggggacgatttggtttatggctagatgctgatttataccacggacgaagcaactcttgcagcactttcaataatgatattctttccaaaaaggaagacttcatagttcaggatctggaggtgtgggcatttgattgaaattcagactgccttaaaatataacattaaaaagactgggttcgatcagccctcctaaagctggctggaaaaagaagccccagcccagcctgcctcatcccaccccaatgcttcctttctgccatcatctcagagcatgatcacattgcagaaagattctggaaggtccatgtagagggcagacattgaagaaagaaacttaaaatccaggttgttgaaaagactttgtactcccacttcctccaaatccatacagtgaggaatcagagtgtttatagatatatgagttgaatgcaatttttatttttggtaactgtgaaaaataagatactgtggatatatacatgccttgtgtatttatcagcataattttcattaccaaaatgtacagctattatttgccatggaaaaggttagtctcatttagaaaaatcgaaagtgcacagcacttaaagggaatatatgaggttttttttttaaaaaaaaaacttttatttattatttgtagtatattgtctgaaatgtgtcggcagttttttttcttttaatgtgtcaaatcttgaaatattaaatgtatacattttgtgctatgttttgggaacaaatctgtttgatttatatagttttatattgaattttttttgccctgattgtttagggtgataggtcttaagcagcatatatctatatatctgtatgtgggtatatagagatatatgtgtgtgtgtatgtatatgtacatatacatatatatgagtgtataattctaaatttctaaaaactcattatgaatgttcatcaatttgactattataggccagctttccatttagtcaataaaagcgtacatttttagttacttaccttgaacatattcgtgtgaaaaagaatacatcatttctcacagtcttaagttgatatttatagaaatgaatacctttgtgaacctagacttagaacaaatcctgcttttgaaaaaaaatgttttgcttcttacaaaatcatttgtgttaataacaaaaactttattttcggagtgttctttgtataacttttccaagcttttacattaacgagcaggcctctgtcttaaaagggactcagtatattaatttctgcattttttaaatcaaatgaaaaacgtcaaattggaccaattgtcttggtttcttgattcatttatttgagaaaaaaacaatacaaagaaatgcattcatatcaaaattggaatagaaaggaaaacctatttttaagatatcaacctattttcacatcataaaacatctattacataaaataaaggtccaggcatagtggctcttgcctgtaatcccagcactttgggaggccgaggcaggtggatcactcaaggtcacaagtttgagaccagtctggccaacatggtgaaaccccatctctactaaaagtacaaatattagccgactatgtggcgggcacctgtaatcccacctactcgggaggctgaggcaggagaattgcttgaatccgggaagcagaggttgtagtgagccaagatcgtgccactgcactctatcctgggtaacagcgagactctgtcttaaaaataataacaataataataataataaagacttacttaaccaatattattgattaccagacttttatgaaagccaaagactgcttgctagtaggaaaaaatttcaaataataaccaaagctgaaaaatggtctgtcataaattatttccccggtaatttttgaaaggaaaaatgtataacaagtactatttacatatctgcatttaaaaaagcaattcttagaatacttcctttacattattctcctattttagacattttgtgaaagagaacaaattgtccagtggcctcctgtcagatcaacaattattatactccttaattccatgcaaatttaaatgaatgctataaaattttaaatctgtagcctgggtgtacgtttcactcaagttctcctactgaggactcttgactaacagcatactggcagtttcaccttaacctgctcgttaaataatgtgttggtgtgagatatcaggaatgtctcatgatatcacgtttaccatttacaccatctgcaaccatatgctattaataaaatggaaaaaaacaaaatggtcattttgcatatacttcactctgacctagtttagtccatgatactataattgtgagagcatatccagatgctgtgttctctatgtaaaacagtattgtccattcagaaatgtgtgacccttcatttatggatattgactatatgtaatgcagtgctatcccaatattttcaataaaggactttatgcattca

SEQ ID NO: 427131 - DNA, 5268 bp, Homo sapiens
tactccattttatttttcacattggccagtgtaaacttttaagtttacagttgctttgttatcttttcttacagggttacgactcactgattaaaaagagggactttttcaaatactttgcacttttgattgtgtattatggataccaaggaagagaagaaggaacggaaacaaagttattttgctcgactgaaaaagaaaaaacaagccaaacaaaatgcagagacagcctcagctgtagctacaaggactcatactgggaaggaagataataatacagtagttttagagccagacaagtgcaacattgctgtggaagaggaatatatgactgatgagaaaaaaaagagaaaaagtaatcagttaaaggagatcaggcgtacagaactaaagagatattatagtattgatgacaatcaaaacaaaacacatgataaaaaagagaagaagatggtggttcagaagccccatgggactatggaatacactgctggaaaccaggacaccctaaactccatagcactgaaatttaacatcactcccaataaattggtggaactgaataaacttttcacacatactattgttccaggccaggtcctttttgtgccagatgccaactctccttccagtaccttaaggctatcatcatccagtcctggtgctactgtctctccttcatcatcagatgcagaatatgataaattgcctgatgctgacttagcacgaaaggccttgaaacccattgaaagagtcttatcgtctacttctgaagaagatgagccaggtgtggtgaaatttttaaaaatgaattgtcgatacttcaccgatggaaagggtgtggttggcggtgttatgatagtgactcctaacaacatcatgtttgaccctcataaatctgatcctctggttattgaaaatgggtgtgaggagtatggtctcatctgccccatggaagaggttgtttccattgcgctctacaatgacatttctcacatgaagatcaaagatgccttgccatcgcctggagaatgggaagacctggcttcagaaaaggatatcaacccattcagtaagttcaaatctatcaacaaggaaaaacgacagcagaatggagagaaaattatgacttcggattccagaccaatagtacctttggagaagtccacaggacatacacctacaaagccctcaggcagctctgtgtcagagaaattaaagaaactggactcctctagggagacatcccatggttctcccacagtgactaagctcagcaaggaaccttccgacacttcttctgcatttgaatctacagccaaagaaaactttctaggggaagatgatgattttgttgacttggaagaactttcttctcaaactggtggtggaatgcacaaaaaagacaccttgaaggagtgcctttctcttgacccagaggaacgaaagaaagctgagtcacaaataaacaattctgccgtggaaatgcaggtgcagtcagccctagcctttttgggaacagagaatgatgttgaactgaagggggcgctagatttagaaacctgtgagaagcaagatataatgccagaagtggacaagcagtctggttcgccagaaagccgagtagaaaacacactgaacatacatgaagatttagataaagttaaactcattgaatattacctgactaagaacaaagaagggccacaggtatctgaaaatttgcagaaaacagaattaagtgatggaaaaagtattgaaccagggggaatagacattacccttagtagttctctttcccaggcgggtgatcccataactgagggcaataaagagccagataagacctgggtgaaaaagggagagcccctcccggtaaaactgaactcttctacagaagcaaatgtgattaaagaggctctagactcctctttggaatctactctggacaacagctgtcaaggtgcacaaatggataataaatctgaagttcagttgtggctgttaaagagaattcaggtacccattgaagatatacttccttcaaaagaagaaaaaagcaagaccccacccatgttcctgtgcatcaaagtgggaaaaccaatgagaaaatcctttgccactcacactgcagccatggtccagcagtacggcaaacggagaaagcagccagagtactggtttgctgttcctcgggagagggtggatcatttgtacacattctttgttcagtggtctcccgatgtctatggaaaagatgccaaagagcaaggctttgtggtggtggagaaggaagaactgaacatgattgacaacttcttcagtgagccaacaaccaagagctgggagatcatcactgttgaagaggcaaagcgcaggaagagcacatgcagctactatgaagacgaggacgaagaggtgctgcctgtcctacggccccacagcgcgctcctggagaatatgcacatcgagcagctggcccgacgccttcctgcaagggtgcaagggtatccatggagactggcctatagcacgttagagcacgggaccagcttaaagacgctctaccggaaatcggcatcactagacagtcctgtcctattggtcatcaaagatatggataatcagatttttggagcatatgcaactcatcctttcaagttcagtgaccactattatggcacaggcgaaacttttctctacacattcagccctcattttaaggtctttaagtggagtggagaaaattcatactttatcaatggagacataagttctttagaacttggtggtggagggggacgatttggtttatggctagatgctgatttataccacggacgaagcaactcttgcagcactttcaataatgatattctttccaaaaaggaagacttcatagttcaggatctggaggtgtgggcatttgattgaaattcagactgccttaaaatataacattaaaaagactgggttcgatcagccctcctaaagctggctggaaaaagaagccccagcccagcctgcctcatcccaccccaatgcttcctttctgccatcatctcagagcatgatcacattgcagaaagattctggaaggtccatgtagagggcagacattgaagaaagaaacttaaaatccaggttgttgaaaagactttgtactcccacttcctccaaatccatacagtgaggaatcagagtgtttatagatatatgagttgaatgcaatttttatttttggtaactgtgaaaaataagatactgtggatatatacatgccttgtgtatttatcagcataattttcattaccaaaatgtacagctattatttgccatggaaaaggttagtctcatttagaaaaatcgaaagtgcacagcacttaaagggaatatatgaggttttttttttaaaaaaaaaacttttatttattatttgtagtatattgtctgaaatgtgtcggcagttttttttcttttaatgtgtcaaatcttgaaatattaaatgtatacattttgtgctatgttttgggaacaaatctgtttgatttatatagttttatattgaattttttttgccctgattgtttagggtgataggtcttaagcagcatatatctatatatctgtatgtgggtatatagagatatatgtgtgtgtgtatgtatatgtacatatacatatatatgagtgtataattctaaatttctaaaaactcattatgaatgttcatcaatttgactattataggccagctttccatttagtcaataaaagcgtacatttttagttacttaccttgaacatattcgtgtgaaaaagaatacatcatttctcacagtcttaagttgatatttatagaaatgaatacctttgtgaacctagacttagaacaaatcctgcttttgaaaaaaaatgttttgcttcttacaaaatcatttgtgttaataacaaaaactttattttcggagtgttctttgtataacttttccaagcttttacattaacgagcaggcctctgtcttaaaagggactcagtatattaatttctgcattttttaaatcaaatgaaaaacgtcaaattggaccaattgtcttggtttcttgattcatttatttgagaaaaaaacaatacaaagaaatgcattcatatcaaaattggaatagaaaggaaaacctatttttaagatatcaacctattttcacatcataaaacatctattacataaaataaaggtccaggcatagtggctcttgcctgtaatcccagcactttgggaggccgaggcaggtggatcactcaaggtcacaagtttgagaccagtctggccaacatggtgaaaccccatctctactaaaagtacaaatattagccgactatgtggcgggcacctgtaatcccacctactcgggaggctgaggcaggagaattgcttgaatccgggaagcagaggttgtagtgagccaagatcgtgccactgcactctatcctgggtaacagcgagactctgtcttaaaaataataacaataataataataataaagacttacttaaccaatattattgattaccagacttttatgaaagccaaagactgcttgctagtaggaaaaaatttcaaataataaccaaagctgaaaaatggtctgtcataaattatttccccggtaatttttgaaaggaaaaatgtataacaagtactatttacatatctgcatttaaaaaagcaattcttagaatacttcctttacattattctcctattttagacattttgtgaaagagaacaaattgtccagtggcctcctgtcagatcaacaattattatactccttaattccatgcaaatttaaatgaatgctataaaattttaaatctgtagcctgggtgtacgtttcactcaagttctcctactgaggactcttgactaacagcatactggcagtttcaccttaacctgctcgttaaataatgtgttggtgtgagatatcaggaatgtctcatgatatcacgtttaccatttacaccatctgcaaccatatgctattaataaaatggaaaaaaacaaaatggtcattttgcatatacttcactctgacctagtttagtccatgatactataattgtgagagcatatccagatgctgtgttctctatgtaaaacagtattgtccattcagaaatgtgtgacccttcatttatggatattgactatatgtaatgcagtgctatcccaatattttcaataaaggactttatgcattca

SEQ ID NO: 427132 - DNA, 5440 bp, Homo sapiens
cgatccggacgcggggccccgcgggcgcgcgcctcggagctcccgcctcctcctcttgctcctcctcggcgtacggtcctcccctgacccctccttccacccgccgagaggatgcgctccccggcgcccagcagcagaggccaccgctcccagaaatgcatgcgaccgatccccttctcccggaccccaggagccggcgcccccgccctgtagggttacgactcactgattaaaaagagggactttttcaaatactttgcacttttgattgtgtattatggataccaaggaagagaagaaggaacggaaacaaagttattttgctcgactgaaaaagaaaaaacaagccaaacaaaatgcagagacagcctcagctgtagctacaaggactcatactgggaaggaagataataatacagtagttttagagccagacaagtgcaacattgctgtggaagaggaatatatgactgatgagaaaaaaaagagaaaaagtaatcagttaaaggagatcaggcgtacagaactaaagagatattatagtattgatgacaatcaaaacaaaacacatgataaaaaagagaagaagatggtggttcagaagccccatgggactatggaatacactgctggaaaccaggacaccctaaactccatagcactgaaatttaacatcactcccaataaattggtggaactgaataaacttttcacacatactattgttccaggccaggtcctttttgtgccagatgccaactctccttccagtaccttaaggctatcatcatccagtcctggtgctactgtctctccttcatcatcagatgcagaatatgataaattgcctgatgctgacttagcacgaaaggccttgaaacccattgaaagagtcttatcgtctacttctgaagaagatgagccaggtgtggtgaaatttttaaaaatgaattgtcgatacttcaccgatggaaagggtgtggttggcggtgttatgatagtgactcctaacaacatcatgtttgaccctcataaatctgatcctctggttattgaaaatgggtgtgaggagtatggtctcatctgccccatggaagaggttgtttccattgcgctctacaatgacatttctcacatgaagatcaaagatgccttgccatctgacctacctcaggatctttgtcctctgtacaggcctggagaatgggaagacctggcttcagaaaaggatatcaacccattcagtaagttcaaatctatcaacaaggaaaaacgacagcagaatggagagaaaattatgacttcggattccagaccaatagtacctttggagaagtccacaggacatacacctacaaagccctcaggcagctctgtgtcagagaaattaaagaaactggactcctctagggagacatcccatggttctcccacagtgactaagctcagcaaggaaccttccgacacttcttctgcatttgaatctacagccaaagaaaactttctaggggaagatgatgattttgttgacttggaagaactttcttctcaaactggtggtggaatgcacaaaaaagacaccttgaaggagtgcctttctcttgacccagaggaacgaaagaaagctgagtcacaaataaacaattctgccgtggaaatgcaggtgcagtcagccctagcctttttgggaacagagaatgatgttgaactgaagggggcgctagatttagaaacctgtgagaagcaagatataatgccagaagtggacaagcagtctggttcgccagaaagccgagtagaaaacacactgaacatacatgaagatttagataaagttaaactcattgaatattacctgactaagaacaaagaagggccacaggtatctgaaaatttgcagaaaacagaattaagtgatggaaaaagtattgaaccagggggaatagacattacccttagtagttctctttcccaggcgggtgatcccataactgagggcaataaagagccagataagacctgggtgaaaaagggagagcccctcccggtaaaactgaactcttctacagaagcaaatgtgattaaagaggctctagactcctctttggaatctactctggacaacagctgtcaaggtgcacaaatggataataaatctgaagttcagttgtggctgttaaagagaattcaggtacccattgaagatatacttccttcaaaagaagaaaaaagcaagaccccacccatgttcctgtgcatcaaagtgggaaaaccaatgagaaaatcctttgccactcacactgcagccatggtccagcagtacggcaaacggagaaagcagccagagtactggtttgctgttcctcgggagagggtggatcatttgtacacattctttgttcagtggtctcccgatgtctatggaaaagatgccaaagagcaaggctttgtggtggtggagaaggaagaactgaacatgattgacaacttcttcagtgagccaacaaccaagagctgggagatcatcactgttgaagaggcaaagcgcaggaagagcacatgcagctactatgaagacgaggacgaagaggtgctgcctgtcctacggccccacagcgcgctcctggagaatatgcacatcgagcagctggcccgacgccttcctgcaagggtgcaagggtatccatggagactggcctatagcacgttagagcacgggaccagcttaaagacgctctaccggaaatcggcatcactagacagtcctgtcctattggtcatcaaagatatggataatcagatttttggagcatatgcaactcatcctttcaagttcagtgaccactattatggcacaggcgaaacttttctctacacattcagccctcattttaaggtctttaagtggagtggagaaaattcatactttatcaatggagacataagttctttagaacttggtggtggagggggacgatttggtttatggctagatgctgatttataccacggacgaagcaactcttgcagcactttcaataatgatattctttccaaaaaggaagacttcatagttcaggatctggaggtgtgggcatttgattgaaattcagactgccttaaaatataacattaaaaagactgggttcgatcagccctcctaaagctggctggaaaaagaagccccagcccagcctgcctcatcccaccccaatgcttcctttctgccatcatctcagagcatgatcacattgcagaaagattctggaaggtccatgtagagggcagacattgaagaaagaaacttaaaatccaggttgttgaaaagactttgtactcccacttcctccaaatccatacagtgaggaatcagagtgtttatagatatatgagttgaatgcaatttttatttttggtaactgtgaaaaataagatactgtggatatatacatgccttgtgtatttatcagcataattttcattaccaaaatgtacagctattatttgccatggaaaaggttagtctcatttagaaaaatcgaaagtgcacagcacttaaagggaatatatgaggttttttttttaaaaaaaaaacttttatttattatttgtagtatattgtctgaaatgtgtcggcagttttttttcttttaatgtgtcaaatcttgaaatattaaatgtatacattttgtgctatgttttgggaacaaatctgtttgatttatatagttttatattgaattttttttgccctgattgtttagggtgataggtcttaagcagcatatatctatatatctgtatgtgggtatatagagatatatgtgtgtgtgtatgtatatgtacatatacatatatatgagtgtataattctaaatttctaaaaactcattatgaatgttcatcaatttgactattataggccagctttccatttagtcaataaaagcgtacatttttagttacttaccttgaacatattcgtgtgaaaaagaatacatcatttctcacagtcttaagttgatatttatagaaatgaatacctttgtgaacctagacttagaacaaatcctgcttttgaaaaaaaatgttttgcttcttacaaaatcatttgtgttaataacaaaaactttattttcggagtgttctttgtataacttttccaagcttttacattaacgagcaggcctctgtcttaaaagggactcagtatattaatttctgcattttttaaatcaaatgaaaaacgtcaaattggaccaattgtcttggtttcttgattcatttatttgagaaaaaaacaatacaaagaaatgcattcatatcaaaattggaatagaaaggaaaacctatttttaagatatcaacctattttcacatcataaaacatctattacataaaataaaggtccaggcatagtggctcttgcctgtaatcccagcactttgggaggccgaggcaggtggatcactcaaggtcacaagtttgagaccagtctggccaacatggtgaaaccccatctctactaaaagtacaaatattagccgactatgtggcgggcacctgtaatcccacctactcgggaggctgaggcaggagaattgcttgaatccgggaagcagaggttgtagtgagccaagatcgtgccactgcactctatcctgggtaacagcgagactctgtcttaaaaataataacaataataataataataaagacttacttaaccaatattattgattaccagacttttatgaaagccaaagactgcttgctagtaggaaaaaatttcaaataataaccaaagctgaaaaatggtctgtcataaattatttccccggtaatttttgaaaggaaaaatgtataacaagtactatttacatatctgcatttaaaaaagcaattcttagaatacttcctttacattattctcctattttagacattttgtgaaagagaacaaattgtccagtggcctcctgtcagatcaacaattattatactccttaattccatgcaaatttaaatgaatgctataaaattttaaatctgtagcctgggtgtacgtttcactcaagttctcctactgaggactcttgactaacagcatactggcagtttcaccttaacctgctcgttaaataatgtgttggtgtgagatatcaggaatgtctcatgatatcacgtttaccatttacaccatctgcaaccatatgctattaataaaatggaaaaaaacaaaatggtcattttgcatatacttcactctgacctagtttagtccatgatactataattgtgagagcatatccagatgctgtgttctctatgtaaaacagtattgtccattcagaaatgtgtgacccttcatttatggatattgactatatgtaatgcagtgctatcccaatattttcaataaaggactttatgcattca

SEQ ID NO: 427133 - DNA, 5352 bp, Homo sapiens
cgatccggacgcggggccccgcgggcgcgcgcctcggagctcccgcctcctcctcttgctcctcctcggcgtacggtcctcccctgacccctccttccacccgccgagaggatgcgctccccggcgcccagcagcagaggccaccgctcccagaaatgcatgcgaccgatccccttctcccggaccccaggagccggcgcccccgccctgtagggttacgactcactgattaaaaagagggactttttcaaatactttgcacttttgattgtgtattatggataccaaggaagagaagaaggaacggaaacaaagttattttgctcgactgaaaaagaaaaaacaagccaaacaaaatgcagagacagcctcagctgtagctacaaggactcatactgggaaggaagataataatacagtagttttagagccagacaagtgcaacattgctgtggaagaggaatatatgactgatgagaaaaaaaagagaaaaagtaatcagttaaaggagatcaggcgtacagaactaaagagatattatagtattgatgacaatcaaaacaaaacacatgataaaaaagagaagaagatggtggttcagaagccccatgggactatggaatacactgctggaaaccaggacaccctaaactccatagcactgaaatttaacatcactcccaataaattggtggaactgaataaacttttcacacatactattgttccaggccaggtcctttttgtgccagatgccaactctccttccagtaccttaaggctatcatcatccagtcctggtgctactgtctctccttcatcatcagatgcagaatatgataaattgcctgatgctgacttagcacgaaaggccttgaaacccattgaaagagtcttatcgtctacttctgaagaagatgagccaggtgtggtgaaatttttaaaaatgaattgtcgatacttcaccgatggaaagggtgtggttggcggtgttatgatagtgactcctaacaacatcatgtttgaccctcataaatctgatcctctggttattgaaaatgggtgtgaggagtatggtctcatctgccccatggaagaggttgtttccattgcgctctacaatgacatttctcacatgaagatcaaagatgccttgccatcgcctggagaatgggaagacctggcttcagaaaaggatatcaacccattcagtaagttcaaatctatcaacaaggaaaaacgacagcagaatggagagaaaattatgacttcggattccagaccaatagtacctttggagaagtccacaggacatacacctacaaagccctcaggcagctctgtgtcagagaaattaaagaaactggactcctctagggagacatcccatggttctcccacagtgactaagctcagcaaggaaccttccgacacttcttctgcatttgaatctacagccaaagaaaactttctaggggaagatgatgattttgttgacttggaagaactttcttctcaaactggtggtggaatgcacaaaaaagacaccttgaaggagtgcctttctcttgacccagaggaacgaaagaaagctgagtcacaaataaacaattctgccgtggaaatgcaggtgcagtcagccctagcctttttgggaacagagaatgatgttgaactgaagggggcgctagatttagaaacctgtgagaagcaagatataatgccagaagtggacaagcagtctggttcgccagaaagccgagtagaaaacacactgaacatacatgaagatttagataaagttaaactcattgaatattacctgactaagaacaaagaagggccacaggtatctgaaaatttgcagaaaacagaattaagtgatggaaaaagtattgaaccagggggaatagacattacccttagtagttctctttcccaggcgggtgatcccataactgagggcaataaagagccagataagacctgggtgaaaaagggagagcccctcccggtaaaactgaactcttctacagaagcaaatgtgattaaagaggctctagactcctctttggaatctactctggacaacagctgtcaaggtgcacaaatggataataaatctgaagttcagttgtggctgttaaagagaattcaggtacccattgaagatatacttccttcaaaagaagaaaaaagcaagaccccacccatgttcctgtgcatcaaagtgggaaaaccaatgagaaaatcctttgccactcacactgcagccatggtccagcagtacggcaaacggagaaagcagccagagtactggtttgctgttcctcgggagagggtggatcatttgtacacattctttgttcagtggtctcccgatgtctatggaaaagatgccaaagagcaaggctttgtggtggtggagaaggaagaactgaacatgattgacaacttcttcagtgagccaacaaccaagagctgggagatcatcactgttgaagaggcaaagcgcaggaagagcacatgcagctactatgaagacgaggacgaagaggtgctgcctgtcctacggccccacagcgcgctcctggagaatatgcacatcgagcagctggcccgacgccttcctgcaagggtgcaagggtatccatggagactggcctatagcacgttagagcacgggaccagcttaaagacgctctaccggaaatcggcatcactagacagtcctgtcctattggtcatcaaagatatggataatcagatttttggagcatatgcaactcatcctttcaagttcagtgaccactattatggcacaggcgaaacttttctctacacattcagccctcattttaaggtctttaagtggagtggagaaaattcatactttatcaatggagacataagttctttagaacttggtggtggagggggacgatttggtttatggctagatgctgatttataccacggacgaagcaactcttgcagcactttcaataatgatattctttccaaaaaggaagacttcatagttcaggatctggaggtgtgggcatttgattgaaattcagactgccttaaaatataacattaaaaagactgggttcgatcagccctcctaaagctggctggaaaaagaagccccagcccagcctgcctcatcccaccccaatgcttcctttctgccatcatctcagagcatgatcacattgcagaaagattctggaaggtccatgtagagggcagacattgaagaaagaaacttaaaatccaggttgttgaaaagactttgtactcccacttcctccaaatccatacagtgaggaatcagagtgtttatagatatatgagttgaatgcaatttttatttttggtaactgtgaaaaataagatactgtggatatatacatgccttgtgtatttatcagcataattttcattaccaaaatgtacagctattatttgccatggaaaaggttagtctcatttagaaaaatcgaaagtgcacagcacttaaagggaatatatgaggttttttttttaaaaaaaaaacttttatttattatttgtagtatattgtctgaaatgtgtcggcagttttttttcttttaatgtgtcaaatcttgaaatattaaatgtatacattttgtgctatgttttgggaacaaatctgtttgatttatatagttttatattgaattttttttgccctgattgtttagggtgataggtcttaagcagcatatatctatatatctgtatgtgggtatatagagatatatgtgtgtgtgtatgtatatgtacatatacatatatatgagtgtataattctaaatttctaaaaactcattatgaatgttcatcaatttgactattataggccagctttccatttagtcaataaaagcgtacatttttagttacttaccttgaacatattcgtgtgaaaaagaatacatcatttctcacagtcttaagttgatatttatagaaatgaatacctttgtgaacctagacttagaacaaatcctgcttttgaaaaaaaatgttttgcttcttacaaaatcatttgtgttaataacaaaaactttattttcggagtgttctttgtataacttttccaagcttttacattaacgagcaggcctctgtcttaaaagggactcagtatattaatttctgcattttttaaatcaaatgaaaaacgtcaaattggaccaattgtcttggtttcttgattcatttatttgagaaaaaaacaatacaaagaaatgcattcatatcaaaattggaatagaaaggaaaacctatttttaagatatcaacctattttcacatcataaaacatctattacataaaataaaggtccaggcatagtggctcttgcctgtaatcccagcactttgggaggccgaggcaggtggatcactcaaggtcacaagtttgagaccagtctggccaacatggtgaaaccccatctctactaaaagtacaaatattagccgactatgtggcgggcacctgtaatcccacctactcgggaggctgaggcaggagaattgcttgaatccgggaagcagaggttgtagtgagccaagatcgtgccactgcactctatcctgggtaacagcgagactctgtcttaaaaataataacaataataataataataaagacttacttaaccaatattattgattaccagacttttatgaaagccaaagactgcttgctagtaggaaaaaatttcaaataataaccaaagctgaaaaatggtctgtcataaattatttccccggtaatttttgaaaggaaaaatgtataacaagtactatttacatatctgcattttgtgaaagagaacaaattgtccagtggcctcctgtcagatcaacaattattatactccttaattccatgcaaatttaaatgaatgctataaaattttaaatctgtagcctgggtgtacgtttcactcaagttctcctactgaggactcttgactaacagcatactggcagtttcaccttaacctgctcgttaaataatgtgttggtgtgagatatcaggaatgtctcatgatatcacgtttaccatttacaccatctgcaaccatatgctattaataaaatggaaaaaaacaaaatggtcattttgcatatacttcactctgacctagtttagtccatgatactataattgtgagagcatatccagatgctgtgttctctatgtaaaacagtattgtccattcagaaatgtgtgacccttcatttatggatattgactatatgtaatgcagtgctatcccaatattttcaataaaggactttatgcattca

SEQ ID NO: 427134 - DNA, 3180 bp, Homo sapiens
tgctttctggtggcggagcaagcttggagacaagtagctttggagaatagctgagggtccatttccactgcagactaatccctgccaatgggtgctgcacacagtgtttgggaggtggatcatttgtacacattctttgttcagtggtctcccgatgtctatggaaaagatgccaaagagcaaggctttgtggtggtggagaaggaagaactgaacatgattgacaacttcttcagtgagccaacaaccaagagctgggagatcatcactgttgaagaggcaaagcgcaggaagagcacatgcagctactatgaagacgaggacgaagaggtgctgcctgtcctacggccccacagcgcgctcctggagaatatgcacatcgagcagctggcccgacgccttcctgcaagggtgcaagggtatccatggagactggcctatagcacgttagagcacgggaccagcttaaagacgctctaccggaaatcggcatcactagacagtcctgtcctattggtcatcaaagatatggataatcagatttttggagcatatgcaactcatcctttcaagttcagtgaccactattatggcacaggcgaaacttttctctacacattcagccctcattttaaggtctttaagtggagtggagaaaattcatactttatcaatggagacataagttctttagaacttggtggtggagggggacgatttggtttatggctagatgctgatttataccacggacgaagcaactcttgcagcactttcaataatgatattctttccaaaaaggaagacttcatagttcaggatctggaggtgtgggcatttgattgaaattcagactgccttaaaatataacattaaaaagactgggttcgatcagccctcctaaagctggctggaaaaagaagccccagcccagcctgcctcatcccaccccaatgcttcctttctgccatcatctcagagcatgatcacattgcagaaagattctggaaggtccatgtagagggcagacattgaagaaagaaacttaaaatccaggttgttgaaaagactttgtactcccacttcctccaaatccatacagtgaggaatcagagtgtttatagatatatgagttgaatgcaatttttatttttggtaactgtgaaaaataagatactgtggatatatacatgccttgtgtatttatcagcataattttcattaccaaaatgtacagctattatttgccatggaaaaggttagtctcatttagaaaaatcgaaagtgcacagcacttaaagggaatatatgaggttttttttttaaaaaaaaaacttttatttattatttgtagtatattgtctgaaatgtgtcggcagttttttttcttttaatgtgtcaaatcttgaaatattaaatgtatacattttgtgctatgttttgggaacaaatctgtttgatttatatagttttatattgaattttttttgccctgattgtttagggtgataggtcttaagcagcatatatctatatatctgtatgtgggtatatagagatatatgtgtgtgtgtatgtatatgtacatatacatatatatgagtgtataattctaaatttctaaaaactcattatgaatgttcatcaatttgactattataggccagctttccatttagtcaataaaagcgtacatttttagttacttaccttgaacatattcgtgtgaaaaagaatacatcatttctcacagtcttaagttgatatttatagaaatgaatacctttgtgaacctagacttagaacaaatcctgcttttgaaaaaaaatgttttgcttcttacaaaatcatttgtgttaataacaaaaactttattttcggagtgttctttgtataacttttccaagcttttacattaacgagcaggcctctgtcttaaaagggactcagtatattaatttctgcattttttaaatcaaatgaaaaacgtcaaattggaccaattgtcttggtttcttgattcatttatttgagaaaaaaacaatacaaagaaatgcattcatatcaaaattggaatagaaaggaaaacctatttttaagatatcaacctattttcacatcataaaacatctattacataaaataaaggtccaggcatagtggctcttgcctgtaatcccagcactttgggaggccgaggcaggtggatcactcaaggtcacaagtttgagaccagtctggccaacatggtgaaaccccatctctactaaaagtacaaatattagccgactatgtggcgggcacctgtaatcccacctactcgggaggctgaggcaggagaattgcttgaatccgggaagcagaggttgtagtgagccaagatcgtgccactgcactctatcctgggtaacagcgagactctgtcttaaaaataataacaataataataataataaagacttacttaaccaatattattgattaccagacttttatgaaagccaaagactgcttgctagtaggaaaaaatttcaaataataaccaaagctgaaaaatggtctgtcataaattatttccccggtaatttttgaaaggaaaaatgtataacaagtactatttacatatctgcatttaaaaaagcaattcttagaatacttcctttacattattctcctattttagacattttgtgaaagagaacaaattgtccagtggcctcctgtcagatcaacaattattatactccttaattccatgcaaatttaaatgaatgctataaaattttaaatctgtagcctgggtgtacgtttcactcaagttctcctactgaggactcttgactaacagcatactggcagtttcaccttaacctgctcgttaaataatgtgttggtgtgagatatcaggaatgtctcatgatatcacgtttaccatttacaccatctgcaaccatatgctattaataaaatggaaaaaaacaaaatggtcattttgcatatacttcactctgacctagtttagtccatgatactataattgtgagagcatatccagatgctgtgttctctatgtaaaacagtattgtccattcagaaatgtgtgacccttcatttatggatattgactatatgtaatgcagtgctatcccaatattttcaataaaggactttatgcattca

SEQ ID NO: 427135 - DNA, 3253 bp, Homo sapiens
caaaggtgaaagtgtccttttacagtctcacagcgatgcctggcaggaagtgtgtttgctctaaatcctaatttgggtgtgttcctgtagaaatgttgaaacttctcctgagggaaacagaaactcaatcatgcaggaaactagatactgagaaaacagttgtagctcagcgtggctacaagtaactgtggtgtggaagcagagtagagagaaaacttgttcctcattagagagagagccacacttctcactgctcacaatgagaggccaaagattacccttggacatccagattttctattgtgccagacctgacgaagagccttttgtgaagatcatcactgttgaagaggcaaagcgcaggaagagcacatgcagctactatgaagacgaggacgaagaggtgctgcctgtcctacggccccacagcgcgctcctggagaatatgcacatcgagcagctggcccgacgccttcctgcaagggtgcaagggtatccatggagactggcctatagcacgttagagcacgggaccagcttaaagacgctctaccggaaatcggcatcactagacagtcctgtcctattggtcatcaaagatatggataatcagatttttggagcatatgcaactcatcctttcaagttcagtgaccactattatggcacaggcgaaacttttctctacacattcagccctcattttaaggtctttaagtggagtggagaaaattcatactttatcaatggagacataagttctttagaacttggtggtggagggggacgatttggtttatggctagatgctgatttataccacggacgaagcaactcttgcagcactttcaataatgatattctttccaaaaaggaagacttcatagttcaggatctggaggtgtgggcatttgattgaaattcagactgccttaaaatataacattaaaaagactgggttcgatcagccctcctaaagctggctggaaaaagaagccccagcccagcctgcctcatcccaccccaatgcttcctttctgccatcatctcagagcatgatcacattgcagaaagattctggaaggtccatgtagagggcagacattgaagaaagaaacttaaaatccaggttgttgaaaagactttgtactcccacttcctccaaatccatacagtgaggaatcagagtgtttatagatatatgagttgaatgcaatttttatttttggtaactgtgaaaaataagatactgtggatatatacatgccttgtgtatttatcagcataattttcattaccaaaatgtacagctattatttgccatggaaaaggttagtctcatttagaaaaatcgaaagtgcacagcacttaaagggaatatatgaggttttttttttaaaaaaaaaacttttatttattatttgtagtatattgtctgaaatgtgtcggcagttttttttcttttaatgtgtcaaatcttgaaatattaaatgtatacattttgtgctatgttttgggaacaaatctgtttgatttatatagttttatattgaattttttttgccctgattgtttagggtgataggtcttaagcagcatatatctatatatctgtatgtgggtatatagagatatatgtgtgtgtgtatgtatatgtacatatacatatatatgagtgtataattctaaatttctaaaaactcattatgaatgttcatcaatttgactattataggccagctttccatttagtcaataaaagcgtacatttttagttacttaccttgaacatattcgtgtgaaaaagaatacatcatttctcacagtcttaagttgatatttatagaaatgaatacctttgtgaacctagacttagaacaaatcctgcttttgaaaaaaaatgttttgcttcttacaaaatcatttgtgttaataacaaaaactttattttcggagtgttctttgtataacttttccaagcttttacattaacgagcaggcctctgtcttaaaagggactcagtatattaatttctgcattttttaaatcaaatgaaaaacgtcaaattggaccaattgtcttggtttcttgattcatttatttgagaaaaaaacaatacaaagaaatgcattcatatcaaaattggaatagaaaggaaaacctatttttaagatatcaacctattttcacatcataaaacatctattacataaaataaaggtccaggcatagtggctcttgcctgtaatcccagcactttgggaggccgaggcaggtggatcactcaaggtcacaagtttgagaccagtctggccaacatggtgaaaccccatctctactaaaagtacaaatattagccgactatgtggcgggcacctgtaatcccacctactcgggaggctgaggcaggagaattgcttgaatccgggaagcagaggttgtagtgagccaagatcgtgccactgcactctatcctgggtaacagcgagactctgtcttaaaaataataacaataataataataataaagacttacttaaccaatattattgattaccagacttttatgaaagccaaagactgcttgctagtaggaaaaaatttcaaataataaccaaagctgaaaaatggtctgtcataaattatttccccggtaatttttgaaaggaaaaatgtataacaagtactatttacatatctgcatttaaaaaagcaattcttagaatacttcctttacattattctcctattttagacattttgtgaaagagaacaaattgtccagtggcctcctgtcagatcaacaattattatactccttaattccatgcaaatttaaatgaatgctataaaattttaaatctgtagcctgggtgtacgtttcactcaagttctcctactgaggactcttgactaacagcatactggcagtttcaccttaacctgctcgttaaataatgtgttggtgtgagatatcaggaatgtctcatgatatcacgtttaccatttacaccatctgcaaccatatgctattaataaaatggaaaaaaacaaaatggtcattttgcatatacttcactctgacctagtttagtccatgatactataattgtgagagcatatccagatgctgtgttctctatgtaaaacagtattgtccattcagaaatgtgtgacccttcatttatggatattgactatatgtaatgcagtgctatcccaatattttcaataaaggactttatgcattca

SEQ ID NO: 427136 - DNA, 3179 bp, Homo sapiens
caaaggtgaaagtgtccttttacagtctcacagcgatgcctggcaggaagtgtgtttgctctaaatcctaatttgggtgtgttcctgtagaaatgttgaaacttctcctgagggaaacagaaactcaatcatgcaggaaactagatactgagaaaacagttgtagctcagcgtggctacaagtaactgtggtgtggaagcagagtagagagaaaacttgttcctcattagagagagagccacacttctcactgctcacaatgagaggccaaagattacccttggacatccagattttctattgtgccagacctgacgaagagccttttgtgaagatcatcactgttgaagaggcaaagcgcaggaagagcacatgcagctactatgaagacgaggacgaagaggtgctgcctgtcctacggccccacagcgcgctcctggagaatatgcacatcgagcagctggcccgacgccttcctgcaagggtgcaagggtatccatggagactggcctatagcacgttagagcacgggaccagcttaaagacgctctaccggaaatcggcatcactagacagtcctgtcctattggtcatcaaagatatggataatcagatttttggagcatatgcaactcatcctttcaagttcagtgaccactattatggcacaggcgaaacttttctctacacattcagccctcattttaaggggacgatttggtttatggctagatgctgatttataccacggacgaagcaactcttgcagcactttcaataatgatattctttccaaaaaggaagacttcatagttcaggatctggaggtgtgggcatttgattgaaattcagactgccttaaaatataacattaaaaagactgggttcgatcagccctcctaaagctggctggaaaaagaagccccagcccagcctgcctcatcccaccccaatgcttcctttctgccatcatctcagagcatgatcacattgcagaaagattctggaaggtccatgtagagggcagacattgaagaaagaaacttaaaatccaggttgttgaaaagactttgtactcccacttcctccaaatccatacagtgaggaatcagagtgtttatagatatatgagttgaatgcaatttttatttttggtaactgtgaaaaataagatactgtggatatatacatgccttgtgtatttatcagcataattttcattaccaaaatgtacagctattatttgccatggaaaaggttagtctcatttagaaaaatcgaaagtgcacagcacttaaagggaatatatgaggttttttttttaaaaaaaaaacttttatttattatttgtagtatattgtctgaaatgtgtcggcagttttttttcttttaatgtgtcaaatcttgaaatattaaatgtatacattttgtgctatgttttgggaacaaatctgtttgatttatatagttttatattgaattttttttgccctgattgtttagggtgataggtcttaagcagcatatatctatatatctgtatgtgggtatatagagatatatgtgtgtgtgtatgtatatgtacatatacatatatatgagtgtataattctaaatttctaaaaactcattatgaatgttcatcaatttgactattataggccagctttccatttagtcaataaaagcgtacatttttagttacttaccttgaacatattcgtgtgaaaaagaatacatcatttctcacagtcttaagttgatatttatagaaatgaatacctttgtgaacctagacttagaacaaatcctgcttttgaaaaaaaatgttttgcttcttacaaaatcatttgtgttaataacaaaaactttattttcggagtgttctttgtataacttttccaagcttttacattaacgagcaggcctctgtcttaaaagggactcagtatattaatttctgcattttttaaatcaaatgaaaaacgtcaaattggaccaattgtcttggtttcttgattcatttatttgagaaaaaaacaatacaaagaaatgcattcatatcaaaattggaatagaaaggaaaacctatttttaagatatcaacctattttcacatcataaaacatctattacataaaataaaggtccaggcatagtggctcttgcctgtaatcccagcactttgggaggccgaggcaggtggatcactcaaggtcacaagtttgagaccagtctggccaacatggtgaaaccccatctctactaaaagtacaaatattagccgactatgtggcgggcacctgtaatcccacctactcgggaggctgaggcaggagaattgcttgaatccgggaagcagaggttgtagtgagccaagatcgtgccactgcactctatcctgggtaacagcgagactctgtcttaaaaataataacaataataataataataaagacttacttaaccaatattattgattaccagacttttatgaaagccaaagactgcttgctagtaggaaaaaatttcaaataataaccaaagctgaaaaatggtctgtcataaattatttccccggtaatttttgaaaggaaaaatgtataacaagtactatttacatatctgcatttaaaaaagcaattcttagaatacttcctttacattattctcctattttagacattttgtgaaagagaacaaattgtccagtggcctcctgtcagatcaacaattattatactccttaattccatgcaaatttaaatgaatgctataaaattttaaatctgtagcctgggtgtacgtttcactcaagttctcctactgaggactcttgactaacagcatactggcagtttcaccttaacctgctcgttaaataatgtgttggtgtgagatatcaggaatgtctcatgatatcacgtttaccatttacaccatctgcaaccatatgctattaataaaatggaaaaaaacaaaatggtcattttgcatatacttcactctgacctagtttagtccatgatactataattgtgagagcatatccagatgctgtgttctctatgtaaaacagtattgtccattcagaaatgtgtgacccttcatttatggatattgactatatgtaatgcagtgctatcccaatattttcaataaaggactttatgcattca

SEQ ID NO: 427137 - DNA, 2803 bp, Homo sapiens
cgtccctggccttctgggctgctcaggctgggatccagagagtcgcaggtcagagccaccacgtgtctgaaaggtcttccttccttcgtaaccccttgggagatctcatcctggtgtgggccaggtctggcagtcaggaacttcctccgtcaatggggtgaggtggttcccttttacatatagatactatttcatatttcctcattgctaattctccagattaaaatgtctgttttcttttttgtgtttcttccccaaggtctttaagtggagtggagaaaattcatactttatcaatggagacataagttctttagaacttggtggtggagggggacgatttggtttatggctagatgctgatttataccacggacgaagcaactcttgcagcactttcaataatgatattctttccaaaaaggaagacttcatagttcaggatctggaggtgtgggcatttgattgaaattcagactgccttaaaatataacattaaaaagactgggttcgatcagccctcctaaagctggctggaaaaagaagccccagcccagcctgcctcatcccaccccaatgcttcctttctgccatcatctcagagcatgatcacattgcagaaagattctggaaggtccatgtagagggcagacattgaagaaagaaacttaaaatccaggttgttgaaaagactttgtactcccacttcctccaaatccatacagtgaggaatcagagtgtttatagatatatgagttgaatgcaatttttatttttggtaactgtgaaaaataagatactgtggatatatacatgccttgtgtatttatcagcataattttcattaccaaaatgtacagctattatttgccatggaaaaggttagtctcatttagaaaaatcgaaagtgcacagcacttaaagggaatatatgaggttttttttttaaaaaaaaaacttttatttattatttgtagtatattgtctgaaatgtgtcggcagttttttttcttttaatgtgtcaaatcttgaaatattaaatgtatacattttgtgctatgttttgggaacaaatctgtttgatttatatagttttatattgaattttttttgccctgattgtttagggtgataggtcttaagcagcatatatctatatatctgtatgtgggtatatagagatatatgtgtgtgtgtatgtatatgtacatatacatatatatgagtgtataattctaaatttctaaaaactcattatgaatgttcatcaatttgactattataggccagctttccatttagtcaataaaagcgtacatttttagttacttaccttgaacatattcgtgtgaaaaagaatacatcatttctcacagtcttaagttgatatttatagaaatgaatacctttgtgaacctagacttagaacaaatcctgcttttgaaaaaaaatgttttgcttcttacaaaatcatttgtgttaataacaaaaactttattttcggagtgttctttgtataacttttccaagcttttacattaacgagcaggcctctgtcttaaaagggactcagtatattaatttctgcattttttaaatcaaatgaaaaacgtcaaattggaccaattgtcttggtttcttgattcatttatttgagaaaaaaacaatacaaagaaatgcattcatatcaaaattggaatagaaaggaaaacctatttttaagatatcaacctattttcacatcataaaacatctattacataaaataaaggtccaggcatagtggctcttgcctgtaatcccagcactttgggaggccgaggcaggtggatcactcaaggtcacaagtttgagaccagtctggccaacatggtgaaaccccatctctactaaaagtacaaatattagccgactatgtggcgggcacctgtaatcccacctactcgggaggctgaggcaggagaattgcttgaatccgggaagcagaggttgtagtgagccaagatcgtgccactgcactctatcctgggtaacagcgagactctgtcttaaaaataataacaataataataataataaagacttacttaaccaatattattgattaccagacttttatgaaagccaaagactgcttgctagtaggaaaaaatttcaaataataaccaaagctgaaaaatggtctgtcataaattatttccccggtaatttttgaaaggaaaaatgtataacaagtactatttacatatctgcatttaaaaaagcaattcttagaatacttcctttacattattctcctattttagacattttgtgaaagagaacaaattgtccagtggcctcctgtcagatcaacaattattatactccttaattccatgcaaatttaaatgaatgctataaaattttaaatctgtagcctgggtgtacgtttcactcaagttctcctactgaggactcttgactaacagcatactggcagtttcaccttaacctgctcgttaaataatgtgttggtgtgagatatcaggaatgtctcatgatatcacgtttaccatttacaccatctgcaaccatatgctattaataaaatggaaaaaaacaaaatggtcattttgcatatacttcactctgacctagtttagtccatgatactataattgtgagagcatatccagatgctgtgttctctatgtaaaacagtattgtccattcagaaatgtgtgacccttcatttatggatattgactatatgtaatgcagtgctatcccaatattttcaataaaggactttatgcattca

SEQ ID NO: 427138 - DNA, 5827 bp, Homo sapiens
cgatccggacgcggggccccgcgggcgcgcgcctcggagctcccgcctcctcctcttgctcctcctcggcgtacggtcctcccctgacccctccttccacccgccgagaggatgcgctccccggcgcccagcagcagaggccaccgctcccagaaatgcatgcgaccgatccccttctcccggaccccaggagccggcgcccccgccctgtagggttacgactcactgattaaaaagagggactttttcaaatactttgcacttttgattgtgtattatggataccaaggaagagaagaaggaacggaaacaaagttattttgctcgactgaaaaagaaaaaacaagccaaacaaaatgcagagacagcctcagctgtagctacaaggactcatactgggaaggaagataataatacagtagttttagagccagacaagtgcaacattgctgtggaagaggaatatatgactgatgagaaaaaaaagagaaaaagtaatcagttaaaggagatcaggcgtacagaactaaagagatattatagtattgatgacaatcaaaacaaaacacatgataaaaaagagaagaagatggtggttcagaagccccatgggactatggaatacactgctggaaaccaggacaccctaaactccatagcactgaaatttaacatcactcccaataaattggtggaactgaataaacttttcacacatactattgttccaggccaggtcctttttgtgccagatgccaactctccttccagtaccttaaggctatcatcatccagtcctggtgctactgtctctccttcatcatcagatgcagaatatgataaattgcctgatgctgacttagcacgaaaggccttgaaacccattgaaagagtcttatcgtctacttctgaagaagatgagccaggtgtggtgaaatttttaaaaatgaattgtcgatacttcaccgatggaaagggtgtggttggcggtgttatgatagtgactcctaacaacatcatgtttgaccctcataaatctgatcctctggttattgaaaatgggtgtgaggagtatggtctcatctgccccatggaagaggttgtttccattgcgctctacaatgacatttctcacatgaagatcaaagatgccttgccatcgcctggagaatgggaagacctggcttcagaaaaggatatcaacccattcagtaagttcaaatctatcaacaaggaaaaacgacagcagaatggagagaaaattatgacttcggattccagaccaatagtacctttggagaagtccacaggacatacacctacaaagccctcaggcagctctgtgtcagagaaattaaagaaactggactcctctagggagacatcccatggttctcccacagtgactaagctcagcaaggaaccttccgacacttcttctgcatttgaatctacagccaaagaaaactttctaggggaagatgatgattttgttgacttggaagaactttcttctcaaactggtggtggaatgcacaaaaaagacaccttgaaggagtgcctttctcttgacccagaggaacgaaagaaagctgagtcacaaataaacaattctgccgtggaaatgcaggtgcagtcagccctagcctttttgggaacagagaatgatgttgaactgaagggggcgctagatttagaaacctgtgagaagcaagatataatgccagaagtggacaagcagtctggttcgccagaaagccgagtagaaaacacactgaacatacatgaagatttagataaagttaaactcattgaatattacctgactaagaacaaagaagggccacaggtatctgaaaatttgcagaaaacagaattaagtgatggaaaaagtattgaaccagggggaatagacattacccttagtagttctctttcccaggcgggtgatcccataactgagggcaataaagagccagataagacctgggtgaaaaagggagagcccctcccggtaaaactgaactcttctacagaagcaaatgtgattaaagaggctctagactcctctttggaatctactctggacaacagctgtcaaggtgcacaaatggataataaatctgaagttcagttgtggctgttaaagagaattcaggtacccattgaagatatacttccttcaaaagaagaaaaaagcaagaccccacccatgttcctgtgcatcaaagtgggaaaaccaatgagaaaatcctttgccactcacactgcagccatggtccagcagtacggcaaacggagaaagcagccagagtactggtttgctgttcctcgggagagggtggatcatttgtacacattctttgttcagtggtctcccgatgtctatggaaaagatgccaaagagcaaggctttgtggtggtggagaaggaagaactgaacatgattgacaacttcttcagtgagccaacaaccaagagctgggagatcatcactgttgaagaggcaaagcgcaggaagagcacatgcagctactatgaagacgaggacgaagaggtgctgcctgtcctacggccccacagcgcgctcctggagaatatgcacatcgagcagctggcccgacgccttcctgcaagggtgcaagggtatccatggagactggcctatagcacgttagagcacgggaccagcttaaagacgctctaccggaaatcggcatcactagacagtcctgtcctattggtcatcaaagatatggataatcagatttttggagcatatgcaactcatcctttcaagttcagtgaccactattatggcacaggcgaaacttttctctacacattcagccctcattttaaggtctttaagtggagtggagaaaattcatactttatcaatggagacataagttctttagaacttggtggtggagggggacgatttggtttatggctagatgctgatttataccacggacgaagcaactcttgcagcactttcaataatgatattctttccaaaaaggaagacttcatagttcaggatctggaggtgtgggcatttgattgaaattcagactgccttaaaatataacattaaaaagactgggttcgatcagccctcctaaagctggctggaaaaagaagccccagcccagcctgcctcatcccaccccaatgcttcctttctgccatcatctcagagcatgatcacattgcagaaagattctggaaggtccatgtagagggcagacattgaagaaagaaacttaaaatccaggttgttgaaaagactttgtactcccacttcctccaaatccatacagtgaggaatcagagtgtttatagatatatgagttgaatgcaatttttatttttggtaactgtgaaaaataagatactgtggatatatacatgccttgtgtatttatcagcataattttcattaccaaaatgtacagctattatttgccatggaaaaggttagtctcatttagaaaaatcgaaagtgcacagcacttaaagggaatatatgaggttttttttttaaaaaaaaaacttttatttattatttgtagtatattgtctgaaatgtgtcggcagttttttttcttttaatgtgtcaaatcttgaaatattaaatgtatacattttgtgctatgttttgggaacaaatctgtttgatttatatagttttatattgaattttttttgccctgattgtttagggtgataggtcttaagcagcatatatctatatatctgtatgtgggtatatagagatatatgtgtgtgtgtatgtatatgtacatatacatatatatgagtgtataattctaaatttctaaaaactcattatgaatgttcatcaatttgactattataggccagctttccatttagtcaataaaagcgtacatttttagttacttaccttgaacatattcgtgtgaaaaagaatacatcatttctcacagtcttaagttgatatttatagaaatgaatacctttgtgaacctagacttagaacaaatcctgcttttgaaaaaaaatgttttgcttcttacaaaatcatttgtgttaataacaaaaactttattttcggagtgttctttgtataacttttccaagcttttacattaacgagcaggcctctgtcttaaaagggactcagtatattaatttctgcattttttaaatcaaatgaaaaacgtcaaattggaccaattgtcttggtttcttgattcatttatttgagaaaaaaacaatacaaagaaatgcattcatatcaaaattggaatagaaaggaaaacctatttttaagatatcaacctattttcacatcataaaacatctattacataaaataaaggtccaggcatagtggctcttgcctgtaatcccagcactttgggaggccgaggcaggtggatcactcaaggtcacaagtttgagaccagtctggccaacatggtgaaaccccatctctactaaaagtacaaatattagccgactatgtggcgggcacctgtaatcccacctactcgggaggctgaggcaggagaattgcttgaatccgggaagcagaggttgtagtgagccaagatcgtgccactgcactctatcctgggtaacagcgagactctgtcttaaaaataataacaataataataataataaagacttacttaaccaatattattgattaccagacttttatgaaagccaaagactgcttgctagtaggaaaaaatttcaaataataaccaaagctgaaaaatggtctgtcataaattatttccccggtaatttttgaaaggaaaaatgtataacaagtactatttacatatctgcatttaaaaaagcaattcttagaatacttcctttacattattctcctattttagacattttgtgaaagagaacaaattgtccagtggcctcctgtcagatcaacaattattatactccttaattccatgcaaatttaaatgaatgctataaaattttaaatctgtagcctgggtgtacgtttcactcaagttctcctactgaggactcttgactaacagcatactggcagtttcaccttaacctgctcgttaaataatgtgttggtgtgagatatcaggaatgtctcatgatatcacgtttaccatttacaccatctgcaaccatatgctattaataaaatggaaaaaaacaaaatggtcattttgcatatacttcactctgacctagtttagtccatgatactataattgtgagagcatatccagatgctgtgttctctatgtaaaacagtattgtccattcagaaatgtgtgacccttcatttatggatattgactatatgtaatgcagtgctatcccaatattttcaataaaggactttatgcattcaaaaacacacacaaaaaactacacagaaagaaaaaaaaaagaaacagggggggcgccgacataaaacataatcactccaagagaagcacagaaatatatgtacaacacacggttgttgcgaaacatagtggcctccaagaagaggaggcattaaaaagaaagacgagagccgaacgcagcagtataaacacacaagcgcaggagcggagaaaaacagctccacacgggagaccacatctggggaaagaagaccacccacacctctgcggggggggcgacacacaatgggagggaacacacacacacgaagagatataacaccgcaggaggaaaaaaacaacacagggtgttacttggtggtgacacaacccaaatgagtcgcgcaggagaaaagtgcccacaggaaatgagttgcgaaaat

SEQ ID NO: 427139 - DNA, 2294 bp, Homo sapiens
aggagcctgttctgtcttcgatgttccccgatcaacctcaccacctcttgctcagcctatataccgccatcttcagcaaaccctgatgaaggctacaaagtaagcgcaagtacccacgtaaagacgttagttctacctggccgaacaactcactacacgttaggtctacctggccaggtagacctaactactcccacttcctccaaatccatacagtgaggaatcagagtgtttatagatatatgagttgaatgcaatttttatttttggtaactgtgaaaaataagatactgtggatatatacatgccttgtgtatttatcagcataattttcattaccaaaatgtacagctattatttgccatggaaaaggttagtctcatttagaaaaatcgaaagtgcacagcacttaaagggaatatatgaggttttttttttaaaaaaaaaacttttatttattatttgtagtatattgtctgaaatgtgtcggcagttttttttcttttaatgtgtcaaatcttgaaatattaaatgtatacattttgtgctatgttttgggaacaaatctgtttgatttatatagttttatattgaattttttttgccctgattgtttagggtgataggtcttaagcagcatatatctatatatctgtatgtgggtatatagagatatatgtgtgtgtgtatgtatatgtacatatacatatatatgagtgtataattctaaatttctaaaaactcattatgaatgttcatcaatttgactattataggccagctttccatttagtcaataaaagcgtacatttttagttacttaccttgaacatattcgtgtgaaaaagaatacatcatttctcacagtcttaagttgatatttatagaaatgaatacctttgtgaacctagacttagaacaaatcctgcttttgaaaaaaaatgttttgcttcttacaaaatcatttgtgttaataacaaaaactttattttcggagtgttctttgtataacttttccaagcttttacattaacgagcaggcctctgtcttaaaagggactcagtatattaatttctgcattttttaaatcaaatgaaaaacgtcaaattggaccaattgtcttggtttcttgattcatttatttgagaaaaaaacaatacaaagaaatgcattcatatcaaaattggaatagaaaggaaaacctatttttaagatatcaacctattttcacatcataaaacatctattacataaaataaaggtccaggcatagtggctcttgcctgtaatcccagcactttgggaggccgaggcaggtggatcactcaaggtcacaagtttgagaccagtctggccaacatggtgaaaccccatctctactaaaagtacaaatattagccgactatgtggcgggcacctgtaatcccacctactcgggaggctgaggcaggagaattgcttgaatccgggaagcagaggttgtagtgagccaagatcgtgccactgcactctatcctgggtaacagcgagactctgtcttaaaaataataacaataataataataataaagacttacttaaccaatattattgattaccagacttttatgaaagccaaagactgcttgctagtaggaaaaaatttcaaataataaccaaagctgaaaaatggtctgtcataaattatttccccggtaatttttgaaaggaaaaatgtataacaagtactatttacatatctgcatttaaaaaagcaattcttagaatacttcctttacattattctcctattttagacattttgtgaaagagaacaaattgtccagtggcctcctgtcagatcaacaattattatactccttaattccatgcaaatttaaatgaatgctataaaattttaaatctgtagcctgggtgtacgtttcactcaagttctcctactgaggactcttgactaacagcatactggcagtttcaccttaacctgctcgttaaataatgtgttggtgtgagatatcaggaatgtctcatgatatcacgtttaccatttacaccatctgcaaccatatgctattaataaaatggaaaaaaacaaaatggtcattttgcatatacttcactctgacctagtttagtccatgatactataattgtgagagcatatccagatgctgtgttctctatgtaaaacagtattgtccattcagaaatgtgtgacccttcatttatggatattgactatatgtaatgcagtgctatcccaatattttcaataaaggactttatgcattca

SEQ ID NO: 427140 - DNA, 1983 bp, Homo sapiens
  misc_feature (1953)..(1953): n is a, c, g, or t
  misc_feature (1980)..(1980): n is a, c, g, or t
cgatccggacgcggggccccgcgggcgcgcgcctcggagctcccgcctcctcctcttgctcctcctcggcgtacggtcctcccctgacccctccttccacccgccgagaggatgcgctccccggcgcccagcagcagaggccaccgctcccagaaatgcatgcgaccgatccccttctcccggaccccaggagccggcgcccccgccctgtagggttacgactcactgattaaaaagagggactttttcaaatactttgcacttttgattgtgtattatggataccaaggaagagaagaaggaacggaaacaaagttattttgctcgactgaaaaagaaaaaacaagccaaacaaaatgcagagacagcctcagctgtagctacaaggactcatactgggaaggaagataataatacagtagttttagagccagacaagtgcaacattgctgtggaagaggaatatatgactgatgagaaaaaaaagagaaaaagtaatcagttaaaggagatcaggcgtacagaactaaagagatattatagtattgatgacaatcaaaacaaaacacatgataaaaaagagaagaagatggtggttcagaagccccatgggactatggaatacactgctggaaaccaggacaccctaaactccatagcactgaaatttaacatcactcccaataaattggtggaactgaataaacttttcacacatactattgttccaggccaggtcctttttgtgccagatgccaactctccttccagtaccttaaggctatcatcatccagtcctggtgctactgtctctccttcatcatcagatgcagaatatgataaattgcctgatgctgacttagcacgaaaggccttgaaacccattgaaagagtcttatcgtctacttctgaagaagatgagccaggtgtggtgaaatttttaaaaatgaattgtcgatacttcaccgatggaaagggtgtggttggcggtgttatgatagtgactcctaacaacatcatgtttgaccctcataaatctgatcctctggttattgaaaatgggtgtgaggagtatggtctcatctgccccatggaagaggttgtttccattgcgctctacaatgacatttctcacatgaagatcaaagatgccttgccatcgcctggagaatgggaagacctggcttcagaaaaggatatcaacccattcagtaagttcaaatctatcaacaaggaaaaacgacagcagaatggagagaaaattatgacttcggattccagaccaatagtacctttggagaagtccacaggacatacacctacaaagccctcaggcagctctgtgtcagagaaattaaagaaactggactcctctagggagacatcccatggttctcccacagtgactaagctcagcaaggaaccttccgacacttcttctgcatttgaatctacagccaaagaaaactttctaggggaagatgatgattttgttgacttggaagaactttcttctcaaactggtggtggaatgcacaaaaaagacaccttgaaggagtgcctttctcttgacccagaggaacgaaagaaagctgagtcacaaataaacaattctgccgtggaaatgcaggtgcagtcagccctagcctttttgggaacagagaatgatgttgaactgaagggggcgctagatttagaaacctgtgagaagcaagatataatgccagaagtggacaagcagtctggttcgccagaaagccgagtagaaaacacactgaacatacatgaagatttagataaagttaaactcattgaatattacctgactaagaacaaagaagggccacaggtatctgaaaatttgcagaaaacagaattaagtgatggaaaaagtattgaaccaggggaggatccagaattctcgagtagtagtagtaggcggcccgcttctanaggatccaagctttaccgtacgccgtncat

SEQ ID NO: 427141 - DNA, 501 bp, Homo sapiens
ggtgaggtggttcccttttacatatagatactatttcatatttcctcattgctaattctccagattaaaatgtctgttttcttttttgtgtttcttccccaaggtctttaagtggagtggagaaaattcatactttatcaatggagacataagttctttagaacttggtggtggagggtaaggttttttttgtttttgttttcttattgttattttaccacctgacctgagtgggtctgttttgacctacgtagttaaaacttcggtgtcaggttattttagctagtccatgtgcttagatgaattaggacagaggctaacacagaatggcctaactaagaatcaaagatagaatatttatgtgtctaatgagagactgttaccacttgtcttttaggaagactggtcatttaaatgaaataaaggaaatgtatcctggttttataagcagtttagaattttgcctgtcagtagtataaaggaaagaagatgggggcaaga

SEQ ID NO: 427142 - DNA, 1021 bp, Homo sapiens
gtgcgcgtgcagggatcagaagccggttggggtgtgagaggttttctcgctctaggaatagcgggttttgcagcaattgttgcatatggattatataaactgaagagcaggggaaatactaaaatgtccattcatctgatccacatgcgtgtggcagcccaaggctttgttgtaggagcaatgactgttggtatgggctattccatgtatcgggaattctgggcaaaacctaagccttagaagaagagatgctgtcttggtcttgttggaggagcttgctttagttagatgtcttattattaaagttacctattattgttggaaataaactaatttgtatgggtttagatggtaacatggcattttgaatattggcttcctttcttgcaggcttgatttgcttggtgaccgaattactagtgactagtttactaactaggtcattcaaggaagtcaagttaacttaaacatgtcacctaaatgcacttgatggtgttgaaatgtccaccttcttaaatttttaagatgaacttagttctaaagaagataacaggccaatcctgaaggtactccctgtttgctgcagaatgtcagatattttggatgttgcataagagtcctatttgccccagttaattcaacttttgtctgcctgttttgtggactggctggctctgttagaactctgtccaaaaagtgcatggaatataacttgtaaagcttcccacaattgacaatatatatgcatgtgtttaaaccaaatccagaaagcttaaacaatagagctgcataatagtatttattaaagaatcacaactgtaaacatgagaataacttaaggattctagtttagttttttgtaattgccaattatatttttgctgctgatatattagaataatttttaaatgtcatcttgaatcagaaatatgtattttaagcactcacgcaaaggtaaatgaacactttttaaatgtgtgtgttgcttattttttcaataagaattgtaaacattgaactg

SEQ ID NO: 427143 - DNA, 1163 bp, Homo sapiens
ctaccatgtcttcatagtctactcacctatgttgatctagacacagagtgctatgcacttgcattcactactgaggacagagcgctggattgtgatgcatactaacttctacaaatactccatgcgataacgcgtgacaatatcgagttgagtaacggttgtatgatatgagcttatgtacactggagctaagcacaggtaaagtagtagaatagtcagtgtcttctgatccgctatagcgaatcgtgatgcccaaggctgtggtgagaacgagcgaccgactagtgtggtaatttccaatatatctcattgtcgttgtccatagtctagtcatcacatcgtcaatgttctaaagaacatatcatactcgcagtgtcttgcccatagctgaggcgtgaactctgcaatacttaaattctctgcctatagtatactcttagctatctatgagttgttagatgacctctagatgttgtagtgattgtcaatgatggtaacatggcattttgaatattggcttcctttcttgcaggcttgatttgcttggtgaccgaattactagtgactagtttactaactaggtcattcaaggaagtcaagttaacttaaacatgtcacctaaatgcacttgatggtgttgaaatgtccaccttcttaaatttttaagatgaacttagttctaaagaagataacaggccaatcctgaaggtactccctgtttgctgcagaatgtcagatattttggatgttgcataagagtcctatttgccccagttaattcaacttttgtctgcctgttttgtggactggctggctctgttagaactctgtccaaaaagtgcatggaatataacttgtaaagcttcccacaattgacaatatatatgcatgtgtttaaaccaaatccagaaagcttaaacaatagagctgcataatagtatttattaaagaatcacaactgtaaacatgagaataacttaaggattctagtttagttttttgtaattgccaattatatttttgctgctgatatattagaataatttttaaatgtcatcttgaatcagaaatatgtattttaagcactcacgcaaaggtaaatgaacactttttaaatgtgtgtgttgcttattttttcaataagaattgtaaacattgaactg

SEQ ID NO: 427144 - DNA, 967 bp, Homo sapiens
gtgcgcgtgcagggatcagaagccggttggggtgtgagaggttttctcgctctaggaatagcgggttttgcagcaattgttgcatatggattatataaactgaagagcaggggaaatactaaaatgtccattcatctgatccacatgcgtgtggcagcccaaggctttgttgtaggagcaatgactgttggtatgggctattccatgtatcgggaattctgggcaaaacctaagccttagaagaagagatgctgtcttggtcttgttggaggagcttgctttagttagatgtcttattattaaagttacctattattgttggaaataaactaatttgtatgggtttagatggtaacatggcattttgaatattggcttcctttcttgcaggcttgatttgcttggtgaccgaattactagtgactagtttactaactaggtcattcaaggaagtcaagttaacttaaacatgtcacctaaatgcacttgatggtgttgaaatgtccaccttcttaaatttttaagatgaacttagttctaaagaagataacaggccaatcctgaaggtactccctgtttgctgcagaatgtcagatattttggatgttgcataagagtcctatttgccccagttaattcaacttttgtctgcctgttttgtggactggctggctctgttagaactctgtccaatgtgtttaaaccaaatccagaaagcttaaacaatagagctgcataatagtatttattaaagaatcacaactgtaaacatgagaataacttaaggattctagtttagttttttgtaattgccaattatatttttgctgctgatatattagaataatttttaaatgtcatcttgaatcagaaatatgtattttaagcactcacgcaaaggtaaatgaacactttttaaatgtgtgtgttgcttattttttcaataagaattgtaaacattgaactg

SEQ ID NO: 427145 - DNA, 687 bp, Homo sapiens
gactctagacgatcccctatttacgcaggccactttacgcaggcactttaacgcaggcttgatttgcttggtgaccgaattactagtgactagtttactaactaggtcattcaaggaagtcaagttaacttaaacatgtcacctaaatgcacttgatggtgttgaaatgtccaccttcttaaatttttaagatgaacttagttctaaagaagataacaggccaatcctgaaggtactccctgtttgctgcagaatgtcagatattttggatgttgcataagagtcctatttgccccagttaattcaacttttgtctgcctgttttgtggactggctggctctgttagaactctgtccaaaaagtgcatggaatataacttgtaaagcttcccacaattgacaatatatatgcatgtgtttaaaccaaatccagaaagcttaaacaatagagctgcataatagtatttattaaagaatcacaactgtaaacatgagaataacttaaggattctagtttagttttttgtaattgccaattatatttttgctgctgatatattagaataatttttaaatgtcatcttgaatcagaaatatgtattttaagcactcacgcaaaggtaaatgaacactttttaaatgtgtgtgttgcttattttttcaataagaattgtaaacattgaactg

SEQ ID NO: 427146 - DNA, 1123 bp, Homo sapiens
gtgcgcgtgcagggatcagaagccggttggggtgtgagaggttttctcgctctaggaatcttcaagcaatcactatgtcaacagacacaggtgtttcccttccttcacatgaggaagatcagggatccaaacttactcgaaaaactaaagaggcaccattcgtacctgttggagcagcgggttttgcagcaattgttgcatatggattatataaactgaagagcaggggaaatactaaaatgtccattcatctgatccacatgcgtgtggcagcccaaggctttgttgtaggagcaatgactgttggtatgggctattccatgtatcgggaattctgggcaaaacctaagccttagaagaagagatgctgtcttggtcttgttggaggagcttgctttagttagatgtcttattattaaagttacctattattgttggaaataaactaatttgtatgggtttagatggtaacatggcattttgaatattggcttcctttcttgcaggcttgatttgcttggtgaccgaatttactaactaggtcattcaaggaagtcaagttaacttaaacatgtcacctaaatgcacttgatggtgttgaaatgtccaccttcttaaatttttaagatgaacttagttctaaagaagataacaggccaatcctgaaggtactccctgtttgctgcagaatgtcagatattttggatgttgcataagagtcctatttgccccagttaattcaacttttgtctgcctgttttgtggactggctggctctgttagaactctgtccaaaaagtgcatggaatataacttgtaaagcttcccacaattgacaatatatatgcatgtgtttaaaccaaatccagaaagcttaaacaatagagctgcataatagtatttattaaagaatcacaactgtaaacatgagaataacttaaggattctagtttagttttttgtaattgccaattatatttttgctgctgatatattagaataatttttaaatgtcatcttgaatcagaaatatgtattttaagcactcacgcaaaggtaaatgaacactttttaaatgtgtgtgttgcttattttttcaataagaattgtaaacattgaactg

SEQ ID NO: 427147 - DNA, 1083 bp, Homo sapiens
gtgcgcgtgcagggatcagaagccggttggggtgtgagaggttttctcgctctaggaatcttcaagcaatcactatgtcaacagacacaggtgtttcccttccttcacatgaggaagatcagggatccaaacttactcgaaaaactaaagaggcaccattcgtacctgttggagcagcgggttttgcagcaattgttgcatatggattatataaactgaagagcaggggaaatactaaaatgtccattcatctgatccacatgcgtgtggcagcccaaggctttgttgtaggagcaatgactgttggtatgggctattccatgtatcgggaattctgggcaaaacctaagccttagaagaagagatgctgtcttggtcttgttggaggagcttgctttagttagatgtcttattattaaagttacctattattgttggaaataaactaatttgtatgggtttagatggtaacatggcattttgaatattggcttcctttcttgcaggcttgatttgcttggtgaccgaattactagtgactagtttactaactaggtcattcaaggaagtcaagttaacttaaacatgtcacctaaatgcacttgatgataacaggccaatcctgaaggtactccctgtttgctgcagaatgtcagatattttggatgttgcataagagtcctatttgccccagttaattcaacttttgtctgcctgttttgtggactggctggctctgttagaactctgtccaaaaagtgcatggaatataacttgtaaagcttcccacaattgacaatatatatgcatgtgtttaaaccaaatccagaaagcttaaacaatagagctgcataatagtatttattaaagaatcacaactgtaaacatgagaataacttaaggattctagtttagttttttgtaattgccaattatatttttgctgctgatatattagaataatttttaaatgtcatcttgaatcagaaatatgtattttaagcactcacgcaaaggtaaatgaacactttttaaatgtgtgtgttgcttattttttcaataagaattgtaaacattgaactg

SEQ ID NO: 427148 - DNA, 517 bp, Homo sapiens
tactgacgcaggctagaaaggatgaaacttgagaacaatattctaagaagcagatagaaaataccacactttgttattccatatagaggaagtgcccagaacaagtacatcaatatatagagaaggtagattagtggttgtcagagagcgcaagaaggggggaattggagagtgtctgcccacaggtacaggcatgctttttggcattatgaaaatattctggaattaggtagtggcgatggttgcgaaagttttggaatatggtaaaagacactgaaatgtatgcttaaaaatggtgaattttgtgatgtataaattctactgtagaaataataataacaacaaaagtaataaagcaaggtgtctttccacatctccatgtccagtattttcatttaaaaaaaaagaaagaaagtaaaagcatttcagggccaggttcagtggctaacttctgtaatcccagcacttttggaggcctaggtgggaggatcgcttgaggccagaagttcaaaaccag

SEQ ID NO: 427149 - DNA, 910 bp, Homo sapiens
ggagaaggagttaaaattctgattaaaaacaaactttaataaagaagcagtgtgccaaggtagaaacagtaaaagatttgtagtaagaaaatatgaatttaaatcagctctacctctgaatagctgtaattttagatgagttcatttttagatacaggtttttttttcatatcatttctgttattctcagataatgttatctgttctaatcaccttttatagtggttgtcggtaatagatgtgaaaatatttgttgtacagtaaaatatggcataaactttagtcattattggtgaatcagtgtaccttagtggagtgagtatgctttccgagttggaaacacctgcgtctgaatcaacttactagctgtcacctcggcaagtcacttcaactctgagatgtggttttctcatctttaaaatggaaatagtactccttacctcatgacgatgttgtgaggataaaatagttactcttcatttgtgagggcccactagcagccaagcagggtgagccatgagctgtaaagctggtatacactgggccttcgatcattggtgacttcatcaaggttagcatttgccttaggattctctgagtgtagcacatatgcaaataacgtgacagataatgtgacaaatccctatttcagatcccatgttagatctggatattcaagaattagccagtcttaccactggaggaggagatgtggagaattttgaaagactcttttcaaagttaaaggaaatgaaaggtaatcagatccattgtgtctaatatgttcccatgttgatgcttgtctgttttacgtagtagcattttattttgttaactgctggattggattccttgttctggtctcagctgtcttgagaaacttagctactcctgggacttggtaaaaaaa

SEQ ID NO: 427150 - DNA, 2165 bp, Homo sapiens
aaattatgctaggtacgaggccggcggtgttaaatcggccgaggcggaaccggctcgcgagcgcagctatggctgctggcgtaccctgtgcgttagtcaccagctgctcctccgtcttctcaggagaccagctggtccaacatatccttggaacagaagatcttattgtggaagtgacttccaatgatgctgtgagattttatccctggaccattgataataaatactattcagcagacatcaatctatgtgtggtgccaaacaaatttcttgttactgcagagattgcagaatctgtccaagcatttgtggtttactttgacagcacacaaaaatcgggccttgatagtgtctcctcatggcttccactggcaaaagcatggttacctgaggtgatgatcttggtctgcgatagagtgtctgaagatggtataaaccgacaaaaagctcaagaatggtgcatcaaacatggctttgaattggtagaacttagtccagaggagttgcctgaggaggatgatgacttcccagaatctacaggagtaaagcgaattgtccaagccctgaatgccaatgtgtggtccaatgtagtgatgaagaatgataggaaccaaggctttagccttctcaactcattgactggaacaaaccatagcattgggtcagcagatccctgtcacccagagcaaccccatttgccagcagcagatagtactgaatccctctctgatcatcggggtggtgcatctaacacaacagatgcccaggttgatagcattgtggatcccatgttagatctggatattcaagaattagccagtcttaccactggaggaggagatgtggagaattttgaaagactcttttcaaagttaaaggaaatgaaagacaaggctgcgacgcttcctcatgagcaaagaaaagtgcatgcagaaaaggtggccaaagcattctggatggcaatcgggggagacagagatgaaattgaaggcctttcatctgatgaagagcactgaattattcatactagggtttgaccaacaaagatgctagctgtctctgagatacctctctactcagcccagtcatattttgccaaaattgcccttatcatgttggctgcctgacttgtttatagggtccccttaattttagtttttagtaggaggttaaggagaaatcttttttttcctcagtatattgtaagagagtgaggaatacagtgatagtaatgagtgaggatttcttaaatatactttttttttgttctaggaatgagggtaggataaatctcagaggtctgtgtgatttactcaagttgaagacaacctccaggccattcctggtcaaccttttaagtagcatttccagcattcacacttgatactgcacatcaggagttgtgtcacctttcctgggtgatttgggttttctccattcaaggagcttgtagctctgagctatgatgcttttattgggaggaaaggaggcagctgcagaattgatgtgagctatgtggggccgaagtctcagcccgcagctaagtctctacctaagaaaatgcctctgggcattcttttgaagtatagtgtctgagctcatgctagaaagaatcaaaaagccagtgtggatttttagactgtaataaatgaggcaaaggatttctattccagtgggaaggaaacctctctactgagttgtgggggatatgttgtatgttagagagaaccttaaggagtccttgtatgggccatggagacagtatgtgataacataccgtgattttcatgaagaaattcttctgtcttagagttctcccctgctgcttgagatgccagagctgtgttgttgcacacctgcaaaacaaggcacatttccccctttctctttaaagccaaagagagatcactgccaaagtgggagcactaaggggtgggtggggaagtgaaatgttaggcgatgaattcctgagcaccttgtttttcttccaaggttcgtagctcctctctgcccttccaagcctgtaacctcggaggactatcttttgttctttatcctttgtcttgtttgagtgggtcagccccagaggaactgataagcaaatggcaagtttttaaaggaagagtggaaagtactgcaaataaaaatccttatttgtttttgta

SEQ ID NO: 427151 - DNA, 2806 bp, Homo sapiens
aaattatgctaggtacgaggccggcggtgttaaatcggccgaggcggaaccggctcgcgagcgcagctatggctgctggcgtaccctgtgcgttagtcaccagctgctcctccgtcttctcaggagaccagctggtccaacatatccttggaacagaagatcttattgtggaagtgacttccaatgatgctgtgagattttatccctggaccattgataataaatactattcagcagacatcaatctatgtgtggtgccaaacaaatttcttgttactgcagagattgcagaatctgtccaagcatttgtggtttactttgacagcacacaaaaatcgggccttgatagtgtctcctcatggcttccactggcaaaagcatggttacctgaggtgatgatcttggtctgcgatagagtgtctgaagatggtataaaccgacaaaaagctcaagaatggtgcatcaaacatggctttgaattggtagaacttagtccagaggagttgcctgaggaggatgatgacttcccagaatctacaggagtaaagcgaattgtccaagccctgaatgccaatgtgtggtccaatgtagtgatgaagaatgataggaaccaaggctttagccttctcaactcattgactggaacaaaccatagcattgggtcagcagatccctgtcacccagagcaaccccatttgccagcagcagatagtactgaatccctctctgatcatcggggtggtgcatctaacacaacagatgcccaggttgatagcattgtggatcccatgttagatctggatattcaagaattagccagtcttaccactggaggaggagatgtggagaattttgaaagactcttttcaaagttaaaggaaatgaaagacaaggctgcgacgcttcctcatgagcaaagaaaagtgcatgcagaaaaggtggccaaagcattctggatggcaatcgggggagacagagatgaaattgaaggcctttcatctgatgaagagcactgaattattcatactagggtttgaccaacaaagatgctagctgtctctgagatacctctctactcagcccagtcatattttgccaaaattgcccttatcatgttggctgcctgacttgtttatagggtccccttaattttagtttttagtaggaggttaaggagaaatcttttttttcctcagtatattgtaagagagtgaggaatacagtgatagtaatgagtgaggatttcttaaatatactttttttttgttctaggaatgagggtaggataaatctcagaggtctgtgtgatttactcaagttgaagacaacctccaggccattcctggtcaaccttttaagtagcatttccagcattcacacttgatactgcacatcaggagttgtgtcacctttcctgggtgatttgggttttctccattcaaggagcttgtagctctgagctatgatgcttttattgggaggaaaggaggcagctgcagaattgatgtgagctatgtggggccgaagtctcagcccgcagctaagtctctacctaagaaaatgcctctgggcattcttttgaagtatagtgtctgagctcatgctagaaagaatcaaaaagccagtgtggatttttagactgtaataaatgaggcaaaggatttctattccagtgggaaggaaacctctctactgagttgtgggggatatgttgtatgttagagagaaccttaaggagtccttgtatgggccatggagacagtatgtgataacataccgtgattttcatgaagaaattcttctgtcttagagttctcccctgctgcttgagatgccagagctgtgttgttgcacacctgcaaaacaaggcacatttccccctttctctttaaagccaaagagagatcactgccaaagtgggagcactaaggggtgggtggggaagtgaaatgttaggcgatgaattcctgagcaccttgtttttcttccaaggttcgtagctcctctctgcccttccaagcctgtaacctcggaggactatcttttgttctttatcctttgtcttgtttgagtgggtcagccccagaggaactgataagcaaatggcaagtttttaaaggaagagtggaaagtactgcaaataaaaatccttatttgtttttgtagactttgtaatgcatatcattagccctcactgtgatcattactgctgtggctctgaactggcacatagtacagtggatggaaggtgcccgcacaccagctgagaactggttctggcctaggtgggctctagaaccatttacacagcatgaaagaaacaggttgggttaggagcagaaagaaataaggctcacacccctccagacactaccttataagcactgcagaacctgaaacagatggcagaaggaatggaatgctacaggggccagcaggagtgaccacagggaggggacagctcagtgactggagcattcaggaagaggctttccagggaacactggacattgcttagtgaccttttgttcctttttttttttttttcttttactgttctgaaagactttgagtctgtggttcaccaccagcccatcagtgtttctttgaggtgattgcattagggaagttggctctgggattgcaaaaaaaaaaaaaaggtggaacatgttttccttaaaagatggaaggttttagaaaatatactaggccatctggttagaaaaaacagaccagactagaaaaagctgtgaatttgattttgtagattaaacaaagccagatgattaaaatgtgatttatttat

SEQ ID NO: 427152 - DNA, 2925 bp, Homo sapiens
aaattatgctaggtacgaggccggcggtgttaaatcggccgaggcggaaccggctcgcgagcgcagctatggctgctggcgtaccctgtgcgttagtcaccagctgctcctccgtcttctcaggagaccagctggtccaacatatccttggaacagaagatcttattgtggaagtgacttccaatgatgctgtgagattttatccctggaccattgataataaatactattcagcagacatcaatctatgtgtggtgccaaacaaatttcttgttactgcagagattgcagaatctgtccaagcatttgtggtttactttgacagcacacaaaaatcgggccttgatagtgtctcctcatggcttccactggcaaaagcatggttacctgaggtgatgatcttggtctgcgatagagtgtctgaagatggtataaaccgacaaaaagctcaagaatggtgcatcaaacatggctttgaattggtagaacttagtccagaggagttgcctgaggaggatgatgacttcccagaatctacaggagtaaagcgaattgtccaagccctgaatgccaatgtgtggtccaatgtagtgatgaagaatgataggaaccaaggctttagccttctcaactcattgactggaacaaaccatagcattgggtcagcagatccctgtcacccagagcaaccccatttgccagcagcagatagtactgaatccctctctgatcatcggggtggtgcatctaacacaacagatgcccaggttgatagcattgtggatcccatgttagatctggatattcaagaattagccagtcttaccactggaggaggagatgtggagaattttgaaagactcttttcaaagttaaaggaaatgaaagacaaggctgcgacgcttcctcatgagcaaagaaaagtgcatgcagaaaaggtggccaaagcattctggatggcaatcgggggagacagagatgaaattgaaggcctttcatctgatgaagagcactgaattattcatactagggtttgaccaacaaagatgctagctgtctctgagatacctctctactcagcccagtcatattttgccaaaattgcccttatcatgttggctgcctgacttgtttatagggtccccttaattttagtttttagtaggaggttaaggagaaatcttttttttcctcagtatattgtaagagagtgaggaatacagtgatagtaatgagtgaggatttcttaaatatactttttttttgttctaggaatgagggtaggataaatctcagaggtctgtgtgatttactcaagttgaagacaacctccaggccattcctggtcaaccttttaagtagcatttccagcattcacacttgatactgcacatcaggagttgtgtcacctttcctgggtgatttgggttttctccattcaaggagcttgtagctctgagctatgatgcttttattgggaggaaaggaggcagctgcagaattgatgtgagctatgtggggccgaagtctcagcccgcagctaagtctctacctaagaaaatgcctctgggcattcttttgaagtatagtgtctgagctcatgctagaaagaatcaaaaagccagtgtggatttttagactgtaataaatgaggcaaaggatttctattccagtgggaaggaaacctctctactgagttgtgggggatatgttgtatgttagagagaaccttaaggagtccttgtatgggccatggagacagtatgtgataacataccgtgattttcatgaagaaattcttctgtcttagagttctcccctgctgcttgagatgccagagctgtgttgttgcacacctgcaaaacaaggcacatttccccctttctctttaaagccaaagagagatcactgccaaagtgggagcactaaggggtgggtggggaagtgaaatgttaggcgatgaattcctgagcaccttgtttttcttccaaggttcgtagctcctctctgcccttccaagcctgtaacctcggaggactatcttttgttctttatcctttgtcttgtttgagtgggtcagccccagaggaactgataagcaaatggcaagtttttaaaggaagagtggaaagtactgcaaataaaaatccttatttgtttttgtagactttgtaatgcatatcattagccctcactgtgatcattactgctgtggctctgaactggcacatagtacagtggatggaaggtgcccgcacaccagctgagaactggttctggcctaggtgggctctagaaccatttacacagcatgaaagaaacaggttgggttaggagcagaaagaaataaggctcacacccctccagacactaccttataagcactgcagaacctgaaacagatggcagaaggaatggaatgctacaggggccagcaggagtgaccacagggaggggacagctcagtgactggagcattcaggaagaggctttccagggaacactggacattgcttagtgaccttttgttcctttttttttttttttcttttactgttctgaaagactttgagtctgtggttcaccaccagcccatcagtgtttctttgaggtgattgcattagggaagttggctctgggattgcaaaaaaaaaaaaaaggtggaacatgttttccttaaaagatggaaggttttagaaaatatactaggccatctggttagaaaaaacagaccagactagaaaaagctgtgaatttgattttgtagattaaacaaagccagatgattaaaatgtgatttatttataaactgtgctaatgtctattattatgattttgtggttttttattagggggtatgagtgagggaagccctatatccttcattggattagacatatatagtgaatagtggaagagtctgtc

SEQ ID NO: 427153 - DNA, 2310 bp, Homo sapiens
aaattatgctaggtacgaggccggcggtgttaaatcggccgaggcggaaccggctcgcgagcgcagctatggctgctggcgtaccctgtgcgttagtcaccagctgctcctccgtcttctcaggagaccagctggtccaacgtgagtagataggcgcctgggccgacctccaaggcccctgagcctcagcgggcgacggacccagcaccacggcctctctgggccttgtccccgcagcgggccctgcgttcttcctccagtcagtggaggcgcccagtctccccagatatccttggaacagaagatcttattgtggaagtgacttccaatgatgctgtgagattttatccctggaccattgataataaatactattcagcagacatcaatctatgtgtggtgccaaacaaatttcttgttactgcagagattgcagaatctgtccaagcatttgtggtttactttgacagcacacaaaaatcgggccttgatagtgtctcctcatggcttccactggcaaaagcatggttacctgaggtgatgatcttggtctgcgatagagtgtctgaagatggtataaaccgacaaaaagctcaagaatggtgcatcaaacatggctttgaattggtagaacttagtccagaggagttgcctgaggaggatgatgacttcccagaatctacaggagtaaagcgaattgtccaagccctgaatgccaatgtgtggtccaatgtagtgatgaagaatgataggaaccaaggctttagccttctcaactcattgactggaacaaaccatagcattgggtcagcagatccctgtcacccagagcaaccccatttgccagcagcagatagtactgaatccctctctgatcatcggggtggtgcatctaacacaacagatgcccaggttgatagcattgtggatcccatgttagatctggatattcaagaattagccagtcttaccactggaggaggagatgtggagaattttgaaagactcttttcaaagttaaaggaaatgaaagacaaggctgcgacgcttcctcatgagcaaagaaaagtgcatgcagaaaaggtggccaaagcattctggatggcaatcgggggagacagagatgaaattgaaggcctttcatctgatgaagagcactgaattattcatactagggtttgaccaacaaagatgctagctgtctctgagatacctctctactcagcccagtcatattttgccaaaattgcccttatcatgttggctgcctgacttgtttatagggtccccttaattttagtttttagtaggaggttaaggagaaatcttttttttcctcagtatattgtaagagagtgaggaatacagtgatagtaatgagtgaggatttcttaaatatactttttttttgttctaggaatgagggtaggataaatctcagaggtctgtgtgatttactcaagttgaagacaacctccaggccattcctggtcaaccttttaagtagcatttccagcattcacacttgatactgcacatcaggagttgtgtcacctttcctgggtgatttgggttttctccattcaaggagcttgtagctctgagctatgatgcttttattgggaggaaaggaggcagctgcagaattgatgtgagctatgtggggccgaagtctcagcccgcagctaagtctctacctaagaaaatgcctctgggcattcttttgaagtatagtgtctgagctcatgctagaaagaatcaaaaagccagtgtggatttttagactgtaataaatgaggcaaaggatttctattccagtgggaaggaaacctctctactgagttgtgggggatatgttgtatgttagagagaaccttaaggagtccttgtatgggccatggagacagtatgtgataacataccgtgattttcatgaagaaattcttctgtcttagagttctcccctgctgcttgagatgccagagctgtgttgttgcacacctgcaaaacaaggcacatttccccctttctctttaaagccaaagagagatcactgccaaagtgggagcactaaggggtgggtggggaagtgaaatgttaggcgatgaattcctgagcaccttgtttttcttccaaggttcgtagctcctctctgcccttccaagcctgtaacctcggaggactatcttttgttctttatcctttgtcttgtttgagtgggtcagccccagaggaactgataagcaaatggcaagtttttaaaggaagagtggaaagtactgcaaataaaaatccttatttgtttttgta

SEQ ID NO: 427154 - DNA, 1206 bp, Homo sapiens
  misc_feature (1166)..(1166): n is a, c, g, or t
  misc_feature (1172)..(1172): n is a, c, g, or t
  misc_feature (1180)..(1180): n is a, c, g, or t
  misc_feature (1195)..(1195): n is a, c, g, or t
aaattatgctaggtacgaggccggcggtgttaaatcggccgaggcggaaccggctcgcgagcgcagctatggctgctggcgtaccctgtgcgttagtcaccagctgctcctccgtcttctcaggagaccagctggtccaacatatccttggaacagaagatcttattgtggaagtgacttccaatgatgctgtgagattttatccctggaccattgataataaatactattcagcagacatcaatctatgtgtggtgccaaacaaatttcttgttactgcagagattgcagaatctgtccaagcatttgtggtttactttgacagcacacaaaaatcgggccttgatagtgtctcctcatggcttccactggcaaaagcatggttacctgaggtgatgatcttggtctgcgatagagtgtctgaagatggtataaaccgacaaaaagctcaagaatggtgcatcaaacatggctttgaattggtagaacttagtccagaggagttgcctgaggaggatgatgacttcccagaatctacaggagtaaagcgaattgtccaagccctgaatgccaatgtgtggtccaatgtagtgatgaagaatgataggaaccaaggctttagccttctcaactcattgactggaacaaaccatagcattgggtcagcagatccctgtcacccagagcaaccccatttgccagcagcagatagtactgaatccctctctgatcatcggggtggtgcatctaacacaacagatgcccaggttgatagcattgtggatcccatgttagatctggatattcaagaattagccagtcttaccactggaggaggagatgtggagaattttgaaagactcttttcaaagttaaaggaaatgaaagacaaggctgcgacgcttcctcatgagcaaagaaaagtgcatgcagaaaaggtggccaaagcattctggatggcaatcgggggagacagagatgaaattgaaggcctttcatctgatgaagagcactgaattattcatactagggtttgaccaacaaagatgctagctgtctctgagatacctctctactcagcccagtcatattttgccaaaattgcccttatcatgttggctgcctgacttgtttatagggtccccttaattttagtttttagtaancgccanggttttcncatcgcgagcgacanggtaaacgcat

SEQ ID NO: 427155 - DNA, 2683 bp, Homo sapiens
ggagaaggagttaaaattctgattaaaaacaaactttaataaagaagcagtgtgccaaggtagaaacagtaaaagatttgtagtaagaaaatatgaatttaaatcagctctacctctgaatagctgtaattttagatgagttcatttttagatacaggtttttttttcatatcatttctgttattctcagataatgttatctgttctaatcaccttttatagtggttgtcggtaatagatgtgaaaatatttgttgtacagtaaaatatggcataaactttagtcattattggtgaatcagtgtaccttagtggagtgagtatgctttccgagttggaaacacctgcgtctgaatcaacttactagctgtcacctcggcaagtcacttcaactctgagatgtggttttctcatctttaaaatggaaatagtactccttacctcatgacgatgttgtgaggataaaatagttactcttcatttgtgagggcccactagcagccaagcagggtgagccatgagctgtaaagctggtatacactgggccttcgatcattggtgacttcatcaaggttagcatttgccttaggattctctgagtgtagcacatatgcaaataacgtgacagataatgtgacaaatccctatttcagatcccatgttagatctggatattcaagaattagccagtcttaccactggaggaggagatgtggagaattttgaaagactcttttcaaagttaaaggaaatgaaagacaaggctgcgacgcttcctcatgagcaaagaaaagtgcatgcagaaaaggtgagacaatcagccaggtatttattgaatacctataaaaggtccagtgctattattataattatatatcacacttgtgtatttctgaagggtcttagtgtgagcttttcattgaatattaacttctaactaattaaatatttatacagtaatagtatagttgctgcagtcaaaccaagatttttcacctggatggtgagtgatgtggaacctttattgagactcaggatgtttgcctttctaactattgggccagaaaactcttagttgttttgttttattattaccaacacaacacatgctattggcaggaaacttgtatggttgatggtgttccctgatatgtgtcataatttatcctgttcccttttggacatttaggtcatgtgcattttttgcttctataaataacaaagctgtgcatgtctttacacatcatctttgtatacaactctaaatatatccttggtataaatttctagatgtggcgatcatgggtcaaatggtattcaagggttctgatatgtgttgccagaggactggagggcaaagtgcagaattttaggtctcagtcagtttaaggtatgacatatgaaacaagctgaaatgtagctgttgcctaaaatttgttgcatgcttctctccacaggtggccaaagcattctggatggcaatcgggggagacagagatgaaattgaaggcctttcatctgatgaagagcactgaattattcatactagggtttgaccaacaaagatgctagctgtctctgagatacctctctactcagcccagtcatattttgccaaaattgcccttatcatgttggctgcctgacttgtttatagggtccccttaattttagtttttagtaggaggttaaggagaaatcttttttttcctcagtatattgtaagagagtgaggaatacagtgatagtaatgagtgaggatttcttaaatatactttttttttgttctaggaatgagggtaggataaatctcagaggtctgtgtgatttactcaagttgaagacaacctccaggccattcctggtcaaccttttaagtagcatttccagcattcacacttgatactgcacatcaggagttgtgtcacctttcctgggtgatttgggttttctccattcaaggagcttgtagctctgagctatgatgcttttattgggaggaaaggaggcagctgcagaattgatgtgagctatgtggggccgaagtctcagcccgcagctaagtctctacctaagaaaatgcctctgggcattcttttgaagtatagtgtctgagctcatgctagaaagaatcaaaaagccagtgtggatttttagactgtaataaatgaggcaaaggatttctattccagtgggaaggaaacctctctactgagttgtgggggatatgttgtatgttagagagaaccttaaggagtccttgtatgggccatggagacagtatgtgataacataccgtgattttcatgaagaaattcttctgtcttagagttctcccctgctgcttgagatgccagagctgtgttgttgcacacctgcaaaacaaggcacatttccccctttctctttaaagccaaagagagatcactgccaaagtgggagcactaaggggtgggtggggaagtgaaatgttaggcgatgaattcctgagcaccttgtttttcttccaaggttcgtagctcctctctgcccttccaagcctgtaacctcggaggactatcttttgttctttatcctttgtcttgtttgagtgggtcagccccagaggaactgataagcaaatggcaagtttttaaaggaagagtggaaagtactgcaaataaaaatccttatttgtttttgta

SEQ ID NO: 427156 - DNA, 856 bp, Homo sapiens
aaattatgctaggtacgaggccggcggtgttaaatcggccgaggcggaaccggctcgcgagcgcagctatggctgctggcgtaccctgtgcgttagtcaccagctgctcctccgtcttctcaggagaccagctggtccaacatatccttggaacagaagatcttattgtggaagtgacttccaatgatgctgtgagattttatccctggaccattgataataaatactattcagcagacatcaatctatgtgtggtgccaaacaaatttcttgttactgcagagattgcagaatctgtccaagcatttgtggtttactttgacagcacacaaaaatcgggccttgatagtgtctcctcatggcttccactggcaaaagcatggttacctgaggtgatgatcttggtctgcgatagagtgtctgaagatggtataaaccgacaaaaagctcaagaatggtgcatcaaacatggctttgaattggtagaacttagtccagaggagttgcctgaggaggatgatgacttcccagaatctacaggagtaaagcgaattgtccaagccctgaatgccaatgtgtggtccaatgtagtgatgaagaatgtttcttggacattgatattcaaaggtcaaatatttaatctgaaaatctaggtaattaaaaacgtaagagatgaattgcattccttcctgccctccacccagataaattggatgtgttatctatatgggaattcatgatttaatatgtgattattataagtctgaacaacttacttggttataggatatcttcataacttttttcctttagtgtcttcttaaaagttagtaatacacaagcaaccaaaggaaaa

SEQ ID NO: 427157 - DNA, 2814 bp, Homo sapiens
aaattatgctaggtacgaggccggcggtgttaaatcggccgaggcggaaccggctcgcgagcgcagctatggctgctggcgtaccctgtgcgttagtcaccagctgctcctccgtcttctcaggagaccagctggtccaacatatccttggaacagaagatcttattgtggaagtgacttccaatgatgctgtgagattttatccctggaccattgataataaatactattcagcagacatcaatctatgtgtggtgccaaacaaatttcttgttactgcagagattgcagaatctgtccaagcatttgtggtttactttgacagcacacaaaaatcgggccttgatagtgtctcctcatggcttccactggcaaaagcatggttacctgaggtgatgatcttggtctgcgatagagtgtctgaagatggtataaaccgacaaaaagctcaagaatggtgcatcaaacatggctttgaattggtagaacttagtccagaggagttgcctgaggaggatgatgacttcccagaatctacaggagtaaagcgaattgtccaagccctgaatgccaatgtgtggtccaatgtagtgatgaagaatgataggaaccaaggctttagccttctcaactcattgactggaacaaaccatagcattgggtcagcagatccctgtcacccagagcaaccccatttgccagcagcagatagtactgaatccctctctgatcatcggggtggtgcatctaacacaacagatgcccaggttgatagcattgtggatcccatgttagatctggatattcaagaattagccagtcttaccactggaggaggagatgtggagaattttgaaagactcttttcaaagttaaaggaaatgaaagacaaggctgcgacgcttcctcatgagcaaagaaaagtgcatgcagaaaaggtgagacaatcagccaggtatttattgaatacctataaaaggtccagtgctattattataattatatatcacacttgtgtatttctgaagggtcttagtgtgagcttttcattgaatattaacttctaactaattaaatatttatacagtaatagtatagttgctgcagtcaaaccaagatttttcacctggatggtgagtgatgtggaacctttattgagactcaggatgtttgcctttctaactattgggccagaaaactcttagttgttttgttttattattaccaacacaacacatgctattggcaggaaacttgtatggttgatggtgttccctgatatgtgtcataatttatcctgttcccttttggacatttaggtcatgtgcattttttgcttctataaataacaaagctgtgcatgtctttacacatcatctttgtatacaactctaaatatatccttggtataaatttctagatgtggcgatcatgggtcaaatggtattcaagggttctgatatgtgttgccagaggactggagggcaaagtgcagaattttaggtctcagtcagtttaaggtatgacatatgaaacaagctgaaatgtagctgttgcctaaaatttgttgcatgcttctctccacaggtggccaaagcattctggatggcaatcgggggagacagagatgaaattgaaggcctttcatctgatgaagagcactgaattattcatactagggtttgaccaacaaagatgctagctgtctctgagatacctctctactcagcccagtcatattttgccaaaattgcccttatcatgttggctgcctgacttgtttatagggtccccttaattttagtttttagtaggaggttaaggagaaatcttttttttcctcagtatattgtaagagagtgaggaatacagtgatagtaatgagtgaggatttcttaaatatactttttttttgttctaggaatgagggtaggataaatctcagaggtctgtgtgatttactcaagttgaagacaacctccaggccattcctggtcaaccttttaagtagcatttccagcattcacacttgatactgcacatcaggagttgtgtcacctttcctgggtgatttgggttttctccattcaaggagcttgtagctctgagctatgatgcttttattgggaggaaaggaggcagctgcagaattgatgtgagctatgtggggccgaagtctcagcccgcagctaagtctctacctaagaaaatgcctctgggcattcttttgaagtatagtgtctgagctcatgctagaaagaatcaaaaagccagtgtggatttttagactgtaataaatgaggcaaaggatttctattccagtgggaaggaaacctctctactgagttgtgggggatatgttgtatgttagagagaaccttaaggagtccttgtatgggccatggagacagtatgtgataacataccgtgattttcatgaagaaattcttctgtcttagagttctcccctgctgcttgagatgccagagctgtgttgttgcacacctgcaaaacaaggcacatttccccctttctctttaaagccaaagagagatcactgccaaagtgggagcactaaggggtgggtggggaagtgaaatgttaggcgatgaattcctgagcaccttgtttttcttccaaggttcgtagctcctctctgcccttccaagcctgtaacctcggaggactatcttttgttctttatcctttgtcttgtttgagtgggtcagccccagaggaactgataagcaaatggcaagtttttaaaggaagagtggaaagtactgcaaataaaaatccttatttgtttttgta

SEQ ID NO: 427158 - DNA, 2013 bp, Homo sapiens
aaattatgctaggtacgaggccggcggtgttaaatcggccgaggcggaaccggctcgcgagcgcagctatggctgctggcgtaccctgtgcgttagtcaccagctgctcctccgtcttctcaggagaccagctggtccaacatatccttggaacagaagatcttattgtggaagtgacttccaatgatgctgtgagattttatccctggaccattgataataaatactattcagcagacatcaatctatgtgtggtgccaaacaaatttcttgttactgcagagattgcagaatctgtccaagcatttgtggtttactttgacagcacacaaaaatcgggccttgatagtgtctcctcatggcttccactggcaaaagcatggttacctgaggtgatgatcttggtctgcgatagagtgtctgaagatggtataaaccgacaaaaagctcaagaatggtgcatcaaacatggctttgaattggtagaacttagtccagaggagttgcctgaggaggatgatgacttcccagaatctacaggagtaaagcgaattgtccaagccctgaatgccaatgtgtggtccaatgtagtgatgaagaatgataggaaccaaggctttagccttctcaactcattgactggaacaaaccatagcattgggtcagcagatccctgtcacccagagcaaccccatttgccagcagcagatagtactgaatccctctctgatcatcggggtggtgcatctaacacaacagatgcccaggttgatagcattgtggatcccatgttagatctggatattcaagaattagccagtcttaccactggaggaggagatgtggagaattttgaaagactcttttcaaagttaaaggaaatgaaagacaaagatgctagctgtctctgagatacctctctactcagcccagtcatattttgccaaaattgcccttatcatgttggctgcctgacttgtttatagggtccccttaattttagtttttagtaggaggttaaggagaaatcttttttttcctcagtatattgtaagagagtgaggaatacagtgatagtaatgagtgaggatttcttaaatatactttttttttgttctaggaatgagggtaggataaatctcagaggtctgtgtgatttactcaagttgaagacaacctccaggccattcctggtcaaccttttaagtagcatttccagcattcacacttgatactgcacatcaggagttgtgtcacctttcctgggtgatttgggttttctccattcaaggagcttgtagctctgagctatgatgcttttattgggaggaaaggaggcagctgcagaattgatgtgagctatgtggggccgaagtctcagcccgcagctaagtctctacctaagaaaatgcctctgggcattcttttgaagtatagtgtctgagctcatgctagaaagaatcaaaaagccagtgtggatttttagactgtaataaatgaggcaaaggatttctattccagtgggaaggaaacctctctactgagttgtgggggatatgttgtatgttagagagaaccttaaggagtccttgtatgggccatggagacagtatgtgataacataccgtgattttcatgaagaaattcttctgtcttagagttctcccctgctgcttgagatgccagagctgtgttgttgcacacctgcaaaacaaggcacatttccccctttctctttaaagccaaagagagatcactgccaaagtgggagcactaaggggtgggtggggaagtgaaatgttaggcgatgaattcctgagcaccttgtttttcttccaaggttcgtagctcctctctgcccttccaagcctgtaacctcggaggactatcttttgttctttatcctttgtcttgtttgagtgggtcagccccagaggaactgataagcaaatggcaagtttttaaaggaagagtggaaagtactgcaaataaaaatccttatttgtttttgta

SEQ ID NO: 427159 - DNA, 1954 bp, Homo sapiens
aaattatgctaggtacgaggccggcggtgttaaatcggccgaggcggaaccggctcgcgagcgcagctatggctgctggcgtaccctgtgcgttagtcaccagctgctcctccgtcttctcaggagaccagctggtccaacatatccttggaacagaagatcttattgtggaagtgacttccaatgatgctgtgagattttatccctggaccattgataataaatactattcagcagacatcaatctatgtgtggtgccaaacaaatttcttgttactgcagagattgcagaatctgtccaagcatttgtggtttactttgacagcacacaaaaatcgggccttgatagtgtctcctcatggcttccactggcaaaagcatggttacctgaggtgatgatcttggtctgcgatagagtgtctgaagatggtataaaccgacaaaaagctcaagaatggtgcatcaaacatggctttgaattggtagaacttagtccagaggagttgcctgaggaggatgatgacttcccagaatctacaggagtaaagcgaattgtccaagccctgaatgccaatgtgtggtccaatgtagtgatgaagaatgataggaaccaaggctttagccttctcaactcattgactggaacaaaccatagcattgggtcagcagatccctgtcacccagagcaaccccatttgccagcagcagatagtactgaatccctctctgatcatcggggtggtgcatctaacacaacagatgcccaggttgatagcattgtggatcccatgttagatctggatattcaagaattagccagtcttaccactggaggaggagatgtggagaattttgaaagactcttttcaaagttaaaggaaatgaaagacaaagatgctagctgtctctgagatacctctctactcagcccagtcatattttgccaaaattgcccttatcatgttggctgctgcttgagatgccagagctgtgttgttgcacacctgcaaaacaaggcacatttccccctttctctttaaagccaaagagagatcactgccaaagtgggagcactaaggggtgggtggggaagtgaaatgttaggcgatgaattcctgagcaccttgtttttcttccaaggttcgtagctcctctctgcccttccaagcctgtaacctcggaggactatcttttgttctttatcctttgtcttgtttgagtgggtcagccccagaggaactgataagcaaatggcaagtttttaaaggaagagtggaaagtactgcaaataaaaatccttatttgtttttgtagactttgtaatgcatatcattagccctcactgtgatcattactgctgtggctctgaactggcacatagtacagtggatggaaggtgcccgcacaccagctgagaactggttctggcctaggtgggctctagaaccatttacacagcatgaaagaaacaggttgggttaggagcagaaagaaataaggctcacacccctccagacactaccttataagcactgcagaacctgaaacagatggcagaaggaatggaatgctacaggggccagcaggagtgaccacagggaggggacagctcagtgactggagcattcaggaagaggctttccagggaacactggacattgcttagtgaccttttgttcctttttttttttttttcttttactgttctgaaagactttgagtctgtggttcaccaccagcccatcagtgtttctttgaggtgattgcattagggaagttggctctgggattgcaaaaaaaaaaaaaaggtggaacatgttttccttaaaagatggaaggttttagaaaatatactaggccatctggttagaaaaaacagaccagactagaaaaagctgtgaatttgattttgtagattaaacaaagccagatgattaaaatgtgatttatttat

SEQ ID NO: 427160 - DNA, 853 bp, Homo sapiens
cggcacgaggggtgttcagagtttcggttctcttttctgtgatcgtattacttatgcaaaacgagcccagtcacttgcgcggccagagaggggcaggtgctgggcggcggctgacgggcgcagcaccctaggcccagtgtctggctccagccccgcatccggcgccggccccgcatccagctctggccctgcgacaatagagtccggaagtgcaggcaaagcggctcccgggagcgccgcgcggtcctgcgcgggatcagcgagggccgcgccccggcgggcgggcggcatggctgcagtgctggctctcagggtggtcgcggggttggcggccgcagcgctggtggccatgctcttggagcactacggcctggcgggccagccctcgccgctgccgcgccccgcgccccccaggaggccgcaccctgcgccagggcccggagacagcaacatcttctggggcctgcagatatccgacattcacctgagcaggtttcgagatccaggcagagcggtagacttagagaaattctgttctgaaactattgacatcattcaaccagctctcgtcctagcaacaggagacctgacagatgccaaaacaaaggaacagttgggatccaggcagcatgaggtagaatggcaaacctaccagggtattctgaagaagacaagagtcatggaaaaaaccaagtggctggatatcaaaggaaatcatggtaagagccaagagccagattacaataaagacaagagtttttttcccccttcaggaacctagattttccaacttagattgtaaaattataaagtgggacatttacatatactaaaggtcacatctctgaaatac

SEQ ID NO: 427161 - DNA, 464 bp, Homo sapiens
caagacaaaatgacaataataataataataatacctagaaactcacacactgagaatggggcagtaaataataatagggaggatagaaaagtcagcatggcattccagatgagaaaactgaagcaagttaaactttctacatggtaaccgtgattatgtagttgatatacaaagtaatgactgtgggccttcaagaagaggttaaaatacattcattatattaacgagtgcatcttagaaagatttctttcaaaaagtagttgaagtttttttgctttaaggagtaaatctcaatcatctggaaatttaacttctgtggaatacctctttacatcttaaaggaaatgttaatgcattatattgaggttattattgcaatggaattttcaaaaatgtgagtgtgctttttttgtttctagaatctataagacacatatctgttctaggtatagtgtctactaaga

SEQ ID NO: 427162 - DNA, 2667 bp, Homo sapiens
cggcacgaggggtgttcagagtttcggttctcttttctgtgatcgtattacttatgcaaaacgagcccagtcacttgcgcggccagagaggggcaggtgctgggcggcggctgacgggcgcagcaccctaggcccagtgtctggctccagccccgcatccggcgccggccccgcatccagctctggccctgcgacaatagagtccggaagtgcaggcaaagcggctcccgggagcgccgcgcggtcctgcgcgggatcagcgagggccgcgccccggcgggcgggcggcatggctgcagtgctggctctcagggtggtcgcggggttggcggccgcagcgctggtggccatgctcttggagcactacggcctggcgggccagccctcgccgctgccgcgccccgcgccccccaggaggccgcaccctgcgccagggcccggagacagcaacatcttctggggcctgcaggagacctgacagatgccaaaacaaaggaacagttgggatccaggcagcatgaggtagaatggcaaacctaccagggtattctgaagaagacaagagtcatggaaaaaaccaagtggctggatatcaaaggaaatcatgatgcattcaatattccaagtctggacagcatcaagaattattacaggaaatattctgctgtacgtagagatggctctttccattatgtccacagtactccctttggcaactattcgttcatctgtgtagatgccactgtaaatccagggcctaagagaccctataatttctttggaattttagataagaaaaagatggaggagctcttattactggccaaggaaagcagtcggagcaaccatacaatttggtttggacactttacaacatccactattctttctccatcaccaggaatccggtcaataatgagttcggctatagcttatttgtgtggacatctccatacacttggtggactgatgcctgttttgcacactcgtcacttccagggcactttggaacttgaggtgggagactggaaggataataggaggtaccggatttttgcttttgatcacgacctctttagctttgcagatttgatctttgggaagtggcctgtggttcttatcaccaatcctaaatcactcctttatagttgtggtgaacatgaaccactagaaagacttcttcactcaacacacatcagagtcttggccttttccttatcctccattacttctgtcacagttaagattgatggagttcatttaggccaggctgttcatgtgtctggtcccattttcgtactgaagtggaatcctagaaactacagtagtgggacacataacatagaagtaatcgtccaggattctgctggaagaagtaagagtgttcaccacatattttctgttcaagagaataatcatctcagttttgatcccctggcatcatttattctccgtactgatcactacatcatggcccgggtcctttttgtgctgattgtgctgagccagctcaccattctcattatttttagatatcgaggatacccagagcttaaagaaccttcagggtttataaatctgacctcattttctcttcatgtcttgagcaaaataaacatcttctactattctgtgttgttgttgaccctgtatacagtgctgggtccatggttttttggtgaaatcattgatggcaaatttggttgctgcttttcctttgggatatttgttaatggacatttcctacaaggcagcataacatttataattggaattctccagctggcgttttttaacatccccttgatggcttacatgtgttggagcttgctgcagcggtgctttggtcacaacttcaggtctcatctccatcaaagaaaatacttgaaaattatgcctgttcacctacttatgctactgctgtacatctggcaggtttattcctgctactttctttatgcaacatacggcaccctagcttttttattctcccctttgcggacctggttgacactgctgacacctgttctcattcgttatgtgtggacactgaactccaccaagtttggaatcttcatggtgcagttaaaaagccacctgagctcctgaaggccatgtctcaccactggcagctgggcagaagcccagcctctgtgtctgtagcccaggcctctaccccagtagcaggtggagggccaggattggtgggtgagctttagggagcagctgctcgtttggagtcctggacgttggagggattacccactactgatacctgcagaatggactgcagaaaagtctcaaaaataatgcctttattccttccctccctaaggaggcaaagagttgatttacctttgtgaagagaaaacccttatctaggacatccacagggtagaggttgggtgtgtgtacgggagtgtctgaggcccagtgtgttttttagggttaccccatgtaaagcacttaccgctgtgcttggaattcagcagctgtcaaaggtgcaatttcaggggcagggaacctttgaggatctgggcccgaccctcactacccctgagatattagttcccaggcctgttttcccacaggattgtgggctctctgcttccttagtcggaagtgttttcaactaatcaaataaatgaatgaatgatgaataagaaa

SEQ ID NO: 427163 - DNA, 2621 bp, Homo sapiens
cggcacgaggggtgttcagagtttcggttctcttttctgtgatcgtattacttatgcaaaacgagcccagtcacttgcgcggccagagaggggcaggtgctgggcggcggctgacgggcgcagcaccctaggcccagtgtctggctccagccccgcatccggcgccggccccgcatccagctctggccctgcgacaatagagtccggaagtgcaggcaaagcggctcccgggagcgccgcgcggtcctgcgcgggatcagcgagggccgcgccccggcgggcgggcggcatggctgcagtgctggctctcagggtggtcgcggggttggcggccgcagcgctggtggccatgctcttggagcactacggcctggcgggccagccctcgccgctgccgcgccccgcgccccccaggaggccgcaccctgcgccagggcccggagacagcaacatcttctggggcctgcaggagacctgacagatgccaaaacaaaggaacagttgggatccaggcagcatgaggtagaatggcaaacctaccagggtattctgaagaagacaagagtcatggaaaaaaccaagtggctggatatcaaaggaaatcatggaaatattctgctgtacgtagagatggctctttccattatgtccacagtactccctttggcaactattcgttcatctgtgtagatgccactgtaaatccagggcctaagagaccctataatttctttggaattttagataagaaaaagatggaggagctcttattactggccaaggaaagcagtcggagcaaccatacaatttggtttggacactttacaacatccactattctttctccatcaccaggaatccggtcaataatgagttcggctatagcttatttgtgtggacatctccatacacttggtggactgatgcctgttttgcacactcgtcacttccagggcactttggaacttgaggtgggagactggaaggataataggaggtaccggatttttgcttttgatcacgacctctttagctttgcagatttgatctttgggaagtggcctgtggttcttatcaccaatcctaaatcactcctttatagttgtggtgaacatgaaccactagaaagacttcttcactcaacacacatcagagtcttggccttttccttatcctccattacttctgtcacagttaagattgatggagttcatttaggccaggctgttcatgtgtctggtcccattttcgtactgaagtggaatcctagaaactacagtagtgggacacataacatagaagtaatcgtccaggattctgctggaagaagtaagagtgttcaccacatattttctgttcaagagaataatcatctcagttttgatcccctggcatcatttattctccgtactgatcactacatcatggcccgggtcctttttgtgctgattgtgctgagccagctcaccattctcattatttttagatatcgaggatacccagagcttaaagaaccttcagggtttataaatctgacctcattttctcttcatgtcttgagcaaaataaacatcttctactattctgtgttgttgttgaccctgtatacagtgctgggtccatggttttttggtgaaatcattgatggcaaatttggttgctgcttttcctttgggatatttgttaatggacatttcctacaaggcagcataacatttataattggaattctccagctggcgttttttaacatccccttgatggcttacatgtgttggagcttgctgcagcggtgctttggtcacaacttcaggtctcatctccatcaaagaaaatacttgaaaattatgcctgttcacctacttatgctactgctgtacatctggcaggtttattcctgctactttctttatgcaacatacggcaccctagcttttttattctcccctttgcggacctggttgacactgctgacacctgttctcattcgttatgtgtggacactgaactccaccaagtttggaatcttcatggtgcagttaaaaagccacctgagctcctgaaggccatgtctcaccactggcagctgggcagaagcccagcctctgtgtctgtagcccaggcctctaccccagtagcaggtggagggccaggattggtgggtgagctttagggagcagctgctcgtttggagtcctggacgttggagggattacccactactgatacctgcagaatggactgcagaaaagtctcaaaaataatgcctttattccttccctccctaaggaggcaaagagttgatttacctttgtgaagagaaaacccttatctaggacatccacagggtagaggttgggtgtgtgtacgggagtgtctgaggcccagtgtgttttttagggttaccccatgtaaagcacttaccgctgtgcttggaattcagcagctgtcaaaggtgcaatttcaggggcagggaacctttgaggatctgggcccgaccctcactacccctgagatattagttcccaggcctgttttcccacaggattgtgggctctctgcttccttagtcggaagtgttttcaactaatcaaataaatgaatgaatgatgaataagaaa

SEQ ID NO: 427164 - DNA, 2400 bp, Homo sapiens
cggcacgaggggtgttcagagtttcggttctcttttctgtgatcgtattacttatgcaaaacgagcccagtcacttgcgcggccagagaggggcaggtgctgggcggcggctgacgggcgcagcaccctaggcccagtgtctggctccagccccgcatccggcgccggccccgcatccagctctggccctgcgacaatagagtccggaagtgcaggcaaagcggctcccgggagcgccgcgcggtcctgcgcgggatcagcgagggccgcgccccggcgggcgggcggcatggctgcagtgctggctctcagggtggtcgcggggttggcggccgcagcgctggtggccatgctcttggagcactacggcctggcgggccagccctcgccgctgccgcgccccgcgccccccaggaggccgcaccctgcgccagggcccggagacagcaacatcttctggggcctgcaggagacctgacagatgccaaaacaaaggaacagttgggatccaggcagcatgaggtagaatggcaaacctaccagggtattctgaagaagacaagagtcatggaaaaaaccaagtggctggatatcaaaggaaatcatgaaaaagatggaggagctcttattactggccaaggaaagcagtcggagcaaccatacaatttggtttggacactttacaacatccactattctttctccatcaccaggaatccggtcaataatgagggcactttggaacttgaggtgggagactggaaggataataggaggtaccggatttttgcttttgatcacgacctctttagctttgcagatttgatctttgggaagtggcctgtggttcttatcaccaatcctaaatcactcctttatagttgtggtgaacatgaaccactagaaagacttcttcactcaacacacatcagagtcttggccttttccttatcctccattacttctgtcacagttaagattgatggagttcatttaggccaggctgttcatgtgtctggtcccattttcgtactgaagtggaatcctagaaactacagtagtgggacacataacatagaagtaatcgtccaggattctgctggaagaagtaagagtgttcaccacatattttctgttcaagagaataatcatctcagttttgatcccctggcatcatttattctccgtactgatcactacatcatggcccgggtcctttttgtgctgattgtgctgagccagctcaccattctcattatttttagatatcgaggatacccagagcttaaagaaccttcagggtttataaatctgacctcattttctcttcatgtcttgagcaaaataaacatcttctactattctgtgttgttgttgaccctgtatacagtgctgggtccatggttttttggtgaaatcattgatggcaaatttggttgctgcttttcctttgggatatttgttaatggacatttcctacaaggcagcataacatttataattggaattctccagctggcgttttttaacatccccttgatggcttacatgtgttggagcttgctgcagcggtgctttggtcacaacttcaggtctcatctccatcaaagaaaatacttgaaaattatgcctgttcacctacttatgctactgctgtacatctggcaggtttattcctgctactttctttatgcaacatacggcaccctagcttttttattctcccctttgcggacctggttgacactgctgacacctgttctcattcgttatgtgtggacactgaactccaccaagtttggaatcttcatggtgcagttaaaaagccacctgagctcctgaaggccatgtctcaccactggcagctgggcagaagcccagcctctgtgtctgtagcccaggcctctaccccagtagcaggtggagggccaggattggtgggtgagctttagggagcagctgctcgtttggagtcctggacgttggagggattacccactactgatacctgcagaatggactgcagaaaagtctcaaaaataatgcctttattccttccctccctaaggaggcaaagagttgatttacctttgtgaagagaaaacccttatctaggacatccacagggtagaggttgggtgtgtgtacgggagtgtctgaggcccagtgtgttttttagggttaccccatgtaaagcacttaccgctgtgcttggaattcagcagctgtcaaaggtgcaatttcaggggcagggaacctttgaggatctgggcccgaccctcactacccctgagatattagttcccaggcctgttttcccacaggattgtgggctctctgcttccttagtcggaagtgttttcaactaatcaaataaatgaatgaatgatgaataagaaa

SEQ ID NO: 427165 - DNA, 2411 bp, Homo sapiens
gtgagccatgatcgcgccactgcattcctgcctgggggatagagaccctgtctgagaagtgaaggaaaggggaatggtagagggaaggggaagagaaagaaaagaaaacctatggaggtacgttaataatcagaaggggccagaggaagccacctgacacatttgtgagacaatttaaaaggcgttctcatacattctcactttgatacaacaaccctgcaaagtgcgcacggaaggtgttattaactccgttttacaggagacctgacagatgccaaaacaaaggaacagttgggatccaggcagcatgaggtagaatggcaaacctaccagggtattctgaagaagacaagagtcatggaaaaaaccaagtggctggatatcaaaggaaatcatggaaatattctgctgtacgtagagatggctctttccattatgtccacagtactccctttggcaactattcgttcatctgtgtagatgccactgtaaatccagggcctaagagaccctataatttctttggaattttagataagaaaaagatggaggagctcttattactggccaaggaaagcagtcggagcaaccatacaatttggtttggacactttacaacatccactattctttctccatcaccaggaatccggtcaataatgagttcggctatagcttatttgtgtggacatctccatacacttggtggactgatgcctgttttgcacactcgtcacttccagggcactttggaacttgaggtgggagactggaaggataataggaggtaccggatttttgcttttgatcacgacctctttagctttgcagatttgatctttgggaagtggcctgtggttcttatcaccaatcctaaatcactcctttatagttgtggtgaacatgaaccactagaaagacttcttcactcaacacacatcagagtcttggccttttccttatcctccattacttctgtcacagttaagattgatggagttcatttaggccaggctgttcatgtgtctggtcccattttcgtactgaagtggaatcctagaaactacagtagtgggacacataacatagaagtaatcgtccaggattctgctggaagaagtaagagtgttcaccacatattttctgttcaagagaataatcatctcagttttgatcccctggcatcatttattctccgtactgatcactacatcatggcccgggtcctttttgtgctgattgtgctgagccagctcaccattctcattatttttagatatcgaggatacccagagcttaaagaaccttcagggtttataaatctgacctcattttctcttcatgtcttgagcaaaataaacatcttctactattctgtgttgttgttgaccctgtatacagtgctgggtccatggttttttggtgaaatcattgatggcaaatttggttgctgcttttcctttgggatatttgttaatggacatttcctacaaggcagcataacatttataattggaattctccagctggcgttttttaacatccccttgatggcttacatgtgttggagcttgctgcagcggtgctttggtcacaacttcaggtctcatctccatcaaagaaaatacttgaaaattatgcctgttcacctacttatgctactgctgtacatctggcaggtttattcctgctactttctttatgcaacatacggcaccctagcttttttattctcccctttgcggacctggttgacactgctgacacctgttctcattcgttatgtgtggacactgaactccaccaagtttggaatcttcatggtgcagttaaaaagccacctgagctcctgaaggccatgtctcaccactggcagctgggcagaagcccagcctctgtgtctgtagcccaggcctctaccccagtagcaggtggagggccaggattggtgggtgagctttagggagcagctgctcgtttggagtcctggacgttggagggattacccactactgatacctgcagaatggactgcagaaaagtctcaaaaataatgcctttattccttccctccctaaggaggcaaagagttgatttacctttgtgaagagaaaacccttatctaggacatccacagggtagaggttgggtgtgtgtacgggagtgtctgaggcccagtgtgttttttagggttaccccatgtaaagcacttaccgctgtgcttggaattcagcagctgtcaaaggtgcaatttcaggggcagggaacctttgaggatctgggcccgaccctcactacccctgagatattagttcccaggcctgttttcccacaggattgtgggctctctgcttccttagtcggaagtgttttcaactaatcaaataaatgaatgaatgatgaataagaaa

SEQ ID NO: 427166 - DNA, 1587 bp, Homo sapiens
ttagccaggcgtagtggtgtgtgcctatagtcctgcagctgtatcaggaagatcacttgaccacagaagatgaaagctgcagtgagctagctatgattgcaccactgcacgccagcctggacaacagagagaaaccttgaaaaacaacaacaacaacaacaacaacaataacaacaacaacaaagtgtagttattagaaacctattcttattttaatttagaacattataaatatttccatgtacatgaaagttacttttcttctgtggttattactaggattctgctggaagaagtaagagtgttcaccacatattttctgttcaagagaataatcatctcagttttgatcccctggcatcatttattctccgtactgatcactacatcatggcccgggtcctttttgtgctgattgtgctgagccagctcaccattctcattatttttagatatcgaggatacccagagcttaaagaaccttcagggtttataaatctgacctcattttctcttcatgtcttgagcaaaataaacatcttctactattctgtgttgttgttgaccctgtatacagtgctgggtccatggttttttggtgaaatcattgatggcaaatttggttgctgcttttcctttgggatatttgttaatggacatttcctacaaggcagcataacatttataattggaattctccagctggcgttttttaacatccccttgatggcttacatgtgttggagcttgctgcagcggtgctttggtcacaacttcaggtctcatctccatcaaagaaaatacttgaaaattatgcctgttcacctacttatgctactgctgtacatctggcaggtttattcctgctactttctttatgcaacatacggcaccctagcttttttattctcccctttgcggacctggttgacactgctgacacctgttctcattcgttatgtgtggacactgaactccaccaagtttggaatcttcatggtgcagttaaaaagccacctgagctcctgaaggccatgtctcaccactggcagctgggcagaagcccagcctctgtgtctgtagcccaggcctctaccccagtagcaggtggagggccaggattggtgggtgagctttagggagcagctgctcgtttggagtcctggacgttggagggattacccactactgatacctgcagaatggactgcagaaaagtctcaaaaataatgcctttattccttccctccctaaggaggcaaagagttgatttacctttgtgaagagaaaacccttatctaggacatccacagggtagaggttgggtgtgtgtacgggagtgtctgaggcccagtgtgttttttagggttaccccatgtaaagcacttaccgctgtgcttggaattcagcagctgtcaaaggtgcaatttcaggggcagggaacctttgaggatctgggcccgaccctcactacccctgagatattagttcccaggcctgttttcccacaggattgtgggctctctgcttccttagtcggaagtgttttcaactaatcaaataaatgaatgaatgatgaataagaaa

SEQ ID NO: 427167 - DNA, 1090 bp, Homo sapiens
taacctctctcacctggttataggcacatgcaacacatccagctgctttaaatttttcttttgtagcgatgtggtctggctacgtcactagcctagttagaactcttggctcaagtgatcctccccccttcacttcccagtgtagggattacaggcatgagcccttgtccttggccaaaattactttttaaaaagtcatcaatgttttgccgatcttttaaagtatactgatcatgagtaactactcttaaagataatttcataaaatgttcacaacttcaggtctcatctccatcaaagaaaatacttgaaaattatgcctgttcacctacttatgctactgctgtacatctggcaggtttattcctgctactttctttatgcaacatacggcaccctagcttttttattctcccctttgcggacctggttgacactgctgacacctgttctcattcgttatgtgtggacactgaactccaccaagtttggaatcttcatggtgcagttaaaaagccacctgagctcctgaaggccatgtctcaccactggcagctgggcagaagcccagcctctgtgtctgtagcccaggcctctaccccagtagcaggtggagggccaggattggtgggtgagctttagggagcagctgctcgtttggagtcctggacgttggagggattacccactactgatacctgcagaatggactgcagaaaagtctcaaaaataatgcctttattccttccctccctaaggaggcaaagagttgatttacctttgtgaagagaaaacccttatctaggacatccacagggtagaggttgggtgtgtgtacgggagtgtctgaggcccagtgtgttttttagggttaccccatgtaaagcacttaccgctgtgcttggaattcagcagctgtcaaaggtgcaatttcaggggcagggaacctttgaggatctgggcccgaccctcactacccctgagatattagttcccaggcctgttttcccacaggattgtgggctctctgcttccttagtcggaagtgttttcaactaatcaaataaatgaatgaatgatgaataagaaa

SEQ ID NO: 427168 - DNA, 441 bp, Homo sapiens
ttattactggccaaggaaagcagtcggagcaaccatacaatttggtttggacactttacaacatccactattctttctccatcaccaggaatccggtcaataatgaggtgagacaagcttccaaaatcagaattaatttgtttttagtttttttattttgctgttacctattctgcttttctggcaagacatttttattagtttggcctcacgcgttatctttgttcatttatttcatttatttttcattggttagttcggctatagcttatttgtgtggacatctccatacacttggtggactgatgcctgttttgcacactcgtcacttccagggcactttggaacttgaggtgggagactggaaggataataggaggtaagggaacctccccatagaagaaaacttatacacataagttttgccaaagcaatgatagt

SEQ ID NO: 427169 - DNA, 327 bp, Homo sapiens
aaggctactttaaaaatcttaactgaaagtgtacccatgtatctatttcacgttaacatctatttccctgcaggcccgggtcctttttgtgctgattgtgctgagccagctcaccattctcattatttttagatatcgaggatacccagagcttaaaggttagttatggttccttttattcctataagccttgttcatggaaaaaaccaaactccgtaaaatattttaaagaggtttattctaagccaatatgaatgaccatggcccagggaaaacacaaactcaagaagccttgagtaaatggtcctgaggcagttggattacagt

SEQ ID NO: 427170 - DNA, 2779 bp, Homo sapiens
cggcacgaggggtgttcagagtttcggttctcttttctgtgatcgtattacttatgcaaaacgagcccagtcacttgcgcggccagagaggggcaggtgctgggcggcggctgacgggcgcagcaccctaggcccagtgtctggctccagccccgcatccggcgccggccccgcatccagctctggccctgcgacaatagagtccggaagtgcaggcaaagcggctcccgggagcgccgcgcggtcctgcgcgggatcagcgagggccgcgccccggcgggcgggcggcatggctgcagtgctggctctcagggtggtcgcggggttggcggccgcagcgctggtggccatgctcttggagcactacggcctggcgggccagccctcgccgctgccgcgccccgcgccccccaggaggccgcaccctgcgccagggcccggagacagcaacatcttctggggcctgcagatatccgacattcacctgagcaggtttcgagatccaggcagagcggtagacttagagaaattctgttctgaaactattgacatcattcaaccagctctcgtcctagcaacaggagacctgacagatgccaaaacaaaggaacagttgggatccaggcagcatgaggtagaatggcaaacctaccagggtattctgaagaagacaagagtcatggaaaaaaccaagtggctggatatcaaaggaaatcatgatgcattcaatattccaagtctggacagcatcaagaattattacaggaaatattctgctgtacgtagagatggctctttccattatgtccacagtactccctttggcaactattcgttcatctgtgtagatgccactgtaaatccagggcctaagagaccctataatttctttggaattttagataagaaaaagatggaggagctcttattactggccaaggaaagcagtcggagcaaccatacaatttggtttggacactttacaacatccactattctttctccatcaccaggaatccggtcaataatgagttcggctatagcttatttgtgtggacatctccatacacttggtggactgatgcctgttttgcacactcgtcacttccagggcactttggaacttgaggtgggagactggaaggataataggaggtaccggatttttgcttttgatcacgacctctttagctttgcagatttgatctttgggaagtggcctgtggttcttatcaccaatcctaaatcactcctttatagttgtggtgaacatgaaccactagaaagacttcttcactcaacacacatcagagtcttggccttttccttatcctccattacttctgtcacagttaagattgatggagttcatttaggccaggctgttcatgtgtctggtcccattttcgtactgaagtggaatcctagaaactacagtagtgggacacataacatagaagtaatcgtccaggattctgctggaagaagtaagagtgttcaccacatattttctgttcaagagaataatcatctcagttttgatcccctggcatcatttattctccgtactgatcactacatcatggcccgggtcctttttgtgctgattgtgctgagccagctcaccattctcattatttttagatatcgaggatacccagagcttaaagaaccttcagggtttataaatctgacctcattttctcttcatgtcttgagcaaaataaacatcttctactattctgtgttgttgttgaccctgtatacagtgctgggtccatggttttttggtgaaatcattgatggcaaatttggttgctgcttttcctttgggatatttgttaatggacatttcctacaaggcagcataacatttataattggaattctccagctggcgttttttaacatccccttgatggcttacatgtgttggagcttgctgcagcggtgctttggtcacaacttcaggtctcatctccatcaaagaaaatacttgaaaattatgcctgttcacctacttatgctactgctgtacatctggcaggtttattcctgctactttctttatgcaacatacggcaccctagcttttttattctcccctttgcggacctggttgacactgctgacacctgttctcattcgttatgtgtggacactgaactccaccaagtttggaatcttcatggtgcagttaaaaagccacctgagctcctgaaggccatgtctcaccactggcagctgggcagaagcccagcctctgtgtctgtagcccaggcctctaccccagtagcaggtggagggccaggattggtgggtgagctttagggagcagctgctcgtttggagtcctggacgttggagggattacccactactgatacctgcagaatggactgcagaaaagtctcaaaaataatgcctttattccttccctccctaaggaggcaaagagttgatttacctttgtgaagagaaaacccttatctaggacatccacagggtagaggttgggtgtgtgtacgggagtgtctgaggcccagtgtgttttttagggttaccccatgtaaagcacttaccgctgtgcttggaattcagcagctgtcaaaggtgcaatttcaggggcagggaacctttgaggatctgggcccgaccctcactacccctgagatattagttcccaggcctgttttcccacaggattgtgggctctctgcttccttagtcggaagtgttttcaactaatcaaataaatgaatgaatgatgaataagaaa

SEQ ID NO: 427171 - DNA, 271 bp, Homo sapiens
gcggccgcctactactactactactgctcgaattcaagcttctaacgatgtacgggcccatgtaaagcacttaccgctgtgcttggaattcagcagctgtcaaaggtgcaatttcaggggcagggaacctttgaggatctgggcccgaccctcactacccctgagatattagttcccaggcctgttttcccacaggattgtgggctctctgcttccttagtcggaagtgttttcaactaatcaaataaatgaatgaatgatgaataagaaa

SEQ ID NO: 427172 - DNA, 2479 bp, Homo sapiens
cggcacgaggggtgttcagagtttcggttctcttttctgtgatcgtattacttatgcaaaacgagcccagtcacttgcgcggccagagaggggcaggtgctgggcggcggctgacgggcgcagcaccctaggcccagtgtctggctccagccccgcatccggcgccggccccgcatccagctctggccctgcgacaatagagtccggaagtgcaggcaaagcggctcccgggagcgccgcgcggtcctgcgcgggatcagcgagggccgcgccccggcgggcgggcggcatggctgcagtgctggctctcagggtggtcgcggggttggcggccgcagcgctggtggccatgctcttggagcactacggcctggcgggccagccctcgccgctgccgcgccccgcgccccccaggaggccgcaccctgcgccagggcccggagacagcaacatcttctggggcctgcaggagacctgacagatgccaaaacaaaggaacagttgggatccaggcagcatgaggtagaatggcaaacctaccagggtattctgaagaagacaagagtcatggaaaaaaccaagtggctggatatcaaaggaaatcatgaaaaagatggaggagctcttattactggccaaggaaagcagtcggagcaaccatacaatttggtttggacactttacaacatccactattctttctccatcaccaggaatccggtcaataatgagttcggctatagcttatttgtgtggacatctccatacacttggtggactgatgcctgttttgcacactcgtcacttccagggcactttggaacttgaggtgggagactggaaggataataggaggtaccggatttttgcttttgatcacgacctctttagctttgcagatttgatctttgggaagtggcctgtggttcttatcaccaatcctaaatcactcctttatagttgtggtgaacatgaaccactagaaagacttcttcactcaacacacatcagagtcttggccttttccttatcctccattacttctgtcacagttaagattgatggagttcatttaggccaggctgttcatgtgtctggtcccattttcgtactgaagtggaatcctagaaactacagtagtgggacacataacatagaagtaatcgtccaggattctgctggaagaagtaagagtgttcaccacatattttctgttcaagagaataatcatctcagttttgatcccctggcatcatttattctccgtactgatcactacatcatggcccgggtcctttttgtgctgattgtgctgagccagctcaccattctcattatttttagatatcgaggatacccagagcttaaagaaccttcagggtttataaatctgacctcattttctcttcatgtcttgagcaaaataaacatcttctactattctgtgttgttgttgaccctgtatacagtgctgggtccatggttttttggtgaaatcattgatggcaaatttggttgctgcttttcctttgggatatttgttaatggacatttcctacaaggcagcataacatttataattggaattctccagctggcgttttttaacatccccttgatggcttacatgtgttggagcttgctgcagcggtgctttggtcacaacttcaggtctcatctccatcaaagaaaatacttgaaaattatgcctgttcacctacttatgctactgctgtacatctggcaggtttattcctgctactttctttatgcaacatacggcaccctagcttttttattctcccctttgcggacctggttgacactgctgacacctgttctcattcgttatgtgtggacactgaactccaccaagtttggaatcttcatggtgcagttaaaaagccacctgagctcctgaaggccatgtctcaccactggcagctgggcagaagcccagcctctgtgtctgtagcccaggcctctaccccagtagcaggtggagggccaggattggtgggtgagctttagggagcagctgctcgtttggagtcctggacgttggagggattacccactactgatacctgcagaatggactgcagaaaagtctcaaaaataatgcctttattccttccctccctaaggaggcaaagagttgatttacctttgtgaagagaaaacccttatctaggacatccacagggtagaggttgggtgtgtgtacgggagtgtctgaggcccagtgtgttttttagggttaccccatgtaaagcacttaccgctgtgcttggaattcagcagctgtcaaaggtgcaatttcaggggcagggaacctttgaggatctgggcccgaccctcactacccctgagatattagttcccaggcctgttttcccacaggattgtgggctctctgcttccttagtcggaagtgttttcaactaatcaaataaatgaatgaatgatgaataagaaa

SEQ ID NO: 427173 - DNA, 2384 bp, Homo sapiens
atctcactacaccaagaattctaggtacttagtatgccctcactaaatctgcaaatgattgataaatactgttccactggattttgatttctttttgaacatttaatggactccctaaaagagccgtcttacttctgaacttggtgaacttgtatttggttattgaatgagtttgcatgagtctttggggacaatgggagaaaaactttgaaatttcatcagtttatccattgtggatctagtttagtatatttctgtcagatcagcaaatctcgttttcaaaggaaggtaaaatctagcgtattagggaaggaattttaaagcattgtctttttattacactaacaccctcctgtcttctattttttaggaaatattctgctgtacgtagagatggctctttccattatgtccacagtactccctttggcaactattcgttcatctgtgtagatgccactgtaaatccagggcctaagagaccctataatttctttggaattttagataagaaaaagatggaggagctcttattactggccaaggaaagcagtcggagcaaccatacaatttggtttggacactttacaacatccactattctttctccatcaccaggaatccggtcaataatgagttcggctatagcttatttgtgtggacatctccatacacttggtggactgatgcctgttttgcacactcgtcacttccagggcactttggaacttgaggtgggagactggaaggataataggaggtaccggatttttgcttttgatcacgacctctttagctttgcagatttgatctttgggaagtggcctgtggttcttatcaccaatcctaaatcactcctttatagttgtggtgaacatgaaccactagaaagacttcttcactcaacacacatcagagtcttggccttttccttatcctccattacttctgtcacagttaagattgatggagttcatttaggccaggctgttcatgtgtctggtcccattttcgtactgaagtggaatcctagaaactacagtagtgggacacataacatagaagtaatcgtccaggattctgctggaagaagtaagagtgttcaccacatattttctgttcaagagaataatcatctcagttttgatcccctggcatcatttattctccgtactgatcactacatcatggcccgggtcctttttgtgctgattgtgctgagccagctcaccattctcattatttttagatatcgaggatacccagagcttaaagaaccttcagggtttataaatctgacctcattttctcttcatgtcttgagcaaaataaacatcttctactattctgtgttgttgttgaccctgtatacagtgctgggtccatggttttttggtgaaatcattgatggcaaatttggttgctgcttttcctttgggatatttgttaatggacatttcctacaaggcagcataacatttataattggaattctccagctggcgttttttaacatccccttgatggcttacatgtgttggagcttgctgcagcggtgctttggtcacaacttcaggtctcatctccatcaaagaaaatacttgaaaattatgcctgttcacctacttatgctactgctgtacatctggcaggtttattcctgctactttctttatgcaacatacggcaccctagcttttttattctcccctttgcggacctggttgacactgctgacacctgttctcattcgttatgtgtggacactgaactccaccaagtttggaatcttcatggtgcagttaaaaagccacctgagctcctgaaggccatgtctcaccactggcagctgggcagaagcccagcctctgtgtctgtagcccaggcctctaccccagtagcaggtggagggccaggattggtgggtgagctttagggagcagctgctcgtttggagtcctggacgttggagggattacccactactgatacctgcagaatggactgcagaaaagtctcaaaaataatgcctttattccttccctccctaaggaggcaaagagttgatttacctttgtgaagagaaaacccttatctaggacatccacagggtagaggttgggtgtgtgtacgggagtgtctgaggcccagtgtgttttttagggttaccccatgtaaagcacttaccgctgtgcttggaattcagcagctgtcaaaggtgcaatttcaggggcagggaacctttgaggatctgggcccgaccctcactacccctgagatattagttcccaggcctgttttcccacaggattgtgggctctctgcttccttagtcggaagtgttttcaactaatcaaataaatgaatgaatgatgaataagaaa

SEQ ID NO: 427174 - DNA, 2293 bp, Homo sapiens
cggcacgaggggtgttcagagtttcggttctcttttctgtgatcgtattacttatgcaaaacgagcccagtcacttgcgcggccagagaggggcaggtgctgggcggcggctgacgggcgcagcaccctaggcccagtgtctggctccagccccgcatccggcgccggccccgcatccagctctggccctgcgacaatagagtccggaagtgcaggcaaagcggctcccgggagcgccgcgcggtcctgcgcgggatcagcgagggccgcgccccggcgggcgggcggcatggctgcagtgctggctctcagggtggtcgcggggttggcggccgcagcgctggtggccatgctcttggagcactacggcctggcgggccagccctcgccgctgccgcgccccgcgccccccaggaggccgcaccctgcgccagggcccggagacagcaacatcttctggggcctgcagatatccgacattcacctgagcaggtttcgagatccaggcagagcggtagacttagagaaattctgttctgaaactattgacatcattcaaccagctctcgtcctagcaacaggagacctgacagatgccaaaacaaaggaacagttgggatccaggcagcatgaggtagaatggcaaacctaccagggtattctgaagaagacaagagtcatggaaaaaaccaagtggctggatatcaaaggaaatcatgatgcattcaatattccaagtctggacagcatcaagaattattacaggaaatattctgctgtacgtagagatggctctttccattatgtccacagtactccctttggcaactattcgttcatctgtgtagatgccactgtaaatccagggcctaagagaccctataatttctttggaattttagataagaaaaagatggaggagctcttattactggccaaggaaagcagtcggagcaaccatacaatttggtttggacactttacaacatccactattctttctccatcaccaggaatccggtcaataatgagttcggctatagcttatttgtgtggacatctccatacacttggtggactgatgcctgttttgcacactcgtcacttccagggcactttggaacttgaggtgggagactggaaggataataggaggtaccggatttttgcttttgatcacgacctctttagctttgcagatttgatctttgggaagtggcctgtggttcttatcaccaatcctaaatcactcctttatagttgtggtgaacatgaaccactagaaagacttcttcactcaacacacatcagagtcttggccttttccttatcctccattacttctgtcacagttaagattgatggagttcatttaggccaggctgttcatgtgtctggtcccattttcgtactgaagtggaatcctagaaactacagtagtgggacacataacatagaagtaatcgtccaggattctgctggaagaagtaagagtgttcaccacatattttctgttcaagagaataatcatctcagttttgatcccctggcatcatttattctccgtactgatcactacatcatggcccgggtcctttttgtgctgattgtgctgagccagctcaccattctcattatttttagatatcgaggatacccagagcttaaagaaccttcagggtttataaatctgacctcattttctcttcatgtcttgagcaaaataaacatcttctactattctgtgttgttgttgaccctgtatacagtgctgggtaagtaaattagtacagattatggggaattttgccaaagaatatattaacaattttgacaatagaattagactcttgagggtataacaaatggctcatggattcttcataaatcattttctgggacatggttttggaaaataaagctcgtgcctaacatgtttaaaggacatttagttaacaccaagttaacttaagggtgctgagaagactgctacagaattagtatttgtgtagaaacctaatagaagcttaaatagcacctcctcagagcaaccttctttgtctatcttaaagttttagtctatatctcatcacaggttttacttccatcattacctttatcagaatttatacctatcttctgtgtttattatctattaactcattaaaatattcactggtaggcgggtacggtggctcatgcctgtagttccagctacttgggggctgaggcgagagtactgcttgagtccaggaggtcaaatccagcctgggcaacacagcaagacgccatc

SEQ ID NO: 427175 - DNA, 608 bp, Homo sapiens
cgtcgatgactgggaaacctggcggcaaaagacttccctagagctgtggcccccacaccttttctcttctatgaacacgtgtgatctgggctgtggaagttgtattttagactctgacatgaagtaaccttttcatctatttttctctgttacaggaaaaaggccacagtgaaggccgactccttagtttcttggaacagtctgagcacaagacttcagatgcagacatcaagtcttcagaaacaggagccttcaggtgaattggattgtgcactgaattgtggctgtcagcatttctgaaaagtgcaggccttgtcctgtgttctgtgtgtagtgtgatactcagactgttgcagtagaaatcactgtggaactattatgacctctctctcagtatgactctgtgctccccatttagctaagattggataactcaattcattcattgtgttaaaacaaacagagtgaaagttatgtcttattcttctgtacctctctatccccatccaaccctggttttctgacctggattctcaagcagcttgggaatttggatctcagttctcattctctcaatggccagctttaagtagtatatgatttaccca

SEQ ID NO: 427176 - DNA, 2557 bp, Homo sapiens
aaactagctaggtacgaggctggtgttaaatcggcagaggcctccccctccccccgcgctcccaacgtgtggcggctcgcgacccccggcaacccggagaaggtctacagagcggcctgcgccagcgaacaaaaggatgccacggagaaagaaaaaagttaaagaagtctccgaatctcggaacctggagaagaaggatgtggaaactaccagttctgtcagtgtgaagaggaagcgtagacttgaggatgcattcattgtgatatccgatagtgatggagaggaaccaaaggaggaaaatgggttgcagaaaacgaagacaaaacagtcgaatagagcaaagtgtttggccaaaagaaaaatcgcacagatgacagaagaagaacagtttgctctggctctcaaaatgagtgagcaggaagctagggaggtgaacagccaggaggaggaagaagaggagctcttgaggaaagccattgctgaaagcctgaatagttgccggccttctgatgcttccgctaccagatctcgacctctggccactggaccgtcttcccagtcccatcaagagaaaaccacagactctgggctcactgaaggcatatggcagctggtacctccatcactgtttaaaggctcacatatcagtcagggaaacgaggctgaggaaagagaggagccttgggaccacactgaaaaaactgaagaggagccggtctctggcagctcaggaagctgggaccagtcaagccagccagtgtttgagaatgtgaacgttaaatcttttgacagatgtactggccactcggctgagcacacacagtgtgggaagccacaggaaagtactgggaggggttctgcttttctcaaagctgtccagggtagcggggacacatctaggcactgtctacctaccctagcagatgccaaaggtctccaggacactgggggcactgtgaactatttctggggtattccattctgccctgatggagtagaccctaaccagtataccaaggtcattctctgccagttggaggtttatcaaaagagcctgaaaatggctcagaggcagctccttaataaaaaaggttttggggaaccagtgttacctagacctccttctctgatccagaatgaatgtggccaaggagagcaggctagtgagaaaaatgaatgcatctcagaagatatgggagatgaagacaaagaggagaggcaggagtctagggcatctgactggcactcaaaaaccaaggatttccaggaaagctcaattaaaagcttgaaagagaaacttttgttggaggaagaaccaacaaccagtcatggtcagtcttcccaagggattgttgaagaaacttctgaagagggaaactctgtacctgcttcacaaagtgttgctgctttgaccagtaagagaagcttagtccttatgccagagagttctgcagaagaaatcactgtttgtcctgagacacagctaagttcctctgaaacttttgaccttgaaagagaagtctctccaggtagcagagatatcttggatggagtcagaataataatggcagataaggaggttggtaacaaggaagatgctgagaaggaagtagctatttctaccttctcatccagtaaccaggtatcctgcccgctatgtgaccaatgctttccacccacaaagattgaacgacatgccatgtactgcaatggtctgatggaggaagatacagtattgactcggagacaaaaagaggccaagaccaagagtgacagtgggacagctgcccagacttctctagacattgacaagaatgagaagtgttacctctgtaaatccctggtcccatttagagagtatcagtgtcatgtggactcctgtctccagcttgcaaaggctgaccaaggagatggacctgaagggagtggaagagcatgttcaactgtggaggggaagtggcagcagaggctgaagaacccaaaggaaaaaggccacagtgaaggccgactccttagtttcttggaacagtctgagcacaagacttcagatgcagacatcaagtcttcagaaacaggagccttcagggtgccttcaccagggatggaagaggcaggctgcagcagagagatgcagagttctttcacacgtcgtgacttaaatgaatctcccgtcaagtcttttgtttccatttcagaagccacagattgcttagtggactttaaaaagcaagttactgtccagccaggtagtcggacacggaccaaagctggcagaggaagaaggagaaaattctgaatttctagggtccaaaagttgacaaaaccattagtaggaggggtgggccatgttcattaagccatagtggtccctagttcattgttgagcaagttttagccctgcagttttcaccaccagcacctacccagcattctggtttttatgttttttatgatctatgcagacaactgtgtattctgttttataacagtttgtttgaatttacttacagttaaaaaatttaaatataatttatgtttgtacgaaatcttatttcaa

SEQ ID NO: 427177 - DNA, 1820 bp, Homo sapiens
  misc_feature (1801)..(1801): n is a, c, g, or t
tggaaaagtcatggaggccatggggttggcttgaaaccagctttggggggttcgattccttccttttttgtctagattttatgtatacgggttcttcgaatgtgtggtagggtggggggcatccatatagtcactccaggtttatggagggttcttctactattaggacttttcgcttcgaagcgaaggcttctcaaatcatgaaaattattaatattactgctgttagagaaatgaacgagcctacagatgataggatgtttcatgtggtgtatgcatcggggtagtccgagtaacgtcggggcattccggataggccgagaaagtgttgtgggaagaaagttagatttacgcagatgacagaagaagaacagtttgctctggctctcaaaatgagtgagcaggaagctagggaggtgaacagccaggaggaggaagaagaggagctcttgaggaaagccattgctgaaagcctgaatagttgccggccttctgatgcttccgctaccagatctcgacctctggccactggaccgtcttcccagtcccatcaagagaaaaccacagactctgggctcactgaagtcttcccaagggattgttgaagaaacttctgaagagggaaactctgtacctgcttcacaaagtgttgctgctttgaccagtaagagaagcttagtccttatgccagagagttctgcagaagaaatcactgtttgtcctgagacacagctaagttcctctgaaacttttgaccttgaaagagaagtctctccaggtagcagagatatcttggatggagtcagaataataatggcagataaggaggttggtaacaaggaagatgctgagaaggaagtagctatttctaccttctcatccagtaaccaggtatcctgcccgctatgtgaccaatgctttccacccacaaagattgaacgacatgccatgtactgcaatggtctgatggaggaagatacagtattgactcggagacaaaaagaggccaagaccaagagtgacagtgggacagctgcccagacttctctagacattgacaagaatgagaagtgttacctctgtaaatccctggtcccatttagagagtatcagtgtcatgtggactcctgtctccagcttgcaaaggctgaccaaggagatggacctgaagggagtggaagagcatgttcaactgtggaggggaagtggcagcagaggctgaagaacccaaaggaaaaaggccacagtgaaggccgactccttagtttcttggaacagtctgagcacaagacttcagatgcagacatcaagtcttcagaaacaggagccttcagggtgccttcaccagggatggaagaggcaggctgcagcagagagatgcagagttctttcacacgtcgtgacttaaatgaatctcccgtcaagtcttttgtttccatttcagaagccacagattgcttagtggactttaaaaagcaagttactgtccagccaggtagtcggacacggaccaaagctggcagaggaagaaggagaaaattctgaatttctagggtccaaaagttgacaaaaccattagtaggaggggtgggccatgttcattaagccatagtggtccctagttcattgttgagcaagttttagccctgcagttttcaccaccagcacctacccagcattctggtttttatgttttttatgatctatgcagacaactgtgtattctgttttataacagtttgtttgaatttacttacagttaaaaaatttaaatataaaaaaaaaaattcaactgcccgancgtttaccgtcggcttggc

SEQ ID NO: 427178 - DNA, 2796 bp, Homo sapiens
  misc_feature (2777)..(2777): n is a, c, g, or t
aaactagctaggtacgaggctggtgttaaatcggcagaggcctccccctccccccgcgctcccaacgtgtggcggctcgcgacccccggcaacccggagaaggtctacagagcggcctgcgccagcgagtgagtacccgccgcctgcgcacagctccgcccacccctccctgcctccttttcttcctcagcgggtccgcggcccgctactctccgggaggggcgcttcccgacgccaagtcttactgttgctcaggctggaatgcagtggtgcgctctcggctcactgcaacctctcccttctgggttcaagcgattctcgtgcctcagcctcccaagtagctgggattacagacaaaaggatgccacggagaaagaaaaaagttaaagaagtctccgaatctcggaacctggagaagaaggatgtggaaactaccagttctgtcagtgtgaagaggaagcgtagacttgaggatgcattcattgtgatatccgatagtgatggagaggaaccaaaggaggaaaatgggttgcagaaaacgaagacaaaacagtcgaatagagcaaagtgtttggccaaaagaaaaatcgcacagatgacagaagaagaacagtttgctctggctctcaaaatgagtgagcaggaagctagggaggtgaacagccaggaggaggaagaagaggagctcttgaggaaagccattgctgaaagcctgaatagttgccggccttctgatgcttccgctaccagatctcgacctctggccactggaccgtcttcccagtcccatcaagagaaaaccacagactctgggctcactgaaggcatatggcagctggtacctccatcactgtttaaaggctcacatatcagtcagggaaacgaggctgaggaaagagaggagccttgggaccacactgaaaaaactgaagaggagccggtctctggcagctcaggaagctgggaccagtcaagccagccagtgtttgagaatgtgaacgttaaatcttttgacagatgtactggccactcggctgagcacacacagtgtgggaagccacaggaaagtactgggaggggttctgcttttctcaaagctgtccagggtagcggggacacatctaggcactgtctacctaccctagcagatgccaaaggtctccaggacactgggggcactgtgaactatttctggggtattccattctgccctgatggagtagaccctaaccagtataccaaggtcattctctgccagttggaggtttatcaaaagagcctgaaaatggctcagaggcagctccttaataaaaaaggttttggggaaccagtgttacctagacctccttctctgatccagaatgaatgtggccaaggagagcaggctagtgagaaaaatgaatgcatctcagaagatatgggagatgaagacaaagaggagaggcaggagtctagggcatctgactggcactcaaaaaccaaggatttccaggaaagctcaattaaaagcttgaaagagaaacttttgttggaggaagaaccaacaaccagtcatggtcagtcttcccaagggattgttgaagaaacttctgaagagggaaactctgtacctgcttcacaaagtgttgctgctttgaccagtaagagaagcttagtccttatgccagagagttctgcagaagaaatcactgtttgtcctgagacacagctaagttcctctgaaacttttgaccttgaaagagaagtctctccaggtagcagagatatcttggatggagtcagaataataatggcagataaggaggttggtaacaaggaagatgctgagaaggaagtagctatttctaccttctcatccagtaaccaggtatcctgcccgctatgtgaccaatgctttccacccacaaagattgaacgacatgccatgtactgcaatggtctgatggaggaagatacagtattgactcggagacaaaaagaggccaagaccaagagtgacagtgggacagctgcccagacttctctagacattgacaagaatgagaagtgttacctctgtaaatccctggtcccatttagagagtatcagtgtcatgtggactcctgtctccagcttgcaaaggctgaccaaggagatggacctgaagggagtggaagagcatgttcaactgtggaggggaagtggcagcagaggctgaagaacccaaaggaaaaaggccacagtgaaggccgactccttagtttcttggaacagtctgagcacaagacttcagatgcagacatcaagtcttcagaaacaggagccttcagggtgccttcaccagggatggaagaggcaggctgcagcagagagatgcagagttctttcacacgtcgtgacttaaatgaatctcccgtcaagtcttttgtttccatttcagaagccacagattgcttagtggactttaaaaagcaagttactgtccagccaggtagtcggacacggaccaaagctggcagaggaagaaggagaaaattctgaatttctagggtccaaaagttgacaaaaccattagtaggaggggtgggccatgttcattaagccatagtggtccctagttcattgttgagcaagttttagccctgcagttttcaccaccagcacctacccagcattctggtttttatgttttttatgatctatgcagacaactgtgtattctgttttataacagtttgtttgaatttacttacagttaaaaaatttaaatataaaaaaaaaaattcaactgcccgancgtttaccgtcggcttggc

SEQ ID NO: 427179 - DNA, 2557 bp, Homo sapiens
  misc_feature (2538)..(2538): n is a, c, g, or t
tggaaaagtcatggaggccatggggttggcttgaaaccagctttggggggttcgattccttccttttttgtctagattttatgtatacgggttcttcgaatgtgtggtagggtggggggcatccatatagtcactccaggtttatggagggttcttctactattaggacttttcgcttcgaagcgaaggcttctcaaatcatgaaaattattaatattactgctgttagagaaatgaacgagcctacagatgataggatgtttcatgtggtgtatgcatcggggtagtccgagtaacgtcggggcattccggataggccgagaaagtgttgtgggaagaaagttagatttacgcagatgacagaagaagaacagtttgctctggctctcaaaatgagtgagcaggaagctagggaggtgaacagccaggaggaggaagaagaggagctcttgaggaaagccattgctgaaagcctgaatagttgccggccttctgatgcttccgctaccagatctcgacctctggccactggaccgtcttcccagtcccatcaagagaaaaccacagactctgggctcactgaaggcatatggcagctggtacctccatcactgtttaaaggctcacatatcagtcagggaaacgaggctgaggaaagagaggagccttgggaccacactgaaaaaactgaagaggagccggtctctggcagctcaggaagctgggaccagtcaagccagccagtgtttgagaatgtgaacgttaaatcttttgacagatgtactggccactcggctgagcacacacagtgtgggaagccacaggaaagtactgggaggggttctgcttttctcaaagctgtccagggtagcggggacacatctaggcactgtctacctaccctagcagatgccaaaggtctccaggacactgggggcactgtgaactatttctggggtattccattctgccctgatggagtagaccctaaccagtataccaaggtcattctctgccagttggaggtttatcaaaagagcctgaaaatggctcagaggcagctccttaataaaaaaggttttggggaaccagtgttacctagacctccttctctgatccagaatgaatgtggccaaggagagcaggctagtgagaaaaatgaatgcatctcagaagatatgggagatgaagacaaagaggagaggcaggagtctagggcatctgactggcactcaaaaaccaaggatttccaggaaagctcaattaaaagcttgaaagagaaacttttgttggaggaagaaccaacaaccagtcatggtcagtcttcccaagggattgttgaagaaacttctgaagagggaaactctgtacctgcttcacaaagtgttgctgctttgaccagtaagagaagcttagtccttatgccagagagttctgcagaagaaatcactgtttgtcctgagacacagctaagttcctctgaaacttttgaccttgaaagagaagtctctccaggtagcagagatatcttggatggagtcagaataataatggcagataaggaggttggtaacaaggaagatgctgagaaggaagtagctatttctaccttctcatccagtaaccaggtatcctgcccgctatgtgaccaatgctttccacccacaaagattgaacgacatgccatgtactgcaatggtctgatggaggaagatacagtattgactcggagacaaaaagaggccaagaccaagagtgacagtgggacagctgcccagacttctctagacattgacaagaatgagaagtgttacctctgtaaatccctggtcccatttagagagtatcagtgtcatgtggactcctgtctccagcttgcaaaggctgaccaaggagatggacctgaagggagtggaagagcatgttcaactgtggaggggaagtggcagcagaggctgaagaacccaaaggaaaaaggccacagtgaaggccgactccttagtttcttggaacagtctgagcacaagacttcagatgcagacatcaagtcttcagaaacaggagccttcagggtgccttcaccagggatggaagaggcaggctgcagcagagagatgcagagttctttcacacgtcgtgacttaaatgaatctcccgtcaagtcttttgtttccatttcagaagccacagattgcttagtggactttaaaaagcaagttactgtccagccaggtagtcggacacggaccaaagctggcagaggaagaaggagaaaattctgaatttctagggtccaaaagttgacaaaaccattagtaggaggggtgggccatgttcattaagccatagtggtccctagttcattgttgagcaagttttagccctgcagttttcaccaccagcacctacccagcattctggtttttatgttttttatgatctatgcagacaactgtgtattctgttttataacagtttgtttgaatttacttacagttaaaaaatttaaatataaaaaaaaaaattcaactgcccgancgtttaccgtcggcttggc

SEQ ID NO: 427180 - DNA, 1834 bp, Homo sapiens
  misc_feature (1815)..(1815): n is a, c, g, or t
aaactagctaggtacgaggctggtgttaaatcggcagaggcctccccctccccccgcgctcccaacgtgtggcggctcgcgacccccggcaacccggagaaggtctacagagcggcctgcgccagcgaacaaaaggatgccacggagaaagaaaaaagttaaagaagtctccgaatctcggaacctggagaagaaggatgtggaaactaccagttctgtcagtgtgaagaggaagcgtagacttgaggatgcattcattgtgatatccgatagtgatggagaggaaccaaaggaggaaaatgggttgcagaaaacgaagacaaaacagtcgaatagagcaaagtgtttggccaaaagaaaaatcgcacagatgacagaagaagaacagtttgctctggctctcaaaatgagtgagcaggaagctagggaggtgaacagccaggaggaggaagaagaggagctcttgaggaaagccattgctgaaagcctgaatagttgccggccttctgatgcttccgctaccagatctcgacctctggccactggaccgtcttcccagtcccatcaagagaaaaccacagactctgggctcactgaagtcttcccaagggattgttgaagaaacttctgaagagggaaactctgtacctgcttcacaaagtgttgctgctttgaccagtaagagaagcttagtccttatgccagagagttctgcagaagaaatcactgtttgtcctgagacacagctaagttcctctgaaacttttgaccttgaaagagaagtctctccaggtagcagagatatcttggatggagtcagaataataatggcagataaggaggttggtaacaaggaagatgctgagaaggaagtagctatttctaccttctcatccagtaaccaggtatcctgcccgctatgtgaccaatgctttccacccacaaagattgaacgacatgccatgtactgcaatggtctgatggaggaagatacagtattgactcggagacaaaaagaggccaagaccaagagtgacagtgggacagctgcccagacttctctagacattgacaagaatgagaagtgttacctctgtaaatccctggtcccatttagagagtatcagtgtcatgtggactcctgtctccagcttgcaaaggctgaccaaggagatggacctgaagggagtggaagagcatgttcaactgtggaggggaagtggcagcagaggctgaagaacccaaaggaaaaaggccacagtgaaggccgactccttagtttcttggaacagtctgagcacaagacttcagatgcagacatcaagtcttcagaaacaggagccttcagggtgccttcaccagggatggaagaggcaggctgcagcagagagatgcagagttctttcacacgtcgtgacttaaatgaatctcccgtcaagtcttttgtttccatttcagaagccacagattgcttagtggactttaaaaagcaagttactgtccagccaggtagtcggacacggaccaaagctggcagaggaagaaggagaaaattctgaatttctagggtccaaaagttgacaaaaccattagtaggaggggtgggccatgttcattaagccatagtggtccctagttcattgttgagcaagttttagccctgcagttttcaccaccagcacctacccagcattctggtttttatgttttttatgatctatgcagacaactgtgtattctgttttataacagtttgtttgaatttacttacagttaaaaaatttaaatataaaaaaaaaaattcaactgcccgancgtttaccgtcggcttggc

SEQ ID NO: 427181 - DNA, 1945 bp, Homo sapiens
  misc_feature (1926)..(1926): n is a, c, g, or t
aaactagctaggtacgaggctggtgttaaatcggcagaggcctccccctccccccgcgctcccaacgtgtggcggctcgcgacccccggcaacccggagaaggtctacagagcggcctgcgccagcgagtgagtacccgccgcctgcgcacagctccgcccacccctccctgcctccttttcttcctcagcgggtccgcggcccgctactctccgggaggggcgcttcccgacgccaagacaaaaggatgccacggagaaagaaaaaagttaaagaagtctccgaatctcggaacctggagaagaaggatgtggaaactaccagttctgtcagtgtgaagaggaagcgtagacttgaggatgcattcattgtgatatccgatagtgatggagaggaaccaaaggaggaaaatgggttgcagaaaacgaagacaaaacagtcgaatagagcaaagtgtttggccaaaagaaaaatcgcacagatgacagaagaagaacagtttgctctggctctcaaaatgagtgagcaggaagctagggaggtgaacagccaggaggaggaagaagaggagctcttgaggaaagccattgctgaaagcctgaatagttgccggccttctgatgcttccgctaccagatctcgacctctggccactggaccgtcttcccagtcccatcaagagaaaaccacagactctgggctcactgaagtcttcccaagggattgttgaagaaacttctgaagagggaaactctgtacctgcttcacaaagtgttgctgctttgaccagtaagagaagcttagtccttatgccagagagttctgcagaagaaatcactgtttgtcctgagacacagctaagttcctctgaaacttttgaccttgaaagagaagtctctccaggtagcagagatatcttggatggagtcagaataataatggcagataaggaggttggtaacaaggaagatgctgagaaggaagtagctatttctaccttctcatccagtaaccaggtatcctgcccgctatgtgaccaatgctttccacccacaaagattgaacgacatgccatgtactgcaatggtctgatggaggaagatacagtattgactcggagacaaaaagaggccaagaccaagagtgacagtgggacagctgcccagacttctctagacattgacaagaatgagaagtgttacctctgtaaatccctggtcccatttagagagtatcagtgtcatgtggactcctgtctccagcttgcaaaggctgaccaaggagatggacctgaagggagtggaagagcatgttcaactgtggaggggaagtggcagcagaggctgaagaacccaaaggaaaaaggccacagtgaaggccgactccttagtttcttggaacagtctgagcacaagacttcagatgcagacatcaagtcttcagaaacaggagccttcagggtgccttcaccagggatggaagaggcaggctgcagcagagagatgcagagttctttcacacgtcgtgacttaaatgaatctcccgtcaagtcttttgtttccatttcagaagccacagattgcttagtggactttaaaaagcaagttactgtccagccaggtagtcggacacggaccaaagctggcagaggaagaaggagaaaattctgaatttctagggtccaaaagttgacaaaaccattagtaggaggggtgggccatgttcattaagccatagtggtccctagttcattgttgagcaagttttagccctgcagttttcaccaccagcacctacccagcattctggtttttatgttttttatgatctatgcagacaactgtgtattctgttttataacagtttgtttgaatttacttacagttaaaaaatttaaatataaaaaaaaaaattcaactgcccgancgtttaccgtcggcttggc

SEQ ID NO: 427182 - DNA, 1707 bp, Homo sapiens
  misc_feature (1688)..(1688): n is a, c, g, or t
gaaggacagatggacagacggatggaatttattaggggaattggctcattcaattatggaggttgaaaagtccccacaatagtctatttgcaagctggataccctgggatgccagtagtatggctcagtggaagtctgaaggcctgaggacaaggggaaccaaaggaggaaaatgggttgcagaaaacgaagacaaaacagtcgaatagagcaaagtgtttggccaaaagaaaaatcgcacagatgacagaagaagaacagtttgctctggctctcaaaatgagtgagcaggaagctagggaggtgaacagccaggaggaggaagaagaggagctcttgaggaaagccattgctgaaagcctgaatagttgccggccttctgatgcttccgctaccagatctcgacctctggccactggaccgtcttcccagtcccatcaagagaaaaccacagactctgggctcactgaagtcttcccaagggattgttgaagaaacttctgaagagggaaactctgtacctgcttcacaaagtgttgctgctttgaccagtaagagaagcttagtccttatgccagagagttctgcagaagaaatcactgtttgtcctgagacacagctaagttcctctgaaacttttgaccttgaaagagaagtctctccaggtagcagagatatcttggatggagtcagaataataatggcagataaggaggttggtaacaaggaagatgctgagaaggaagtagctatttctaccttctcatccagtaaccaggtatcctgcccgctatgtgaccaatgctttccacccacaaagattgaacgacatgccatgtactgcaatggtctgatggaggaagatacagtattgactcggagacaaaaagaggccaagaccaagagtgacagtgggacagctgcccagacttctctagacattgacaagaatgagaagtgttacctctgtaaatccctggtcccatttagagagtatcagtgtcatgtggactcctgtctccagcttgcaaaggctgaccaaggagatggacctgaagggagtggaagagcatgttcaactgtggaggggaagtggcagcagaggctgaagaacccaaaggaaaaaggccacagtgaaggccgactccttagtttcttggaacagtctgagcacaagacttcagatgcagacatcaagtcttcagaaacaggagccttcagggtgccttcaccagggatggaagaggcaggctgcagcagagagatgcagagttctttcacacgtcgtgacttaaatgaatctcccgtcaagtcttttgtttccatttcagaagccacagattgcttagtggactttaaaaagcaagttactgtccagccaggtagtcggacacggaccaaagctggcagaggaagaaggagaaaattctgaatttctagggtccaaaagttgacaaaaccattagtaggaggggtgggccatgttcattaagccatagtggtccctagttcattgttgagcaagttttagccctgcagttttcaccaccagcacctacccagcattctggtttttatgttttttatgatctatgcagacaactgtgtattctgttttataacagtttgtttgaatttacttacagttaaaaaatttaaatataaaaaaaaaaattcaactgcccgancgtttaccgtcggcttggc

SEQ ID NO: 427183 - DNA, 2633 bp, Homo sapiens
  misc_feature (2614)..(2614): n is a, c, g, or t
gtgacgcgtgggtcgacccacgcgtactcgcgacccccggcaacccggagaaggtctacagagcggcctgcgccagcgagtgagtacccgccgcctgcgcacagctccgcccacccctccctgcctccttttcttcctcagcgggtccgcggcccgctactctccgggaggggcgcttcccgacgccaagacaaaaggatgccacggagaaagaaaaaagttaaagaagtctccgaatctcggaacctggagaagaaggatgtggaaactaccagttctgtcagtgtgaagaggaagcgtagacttgaggatgcattcattgtgatatccgatagtgatggagaggaaccaaaggaggaaaatgggttgcagaaaacgaagacaaaacagtcgaatagagcaaagtgtttggccaaaagaaaaatcgcacagatgacagaagaagaacagtttgctctggctctcaaaatgagtgagcaggaagctagggaggtgaacagccaggaggaggaagaagaggagctcttgaggaaagccattgctgaaagcctgaatagttgccggccttctgatgcttccgctaccagatctcgacctctggccactggaccgtcttcccagtcccatcaagagaaaaccacagactctgggctcactgaaggcatatggcagctggtacctccatcactgtttaaaggctcacatatcagtcagggaaacgaggctgaggaaagagaggagccttgggaccacactgaaaaaactgaagaggagccggtctctggcagctcaggaagctgggaccagtcaagccagccagtgtttgagaatgtgaacgttaaatcttttgacagatgtactggccactcggctgagcacacacagtgtgggaagccacaggaaagtactgggaggggttctgcttttctcaaagctgtccagggtagcggggacacatctaggcactgtctacctaccctagcagatgccaaaggtctccaggacactgggggcactgtgaactatttctggggtattccattctgccctgatggagtagaccctaaccagtataccaaggtcattctctgccagttggaggtttatcaaaagagcctgaaaatggctcagaggcagctccttaataaaaaaggttttggggaaccagtgttacctagacctccttctctgatccagaatgaatgtggccaaggagagcaggctagtgagaaaaatgaatgcatctcagaagatatgggagatgaagacaaagaggagaggcaggagtctagggcatctgactggcactcaaaaaccaaggatttccaggaaagctcaattaaaagcttgaaagagaaacttttgttggaggaagaaccaacaaccagtcatggtcagtcttcccaagggattgttgaagaaacttctgaagagggaaactctgtacctgcttcacaaagtgttgctgctttgaccagtaagagaagcttagtccttatgccagagagttctgcagaagaaatcactgtttgtcctgagacacagctaagttcctctgaaacttttgaccttgaaagagaagtctctccaggtagcagagatatcttggatggagtcagaataataatggcagataaggaggttggtaacaaggaagatgctgagaaggaagtagctatttctaccttctcatccagtaaccaggtatcctgcccgctatgtgaccaatgctttccacccacaaagattgaacgacatgccatgtactgcaatggtctgatggaggaagatacagtattgactcggagacaaaaagaggccaagaccaagagtgacagtgggacagctgcccagacttctctagacattgacaagaatgagaagtgttacctctgtaaatccctggtcccatttagagagtatcagtgtcatgtggactcctgtctccagcttgcaaaggctgaccaaggagatggacctgaagggagtggaagagcatgttcaactgtggaggggaagtggcagcagaggctgaagaacccaaaggaaaaaggccacagtgaaggccgactccttagtttcttggaacagtctgagcacaagacttcagatgcagacatcaagtcttcagaaacaggagccttcagggtgccttcaccagggatggaagaggcaggctgcagcagagagatgcagagttctttcacacgtcgtgacttaaatgaatctcccgtcaagtcttttgtttccatttcagaagccacagattgcttagtggactttaaaaagcaagttactgtccagccaggtagtcggacacggaccaaagctggcagaggaagaaggagaaaattctgaatttctagggtccaaaagttgacaaaaccattagtaggaggggtgggccatgttcattaagccatagtggtccctagttcattgttgagcaagttttagccctgcagttttcaccaccagcacctacccagcattctggtttttatgttttttatgatctatgcagacaactgtgtattctgttttataacagtttgtttgaatttacttacagttaaaaaatttaaatataaaaaaaaaaattcaactgcccgancgtttaccgtcggcttggc

SEQ ID NO: 427184 - DNA, 2485 bp, Homo sapiens
  misc_feature (2466)..(2466): n is a, c, g, or t
ggcttctccagatgccggggctgggtccttcccaaggttgagacaaaaggatgccacggagaaagaaaaaagttaaagaagtctccgaatctcggaacctggagaagaaggatgtggaaactaccagttctgtcagtgtgaagaggaagcgtagacttgaggatgcattcattgtgatatccgatagtgatggagaggaaccaaaggaggaaaatgggttgcagaaaacgaagacaaaacagtcgaatagagcaaagtgtttggccaaaagaaaaatcgcacagatgacagaagaagaacagtttgctctggctctcaaaatgagtgagcaggaagctagggaggtgaacagccaggaggaggaagaagaggagctcttgaggaaagccattgctgaaagcctgaatagttgccggccttctgatgcttccgctaccagatctcgacctctggccactggaccgtcttcccagtcccatcaagagaaaaccacagactctgggctcactgaaggcatatggcagctggtacctccatcactgtttaaaggctcacatatcagtcagggaaacgaggctgaggaaagagaggagccttgggaccacactgaaaaaactgaagaggagccggtctctggcagctcaggaagctgggaccagtcaagccagccagtgtttgagaatgtgaacgttaaatcttttgacagatgtactggccactcggctgagcacacacagtgtgggaagccacaggaaagtactgggaggggttctgcttttctcaaagctgtccagggtagcggggacacatctaggcactgtctacctaccctagcagatgccaaaggtctccaggacactgggggcactgtgaactatttctggggtattccattctgccctgatggagtagaccctaaccagtataccaaggtcattctctgccagttggaggtttatcaaaagagcctgaaaatggctcagaggcagctccttaataaaaaaggttttggggaaccagtgttacctagacctccttctctgatccagaatgaatgtggccaaggagagcaggctagtgagaaaaatgaatgcatctcagaagatatgggagatgaagacaaagaggagaggcaggagtctagggcatctgactggcactcaaaaaccaaggatttccaggaaagctcaattaaaagcttgaaagagaaacttttgttggaggaagaaccaacaaccagtcatggtcagtcttcccaagggattgttgaagaaacttctgaagagggaaactctgtacctgcttcacaaagtgttgctgctttgaccagtaagagaagcttagtccttatgccagagagttctgcagaagaaatcactgtttgtcctgagacacagctaagttcctctgaaacttttgaccttgaaagagaagtctctccaggtagcagagatatcttggatggagtcagaataataatggcagataaggaggttggtaacaaggaagatgctgagaaggaagtagctatttctaccttctcatccagtaaccaggtatcctgcccgctatgtgaccaatgctttccacccacaaagattgaacgacatgccatgtactgcaatggtctgatggaggaagatacagtattgactcggagacaaaaagaggccaagaccaagagtgacagtgggacagctgcccagacttctctagacattgacaagaatgagaagtgttacctctgtaaatccctggtcccatttagagagtatcagtgtcatgtggactcctgtctccagcttgcaaaggctgaccaaggagatggacctgaagggagtggaagagcatgttcaactgtggaggggaagtggcagcagaggctgaagaacccaaaggaaaaaggccacagtgaaggccgactccttagtttcttggaacagtctgagcacaagacttcagatgcagacatcaagtcttcagaaacaggagccttcagggtgccttcaccagggatggaagaggcaggctgcagcagagagatgcagagttctttcacacgtcgtgacttaaatgaatctcccgtcaagtcttttgtttccatttcagaagccacagattgcttagtggactttaaaaagcaagttactgtccagccaggtagtcggacacggaccaaagctggcagaggaagaaggagaaaattctgaatttctagggtccaaaagttgacaaaaccattagtaggaggggtgggccatgttcattaagccatagtggtccctagttcattgttgagcaagttttagccctgcagttttcaccaccagcacctacccagcattctggtttttatgttttttatgatctatgcagacaactgtgtattctgttttataacagtttgtttgaatttacttacagttaaaaaatttaaatataaaaaaaaaaattcaactgcccgancgtttaccgtcggcttggc

SEQ ID NO: 427185 - DNA, 2797 bp, Homo sapiens
  misc_feature (2778)..(2778): n is a, c, g, or t
gtattttcagtagagactgggtttcaccatgttggccaggctggtctggaactcctgacctcaggtgatctgcctgcctcagcctcccaaagtgctgggattacaagcattagccacctcgcccagcctgaaatgattttaaatgtgaaggatacttgccagtggcaggtcctgaaccatctttttatgccatttgcctccctgttttaaaaaagggtttagtatagtgatctagtacaacactttgcacatagacattcagcatatgctgtgaaattaaattgagccatttacattttagaaagagaaagtcttatgaacggtggcctcccattttgtccttcctgtgacccttcatatatagttattttaataataaacctggtctggtatgggatcacttgtttcagagttgccggccttctgatgcttccgctaccagatctcgacctctggccactggaccgtcttcccagtcccatcaagagaaaaccacagactctgggctcactgaaggcatgtctccctgttctgactccttccattcatcaagtataactgtaccacagggatctcatgctgagagtagatacacggaaataccccagatccttttggtgataataaagaagttaaatcaggaagtagttgagatcataagaatatccggcatacttttatctccaaggaaaaaccaacatttggttaaacccaaagaagagcctttcttacccatattatgtaattcttggtaagtgataacttaccaagccctcttaataaaaaagtttgtccttagccctactttttctcaaatacctacaggcatatggcagctggtacctccatcactgtttaaaggctcacatatcagtcagggaaacgaggctgaggaaagagaggagccttgggaccacactgaaaaaactgaagaggagccggtctctggcagctcaggaagctgggaccagtcaagccagccagtgtttgagaatgtgaacgttaaatcttttgacagatgtactggccactcggctgagcacacacagtgtgggaagccacaggaaagtactgggaggggttctgcttttctcaaagctgtccagggtagcggggacacatctaggcactgtctacctaccctagcagatgccaaaggtctccaggacactgggggcactgtgaactatttctggggtattccattctgccctgatggagtagaccctaaccagtataccaaggtcattctctgccagttggaggtttatcaaaagagcctgaaaatggctcagaggcagctccttaataaaaaaggttttggggaaccagtgttacctagacctccttctctgatccagaatgaatgtggccaaggagagcaggctagtgagaaaaatgaatgcatctcagaagatatgggagatgaagacaaagaggagaggcaggagtctagggcatctgactggcactcaaaaaccaaggatttccaggaaagctcaattaaaagcttgaaagagaaacttttgttggaggaagaaccaacaaccagtcatggtcagtcttcccaagggattgttgaagaaacttctgaagagggaaactctgtacctgcttcacaaagtgttgctgctttgaccagtaagagaagcttagtccttatgccagagagttctgcagaagaaatcactgtttgtcctgagacacagctaagttcctctgaaacttttgaccttgaaagagaagtctctccaggtagcagagatatcttggatggagtcagaataataatggcagataaggaggttggtaacaaggaagatgctgagaaggaagtagctatttctaccttctcatccagtaaccaggtatcctgcccgctatgtgaccaatgctttccacccacaaagattgaacgacatgccatgtactgcaatggtctgatggaggaagatacagtattgactcggagacaaaaagaggccaagaccaagagtgacagtgggacagctgcccagacttctctagacattgacaagaatgagaagtgttacctctgtaaatccctggtcccatttagagagtatcagtgtcatgtggactcctgtctccagcttgcaaaggctgaccaaggagatggacctgaagggagtggaagagcatgttcaactgtggaggggaagtggcagcagaggctgaagaacccaaaggaaaaaggccacagtgaaggccgactccttagtttcttggaacagtctgagcacaagacttcagatgcagacatcaagtcttcagaaacaggagccttcagggtgccttcaccagggatggaagaggcaggctgcagcagagagatgcagagttctttcacacgtcgtgacttaaatgaatctcccgtcaagtcttttgtttccatttcagaagccacagattgcttagtggactttaaaaagcaagttactgtccagccaggtagtcggacacggaccaaagctggcagaggaagaaggagaaaattctgaatttctagggtccaaaagttgacaaaaccattagtaggaggggtgggccatgttcattaagccatagtggtccctagttcattgttgagcaagttttagccctgcagttttcaccaccagcacctacccagcattctggtttttatgttttttatgatctatgcagacaactgtgtattctgttttataacagtttgtttgaatttacttacagttaaaaaatttaaatataaaaaaaaaaattcaactgcccgancgtttaccgtcggcttggc

SEQ ID NO: 427186 - DNA, 1537 bp, Homo sapiens
  misc_feature (1518)..(1518): n is a, c, g, or t
ttaattggcagcaacactctggtgaggcaattgttaatacccattttaagatgaggaaagagattcagatgtcatttacccaatcacaaatttagtaagtgatttagttctgatttaaataccagtcttctgactttacaggatgtgcttgttttattgacacttactggcttatggaaaatattttcttcttattgttaattgttgagggagaacattgaacaattaaatttttttaaaaaaggaagagaagccagttcacctgtgcctgtatatttaagatactacgtatttctttgcagtcttcccaagggattgttgaagaaacttctgaagagggaaactctgtacctgcttcacaaagtgttgctgctttgaccagtaagagaagcttagtccttatgccagagagttctgcagaagaaatcactgtttgtcctgagacacagctaagttcctctgaaacttttgaccttgaaagagaagtctctccaggtagcagagatatcttggatggagtcagaataataatggcagataaggaggttggtaacaaggaagatgctgagaaggaagtagctatttctaccttctcatccagtaaccaggtatcctgcccgctatgtgaccaatgctttccacccacaaagattgaacgacatgccatgtactgcaatggtctgatggaggaagatacagtattgactcggagacaaaaagaggccaagaccaagagtgacagtgggacagctgcccagacttctctagacattgacaagaatgagaagtgttacctctgtaaatccctggtcccatttagagagtatcagtgtcatgtggactcctgtctccagcttgcaaaggctgaccaaggagatggacctgaagggagtggaagagcatgttcaactgtggaggggaagtggcagcagaggctgaagaacccaaaggaaaaaggccacagtgaaggccgactccttagtttcttggaacagtctgagcacaagacttcagatgcagacatcaagtcttcagaaacaggagccttcagggtgccttcaccagggatggaagaggcaggctgcagcagagagatgcagagttctttcacacgtcgtgacttaaatgaatctcccgtcaagtcttttgtttccatttcagaagccacagattgcttagtggactttaaaaagcaagttactgtccagccaggtagtcggacacggaccaaagctggcagaggaagaaggagaaaattctgaatttctagggtccaaaagttgacaaaaccattagtaggaggggtgggccatgttcattaagccatagtggtccctagttcattgttgagcaagttttagccctgcagttttcaccaccagcacctacccagcattctggtttttatgttttttatgatctatgcagacaactgtgtattctgttttataacagtttgtttgaatttacttacagttaaaaaatttaaatataaaaaaaaaaattcaactgcccgancgtttaccgtcggcttggc

SEQ ID NO: 427187 - DNA, 1728 bp, Homo sapiens
  misc_feature (1709)..(1709): n is a, c, g, or t
aaactagctaggtacgaggctggtgttaaatcggcagaggcctccccctccccccgcgctcccaacgtgtggcggctcgcgacccccggcaacccggagaaggtctacagagcggcctgcgccagcgaacaaaaggatgccacggagaaagaaaaaagttaaagaagtctccgaatctcggaacctggagaagaaggatgtggaaactaccagttctgtcagtgtgaagaggaagcgtagacttgaggatgcattcattgtgatatccgatagtgatggagaggaaccaaaggaggaaaatgggttgcagaaaacgaagacaaaacagtcgaatagagcaaagtgtttggccaaaagaaaaatcgcacagatgacagaagaagaacagtttgctctggctctcaaaatgagtgagcaggaagctagggaggtgaacagccaggaggaggaagaagaggagctcttgaggaaagccattgctgaaagcctgaattcttcccaagggattgttgaagaaacttctgaagagggaaactctgtacctgcttcacaaagtgttgctgctttgaccagtaagagaagcttagtccttatgccagagagttctgcagaagaaatcactgtttgtcctgagacacagctaagttcctctgaaacttttgaccttgaaagagaagtctctccaggtagcagagatatcttggatggagtcagaataataatggcagataaggaggttggtaacaaggaagatgctgagaaggaagtagctatttctaccttctcatccagtaaccaggtatcctgcccgctatgtgaccaatgctttccacccacaaagattgaacgacatgccatgtactgcaatggtctgatggaggaagatacagtattgactcggagacaaaaagaggccaagaccaagagtgacagtgggacagctgcccagacttctctagacattgacaagaatgagaagtgttacctctgtaaatccctggtcccatttagagagtatcagtgtcatgtggactcctgtctccagcttgcaaaggctgaccaaggagatggacctgaagggagtggaagagcatgttcaactgtggaggggaagtggcagcagaggctgaagaacccaaaggaaaaaggccacagtgaaggccgactccttagtttcttggaacagtctgagcacaagacttcagatgcagacatcaagtcttcagaaacaggagccttcagggtgccttcaccagggatggaagaggcaggctgcagcagagagatgcagagttctttcacacgtcgtgacttaaatgaatctcccgtcaagtcttttgtttccatttcagaagccacagattgcttagtggactttaaaaagcaagttactgtccagccaggtagtcggacacggaccaaagctggcagaggaagaaggagaaaattctgaatttctagggtccaaaagttgacaaaaccattagtaggaggggtgggccatgttcattaagccatagtggtccctagttcattgttgagcaagttttagccctgcagttttcaccaccagcacctacccagcattctggtttttatgttttttatgatctatgcagacaactgtgtattctgttttataacagtttgtttgaatttacttacagttaaaaaatttaaatataaaaaaaaaaattcaactgcccgancgtttaccgtcggcttggc

SEQ ID NO: 427188 - DNA, 1839 bp, Homo sapiens
  misc_feature (1820)..(1820): n is a, c, g, or t
aaactagctaggtacgaggctggtgttaaatcggcagaggcctccccctccccccgcgctcccaacgtgtggcggctcgcgacccccggcaacccggagaaggtctacagagcggcctgcgccagcgagtgagtacccgccgcctgcgcacagctccgcccacccctccctgcctccttttcttcctcagcgggtccgcggcccgctactctccgggaggggcgcttcccgacgccaagacaaaaggatgccacggagaaagaaaaaagttaaagaagtctccgaatctcggaacctggagaagaaggatgtggaaactaccagttctgtcagtgtgaagaggaagcgtagacttgaggatgcattcattgtgatatccgatagtgatggagaggaaccaaaggaggaaaatgggttgcagaaaacgaagacaaaacagtcgaatagagcaaagtgtttggccaaaagaaaaatcgcacagatgacagaagaagaacagtttgctctggctctcaaaatgagtgagcaggaagctagggaggtgaacagccaggaggaggaagaagaggagctcttgaggaaagccattgctgaaagcctgaattcttcccaagggattgttgaagaaacttctgaagagggaaactctgtacctgcttcacaaagtgttgctgctttgaccagtaagagaagcttagtccttatgccagagagttctgcagaagaaatcactgtttgtcctgagacacagctaagttcctctgaaacttttgaccttgaaagagaagtctctccaggtagcagagatatcttggatggagtcagaataataatggcagataaggaggttggtaacaaggaagatgctgagaaggaagtagctatttctaccttctcatccagtaaccaggtatcctgcccgctatgtgaccaatgctttccacccacaaagattgaacgacatgccatgtactgcaatggtctgatggaggaagatacagtattgactcggagacaaaaagaggccaagaccaagagtgacagtgggacagctgcccagacttctctagacattgacaagaatgagaagtgttacctctgtaaatccctggtcccatttagagagtatcagtgtcatgtggactcctgtctccagcttgcaaaggctgaccaaggagatggacctgaagggagtggaagagcatgttcaactgtggaggggaagtggcagcagaggctgaagaacccaaaggaaaaaggccacagtgaaggccgactccttagtttcttggaacagtctgagcacaagacttcagatgcagacatcaagtcttcagaaacaggagccttcagggtgccttcaccagggatggaagaggcaggctgcagcagagagatgcagagttctttcacacgtcgtgacttaaatgaatctcccgtcaagtcttttgtttccatttcagaagccacagattgcttagtggactttaaaaagcaagttactgtccagccaggtagtcggacacggaccaaagctggcagaggaagaaggagaaaattctgaatttctagggtccaaaagttgacaaaaccattagtaggaggggtgggccatgttcattaagccatagtggtccctagttcattgttgagcaagttttagccctgcagttttcaccaccagcacctacccagcattctggtttttatgttttttatgatctatgcagacaactgtgtattctgttttataacagtttgtttgaatttacttacagttaaaaaatttaaatataaaaaaaaaaattcaactgcccgancgtttaccgtcggcttggc

SEQ ID NO: 427189 - DNA, 653 bp, Homo sapiens
  misc_feature (634)..(634): n is a, c, g, or t
tggggatctgtgctacctggataggcctgatgagaagcagtgcctagagcacagaagcaaaagatcagtgagaagtgctatgattaccaacactactaccaacattattattttttcttttatatcacagatgcagacatcaagtcttcagaaacaggagccttcagggtgccttcaccagggatggaagaggcaggctgcagcagagagatgcagagttctttcacacgtcgtgacttaaatgaatctcccgtcaagtcttttgtttccatttcagaagccacagattgcttagtggactttaaaaagcaagttactgtccagccaggtagtcggacacggaccaaagctggcagaggaagaaggagaaaattctgaatttctagggtccaaaagttgacaaaaccattagtaggaggggtgggccatgttcattaagccatagtggtccctagttcattgttgagcaagttttagccctgcagttttcaccaccagcacctacccagcattctggtttttatgttttttatgatctatgcagacaactgtgtattctgttttataacagtttgtttgaatttacttacagttaaaaaatttaaatataaaaaaaaaaattcaactgcccgancgtttaccgtcggcttggc

SEQ ID NO: 427190 - DNA, 614 bp, Homo sapiens
  misc_feature (595)..(595): n is a, c, g, or t
atggagtaactgtttcagtgtaaagatatgttagttccacatatgaaggcgaatccttagtacttggaacagtctgagcacaagacttcagatgcagacatcaagtcttcagaaacaggagccttcagggtgccttcaccagggatggaagaggcaggctgcagcagagagatgcagagttctttcacacgtcgtgacttaaatgaatctcccgtcaagtcttttgtttccatttcagaagccacagattgcttagtggactttaaaaagcaagttactgtccagccaggtagtcggacacggaccaaagctggcagaggaagaaggagaaaattctgaatttctagggtccaaaagttgacaaaaccattagtaggaggggtgggccatgttcattaagccatagtggtccctagttcattgttgagcaagttttagccctgcagttttcaccaccagcacctacccagcattctggtttttatgttttttatgatctatgcagacaactgtgtattctgttttataacagtttgtttgaatttacttacagttaaaaaatttaaatataaaaaaaaaaattcaactgcccgancgtttaccgtcggcttggc

SEQ ID NO: 427191 - DNA, 1874 bp, Homo sapiens
aaactagctaggtacgaggctggtgttaaatcggcagaggcctccccctccccccgcgctcccaacgtgtggcggctcgcgacccccggcaacccggagaaggtctacagagcggcctgcgccagcgaacaaaaggatgccacggagaaagaaaaaagttaaagaagtctccgaatctcggaacctggagaagaaggatgtggaaactaccagttctgtcagtgtgaagaggaagcgtagacttgaggatgcattcattgtgatatccgatagtgatggagaggaaccaaaggaggaaaatgggttgcagaaaacgaagacaaaacagtcgaatagagcaaagtgtttggccaaaagaaaaatcgcacagatgacagaagaagaacagtttgctctggctctcaaaatgagtgagcaggaagctagggaggtgaacagccaggaggaggaagaagaggagctcttgaggaaagccattgctgaaagcctgaatagttgccggccttctgatgcttccgctaccagatctcgacctctggccactggaccgtcttcccagtcccatcaagagaaaaccacagactctgggctcactgaaggcatatggcagctggtacctccatcactgtttaaaggctcacatatcagtcagggaaacgaggctgaggaaagagaggagccttgggaccacactgaaaaaactgaagaggagccggtctctggcagctcaggaagctgggaccagtcaagccagccagtgtttgagaatgtgaacgttaaatcttttgacagatgtactggccactcggctgagcacacacagtgtgggaagccacaggaaagtactgggaggggttctgcttttctcaaagctgtccagggtagcggggacacatctaggcactgtctacctaccctagcagatgccaaaggtctccaggacactgggggcactgtgaactatttctggggtattccattctgccctgatggagtagaccctaaccagtataccaaggtcattctctgccagttggaggtttatcaaaagagcctgaaaatggctcagaggcagctccttaataaaaaaggttttggggaaccagtgttacctagacctccttctctgatccagaatgaatgtggccaaggagagcaggctagtgagaaaaatgaatgcatctcagaagatatgggagatgaagacaaagaggagaggcaggagtctagggcatctgactggcactcaaaaaccaaggatttccaggaaagctcaattaaaagcttgaaagagaaacttttgttggaggaagaaccaacaaccagtcatggtcagtcttcccaagggattgttgaagaaacttctgaagagggaaactctgtacctgcttcacaaagtgttgctgctttgaccagtaagagaagcttagtccttatgccagagagttctgcagaagaaatcactgtttgtcctgagacacagctaagttcctctgaaacttttgaccttgaaagagaagtctctccaggtagcagagatatcttggatggagtcagaataataatggcagataaggaggttggtaacaaggaagatgctgagaaggaagtagctatttctaccttctcatccagtaaccaggtatcctgcccgctatgtgaccaatgctttccacccacaaagattgaacgacatgccatgtactgcaatggtctgatggaggaagatacaggtaaagacccagcaggacagccaaactcttacttttttgtgtggtggttttataatcctatacattacatgcagggaaaaaaacatagctgttcttcaaagttaaagttgttgttggtcttgggtactactgctttggcga

SEQ ID NO: 427192 - DNA, 1568 bp, Homo sapiens
  misc_feature (1483)..(1484): n is a, c, g, or t
  misc_feature (1498)..(1498): n is a, c, g, or t
  misc_feature (1501)..(1501): n is a, c, g, or t
aaactagctaggtacgaggctggtgttaaatcggcagaggcctccccctccccccgcgctcccaacgtgtggcggctcgcgacccccggcaacccggagaaggtctacagagcggcctgcgccagcgaacaaaaggatgccacggagaaagaaaaaagttaaagaagtctccgaatctcggaacctggagaagaaggatgtggaaactaccagttctgtcagtgtgaagaggaagcgtagacttgaggatgcattcattgtgatatccgatagtgatggagaggaaccaaaggaggaaaatgggttgcagaaaacgaagacaaaacagtcgaatagagcaaagtgtttggccaaaagaaaaatcgcacagatgacagaagaagaacagtttgctctggctctcaaaatgagtgagcaggaagctagggaggtgaacagccaggaggaggaagaagaggagctcttgaggaaagccattgctgaaagcctgaatagttgccggccttctgatgcttccgctaccagatctcgacctctggccactggaccgtcttcccagtcccatcaagagaaaaccacagactctgggctcactgaaggcatatggcagctggtacctccatcactgtttaaaggctcacatatcagtcagggaaacgaggctgaggaaagagaggagccttgggaccacactgaaaaaactgaagaggagccggtctctggcagctcaggaagctgggaccagtcaagccagccagtgtttgagaatgtgaacgttaaatcttttgacagatgtactggccactcggctgagcacacacagtgtgggaagccacaggaaagtactgggaggggttctgcttttctcaaagctgtccagggtagcggggacacatctaggcactgtctacctaccctagcagatgccaaaggtctccaggacactgggggcactgtgaactatttctggggtattccattctgccctgatggagtagaccctaaccagtataccaaggtcattctctgccagttggaggtttatcaaaagagcctgaaaatggctcagaggcagctccttaataaaaaaggttttggggaaccagtgttacctagacctccttctctgatccagaatgaatgtggccaaggagagcaggctagtgagaaaaatgaatgcatctcagaagatatgggagatgaagacaaagaggagaggcaggagtctagggcatctgactggcactcaaaaaccaaggatttccaggaaagctcaattaaaagcttgaaagagaaacttttgttggaggaagaaccaacaaccagtcatggtcagtcttcccaagggattgttgaagaaacttctgaagagggaaactctgtacctgcttcacaaagtgttgctgctttgaccagtaagagaagcttagtccttatgccagagagttctgcagaagaaatcactgtttgtcctgagaccagnnagtccttgaattgnctngaagagagttctcaggtacgagatctgggtgggtcgagacacgggatcagggggacggaatgcaagg

SEQ ID NO: 427193 - DNA, 509 bp, Homo sapiens
  misc_feature (490)..(490): n is a, c, g, or t
tgaatttttttccttctctctagggtgccttcaccagggatggaagaggcaggctgcagcagagagatgcagagttctttcacacgtcgtgacttaaatgaatctcccgtcaagtcttttgtttccatttcagaagccacagattgcttagtggactttaaaaagcaagttactgtccagccaggtagtcggacacggaccaaagctggcagaggaagaaggagaaaattctgaatttctagggtccaaaagttgacaaaaccattagtaggaggggtgggccatgttcattaagccatagtggtccctagttcattgttgagcaagttttagccctgcagttttcaccaccagcacctacccagcattctggtttttatgttttttatgatctatgcagacaactgtgtattctgttttataacagtttgtttgaatttacttacagttaaaaaatttaaatataaaaaaaaaaattcaactgcccgancgtttaccgtcggcttggc

SEQ ID NO: 427194 - DNA, 616 bp, Homo sapiens
  misc_feature (597)..(597): n is a, c, g, or t
agtaaggaggctgagcgacccaatgacatggcactgtagatgcgactctcttattatctatggactagtactgaatagctatcatacagatagcagacgtcgctgtcttcagataacaggagtctttcgtggtgccttcaccagggatggaagaggcaggctgcagcagagagatgcagagttctttcacacgtcgtgacttaaatgaatctcccgtcaagtcttttgtttccatttcagaagccacagattgcttagtggactttaaaaagcaagttactgtccagccaggtagtcggacacggaccaaagctggcagaggaagaaggagaaaattctgaatttctagggtccaaaagttgacaaaaccattagtaggaggggtgggccatgttcattaagccatagtggtccctagttcattgttgagcaagttttagccctgcagttttcaccaccagcacctacccagcattctggtttttatgttttttatgatctatgcagacaactgtgtattctgttttataacagtttgtttgaatttacttacagttaaaaaatttaaatataaaaaaaaaaattcaactgcccgancgtttaccgtcggcttggc

SEQ ID NO: 427195 - DNA, 920 bp, Homo sapiens
  misc_feature (901)..(901): n is a, c, g, or t
caaaggctgaccaaggagatggacctgaagggagtggaagagcatgccatgtactgcaatggtctgatggaggaagatacagtattgactcggagacaaaaagaggccaagaccaagagtgacagtgggacagctgcccagacttctctagacattgacaagaatgagaagtgttacctctgtaaatccctggtcccatttagagagtatcagtgtcatgtggactcctgtctccagcttgcaaaggctgaccaaggagatggacctgaagggagtggaagagcatgttcaactgtggaggggaagtggcagcagaggctgaagaacccaaaggaaaaaggccacagtgaaggccgactccttagtttcttggaacagtctgagcacaagacttcagatgcagacatcaagtcttcagaaacaggagccttcagggtgccttcaccagggatggaagaggcaggctgcagcagagagatgcagagttctttcacacgtcgtgacttaaatgaatctcccgtcaagtcttttgtttccatttcagaagccacagattgcttagtggactttaaaaagcaagttactgtccagccaggtagtcggacacggaccaaagctggcagaggaagaaggagaaaattctgaatttctagggtccaaaagttgacaaaaccattagtaggaggggtgggccatgttcattaagccatagtggtccctagttcattgttgagcaagttttagccctgcagttttcaccaccagcacctacccagcattctggtttttatgttttttatgatctatgcagacaactgtgtattctgttttataacagtttgtttgaatttacttacagttaaaaaatttaaatataaaaaaaaaaattcaactgcccgancgtttaccgtcggcttggc

SEQ ID NO: 427196 - DNA, 1770 bp, Homo sapiens
aaactagctaggtacgaggctggtgttaaatcggcagaggcctccccctccccccgcgctcccaacgtgtggcggctcgcgacccccggcaacccggagaaggtctacagagcggcctgcgccagcgaacaaaaggatgccacggagaaagaaaaaagttaaagaagtctccgaatctcggaacctggagaagaaggatgtggaaactaccagttctgtcagtgtgaagaggaagcgtagacttgaggatgcattcattgtgatatccgatagtgatggagaggaaccaaaggaggaaaatgggttgcagaaaacgaagacaaaacagtcgaatagagcaaagtgtttggccaaaagaaaaatcgcacagatgacagaagaagaacagtttgctctggctctcaaaatgagtgagcaggaagctagggaggtgaacagccaggaggaggaagaagaggagctcttgaggaaagccattgctgaaagcctgaatagttgccggccttctgatgcttccgctaccagatctcgacctctggccactggaccgtcttcccagtcccatcaagagaaaaccacagactctgggctcactgaaggcatatggcagctggtacctccatcactgtttaaaggctcacatatcagtcagggaaacgaggctgaggaaagagaggagccttgggaccacactgaaaaaactgaagaggagccggtctctggcagctcaggaagctgggaccagtcaagccagccagtgtttgagaatgtgaacgttaaatcttttgacagatgtactggccactcggctgagcacacacagtgtgggaagccacaggaaagtactgggaggggttctgcttttctcaaagctgtccagggtagcggggacacatctaggcactgtctacctaccctagcagatgccaaaggtctccaggacactgggggcactgtgaactatttctggggtattccattctgccctgatggagtagaccctaaccagtataccaaggtcattctctgccagttggaggtttatcaaaagagcctgaaaatggctcagaggcagctccttaataaaaaaggttttggggaaccagtgttacctagacctccttctctgatccagaatgaatgtggccaaggagagcaggctagtgagaaaaatgaatgcatctcagaagatatgggagatgaagacaaagaggagaggcaggagtctagggcatctgactggcactcaaaaaccaaggatttccaggaaagctcaattaaaagcttgaaagagaaacttttgttggaggaagaaccaacaaccagtcatggtcagtcttcccaagggattgttgaagaaacttctgaagagggaaactctgtacctgcttcacaaagtgttgctgctttgaccagtaagagaagcttagtccttatgccagagagttctgcagaagaaatcactgtttgtcctgagacacagctaagttcctctgaaacttttgaccttgaaagagaagtctctccaggtagcagagatatcttggatggagtcagaataataatggcagataaggaggtgtggtaacaggaagatggtgggaacgaacgtagttattgtacctgctcatcaagtaaccagttctgggcggatgtgaccaagtttcagcaaagttggagaatgcagctgaagggcggggcggaaaaatggtggggacaaaggcgcagggggggatgtcatttattgaagaggtggtacggaaatgtggc

SEQ ID NO: 427197 - DNA, 1494 bp, Homo sapiens
aaactagctaggtacgaggctggtgttaaatcggcagaggcctccccctccccccgcgctcccaacgtgtggcggctcgcgacccccggcaacccggagaaggtctacagagcggcctgcgccagcgaacaaaaggatgccacggagaaagaaaaaagttaaagaagtctccgaatctcggaacctggagaagaaggatgtggaaactaccagttctgtcagtgtgaagaggaagcgtagacttgaggatgcattcattgtgatatccgatagtgatggagaggaaccaaaggaggaaaatgggttgcagaaaacgaagacaaaacagtcgaatagagcaaagtgtttggccaaaagaaaaatcgcacagatgacagaagaagaacagtttgctctggctctcaaaatgagtgagcaggaagctagggaggtgaacagccaggaggaggaagaagaggagctcttgaggaaagccattgctgaaagcctgaatagttgccggccttctgatgcttccgctaccagatctcgacctctggccactggaccgtcttcccagtcccatcaagagaaaaccacagactctgggctcactgaaggcatatggcagctggtacctccatcactgtttaaaggctcacatatcagtcagggaaacgaggctgaggaaagagaggagccttgggaccacactgaaaaaactgaagaggagccggtctctggcagctcaggaagctgggaccagtcaagccagccagtgtttgagaatgtgaacgttaaatcttttgacagatgtactggccactcggctgagcacacacagtgtgggaagccacaggaaagtactgggaggggttctgcttttctcaaagctgtccagggtagcggggacacatctaggcactgtctacctaccctagcagatgccaaaggtctccaggacactgggggcactgtgaactatttctggggtattccattctgccctgatggagtagaccctaaccagtataccaaggtcattctctgccagttggaggtttatcaaaagagcctgaaaatggctcagaggcagctccttaataaaaaaggttttggggaaccagtgttacctagacctccttctctgatccagaatgaatgtggccaaggagagcaggctagtgagaaaaatgaatgcatctcagaagatatgggagatgaagacaaagaggagaggcaggagtctagggcatctgactggcactcaaaaaccaaggatttccaggaaagctcaattaaaagcttgaaagagaaacttttgttggaggaagaaccaacaaccagtcatggtcaggtaagggtcagtgatgctgtaattaaggatgatttattcacagattaaaacaaggattattttagctgttatttttgtggtcttcccctccttgattattaaagtaatacatgttcactatagaaaattaggaaagtacaggagagtataaaaaaaaa

SEQ ID NO: 427198 - DNA, 472 bp, Homo sapiens
ccccacagaggtgtctactagaccatcttccgctaagaattggtaataaagagaaagaactcagcattttctaagaggtaacaaagaagtggaaacacagacaaaaataaagaaaaaaagaacaacagcatactaaagccaaggtgccactgcccacaggttctggggagaccagcaaacagcatgtggaggtctgatgggagcaagacgcatcttctcccatcaggaaacattatgctaagctttttaactcattgctctaatcgtgtcactaaaattttaaacttaacacaagaatcaggttctcttatccttgtctttcatgcaacataccagtctgcttgggattcccaaacgtaatttaaagaaaggttctactaccttaatcatggaataaagagaggtggcaaaattcttcctaaactccttcctgatgttaaacagatcaatctcactcctggaaaccatgact

SEQ ID NO: 427199 - DNA, 316 bp, Homo sapiens
ctgtgtccgcgaacagggcattaagcaataacagacaagcacaatgactacgtctatggcctggacctcggtgtccagatgcctttctgcactaaaaggaacccaggcgctgtggagaagcagctgacgcaggcctgggaaagacatcaccgtgagcctgggacactgggccagaaaggatgcattcccaggaccacgtatggagtgaaaaggacacaggggccagcttggaaggggctcccaactagtcacatttatagctatttgagcatcacaaaacaaaaggctttactagattatgacatggaataaataa

SEQ ID NO: 427200 - DNA, 794 bp, Homo sapiens
ggctgcatagtattccatggtgtatatgtgccacattttcttaatccagtctatcattgatggacatttgggttggttccaagtctttgctattgtgaatagtgctgcaataaacgtacatgtacatttgtctttatagcagcataatttataatcctttgggtatatacccagtaatgggatggctgagtcaagatggtatttctagttctagatccctgaggaattgccacactgttttctacaatggttgaactagtttatagtcccaccaacagtgtaaaagtgttcctgtttctctacatcctctccagcacctgttgtttcctgactttttaatgatcagatagcctcctattttttaactatgagttggaatttgctgcttttgatatgataagaaagttcaaagtttctcttccttgctttgttgtgtgttctaattcttttctgcccatcccccagtaaagaaaaggctcagtatgatttcttgaatagattgtttaagctattttcaaaacaggacttggtcaggggcaggtagtcttaaatgttcagaagccactggatggaaaattgtgagcacataagtgtttttcttggtcaaccatgtcattttatagccaaagtttgacttgacatactggaattaatccacacgactttgaaaagaataaactctttaaaaagagagtgagcgctccgagggtgttatgagagtcactgtctgaaaccctattgatcatattgtggcagaagaaatagagtcctgccatgaattatacttttcaggt

SEQ ID NO: 427201 - DNA, 615 bp, Homo sapiens
  misc_feature (599)..(599): n is a, c, g, or t
ggctgcatagtattccatggtgtatatgtgccacattttcttaatccagtctatcattgatggacatttgggttggttccaagtctttgctattgtgaatagtgctgcaataaacgtacatgtacatttgtctttatagcagcataatttataatcctttgggtatatacccagtaatgggatggctgagtcaagatggtatttctagttctagatccctgaggaattgccacactgttttctacaatggttgaactagtttatagtcccaccaacagtgtaaaagtgttcctgtttctctacatcctctccagcacctgttgtttcctgactttttaatgatcagatagcctcctattttttaactatgagttggaatttgctgcttttgatatgataagaaagttcaaagtttctcttccttgctttgttgtgtgttctaattcttttctgcccatcccccagtaaagaaaaggctcagtatgatttcttgaatagattgtttaagctattttcaaaacaggacttggtcaggggcaggtagtcttaaatgttcagaagccactggatggaaaattgtgagcaaagatacttcttgnatagctgctgatgttg

SEQ ID NO: 427202 - DNA, 645 bp, Homo sapiens
agtaatgacttacaaattatttactgtcaaaactgtaacatagccatttcttttttttttccaccccaagactccatctcaaaaaaaaaaaaaaaagacttaacagagcatttcacggggaagggccatgagggaacatcacctgggtgatggtaacattctgtatcttgataaggatttgagttatacaagtatatacatctgtcaaaattcaaagaatgtacactcaagatctgtgcatttcattatatgtaaatgttacattaaaatgttgtaaacaaatattgaacaaatatacgcatgctaaagtatttaagaggaagtactggtgtctgcaaaacaaaaattttttttccattttctgtggtaaaatatacataatataaatgtattattttaagtgtacaattcagtggcattaaatacactcagaaagttgtgcaaacatcccatttattcatttccacagattttttaattctcattccaaacagaagccctgtacccaaagagcaataactccgcatcctccaatccccactctctggtaacctctattctactttctgcctctatgaatttgccaattctaggtacctcatataagtggaatacagtatttatccttttgtgtctggcttcttt

SEQ ID NO: 427203 - DNA, 2686 bp, Homo sapiens
ggctgcatagtattccatggtgtatatgtgccacattttcttaatccagtctatcattgatggacatttgggttggttccaagtctttgctattgtgaatagtgctgcaataaacgtacatgtacatttgtctttatagcagcataatttataatcctttgggtatatacccagtaatgggatggctgagtcaagatggtatttctagttctagatccctgaggaattgccacactgttttctacaatggttgaactagtttatagtcccaccaacagtgtaaaagtgttcctgtttctctacatcctctccagcacctgttgtttcctgactttttaatgatcagatagcctcctattttttaactatgagttggaatttgctgcttttgatatgataagaaagttcaaagtttctcttccttgctttgttgtgtgttctaattcttttctgcccatcccccagtaaagaaaaggctcagtatgatttcttgaatagattgtttaagctattttcaaaacaggacttggtcaggggcaggtagtcttaaatgttcagaagccactggatggaaaattgtgagcacataagtgtttttcttggtcaaccatgtcattttatagccaaagtttgacttgacatactggaattaatccacacgactttgaaaagaataaactctttaaaaagagagtgagcgctccgagggtgttatgagagtcactgtctgaaaccctattgatcatattgtggcagaagaaatagagtcctgccatgaattatacttttcaggttaaaaaaaaaaaaagcaatttgtaggacagtttgaataatttagtacaattgttaaaaatacagacatgcacattcctgtatgtgcatttttaaatgttcacgaatgatataagccagatatatttcttagaggtgcttgaaaaaagttatttcttcttgggctttattatctcaatttaaaaaaattaagatgcataattctcataagataacagattcagaagaatatagttcaagaaaaaaaattaaagaactcataaaggagaaggaggaggaggaagagagtgtgaaacaggagcctcagataacttggtaaaggcatgtctcccatttgggaactgatgttcctaagatccgcactgacgctgctcagccggtccatcacacagcaaaggcgtgaggaagggtcactgcccagctggactccagggtggtccacgcatgacagtcacaccgaaccttcatgaggatgtgaactgttggctccaatttaccattcccagcaattccactcagatatttgtatactaatgttcacagcagcgtgaactccacagcaggtggagtaatgttccattgtgtgcatatgccacattttgtttatccattcatctgttgatgcacatttcggttgttcccacctttgggctattattaataatgctgctgtgaacattcccaagagaaataggaagacggctttgctaagaactaaaaaagggatggacaacaagggcatatacccaggggcagtgttctatcatgacagctttactgagagcagagtagttctgctcagaatcagaacacttgttccctatagcccccctgattgccccacaaccaccaccgcatactccccttttcccaaccatgggcagcagattgagctattaacagaagtgtcctttcgctggatttctcaaccctttcctcatcgtccacatagagaaacagtaacagattgctactcacccaacacccaggtcaagtccaatgcaggtaggaataacagcaaatccttcaatttcttgattctgctcttaaaaatcttaacagaggccgggcacggtggctcacgcctgtaatgccagcattttgggaggccgaggcgggtggatcaccaagaccagcctggccaagatggtgaaaccccgtctccactaaaaatacaaaaattagccaggcgtggtggtgggcacctgtaatcccaggtactcgggaggctgaggcagagaattgcttgaacgcgggaggcagagactgcagtgagccgagatcacaccactgcactccagcccaggtgacagagcaagactccatctcaaaaaaaaaaaaaaaagacttaacagagcatttcacggggaagggccatgagggaacatcacctgggtgatggtaacattctgtatcttgataaggatttgagttatacaagtatatacatctgtcaaaattcaaagaatgtacactcaagatctgtgcatttcattatatgtaaatgttacattaaaatgttgtaaacaaatattgaacaaatatacgcatgctaaagtatttaagaggaagtactggtgtctgcaaaacaaaaattttttttccattttctgtggtaaaatatacataatataaatgtattattttaagtgtacaattcagtggcattaaatacactcagaaagttgtgcaaacatcccatttattcatttccacagattttttaattctcattccaaacagaagccctgtacccaaagagcaataactccgcatcctccaatccccactctctggtaacctctattctactttctgcctctatgaatttgccaattctaggtacctcatataagtggaatacagtatttatccttttgtgtctggcttcttt

SEQ ID NO: 427204 - DNA, 2628 bp, Homo sapiens
ggctgcatagtattccatggtgtatatgtgccacattttcttaatccagtctatcattgatggacatttgggttggttccaagtctttgctattgtgaatagtgctgcaataaacgtacatgtacatttgtctttatagcagcataatttataatcctttgggtatatacccagtaatgggatggctgagtcaagatggtatttctagttctagatccctgaggaattgccacactgttttctacaatggttgaactagtttatagtcccaccaacagtgtaaaagtgttcctgtttctctacatcctctccagcacctgttgtttcctgactttttaatgatcagatagcctcctattttttaactatgagttggaatttgctgcttttgatatgataagaaagttcaaagtttctcttccttgctttgttgtgtgttctaattcttttctgcccatcccccagtaaagaaaaggctcagtatgatttcttgaatagattgtttaagctattttcaaaacaggacttggtcaggggcaggtagtcttaaatgttcagaagccactggatggaaaattgtgagcacataagtgtttttcttggtcaaccatgtcattttatagccaaagtttgacttgacatactggaattaatccacacgactttgaaaagaataaactctttaaaaagagagtgagcgctccgagggtgttatgagagtcactgtctgaaaccctattgatcatattgtggcagaagaaatagagtcctgccatgaattatacttttcaggttaaaaaaaaaaaaagcaatttgtaggacagtttgaataatttagtacaattgttaaaaatacagacatgcacattcctgtatgtgcatttttaaatgttcacgaatgatataagccagatatatttcttagaggtgcttgaaaaaagttatttcttcttgggctttattatctcaatttaaaaaaattaagatgcataattctcataagataacagattcagaagaatatagttcaaggagcctcagataacttggtaaaggcatgtctcccatttgggaactgatgttcctaagatccgcactgacgctgctcagccggtccatcacacagcaaaggcgtgaggaagggtcactgcccagctggactccagggtggtccacgcatgacagtcacaccgaaccttcatgaggatgtgaactgttggctccaatttaccattcccagcaattccactcagatatttgtatactaatgttcacagcagcgtgaactccacagcaggtggagtaatgttccattgtgtgcatatgccacattttgtttatccattcatctgttgatgcacatttcggttgttcccacctttgggctattattaataatgctgctgtgaacattcccaagagaaataggaagacggctttgctaagaactaaaaaagggatggacaacaagggcatatacccaggggcagtgttctatcatgacagctttactgagagcagagtagttctgctcagaatcagaacacttgttccctatagcccccctgattgccccacaaccaccaccgcatactccccttttcccaaccatgggcagcagattgagctattaacagaagtgtcctttcgctggatttctcaaccctttcctcatcgtccacatagagaaacagtaacagattgctactcacccaacacccaggtcaagtccaatgcaggtaggaataacagcaaatccttcaatttcttgattctgctcttaaaaatcttaacagaggccgggcacggtggctcacgcctgtaatgccagcattttgggaggccgaggcgggtggatcaccaagaccagcctggccaagatggtgaaaccccgtctccactaaaaatacaaaaattagccaggcgtggtggtgggcacctgtaatcccaggtactcgggaggctgaggcagagaattgcttgaacgcgggaggcagagactgcagtgagccgagatcacaccactgcactccagcccaggtgacagagcaagactccatctcaaaaaaaaaaaaaaaagacttaacagagcatttcacggggaagggccatgagggaacatcacctgggtgatggtaacattctgtatcttgataaggatttgagttatacaagtatatacatctgtcaaaattcaaagaatgtacactcaagatctgtgcatttcattatatgtaaatgttacattaaaatgttgtaaacaaatattgaacaaatatacgcatgctaaagtatttaagaggaagtactggtgtctgcaaaacaaaaattttttttccattttctgtggtaaaatatacataatataaatgtattattttaagtgtacaattcagtggcattaaatacactcagaaagttgtgcaaacatcccatttattcatttccacagattttttaattctcattccaaacagaagccctgtacccaaagagcaataactccgcatcctccaatccccactctctggtaacctctattctactttctgcctctatgaatttgccaattctaggtacctcatataagtggaatacagtatttatccttttgtgtctggcttcttt

SEQ ID NO: 427205 - DNA, 1479 bp, Homo sapiens
cctgctctaaatcttgtctcggtctctcactctgccttatacccctcagttgaattatttcttctgaggaggcaagaactgaggctgctgcagactgatatggattcaccactgctaacacctcctggttggaactacaggaatagaactggaaagggaaaaaaggcagcattcaccacatcccaatcctgaatccaagagtctaagatagtcccccactcctatctcaggcttagaggattagattaatctcctggagggaagactcttccttgaaacatttttttttatctgcctgtagctattgggataattcgggaaatccacagggacagttcaagtcatctttgtcctctactttctgttgcactctcagccttgttctctttttagaaactgcatggtaactattatatagctaaagaagagcattctgacctctgccctgggacttcctggatcctcctcttcttataaatacaagggcagagctggtatcccggggagccaggaagcagtgagcccaggagtcctcggccagccctgcctgcccaccaggaggatgaaggtctccgtggctgccctctcctgcctcatgcttgttgctgtccttggatcccaggcccagttcacaaatgatgcagagacagagttaatgatgtcaaagcttccactggaaaatccagtagttctgaacagctttcactttgctgctgactgctgcacctcctacatctcacaaagcatcccgtgttcactcatgaaaagttattttgaaacgagcagcgagtgctccaagccaggtgtcatattcctcaccaagaaggggcggcaagtctgtgccaaacccagtggtccgggagttcaggattgcatgaaaaagctgaagccctactcaatataataataaagagacaaaagaggccagccacccacctccaacacctcctgagcctctgaagctcccaccaggccagctctcctcccacaacagcttcccacagcatgaagatctccgtggctgccattcccttcttcctcctcatcaccatcgccctagggaccaagactgaatcctcctcacaaactggggggaaaccgaaggttgttaaaatacagctaaagttggtggggggaccttaccacccctcagagtgctgcttcacctacactacctacaagatcccgcgtcagcggattatggattactatgagaccaacagccagtgctccaagcccggaattgtcttcatcaccaaaaggggccattccgtctgtaccaaccccagtgacaagtgggtccaggactatatcaaggacatgaaggagaactgagtgacccagaaggggtggcgaaggcacagctcagagacataaagagaagatgccaaggccccctcctccacccaccgctaactctcagccccagtcaccctcttggagcttccctgctttgaattaaagaccactcatgctctt

SEQ ID NO: 427206 - DNA, 1044 bp, Homo sapiens
cctgctctaaatcttgtctcggtctctcactctgccttatacccctcagttgaattatttcttctgaggaggcaagaactgaggctgctgcagactgatatggattcaccactgctaacacctcctggttggaactacaggaatagaactggaaagggaaaaaaggcagcattcaccacatcccaatcctgaatccaagagtctaagatagtcccccactcctatctcaggcttagaggattagattaatctcctggagggaagactcttccttgaaacatttttttttatctgcctgtagctattgggataattcgggaaatccacagggacagttcaagtcatctttgtcctctactttctgttgcactctcagccttgttctctttttagaaactgcatggtaactattatatagctaaagaagagcattctgacctctgccctgggacttcctggatcctcctcttcttataaatacaagggcagagctggtatcccggggagccaggaagcagtgagcccaggagtcctcggccagccctgcctgcccaccaggaggatgaaggtctccgtggctgccctctcctgcctcatgcttgttgctgtccttggatcccaggcccagttcacaaatgatgcagagacagagttaatgatgtcaaagcttccactggaaaatccagtagttctgaacagctttcactttgctgctgactgctgcacctcctacatctcacaaagcatcccgtgttcactcatgaaaagttattttgaaacgagcagcgagtgctccaagccaggtgtcatattcctcaccaagaaggggcggcaagtctgtgccaaacccagtggtccgggagttcaggattgcatgaaaaagctgaagccctactcaatataataataaagagacaaaagaggccagccacccacctccaacacctcctgtgagtttcttggtctgaaatacttaaaaaatatatatattgttgtgtctggtaatgaaagtaatgcatctaataaagagtattcaatttttta

SEQ ID NO: 427207 - DNA, 700 bp, Homo sapiens
caccctctagtctctagatgaacagatcctgaatgtccaggccccacgtggcctgttctaaggcctgagatggaattggatacaggacacatccagccttgagatcttttgctaagtgtgacacagtgcccccagccctgtgctcatgttcatgcctagggaaaggcttctatcaaaagagttgaacttcttcccactggggatggaagaccatttcctcccttaaaccttggctctccctgcttccttcaggccaccaacaacacatgtgcaggatatgaaattgctgaggcatcactgctttcctacttcccttccaagtctcagctcccttattttaaaaaatatttggcctcaatgatcatttctcaacaattcctcaccgcaggagcctctgaagctcccaccaggccagctctcctcccacaacagcttcccacagcatgaagatctccgtggctgccattcccttcttcctcctcatcaccatcgccctagggaccaagactgaatcctcctcacgtgagtgcaatgccttgtcttccttccaacctagagccctctccgatgtcatttgtcagctcagaggaacaaggtgggagagtataggagctctgactgggtctcaggaaacaggggccccttatgccgttctttggatcgtgaggatgctgcctggaatggagctggaaaacccgct

SEQ ID NO: 427208 - DNA, 474 bp, Homo sapiens
taccggcctccactaaaaagggaaattttggcccctcaaggggccaaaaaatttcggcccaagggtccaaagccaaaagttaattgaatgtcaaaagcttccactggaaaatccagtagttctgaacagctttcactttgctgctgactgctgcacctcctacatctcacaaagcatcccgtgttcactcatgaaaagttattttgaaacgagcagcgagtgctccaagccaggtgtcatattcctcaccaagaaggggcggcaagtctgtgccaaacccagtggtccgggagttcaggattgcatgaaaaagctgaagccctactcaatataataataaagagacaaaagaggccagccacccacctccaacacctcctgtgagtttcttggtctgaaatacttaaaaaatatatatattgttgtgtctggtaatgaaagtaatgcatctaataaagagtattcaatttttta

SEQ ID NO: 427209 - DNA, 869 bp, Homo sapiens
caccctctagtctctagatgaacagatcctgaatgtccaggccccacgtggcctgttctaaggcctgagatggaattggatacaggacacatccagccttgagatcttttgctaagtgtgacacagtgcccccagccctgtgctcatgttcatgcctagggaaaggcttctatcaaaagagttgaacttcttcccactggggatggaagaccatttcctcccttaaaccttggctctccctgcttccttcaggccaccaacaacacatgtgcaggatatgaaattgctgaggcatcactgctttcctacttcccttccaagtctcagctcccttattttaaaaaatatttggcctcaatgatcatttctcaacaattcctcaccgcaggagcctctgaagctcccaccaggccagctctcctcccacaacagcttcccacagcatgaagatctccgtggctgccattcccttcttcctcctcatcaccatcgccctagggaccaagactgaatcctcctcacggggaccttaccacccctcagagtgctgcttcacctacactacctacaagatcccgcgtcagcggattatggattactatgagaccaacagccagtgctccaagcccggaattgtcttcatcaccaaaaggggccattccgtctgtaccaaccccagtgacaagtgggtccaggactatatcaaggacatgaaggagaactgagtgacccagaaggggtggcgaaggcacagctcagagacataaagagaagatgccaaggccccctcctccacccaccgctaactctcagccccagtcaccctcttggagcttccctgctttgaattaaagaccactcatgctctt

SEQ ID NO: 427210 - DNA, 1114 bp, Homo sapiens
cctgctctaaatcttgtctcggtctctcactctgccttatacccctcagttgaattatttcttctgaggaggcaagaactgaggctgctgcagactgatatggattcaccactgctaacacctcctggttggaactacaggaatagaactggaaagggaaaaaaggcagcattcaccacatcccaatcctgaatccaagagtctaagatagtcccccactcctatctcaggcttagaggattagattaatctcctggagggaagactcttccttgaaacatttttttttatctgcctgtagctattgggataattcgggaaatccacagggacagttcaagtcatctttgtcctctactttctgttgcactctcagccttgttctctttttagaaactgcatggtaactattatatagctaaagaagagcattctgacctctgccctgggacttcctggatcctcctcttcttataaatacaagggcagagctggtatcccggggagccaggaagcagtgagcccaggagtcctcggccagccctgcctgcccaccaggaggatgaaggtctccgtggctgccctctcctgcctcatgcttgttgctgtccttggatcccaggcccagttcacaaatgatgcagagacagagttaatgatgtcaaagcttccactggaaaatccagtagttctgaacagctttcactttgctgctgactgctgcacctcctacatctcacaaagcatcccgtgttcactcatgaaaagttattttgaaacgagcagcgagtgctccaagccaggtgtcatattcctcaccaagaaggggcggcaagtctgtgccaaacccagtggtccgggagttcaggattgcatgaaaaagctgaagccctactcaatataataataaagagacaaaagaggccagccacccacctccaacacctcctgagcctctgaagctcccaccaggccagctctcctcccacaacagcttcccacagcatgaagatctccgtggctgccattcccctcctccacccaccgctaactctcagccccagtcaccctcttggagcttccctgctttgaattaaagaccactcatgctctt

SEQ ID NO: 427211 - DNA, 854 bp, Homo sapiens
gctcccaccaggccagctctcctcccacaacagcttcccacagcatgaagatctccgtggctgccattcccttcttcctcctcatcaccatcgccctagggaccaagactgaatcctcctcacgtgagtgcaatgccttgtcttccttccaacctagagcctgcagggaaataagcaggagtgaggttggggctcaggggaagaccaggagcagggactcagaaaggagggctggtatcttcttgaaattgtgtgtatagcaacattatataaatgaattatctactgagcaccacagcacttcaccccatggtgtggtgagcaggatggagatgagacttaggactgtaggttctgcttaagagtttaagttgggatcttccagccttgaccaatgagacttgacttgggagactccaggcttcattccactaccccaaatgccctctagtctccaaataaacagatcctgaatctccaggcctcacatggccttgatctcttatcattgccccccaggaccagtccccccttgccctcaaggacatggagtgagaccagcctgcctctctactccctcaatttctctctctttgccgctaagcaaaagagtggcccaccccatttggggtatatttcctcagggagattaggagcagtgtcttgagcccctcaagggcatttttctattggcctcctgaggtttgggcccagcctgcttccagcgtcacctgtgcccagtgagtgcagcattgcttgggtatgggctggggggaaacacgacagtgtggggtccatcctaggcccccttttctcagctgatttcttagaataagctgcctttagagataacc

SEQ ID NO: 427212 - DNA, 1431 bp, Homo sapiens
cctgctctaaatcttgtctcggtctctcactctgccttatacccctcagttgaattatttcttctgaggaggcaagaactgaggctgctgcagactgatatggattcaccactgctaacacctcctggttggaactacaggaatagaactggaaagggaaaaaaggcagcattcaccacatcccaatcctgaatccaagagtctaagatagtcccccactcctatctcaggcttagaggattagattaatctcctggagggaagactcttccttgaaacatttttttttatctgcctgtagctattgggataattcgggaaatccacagggacagttcaagtcatctttgtcctctactttctgttgcactctcagccttgttctctttttagaaactgcatggtaactattatatagctaaagaagagcattctgacctctgccctgggacttcctggatcctcctcttcttataaatacaagggcagagctggtatcccggggagccaggaagcagtgagcccaggagtcctcggccagccctgcctgcccaccaggaggatgaaggtctccgtggctgccctctcctgcctcatgcttgttgctgtccttggatcccaggcccagttcacaaatgatgcagagacagagttaatgatgtcaaagcttccactggaaaatccagtagttctgaacagctttcactttgctgctgactgctgcacctcctacatctcacaaagcatcccgtgttcactcatgaaaagttattttgaaacgagcagcgagtgctccaagccaggtgtcatattcctcaccaagaaggggcggcaagtctgtgccaaacccagtggtccgggagttcaggattgcatgaaaaagctgaagccctactcaatataataataaagagacaaaagaggccagccacccacctccaacacctcctgagcctctgaagctcccaccaggccagctctcctcccacaacagcttcccacagcatgaagatctccgtggctgccattcccttcttcctcctcatcaccatcgccctagggaccaagactgaatcctcctcacggggaccttaccacccctcagagtgctgcttcacctacactacctacaagatcccgcgtcagcggattatggattactatgagaccaacagccagtgctccaagcccggaattgtcttcatcaccaaaaggggccattccgtctgtaccaaccccagtgacaagtgggtccaggactatatcaaggacatgaaggagaactgagtgacccagaaggggtggcgaaggcacagctcagagacataaagagaagatgccaaggccccctcctccacccaccgctaactctcagccccagtcaccctcttggagcttccctgctttgaattaaagaccactcatgctctt

SEQ ID NO: 427213 - DNA, 1090 bp, Homo sapiens
cctgctctaaatcttgtctcggtctctcactctgccttatacccctcagttgaattatttcttctgaggaggcaagaactgaggctgctgcagactgatatggattcaccactgctaacacctcctggttggaactacaggaatagaactggaaagggaaaaaaggcagcattcaccacatcccaatcctgaatccaagagtctaagatagtcccccactcctatctcaggcttagaggattagattaatctcctggagggaagactcttccttgaaacatttttttttatctgcctgtagctattgggataattcgggaaatccacagggacagttcaagtcatctttgtcctctactttctgttgcactctcagccttgttctctttttagaaactgcatggtaactattatatagctaaagaagagcattctgacctctgccctgggacttcctggatcctcctcttcttataaatacaagggcagagctggtatcccggggagccaggaagcagtgagcccaggagtcctcggccagccctgcctgcccaccaggaggatgaaggtctccgtggctgccctctcctgcctcatgcttgttgctgtccttggatcccaggcccagttcacaaatgatgcagagacagagttaatgatgtcaaagcttccactggaaaatccagtagttctgaacagctttcactttgctgctgactgctgcacctcctacatctcacaaagcatcccgtgttcactcatgaaaagttattttgaaacgagcagcgagtgctccaagccaggtgtcatattcctcaccaagaaggggcggcaagtctgtgccaaacccagtggtccgggagttcaggattgcatgaaaaagctgaagccctactcaatataataataaagagacaaaagaggccagccacccacctccaacacctcctgtgagtttcttggtctgaaatacttaaaaaatatatatattgttgtgtctggtaatgaaagtaatgcatctaataaagagtattcaattttttaactttgcttgagttttaagaggaaataaactaatataaaactgaag

SEQ ID NO: 427214 - DNA, 416 bp, Homo sapiens
tgcaggagcagccaatggtatggcctttaacaaggggcccctcctcagcatctgatgctctctcctcagggggaccttaccacccctcagagtgctgcttcacctacactacctacaagatcccgcgtcagcggattatggattactatgagaccaacagccagtgctccaagcccggaattgtcttcatcaccaaaaggggccattccgtctgtaccaaccccagtgacaagtgggtccaggactatatcaaggacatgaaggagaactgagtgacccagaaggggtggcgaaggcacagctcagagacataaagagaagatgccaaggccccctcctccacccaccgctaactctcagccccagtcaccctcttggagcttccctgctttgaattaaagaccactcatgctctt

SEQ ID NO: 427215 - DNA, 1747 bp, Homo sapiens
cctgctctaaatcttgtctcggtctctcactctgccttatacccctcagttgaattatttcttctgaggaggcaagaactgaggctgctgcagactgatatggattcaccactgctaacacctcctggttggaactacaggaatagaactggaaagggaaaaaaggcagcattcaccacatcccaatcctgaatccaagagtctaagatagtcccccactcctatctcaggcttagaggattagattaatctcctggagggaagactcttccttgaaacatttttttttatctgcctgtagctattgggataattcgggaaatccacagggacagttcaagtcatctttgtcctctactttctgttgcactctcagccttgttctctttttagaaactgcatggtaactattatatagctaaagaagagcattctgacctctgccctgggacttcctggatcctcctcttcttataaatacaagggcagagctggtatcccggggagccaggaagcagtgagcccaggagtcctcggccagccctgcctgcccaccaggaggatgaaggtctccgtggctgccctctcctgcctcatgcttgttgctgtccttggatcccaggcccagttcacaaatgatgcagagacagagttaatgatgtcaaagcttccactggaaaatccagtagttctgaacagctttcactttgctgctgactgctgcacctcctacatctcacaaagcatcccgtgttcactcatgaaaagttattttgaaacgagcagcgagtgctccaagccaggtgtcatattcctcaccaagaaggggcggcaagtctgtgccaaacccagtggtccgggagttcaggattgcatgaaaaagctgaagccctactcaatataataataaagagacaaaagaggccagccacccacctccaacacctcctgagcctctgaagctcccaccaggccagctctcctcccacaacagcttcccacagcatgaagatctccgtggctgccattcccttcttcctcctcatcaccatcgccctagggaccaagactgaatcctcctcacggggaccttaccacccctcagagtgctgcttcacctacactacctacaagatcccgcgtcagcggattatggattactatgagaccaacagccagtgctccaagcccggaattgtcttcatcaccaaaaggggccattccgtctgtaccaaccccagtgacaagtgggtccaggactatatcaaggacatgaaggagaactgagtgacccagaaggggtggcgaaggcacagctcagagacataaagagaagatgccaaggccccctcctccacccaccgctaactctcagccccagtcaccctcttggagcttccctgctttgaattaaagaccactcatgctcttaaaaaaaacaaaaaaaaacaaaaaaaaaaaaaacaaaaaaacaacaaaaaaacaaaaaaaaaaaaaaaagaggggggggcccccaaaaaaacccccgcggggggcccccagtttcgcagctcgccccccgtgctttgttgcacagagggtggccccccatatggagcggagctcgtgtttaccagctcctcgcacatgcctggccgccgcccgttttccccgcactgcctggtcgtcccccaacactcactcccccgtgggcctccctggcgaggaacccccatcccgtggcgggcacactcggcccccttccctt

SEQ ID NO: 427216 - DNA, 660 bp, Homo sapiens
atgtgtatccaaagcactgttattctttgccatgatgatagagattaattagccatatgcaagtttttctgctctttatatcttctttctaatgtttattttttgagaagaaacatctattagcccattgccttttggcacttgaagttaccacccaaactaacatttcaaagttatgttttatcatactgccacctctctcttgtgaagatatctgtttttattgtaacacataaagtccataaaccaggtaatgtatttcaatacttttccaaagtattaaaatagtgttttgaccatactttaagacaggggtgttcaatcttttggcttccctgggccacattggaagaagaagaattgtcttggtccacacataaaatacactagcactagatgatgagcttaaaaaaaaattacaactgggccacatgcggcccatggtccgtgggttggacaagcttactttaagaaactggaaacatattaaatcacaccagaaaatagtttttaaaaatctaatattaaattactacattaaattaattcaaattttaattagattcaattaaaatcttacatataagccagctaaaatcttgtcagttaaaatctaatatgaattcagttgcacactaattataacggtgactattacac

SEQ ID NO: 427217 - DNA, 991 bp, Homo sapiens
ggggctccggcctctgaagttcccaatttaaatggcgggcttggtagtctgaagagtttgtactccttcccggaaaacgtgatttaaaagacacagggcctaaaggattagaacacacttgtgagggggtcctagactggcttcttgatgaagggcagaaaccgcaggggccagcggcagcggtaactcctactgtagtgttgacgttgtggtctgcacaaatggtatttcaagagatctgcggcaaccgcgatgtgaagtggagatgtctaatttctgttgatagtcacaggagttggaaaaacaacattgatccataaagccagtgaggttttaaaatcctctggtgtgcctgttgatggattttataccgaagaagtcagacagggagggagaagaataggattcgatgtcgtcacgttgtccggcacccgggggcctttatcgagagttgggttagagcctccacctggaaaacgtgaatgccgagttgggcagtatgtggtcgacctgacttcttttgagcagttggcactacccgtcttgaggaatgccgactgcagcagtggcccagggcaaagagtgtgcgtcatcgatgagattgggaagatggagctcttcagtcagcttttcattcaagctgttcgtcagacgctgtctaccccagggactataatccttggcacaatcccagttcctaaaggaaagccactggctcttgtagaagaaatcagaaacagaaaggatgtgaaggtgtttaatgtcaccaaggaaaacagaaaccaccttctgccagatatcgtgacgtgcgtgcagagcagcaggaagtgaagacacgtgcattcctgccttccgtgaaggagtgcccagttcaagaggagcctgatggagccctgcctgtcgaggctgtatgcctatggggttatggaaccttgtgggcttttctagagaaaactcaacagctgtttcccataaaatgtttaaaagatca

SEQ ID NO: 427218 - DNA, 475 bp, Homo sapiens
gaaatctgtctgggctccaaacccactttgactttttgagctgtcacttggcagaaactgatgctgggactcggtgattcctgtcctgtttctgagtgctcctgaagagctgggcctcctgcctgggtaacaaaacatacctcaccctctcccagccttccaggcttttcttttagagagttacctagcacaagattgaagaagaggaaaggagctctgaagcctgttctctcacttcttcccacagtcaccaaggaaaacagaaaccaccttctgccagatatcgtgacgtgcgtgcagagcagcaggaagtgaagacacgtgcattcctgccttccgtgaaggagtgcccagttcaagaggagcctgatggagccctgcctgtcgaggctgtatgcctatggggttatggaaccttgtgggcttttctagagaaaactcaacagctgtttcccataaaatgtttaaaagatca

SEQ ID NO: 427219 - DNA, 1681 bp, Homo sapiens
  misc_feature (1496)..(1496): n is a, c, g, or t
  misc_feature (1544)..(1544): n is a, c, g, or t
  misc_feature (1618)..(1618): n is a, c, g, or t
agcgtgtggttctcctcaccatggccaaggcagaaagtccaaaggaacacgacccgttcacttacgactaccagtccctgcagatcggaggcctcgtcatcgccaggatcctcttcatcctgggcatcctcatcgtgctgagcagaagatgccggtgcaagttcaaccagcagcagaggactggggaacctggcgacacgcggtgggcgggtcctgagtcgcgaccctggtccggacctgacctgaattgcgaccccaacctggactgctcccctgaccgcaacccctacccccgcccaccagtatggcccggcacgtgttcctaacggggcccccaggagttggaaaaacaacattgatccataaagccagtgaggttttaaaatcctctggtgtgcctgttgatggattttataccgaagaagtcagacagggagggagaagaataggattcgatgtcgtcacgttgtccggcacccgggggcctttatcgagagttgggttagagcctccacctggaaaacgtgaatgccgagttgggcagtatgtggtcgacctgacttcttttgagcagttggcactacccgtcttgaggaatgccgactgcagcagtggcccagggcaaagagtgtgcgtcatcgatgagattgggaagatggagctcttcagtcagcttttcattcaagctgttcgtcagacgctgtctaccccagggactataatccttggcacaatcccagttcctaaaggaaagccactggctcttgtagaagaaatcagaaacagaaaggatgtgaaggtgtttaatgtcaccaaggaaaacagaaaccaccttctgccagatatcgtgacgtgcgtgcagagcagcaggaagtgaagacacgtgcattcctgccttccgtgaaggagtgcccagttcaagaggagcctgatggagccctgcctgtcgaggctgtatgcctatggggttatggaaccttgtgggcttttctagagaaaactcaacagctgtttcccataaaatgtttaaaagatcaaattagccttaatgctggattgtctgtacaagattaactatccattgtggcttatctatgcttaaagatttcttgtttatttcctcttgcagtcatgcacatgatttgggtaaactgtgagatgagaaatggttttcagagtattagatggaattcacccccgttgaagtttataaatgtgttcaggggaagcgggaggaaagagttcactgcctaatcagttttgcatgtcatgaaaattaaattcctctccaggtgcagcttcagcctcatgcaacttaaagtgataacagttatttgattttttaaaaaatattattccaaaagaaaaccattttaggtcatctcccccaactctgtttgcttactgcttaataaatataaaaataaatctgatggttacagacaggaaaaaaaaaaaaaaaaaaaaaccaggatttgaaggagctattttttttnaatgttgcaactagcaactcatcttcggaagacacagccaggggaatnaagtagaagtgaaaggtttataaatccatttgtaagcatttatcccatatattttaaattcaaggaaaattgtntttatctttgaattttgtattcaatactttatgtactatgtgactcatgcttctggataaata

SEQ ID NO: 427220 - DNA, 1635 bp, Homo sapiens
  misc_feature (1450)..(1450): n is a, c, g, or t
  misc_feature (1498)..(1498): n is a, c, g, or t
  misc_feature (1572)..(1572): n is a, c, g, or t
ggggctccggcctctgaagttcccaatttaaatggcgggcttggtagtctgaagagtttgtactccttcccggaaaacgtgatttaaaagacacagggcctaaaggattagaacacacttgtgagggggtcctagactggcttcttgatgaagggcagaaaccgcaggggccagcggcagcggtaactcctactgtagtgttgacgttgtggtctgcacaaatggtatttcaagagatctgcggcaaccgcgatgtgaagtggagatgtctaatttctgttgatagtcacaggagttggaaaaacaacattgatccataaagccagtgaggttttaaaatcctctggtgtgcctgttgatggattttataccgaagaagtcagacagggagggagaagaataggattcgatgtcgtcacgttgtccggcacccgggggcctttatcgagagttgggttagagcctccacctggaaaacgtgaatgccgagttgggcagtatgtggtcgacctgacttcttttgagcagttggcactacccgtcttgaggaatgccgactgcagcagtggcccagggcaaagagtgtgcgtcatcgatgagattgggaagatggagctcttcagtcagcttttcattcaagctgttcgtcagacgctgtctaccccagggactataatccttggcacaatcccagttcctaaaggaaagccactggctcttgtagaagaaatcagaaacagaaaggatgtgaaggtgtttaatgtcaccaaggaaaacagaaaccaccttctgccagatatcgtgacgtgcgtgcagagcagcaggaagtgaagacacgtgcattcctgccttccgtgaaggagtgcccagttcaagaggagcctgatggagccctgcctgtcgaggctgtatgcctatggggttatggaaccttgtgggcttttctagagaaaactcaacagctgtttcccataaaatgtttaaaagatcaaattagccttaatgctggattgtctgtacaagattaactatccattgtggcttatctatgcttaaagatttcttgtttatttcctcttgcagtcatgcacatgatttgggtaaactgtgagatgagaaatggttttcagagtattagatggaattcacccccgttgaagtttataaatgtgttcaggggaagcgggaggaaagagttcactgcctaatcagttttgcatgtcatgaaaattaaattcctctccaggtgcagcttcagcctcatgcaacttaaagtgataacagttatttgattttttaaaaaatattattccaaaagaaaaccattttaggtcatctcccccaactctgtttgcttactgcttaataaatataaaaataaatctgatggttacagacaggaaaaaaaaaaaaaaaaaaaaaccaggatttgaaggagctattttttttnaatgttgcaactagcaactcatcttcggaagacacagccaggggaatnaagtagaagtgaaaggtttataaatccatttgtaagcatttatcccatatattttaaattcaaggaaaattgtntttatctttgaattttgtattcaatactttatgtactatgtgactcatgcttctggataaata

SEQ ID NO: 427221 - DNA, 1518 bp, Homo sapiens
  misc_feature (1333)..(1333): n is a, c, g, or t
  misc_feature (1381)..(1381): n is a, c, g, or t
  misc_feature (1455)..(1455): n is a, c, g, or t
agcgtgtggttctcctcaccatggccaaggcagaaagtccaaaggaacacgacccgttcacttacgactaccagtccctgcagatcggaggcctcgtcatcgccaggatcctcttcatcctgggcatcctcatcgtgctgagcagaagatgccggtgcaagttcaaccagcagcagaggactggggaacctggcgacacgcggtgggcgggtcctgagtcgcgaccctggtccggacctgacctgaattgcgaccccaacctggactgctcccctgaccgcaacccctacccccgcccaccagtatggcccggcacgtgttcctaacggggcccccaggttagagcctccacctggaaaacgtgaatgccgagttgggcagtatgtggtcgacctgacttcttttgagcagttggcactacccgtcttgaggaatgccgactgcagcagtggcccagggcaaagagtgtgcgtcatcgatgagattgggaagatggagctcttcagtcagcttttcattcaagctgttcgtcagacgctgtctaccccagggactataatccttggcacaatcccagttcctaaaggaaagccactggctcttgtagaagaaatcagaaacagaaaggatgtgaaggtgtttaatgtcaccaaggaaaacagaaaccaccttctgccagatatcgtgacgtgcgtgcagagcagcaggaagtgaagacacgtgcattcctgccttccgtgaaggagtgcccagttcaagaggagcctgatggagccctgcctgtcgaggctgtatgcctatggggttatggaaccttgtgggcttttctagagaaaactcaacagctgtttcccataaaatgtttaaaagatcaaattagccttaatgctggattgtctgtacaagattaactatccattgtggcttatctatgcttaaagatttcttgtttatttcctcttgcagtcatgcacatgatttgggtaaactgtgagatgagaaatggttttcagagtattagatggaattcacccccgttgaagtttataaatgtgttcaggggaagcgggaggaaagagttcactgcctaatcagttttgcatgtcatgaaaattaaattcctctccaggtgcagcttcagcctcatgcaacttaaagtgataacagttatttgattttttaaaaaatattattccaaaagaaaaccattttaggtcatctcccccaactctgtttgcttactgcttaataaatataaaaataaatctgatggttacagacaggaaaaaaaaaaaaaaaaaaaaaccaggatttgaaggagctattttttttnaatgttgcaactagcaactcatcttcggaagacacagccaggggaatnaagtagaagtgaaaggtttataaatccatttgtaagcatttatcccatatattttaaattcaaggaaaattgtntttatctttgaattttgtattcaatactttatgtactatgtgactcatgcttctggataaata

SEQ ID NO: 427222 - DNA, 1421 bp, Homo sapiens
  misc_feature (1236)..(1236): n is a, c, g, or t
  misc_feature (1284)..(1284): n is a, c, g, or t
  misc_feature (1358)..(1358): n is a, c, g, or t
agcgtgtggttctcctcaccatggccaaggcagaaagtccaaaggaacacgacccgttcacttacgactaccagtccctgcagatcggaggcctcgtcatcgccaggatcctcttcatcctgggcatcctcatcgtgctgagcagaagatgccggtgcaagttcaaccagcagcagaggactggggaacctggcgacacgcggtgggcgggtcctgagtcgcgaccctggtccggacctgacctgaattgcgaccccaacctggactgctcccctgaccgcaacccctacccccgcccaccagtatggcccggcacgtgttcctaacggggcccccaggccgactgcagcagtggcccagggcaaagagtgtgcgtcatcgatgagattgggaagatggagctcttcagtcagcttttcattcaagctgttcgtcagacgctgtctaccccagggactataatccttggcacaatcccagttcctaaaggaaagccactggctcttgtagaagaaatcagaaacagaaaggatgtgaaggtgtttaatgtcaccaaggaaaacagaaaccaccttctgccagatatcgtgacgtgcgtgcagagcagcaggaagtgaagacacgtgcattcctgccttccgtgaaggagtgcccagttcaagaggagcctgatggagccctgcctgtcgaggctgtatgcctatggggttatggaaccttgtgggcttttctagagaaaactcaacagctgtttcccataaaatgtttaaaagatcaaattagccttaatgctggattgtctgtacaagattaactatccattgtggcttatctatgcttaaagatttcttgtttatttcctcttgcagtcatgcacatgatttgggtaaactgtgagatgagaaatggttttcagagtattagatggaattcacccccgttgaagtttataaatgtgttcaggggaagcgggaggaaagagttcactgcctaatcagttttgcatgtcatgaaaattaaattcctctccaggtgcagcttcagcctcatgcaacttaaagtgataacagttatttgattttttaaaaaatattattccaaaagaaaaccattttaggtcatctcccccaactctgtttgcttactgcttaataaatataaaaataaatctgatggttacagacaggaaaaaaaaaaaaaaaaaaaaaccaggatttgaaggagctattttttttnaatgttgcaactagcaactcatcttcggaagacacagccaggggaatnaagtagaagtgaaaggtttataaatccatttgtaagcatttatcccatatattttaaattcaaggaaaattgtntttatctttgaattttgtattcaatactttatgtactatgtgactcatgcttctggataaata

SEQ ID NO: 427223 - DNA, 1119 bp, Homo sapiens
  misc_feature (934)..(934): n is a, c, g, or t
  misc_feature (982)..(982): n is a, c, g, or t
  misc_feature (1056)..(1056): n is a, c, g, or t
gaaatctgtctgggctccaaacccactttgactttttgagctgtcacttggcagaaactgatgctgggactcggtgattcctgtcctgtttctgagtgctcctgaagagctgggcctcctgcctgggtaacaaaacatacctcaccctctcccagccttccaggcttttcttttagagagttacctagcacaagattgaagaagaggaaaggagctctgaagcctgttctctcacttcttcccacagtcaccaaggaaaacagaaaccaccttctgccagatatcgtgacgtgcgtgcagagcagcaggaagtgaagacacgtgcattcctgccttccgtgaaggagtgcccagttcaagaggagcctgatggagccctgcctgtcgaggctgtatgcctatggggttatggaaccttgtgggcttttctagagaaaactcaacagctgtttcccataaaatgtttaaaagatcaaattagccttaatgctggattgtctgtacaagattaactatccattgtggcttatctatgcttaaagatttcttgtttatttcctcttgcagtcatgcacatgatttgggtaaactgtgagatgagaaatggttttcagagtattagatggaattcacccccgttgaagtttataaatgtgttcaggggaagcgggaggaaagagttcactgcctaatcagttttgcatgtcatgaaaattaaattcctctccaggtgcagcttcagcctcatgcaacttaaagtgataacagttatttgattttttaaaaaatattattccaaaagaaaaccattttaggtcatctcccccaactctgtttgcttactgcttaataaatataaaaataaatctgatggttacagacaggaaaaaaaaaaaaaaaaaaaaaccaggatttgaaggagctattttttttnaatgttgcaactagcaactcatcttcggaagacacagccaggggaatnaagtagaagtgaaaggtttataaatccatttgtaagcatttatcccatatattttaaattcaaggaaaattgtntttatctttgaattttgtattcaatactttatgtactatgtgactcatgcttctggataaata

SEQ ID NO: 427224 - DNA, 1471 bp, Homo sapiens
  misc_feature (1286)..(1286): n is a, c, g, or t
  misc_feature (1334)..(1334): n is a, c, g, or t
  misc_feature (1408)..(1408): n is a, c, g, or t
agcgtgtggttctcctcaccatggccaaggcagaaagtccaaaggaacacgacccgttcacttacgactaccagtccctgcagatcggaggcctcgtcatcgccaggatcctcttcatcctgggcatcctcatcgtgctgagcagaagatgccggtgcaagttcaaccagcagcagaggactggggaacctggcgacacgcggtgggcgggtcctgagtcgcgaccctggtccggacctgacctgaattgcgaccccaacctggactgctcccctgaccgcaacccctacccccgcccaccagtatggcccggcacgtgttcctaacggggcccccaggagttggaaaaacaacattgatccataaagccagtgaggttttaaaatcctctggtgtgcctgttgatggattttataccgaagaagtcagacagggagggagaagaataggattcgatgtcgtcacgttgtccggcacccgggggcctttatcgagagttgggttagagcctccacctggaaaacgtgaatgccgagttgggcagtatgtggtcgacctgacttcttttgagcagttggcactacccgtcttgaggaatgtcaccaaggaaaacagaaaccaccttctgccagatatcgtgacgtgcgtgcagagcagcaggaagtgaagacacgtgcattcctgccttccgtgaaggagtgcccagttcaagaggagcctgatggagccctgcctgtcgaggctgtatgcctatggggttatggaaccttgtgggcttttctagagaaaactcaacagctgtttcccataaaatgtttaaaagatcaaattagccttaatgctggattgtctgtacaagattaactatccattgtggcttatctatgcttaaagatttcttgtttatttcctcttgcagtcatgcacatgatttgggtaaactgtgagatgagaaatggttttcagagtattagatggaattcacccccgttgaagtttataaatgtgttcaggggaagcgggaggaaagagttcactgcctaatcagttttgcatgtcatgaaaattaaattcctctccaggtgcagcttcagcctcatgcaacttaaagtgataacagttatttgattttttaaaaaatattattccaaaagaaaaccattttaggtcatctcccccaactctgtttgcttactgcttaataaatataaaaataaatctgatggttacagacaggaaaaaaaaaaaaaaaaaaaaaccaggatttgaaggagctattttttttnaatgttgcaactagcaactcatcttcggaagacacagccaggggaatnaagtagaagtgaaaggtttataaatccatttgtaagcatttatcccatatattttaaattcaaggaaaattgtntttatctttgaattttgtattcaatactttatgtactatgtgactcatgcttctggataaata

SEQ ID NO: 427225 - DNA, 1475 bp, Homo sapiens
agcgtgtggttctcctcaccatggccaaggcagaaagtccaaaggaacacgacccgttcacttacgactaccagtccctgcagatcggaggcctcgtcatcgccaggatcctcttcatcctgggcatcctcatcgtgctgagcagaagatgccggtgcaagttcaaccagcagcagaggactggggaacctggcgacacgcggtgggcgggtcctgagtcgcgaccctggtccggacctgacctgaattgcgaccccaacctggactgctcccctgaccgcaacccctacccccgcccaccagtatggcccggcacgtgttcctaacggggcccccaggagttggaaaaacaacattgatccataaagccagtgaggttttaaaatcctctggtgtgcctgttgatggattttataccgaagaagtcagacagggagggagaagaataggattcgatgtcgtcacgttgtccggcacccgggggcctttatcgagagttgggttagagcctccacctggaaaacgtgaatgccgagttgggcagtatgtggtcgacctgacttcttttgagcagttggcactacccgtcttgaggaatgccgactgcagcagtggcccagggcaaagagtgtgcgtcatcgatgagattgggaagatggagctcttcagtcagcttttcattcaagctgttcgtcagacgctgtctaccccagggactataatccttggcacaatcccagttcctaaaggaaagccactggctcttgtagaagaaatcagaaacagaaaggatgtgaaggtgtttaattcaccgtactgtgtcatagaagaccagagcaaattctccagctgtgtatcacagtccactctcacagagcctggctggaggcagaagctactgcaatcactgctgaactcagagtggaagaaaagggcccctgtggtgcccacctctgtgtcgcctcctttctacctcaggtggattccttgaatgcaaacaacaggaatggactttggctaacttaagtgaaaacagcatcaaaaagccttataggctttggagctgtcccatgaagccaaaggaaaagctgactgtcctcatttcaagtggagccacagccgcccaggattgacgcagccaggaccagtagaaatgggatcacaggattgacgcagccagaaccagaattgacgaggtccgctctgcatactccttcattgtccttgttcatgcctgtcctgtcctggtctgcgagctccatgaggtcagggtccttacctgtggtgcttctctatgcgcatctctgtgcctggctcctgtttgcccttccaccccatcagcgtgtgttgagtggatggatattatatgggccaagtaggaaggcactgtgatgggagcagagatggcccttcctttaccctggggcactcgggatggtgtggtagtgaaagaaaaataaacagatcatcgggta

SEQ ID NO: 427226 - DNA, 1830 bp, Homo sapiens
agcgtgtggttctcctcaccatggccaaggcagaaagtccaaaggaacacgacccgttcacttacgactaccagtccctgcagatcggaggcctcgtcatcgccaggatcctcttcatcctgggcatcctcatcgtgctgagcagaagatgccggtgcaagttcaaccagcagcagaggactggggaacctggcgacacgcggtgggcgggtcctgagtcgcgaccctggtccggacctgacctgaattgcgaccccaacctggactgctcccctgaccgcaacccctacccccgcccaccagtatggcccggcacgtgttcctaacggggcccccaggttagagcctccacctggaaaacgtgaatgccgagttgggcagtatgtggtcgacctgacttcttttgagcagttggcactacccgtcttgaggaatgccgactgcagcagtggcccagggcaaagagtgtgcgtcatcgatgagattgggaagatggagctcttcagtcagcttttcattcaagctgttcgtcagacgctgtctaccccagggactataatccttggcacaatcccagttcctaaaggaaagccactggctcttgtagaagaaatcagaaacagaaaggatgtgaaggtgtttaattcaccgtactgtgtcatagaagaccagagcaaattctccagctgtgtatcacagtccactctcacagagcctggctggaggcagaagctactgcaatcactgctgaactcagagtggaagaaaagggcccctgtggtgcccacctctgtgtcgcctcctttctacctcaggtggattccttgaatgcaaacaacaggaatggactttggctaacttaagtgaaaacagcatcaaaaagccttataggctttggagctgtcccatgaagccaaaggaaaagctgactgtcctcatttcaagtggagccacagccgcccaggattgacgcagccaggaccagtagaaatgggatcacaggattgacgcagccaggaccggtagaaatgggatcacgggactgacgcagccaggaccagtagaaatgggatcacgggattgacgcagccaggaccagtagaaatgggatcagcttctggcacttgctgcgtgagctcactcctcttggggtgcagatctcagtcactcctcttggggtacagatctcagagaagttgccagggcctggcttgcccacttgttggctgggggcaagtttcctagaccgtacagtctcctaaagacaaccagagcactcttccaagaagggtgagcaggtgccaggaaccagaattgacgaggtccgctctgcatctcctcttcagacatgtattggcacctattgtatgccaggccccctcttcagatacaaccaccctgaacctcagaaggcttccacatgcactccctgctcttaccgggaaccttggctcagccccttttccatggttcacctgtcgaaattacatccaggcttaagcacccctggaagcctttcctgcccctgaccccacacatgcccctgttcctgcctgccccccagactccttcattgtccttgttcatgcctgtcctgtcctggtctgcgagctccatgaggtcagggtccttacctgtggtgcttctctatgcgcatctctgtgcctggctcctgtttgcccttccaccccatcagcgtgtgttgagtggatggatattatatgggccaagtaggaaggcactgtgatgggagcagagatggcccttcctttaccctggggcactcgggatggtgtggtagtgaaagaaaaataaacagatcatcgggta

SEQ ID NO: 427227 - DNA, 883 bp, Homo sapiens
agcgtgtggttctcctcaccatggccaaggcagaaagtccaaaggaacacgacccgttcacttacgactaccagtccctgcagatcggaggcctcgtcatcgccaggatcctcttcatcctgggcatcctcatcgtgctgagcagaagatgccggtgcaagttcaaccagcagcagaggactggggaacctggcgacacgcggtgggcgggtcctgagtcgcgaccctggtccggacctgacctgaattgcgaccccaacctggactgctcccctgaccgcaacccctacccccgcccaccagtatggcccggcacgtgttcctaacggggcccccaggagttggaaaaacaacattgatccataaagccagtgaggttttaaaatcctctggtgtgcctgttgatggattttataccgaagaagtcagacagggagggagaagaataggattcgatgtcgtcacgttgtccggcacccgggggcctttatcgagagttggatggagctcttcagtcagcttttcattcaagctgttcgtcagacgctgtctaccccagggactataatccttggcacaatcccagttcctaaaggaaagccactggctcttgtagaagaaatcagaaacagaaaggatgtgaaggtgtttaatgtcaccaaggaaaacagaaaccaccttctgccagatatcgtgacgtgcgtgcagagcagcaggaagtgaagacacgtgcattcctgccttccgtgaaggagtgcccagttcaagaggagcctgatggagccctgcctgtcgaggctgtatgcctatggggttatggaaccttgtgggcttttctagagaaaactcaacagctgtttcccataaaatgtttaaaagatca

SEQ ID NO: 427228 - DNA, 513 bp, Homo sapiens
  misc_feature (1)..(1): n is a, c, g, or t
naactaacggctaggtacgaggccgggtggtgctgacttcttttgagcagttggcactacccgtcttgaggaatgccgactgcagcagtggcccagggcaaagagtgtgcgtcatcgatgagattgggaagatggagctcttcagtcagcttttcattcaagctgttcgtcagacgctgtctaccccagggactataatccttggcacaatcccagttcctaaaggaaagccactggctcttgtagaagaaatcagaaacagaaaggatgtgaaggtgtttaatgtcaccaaggaaaacagaaaccaccttctgccagatatcgtgacgtgcgtgcagagcagcaggaagtgaagacacgtgcattcctgccttccgtgaaggagtgcccagttcaagaggagcctgatggagccctgcctgtcgaggctgtatgcctatggggttatggaaccttgtgggcttttctagagaaaactcaacagctgtttcccataaaatgtttaaaagatca

SEQ ID NO: 427229 - DNA, 1531 bp, Homo sapiens
  misc_feature (1346)..(1346): n is a, c, g, or t
  misc_feature (1394)..(1394): n is a, c, g, or t
  misc_feature (1468)..(1468): n is a, c, g, or t
ggcggtgcttccggtcaaagcaccgcttgggggcggggcctggcgacacgcggtgggcgggtcctgagtcgcgaccctggtccggacctgacctgaattgcgaccccaacctggactgctcccctgaccgcaacccctacccccgcccaccagtatggcccggcacgtgttcctaacggggcccccaggagttggaaaaacaacattgatccataaagccagtgaggttttaaaatcctctggtgtgcctgttgatggattttataccgaagaagtcagacagggagggagaagaataggattcgatgtcgtcacgttgtccggcacccgggggcctttatcgagagttgggttagagcctccacctggaaaacgtgaatgccgagttgggcagtatgtggtcgacctgacttcttttgagcagttggcactacccgtcttgaggaatgccgactgcagcagtggcccagggcaaagagtgtgcgtcatcgatgagattgggaagatggagctcttcagtcagcttttcattcaagctgttcgtcagacgctgtctaccccagggactataatccttggcacaatcccagttcctaaaggaaagccactggctcttgtagaagaaatcagaaacagaaaggatgtgaaggtgtttaatgtcaccaaggaaaacagaaaccaccttctgccagatatcgtgacgtgcgtgcagagcagcaggaagtgaagacacgtgcattcctgccttccgtgaaggagtgcccagttcaagaggagcctgatggagccctgcctgtcgaggctgtatgcctatggggttatggaaccttgtgggcttttctagagaaaactcaacagctgtttcccataaaatgtttaaaagatcaaattagccttaatgctggattgtctgtacaagattaactatccattgtggcttatctatgcttaaagatttcttgtttatttcctcttgcagtcatgcacatgatttgggtaaactgtgagatgagaaatggttttcagagtattagatggaattcacccccgttgaagtttataaatgtgttcaggggaagcgggaggaaagagttcactgcctaatcagttttgcatgtcatgaaaattaaattcctctccaggtgcagcttcagcctcatgcaacttaaagtgataacagttatttgattttttaaaaaatattattccaaaagaaaaccattttaggtcatctcccccaactctgtttgcttactgcttaataaatataaaaataaatctgatggttacagacaggaaaaaaaaaaaaaaaaaaaaaccaggatttgaaggagctattttttttnaatgttgcaactagcaactcatcttcggaagacacagccaggggaatnaagtagaagtgaaaggtttataaatccatttgtaagcatttatcccatatattttaaattcaaggaaaattgtntttatctttgaattttgtattcaatactttatgtactatgtgactcatgcttctggataaata

SEQ ID NO: 427230 - DNA, 1157 bp, Homo sapiens
  misc_feature (1)..(1): n is a, c, g, or t
  misc_feature (972)..(972): n is a, c, g, or t
  misc_feature (1020)..(1020): n is a, c, g, or t
  misc_feature (1094)..(1094): n is a, c, g, or t
naactaacggctaggtacgaggccgggtggtgctgacttcttttgagcagttggcactacccgtcttgaggaatgccgactgcagcagtggcccagggcaaagagtgtgcgtcatcgatgagattgggaagatggagctcttcagtcagcttttcattcaagctgttcgtcagacgctgtctaccccagggactataatccttggcacaatcccagttcctaaaggaaagccactggctcttgtagaagaaatcagaaacagaaaggatgtgaaggtgtttaatgtcaccaaggaaaacagaaaccaccttctgccagatatcgtgacgtgcgtgcagagcagcaggaagtgaagacacgtgcattcctgccttccgtgaaggagtgcccagttcaagaggagcctgatggagccctgcctgtcgaggctgtatgcctatggggttatggaaccttgtgggcttttctagagaaaactcaacagctgtttcccataaaatgtttaaaagatcaaattagccttaatgctggattgtctgtacaagattaactatccattgtggcttatctatgcttaaagatttcttgtttatttcctcttgcagtcatgcacatgatttgggtaaactgtgagatgagaaatggttttcagagtattagatggaattcacccccgttgaagtttataaatgtgttcaggggaagcgggaggaaagagttcactgcctaatcagttttgcatgtcatgaaaattaaattcctctccaggtgcagcttcagcctcatgcaacttaaagtgataacagttatttgattttttaaaaaatattattccaaaagaaaaccattttaggtcatctcccccaactctgtttgcttactgcttaataaatataaaaataaatctgatggttacagacaggaaaaaaaaaaaaaaaaaaaaaccaggatttgaaggagctattttttttnaatgttgcaactagcaactcatcttcggaagacacagccaggggaatnaagtagaagtgaaaggtttataaatccatttgtaagcatttatcccatatattttaaattcaaggaaaattgtntttatctttgaattttgtattcaatactttatgtactatgtgactcatgcttctggataaata

SEQ ID NO: 427231 - DNA, 1037 bp, Homo sapiens
agcgtgtggttctcctcaccatggccaaggcagaaagtccaaaggaacacgacccgttcacttacgactaccagtccctgcagatcggaggcctcgtcatcgccaggatcctcttcatcctgggcatcctcatcgtgctgagcagaagatgccggtgcaagttcaaccagcagcagaggactggggaacctggcgacacgcggtgggcgggtcctgagtcgcgaccctggtccggacctgacctgaattgcgaccccaacctggactgctcccctgaccgcaacccctacccccgcccaccagtatggcccggcacgtgttcctaacggggcccccaggagttggaaaaacaacattgatccataaagccagtgaggttttaaaatcctctggtgtgcctgttgatggattttataccgaagaagtcagacagggagggagaagaataggattcgatgtcgtcacgttgtccggcacccgggggcctttatcgagagttgggttagagcctccacctggaaaacgtgaatgccgagttgggcagtatgtggtcgacctgacttcttttgagcagttggcactacccgtcttgaggaatgccgactgcagcagtggcccagggcaaagagtgtgcgtcatcgatgagattgggaagatggagctcttcagtcagcttttcattcaagctgttcgtcagacgctgtctaccccagggactataatccttggcacaatcccagttcctaaaggaaagccactggctcttgtagaagaaatcagaaacagaaaggatgtgaaggtgtttaatgtcaccaaggaaaacagaaaccaccttctgccagatatcgtgacgtgcgtgcagagcagcaggaagtgaagacacgtgcattcctgccttccgtgaaggagtgcccagttcaagaggagcctgatggagccctgcctgtcgaggctgtatgcctatggggttatggaaccttgtgggcttttctagagaaaactcaacagctgtttcccataaaatgtttaaaagatca

SEQ ID NO: 427232 - DNA, 1993 bp, Homo sapiens
agcgtgtggttctcctcaccatggccaaggcagaaagtccaaaggaacacgacccgttcacttacgactaccagtccctgcagatcggaggcctcgtcatcgccaggatcctcttcatcctgggcatcctcatcgtgctgagcagaagatgccggtgcaagttcaaccagcagcagaggactggggaacctggcgacacgcggtgggcgggtcctgagtcgcgaccctggtccggacctgacctgaattgcgaccccaacctggactgctcccctgaccgcaacccctacccccgcccaccagtatggcccggcacgtgttcctaacggggcccccaggagttggaaaaacaacattgatccataaagccagtgaggttttaaaatcctctggtgtgcctgttgatggattttataccgaagaagtcagacagggagggagaagaataggattcgatgtcgtcacgttgtccggcacccgggggcctttatcgagagttgggttagagcctccacctggaaaacgtgaatgccgagttgggcagtatgtggtcgacctgacttcttttgagcagttggcactacccgtcttgaggaatgccgactgcagcagtggcccagggcaaagagtgtgcgtcatcgatgagattgggaagatggagctcttcagtcagcttttcattcaagctgttcgtcagacgctgtctaccccagggactataatccttggcacaatcccagttcctaaaggaaagccactggctcttgtagaagaaatcagaaacagaaaggatgtgaaggtgtttaattcaccgtactgtgtcatagaagaccagagcaaattctccagctgtgtatcacagtccactctcacagagcctggctggaggcagaagctactgcaatcactgctgaactcagagtggaagaaaagggcccctgtggtgcccacctctgtgtcgcctcctttctacctcaggtggattccttgaatgcaaacaacaggaatggactttggctaacttaagtgaaaacagcatcaaaaagccttataggctttggagctgtcccatgaagccaaaggaaaagctgactgtcctcatttcaagtggagccacagccgcccaggattgacgcagccaggaccagtagaaatgggatcacaggattgacgcagccaggaccggtagaaatgggatcacgggactgacgcagccaggaccagtagaaatgggatcacgggattgacgcagccaggaccagtagaaatgggatcagcttctggcacttgctgcgtgagctcactcctcttggggtgcagatctcagtcactcctcttggggtacagatctcagagaagttgccagggcctggcttgcccacttgttggctgggggcaagtttcctagaccgtacagtctcctaaagacaaccagagcactcttccaagaagggtgagcaggtgccaggaaccagaattgacgaggtccgctctgcatctcctcttcagacatgtattggcacctattgtatgccaggccccctcttcagatacaaccaccctgaacctcagaaggcttccacatgcactccctgctcttaccgggaaccttggctcagccccttttccatggttcacctgtcgaaattacatccaggcttaagcacccctggaagcctttcctgcccctgaccccacacatgcccctgttcctgcctgccccccagactccttcattgtccttgttcatgcctgtcctgtcctggtctgcgagctccatgaggtcagggtccttacctgtggtgcttctctatgcgcatctctgtgcctggctcctgtttgcccttccaccccatcagcgtgtgttgagtggatggatattatatgggccaagtaggaaggcactgtgatgggagcagagatggcccttcctttaccctggggcactcgggatggtgtggtagtgaaagaaaaataaacagatcatcgggta

SEQ ID NO: 427233 - DNA, 827 bp, Homo sapiens
agcgtgtggttctcctcaccatggccaaggcagaaagtccaaaggaacacgacccgttcacttacgactaccagtccctgcagatcggaggcctcgtcatcgccaggatcctcttcatcctgggcatcctcatcgtgctgagcagaagatgccggtgcaagttcaaccagcagcagaggactggggaacctggcgacacgcggtgggcgggtcctgagtcgcgaccctggtccggacctgacctgaattgcgaccccaacctggactgctcccctgaccgcaacccctacccccgcccaccagtatggcccggcacgtgttcctaacggggcccccaggagttggaaaaacaacattgatccataaagccagtgaggttttaaaatcctctggtgtgcctgttgatggattttataccgaagaagtcagacagggagggagaagaataggattcgatgtcgtcacgttgtccggcacccgggggcctttatcgagagttgggttagagcctccacctggaaaacgtgaatgccgagttgggcagtatgtggtcgacctgacttcttttgagcagttggcactacccgtcttgaggaatgtcaccaaggaaaacagaaaccaccttctgccagatatcgtgacgtgcgtgcagagcagcaggaagtgaagacacgtgcattcctgccttccgtgaaggagtgcccagttcaagaggagcctgatggagccctgcctgtcgaggctgtatgcctatggggttatggaaccttgtgggcttttctagagaaaactcaacagctgtttcccataaaatgtttaaaagatca

SEQ ID NO: 427234 - DNA, 1151 bp, Homo sapiens
cggcgcgcaggttgattagtctttgcaaaggttaaatggaaaggaaaaggtgggaaatacaccaagagtgatttcaaggagtatgaaaaagaacaggataaaccacctaatttggttctgaaagataaagtaaagcccaaacaggatacaaaatacgatcttatattagatgagcaggccgaagactcaaaatcaagtcactcacacacaagtaaaaaacacaagaagaaaacccatcactgttctgaagagaaagaagatgaggactacatgccaatcaaaaatactaatcaggatatctatagagaaatggggtttggtcactatgaagaagaagaaagctgttgggagaaacaaaagagtgaaaagagagaccgaactcagaaccgaagtcgtagccgatctcgagagagggatggccattatagtaatagtcataaatcaaaataccaaacagatctttatgaaagagaaaggagtaaaaagagagaccgaagcagaagtccaaagaagtccaaagataaagaaaaatctaagtatagatgaaagatgaagaggcagaattgagaggctaacatatttactcttgtctaacttaagagtgccaggaaagcagatgcttagattttgtgtcaaagcttgttatttttttcatactaggattatggtctttagattaatactgattatatagagcacggaaagataaagaattgaacattttctttgtatacttttttacactaattttattgttatacataaatggtagtcttcatttttgaagtcttacattttcactctttttttaatgaagtatttcatactacaaaaatacataaacgtatatataaagggataataaatgtaaatatctgtgtactcatcagccagcttaagatacagatgttgtcgacattttagaagttccctaaggccctctccctctcaaataattatttggaattttgtgtttgtcatttgtctattatagttttacaacatacgtatgtatctgtaagtgaaatgttaattttgtatgtttctgaattttatataaatggcaaaatgtttacttctgtgactttctttcatttttattgctatatagtattatataaatatactacaacttattcattcttgatgga

SEQ ID NO: 427235 - DNA, 2121 bp, Homo sapiens
tcctcccggggtttgtagcggaggaggagcgggcgccatggcggttctactggagaccactttaggcgacgtcgtcatcgacttgtacaccgaagaacggccgcgtgcctgcttgaatttcttgaaactgtgcaaaataaaatattacaattattgccttattcacaatgtacagagggattttatcatacaaactggcgatcctacagggactggccgtggaggagagtctatctttggccaactgtatggtgatcaagcaagcttttttgaggcagaaaaagtcccaagaattaagcacaagaagaaaggcacagtgtccatggtgaataatggcagtgatcaacatggatctcagtttcttatcaccacaggagaaaatctagattatcttgatggtgtccatacggtgtttggtgaggtgacagaaggcatggacataattaagaaaattaatgagacctttgttgacaaggactttgtaccatatcaggatatcaggataaatcatacggtgattttagatgatccatttgatgaccctcctgatttattaatccctgatcgatcaccagaacctacaagggaacaattagatagtggtcgaataggagcagatgaagaaattgatgatttcaaaggaagatcagctgaggaagtagaagaaataaaggcagaaaaagaggctaaaactcaggctatacttttggagatggtgggagacctacctgatgcagatattaaacctccagaaaatgtactgtttgtgtgtaaattgaacccagtgaccacagatgaggatctggaaataatattctctagatttgggccaataagaagttgtgaagttatccgagactggaagacaggagagtccctctgttacgcttttattgaatttgaaaaggaagaagattgtgagaaagcattcttcaaaatggacaatgtgcttatagatgacagaagaatacatgtggattttagccagtcggttgcaaaggttaaatggaaaggaaaaggtgggaaatacaccaagagtgatttcaaggagtatgaaaaagaacaggataaaccacctaatttggttctgaaagataaagtaaagcccaaacaggatacaaaatacgatcttatattagatgagcaggccgaagactcaaaatcaagtcactcacacacaagtaaaaaacacaagaagaaaacccatcactgttctgaagagaaagaagatgaggactacatgccaatcaaaaatactaatcaggatatctatagagaaatggggtttggtcactatgaagaagaagaaagctgttgggagaaacaaaagagtgaaaagagagaccgaactcagaaccgaagtcgtagccgatctcgagagagggatggccattatagtaatagtcataaatcaaaataccaaacagatctttatgaaagagaaaggagtaaaaagagagaccgaagcagaagtccaaagaagtccaaagataaagaaaaatctaagtatagatgaaagatgaagaggcagaattgagaggctaacatatttactcttgtctaacttaagagtgccaggaaagcagatgcttagattttgtgtcaaagcttgttatttttttcatactaggattatggtctttagattaatactgattatatagagcacggaaagataaagaattgaacattttctttgtatacttttttacactaattttattgttatacataaatggtagtcttcatttttgaagtcttacattttcactctttttttaatgaagtatttcatactacaaaaatacataaacgtatatataaagggataataaatgtaaatatctgtgtactcatcagccagcttaagatacagatgttgtcgacattttagaagttccctaaggccctctccctctcaaataattatttggaattttgtgtttgtcatttgtctattatagttttacaacatacgtatgtatctgtaagtgaaatgttaattttgtatgtttctgaattttatataaatggcaaaatgtttacttctgtgactttctttcatttttattgctatatagtattatataaatatactacaacttattcattcttgatgga

SEQ ID NO: 427236 - DNA, 2239 bp, Homo sapiens
tcctcccggggtttgtagcggaggaggagcgggcgccatggcggttctactggagaccactttaggcgacgtcgtcatcgacttgtacaccgaagaacggccgcgtgcctgcttgaatttcttgaaactgtgcaaaataaaatattacaattattgccttattcacaatgtacagagggattttatcatacaaactggcgatcctacagggactggccgtggaggagagtctatctttggccaactgtatggtgatcaagcaagcttttttgaggcagaaaaagtcccaagaattaagcacaagaagaaaggcacagtgtccatggtgaataatggcagtgatcaacatggatctcagtttcttatcaccacaggagaaaatctagattatcttgatggtgtccatacggtgtttggtgaggtgacagaaggcatggacataattaagaaaattaatgagacctttgttgacaaggactttgtaccatatcaggatatcaggataaatcatacggtgattttagatgatccatttgatgaccctcctgatttattaatccctgatcgatcaccagaacctacaagggaacaattagatagtggtcgaataggagcagatgaagaaattgatgatttcaaaggaagatcagctgaggaagtagaagaaataaaggcagaaaaagaggctaaaactcaggctatacttttggagatggtgggagacctacctgatgcagatattaaacctccagaaaatgtactgtttgtgtgtaaattgaacccagtgaccacagatgaggatctggaaataatattctctagatttgggccaataagaagttgtgaagttatccgagactggaagacaggagagtccctctgttacgcttttattgaatttgaaaaggaagaagattgtgagaaagcattcttcaaaatggacaatgtgcttatagatgacagaagaatacatgtggattttagccagtcggttgcaaaggttaaatggaaaggaaaaggtgggaaatacaccaagagtgatttcaaggagtatgaaaaagaacaggataaaccacctaatttggttctgaaagataaagtaaagcccaaacaggatacaaaatacgatcttatattagatgagcaggccgaagactcaaaatcaagtcactcacacacaagtaaaaaacacaagaagaaaacccatcactgttctgaagagaaagaagatgaggactacatgccaatcaaaaatactaatcaggatatctatagagaaatggggtttggtcactatgaagaagaagaaagctgttgggagaaacaaaagagtgaaaagagagaccgaactcagaaccgaagtcgtagccgatctcgagagagggatggccattatagtaatagtcataaatcaaaataccaaacagatctttatgaaagagaaaggagtaaaaagagagaccgaagcagaagtccaaagaagtccaaagataaagaaaaatctaagtatagatgaaagatgaagaggcagaattgagaggctaacatatttactcttgtctaacttaagagtgccaggaaagcagatgcttagattttgtgtcaaagcttgttatttttttcatactaggattatggtctttagattaatactgattatatagagcacggaaagataaagaattgaacattttctttgtatacttttttacactaattttattgttatacataaatggtagtcttcatttttgaagtcttacattttcactctttttttaatgaagtatttcatactacaaaaatacataaacgtatatataaagggataataaatgtaaatatctgtgtactcatcagccagcttaagatacagatgttgtcgacattttagaagttccctaaggccctctccctctcaaataattatttggaattttgtgtttgtcatttgtctattatagttttacaacatacgtatgtatctgtaagtgaaatgttaattttgtatgtttctgaattttatataaatggcaaaatgtttacttctgtgactttctttcatttttattgctatatagtattatataaatatactacaacttattcattcttgatggacatttgagttttgtttatttgtttttgctgttgaaacaatgctgctgtgaacattgtatctagcagttatattgcttgatatattgataaaataatgccaaatttgtgttctgaaaaa

SEQ ID NO: 427237 - DNA, 1297 bp, Homo sapiens
gttatttcaatgatatcttcttataggattcttatgggaattttagtagtttcattgcagatcaataatgggaccacgttttgggggagtgaagggtggggagctgggaataagactatacataatcagaatttttgattttgcagattgctctagagacatgttctgatttcagttgagctatttcagttccatatttttgaagctgatccttcgtttcagccaaaatagtagatacaaatcaatgacgttgttaaacctttttctgaattattttattgctttgtaatttacaagattcttgacattagtggtagtgttcacatttaagctgttataacagccttctaatggtagacttttctaagttttattaattgaaaatgcccacaaaatgattattttactgattcacttgtaattcccccttcctttgacaggatatctatagagaaatggggtttggtcactatgaagaagaagaaagctgttgggagaaacaaaagagtgaaaagagagaccgaactcagaaccgaagtcgtagccgatctcgagagagggatggccattatagtaatagtcataaatcaaaataccaaacagatctttatgaaagagaaaggagtaaaaagagagaccgaagcagaagtccaaagaagtccaaagataaagaaaaatctaagtatagatgaaagatgaagaggcagaattgagaggctaacatatttactcttgtctaacttaagagtgccaggaaagcagatgcttagattttgtgtcaaagcttgttatttttttcatactaggattatggtctttagattaatactgattatatagagcacggaaagataaagaattgaacattttctttgtatacttttttacactaattttattgttatacataaatggtagtcttcatttttgaagtcttacattttcactctttttttaatgaagtatttcatactacaaaaatacataaacgtatatataaagggataataaatgtaaatatctgtgtactcatcagccagcttaagatacagatgttgtcgacattttagaagttccctaaggccctctccctctcaaataattatttggaattttgtgtttgtcatttgtctattatagttttacaacatacgtatgtatctgtaagtgaaatgttaattttgtatgtttctgaattttatataaatggcaaaatgtttacttctgtgactttctttcatttttattgctatatagtattatataaatatactacaacttattcattcttgatgga

SEQ ID NO: 427238 - DNA, 634 bp, Homo sapiens
ccactgcactccagctcgggcaacagggcaagactccgtctcaaaaaaaataataagaagaatttaaacatgataactcgatatgcattgctgaatttcctcttgattgaactaaaagaagagacatacaaatgtacctgttatcttatatagcttttctgggcattggaatttataataattttttctagttaaagatgtccctcattttctaaatttaaattttttaaattattgacaaatacgtttattttttcctcctaatttttttgcctactagtctttattttaagattgtttaggattaggattctttccatttctcctgactatataatgaaagaaaatgttagttttgttttagaaatgtactatattcttttgagatgctttttgctttagttacttttagccttatgacctcctttgtttaccagatcttaagttttgatgtcttaccagtattatttatcacatttatccttaactaactactgcagtacaaaatacgatcttatattagatgagcaggccgaagactcaaaatcaagtcactcacacacaagtaaaaaacacaagaagaaaacccatcactgttctgaagagaaagaagatgaggactacatgccaatca

SEQ ID NO: 427239 - DNA, 2069 bp, Homo sapiens
tcctcccggggtttgtagcggaggaggagcgggcgccatggcggttctactggagaccactttaggcgacgtcgtcatcgacttgtacaccgaagaacggccgcgtgcctgcttgaatttcttgaaactgtgcaaaataaaatattacaattattgccttattcacaatgtacagagggattttatcatacaaactggcgatcctacagggactggccgtggaggagagtctatctttggccaactgtatggtgatcaagcaagcttttttgaggcagaaaaagtcccaagaattaagcacaagaagaaaggcacagtgtccatggtgaataatggcagtgatcaacatggatctcagtttcttatcaccacaggagaaaatctagattatcttgatggtgtccatacggtgtttggtgaggtgacagaaggcatggacataattaagaaaattaatgagacctttgttgacaaggactttgtaccatatcaggatatcaggataaatcatacggtgattttagatgatccatttgatgaccctcctgatttattaatccctgatcgatcaccagaacctacaagggaacaattagatagtggtcgaataggagcagatgaagaaattgatgatttcaaaggaagatcagctgaggaagtagaagaaataaaggcagaaaaagaggctaaaactcaggctatacttttggagatggtgggagacctacctgatgcagatattaaacctccagaaaatgtactgtttgtgtgtaaattgaacccagtgaccacagatgaggatctggaaataatattctctagatttgggccaataagaagttgtgaagttatccgagactggaagacaggagagtccctctgttacgcttttattgaatttgaaaaggaagaagattgtgagaaagcattcttcaaaatggacaatgtgcttatagatgacagaagaatacatgtggattttagccagtcggttgcaaaggttaaatggaaaggaaaaggtgggaaatacaccaagagtgatttcaaggagtatgaaaaagaacaggataaaccacctaatttggttctgaaagataaagtaaagcccaaacaggatacaaaatacgatcttatattagatgagcaggccgaagactcaaaatcaagtcactcacacacaagtaaaaaacacaagaagaaaacccatcactgttctgaagagaaagaagatgaggactacatgccaatcaaaaatactaatcaggatatctatagagaaatggggtttggtcactatgaagaagaagaaagctgttgggagaaacaaaagaggatggccattatagtaatagtcataaatcaaaataccaaacagatctttatgaaagagaaaggagtaaaaagagagaccgaagcagaagtccaaagaagtccaaagataaagaaaaatctaagtatagatgaaagatgaagaggcagaattgagaggctaacatatttactcttgtctaacttaagagtgccaggaaagcagatgcttagattttgtgtcaaagcttgttatttttttcatactaggattatggtctttagattaatactgattatatagagcacggaaagataaagaattgaacattttctttgtatacttttttacactaattttattgttatacataaatggtagtcttcatttttgaagtcttacattttcactctttttttaatgaagtatttcatactacaaaaatacataaacgtatatataaagggataataaatgtaaatatctgtgtactcatcagccagcttaagatacagatgttgtcgacattttagaagttccctaaggccctctccctctcaaataattatttggaattttgtgtttgtcatttgtctattatagttttacaacatacgtatgtatctgtaagtgaaatgttaattttgtatgtttctgaattttatataaatggcaaaatgtttacttctgtgactttctttcatttttattgctatatagtattatataaatatactacaacttattcattcttgatgga

SEQ ID NO: 427240 - DNA, 1272 bp, Homo sapiens
gaaagcattcttcaaaatccacatgtattcttctgtcatctataagcacattgtccattttgaagaatgctttctcacattcttcaaaatggacaatgtgcttatagatgacagaagaatacatgtggattttagccagtcggttgcaaaggttaaatggaaaggaaaaggtgggaaatacaccaagagtgatttcaaggagtatgaaaaagaacaggataaaccacctaatttggttctgaaagataaagtaaagcccaaacaggatacaaaatacgatcttatattagatgagcaggccgaagactcaaaatcaagtcactcacacacaagtaaaaaacacaagaagaaaacccatcactgttctgaagagaaagaagatgaggactacatgccaatcaaaaatactaatcaggatatctatagagaaatggggtttggtcactatgaagaagaagaaagctgttgggagaaacaaaagagtgaaaagagagaccgaactcagaaccgaagtcgtagccgatctcgagagagggatggccattatagtaatagtcataaatcaaaataccaaacagatctttatgaaagagaaaggagtaaaaagagagaccgaagcagaagtccaaagaagtccaaagataaagaaaaatctaagtatagatgaaagatgaagaggcagaattgagaggctaacatatttactcttgtctaacttaagagtgccaggaaagcagatgcttagattttgtgtcaaagcttgttatttttttcatactaggattatggtctttagattaatactgattatatagagcacggaaagataaagaattgaacattttctttgtatacttttttacactaattttattgttatacataaatggtagtcttcatttttgaagtcttacattttcactctttttttaatgaagtatttcatactacaaaaatacataaacgtatatataaagggataataaatgtaaatatctgtgtactcatcagccagcttaagatacagatgttgtcgacattttagaagttccctaaggccctctccctctcaaataattatttggaattttgtgtttgtcatttgtctattatagttttacaacatacgtatgtatctgtaagtgaaatgttaattttgtatgtttctgaattttatataaatggcaaaatgtttacttctgtgactttctttcatttttattgctatatagtattatataaatatactacaacttattcattcttgatgga

SEQ ID NO: 427241 - DNA, 1846 bp, Homo sapiens
ttgggcgccacaccttgcgcgccccggggcccaaggagacgaccctgaagaggagcctggctacttttgcctcagacgagtccggagcgccgggttaaccggtctgaagtcccaggggctttctgggactgctcagccaccggcagcttccggcaccaggggacgccggacgccgtccggacattcggcgcgcttgccacgatcttggacgggtctcgggcctcgacctttgaattccccgctccggctccaagatgtcagcaacgctgatcctggagcccccaggccgctgctgctggaacgagccggtgcgcattgccgtgcgcggcctggccccggagcagcgggttacgctgcgcgcgtccctgcgcgacgagaagggcgcgctcttccgggcccacgcgcgctactgcgccgacgcccgcggcgagctggacctggagcgcgcacccgcgctgggcggcagcttcgcgggactcgagcccatggggctgctctgggccctggaacccgagaagcctttttggcgcttcctgaagcgggacgtacagattccttttgtcgtggagttggaggtgctggacggccacgaccccgagcctggacggctgctgtgccaggcgcagcacgagcgccacttcctcccgccaggggtgcggcgccagtcggtgcgagcgggccgggtgcgcgccacgctcttcctgccgccaggacctggacccttcccagggatcattgacatctttggtattggagggggcctcttggaatatcgagccagcctccttgctggccatggctttgccacgttggctctagcttattataactttgaagatctccccaataacatggacaacatatccctggagtacttcgaagaagccgtatgctacatgcttcaacatccccaggtaaaaggcccaggcattgggcttttgggcatttctctaggagctgatatttgtctctcaatggcctcattcttgaagaatgtctcagccacagtttccatcaatggatctgggatcagtgggaacacagccatcaactataagcacagtagcattccaccattgggctatgacctgaggagaatcaaggtagctttctcaggcctcgtggacatcgtggatataaggaatgctctcgtaggagggtacaagaaccccagcatgattccaatagagaaggcccaggggcccatcctgctcattgttggtcaggatgaccataactggagaagtgagttgtatgcccaaacagtctctgaacggttacaggcccatggaaaggaaaaaccccagatcatctgttaccctgggactgggcattacatcgagcctccttacttccccctgtgcccagcttcccttcacagattactgaacaaacatgttatatggggtggggagcccagggctcattctaaggcccaggaagatgcctggaagcaaattctagccttcttctgcaaacacctgggaggtacccagaaaacagctgtccctaaattgtaatgcatttgtctgttgttgacatgagagattcaagatcagattctagtgttcagtaaccctatgtgaatcagatgtctcctggataacattaaagccatgtctttgtcattaaaagaaaaaacgttatagactaaaaaaagaaaaaaaaaaagggggggggaaaaaatttcgcgggggcgaatttggtcacgcgtttttgacagagggccctaagggggtttaaaacgggggggggttaaagtggagaaacgtctgggtttggggagacctttggtggtgggacccacaaatcgcgggaattagtgttgaacttggggttgtaaagg

SEQ ID NO: 427242 - DNA, 7223 bp, Homo sapiens
tagccggacggcgcggtggtcgggacagactggccgttgctgtggagacgcctggagagttgtggactggggcaacctttgccagtgatgagaagtgatgctcgtggcagtgctgaatctctctgaatatgattcgaattgcagccttaaatgccagctccaccattgaggatgatcatgaaggaagctttaaaagtcacaaaacccagacaaaggaggctcaggaagcagaggcttttgcattgtaccacaaggcccttgatctgcagaaacatgaccggtttgaggagtctgccaaagcctaccatgagctcttggaggcgagcctgctgcgggaggcagtttcatccggtgatgagaaagaggggttgaaacaccctgggctgatactgaaatattccacttataagaacttggcccagctggcagcccagcgggaggatctggagacagccatggagttctacttagaggcagtgatgctggactccacagatgtcaacctctggtataagattggacatgtggccctgaggctcatccggatccccctggctcgccatgcttttgaggaagggctgcggtgcaatcctgaccactggccctgtttggataacctaatcactgtcctgtacaccctcagtgattacacaacatgtctgtacttcatctgcaaagctttggagaaggattgccggtacagcaaagggctggtcctcaaggagaagatttttgaggagcagccttgtctccggaaggactctctcagaatgttcctcaaatgtgacatgtcgattcacgatgtttcggtgagtgcagctgagacacaggcgattgtagatgaggccttggggctgcgaaaaaagaggcaagcgctgattgtgcgggagaaggagccggacctgaaacttgtgcagcccattcctttcttcacctggaagtgcctcggagagagcttgctggccatgtacaatcatctcaccacctgtgagcccccacgtcccagccttggcaaaaggattgatttgtcggactaccaggaccccagccagcctcttgagtcctccatggtggtgacgccagttaacgtgatccagccaagcactgtcagcaccaacccagctgtggctgtcgccgagcctgtggtctcctacacctctgtggctacaaccagcttcccactgcacagtcctggtctgttggagacaggcgctcctgtgggtgatatttctgggggagataaatccaagaaaggggtaaaacggaagaagatttcagaagagagtggagaaacagcaaagcggcggtctgcccgtgtccgaaacaccaagtgcaaaaaagaagagaaagtagacttccaggagcttctgatgaagttcttgccgtccaggttaagaaagctggaccctgaggaggaagatgattcctttaataactatgaagtccagtcagaagccaaactggaaagcttcccaagcattgggcctcaaaggctgtcatttgactcagccacattcatggaatctgaaaagcaggacgtgcatgagttcctgctggagaacctaaccaacgggggcatcctggagctgatgatgcgctacctgaaagccatgggccacaagttcttggtaaggtggcctccaggcttggcggaggtcgtgctcagcgtctaccacagctggaggaggcacagcaccagcctgcccaacccgctgctgagggactgcagcaacaagcacatcaaggacatgatgctgatgtctctctcctgcatggaactccagctggaccagtggctgctgaccaaaggcagaagctctgcagtgtctcctcggaactgccctgctggtatggtgaatggcagatttggacctgacttcccagggacccactgcctgggtgacctcctacagctgtcatttgcctcgtcccagcgcgacctgttcgaggatggttggctggagtttgtggtccgtgtttactggctgaaggctcgcttcctggcgctgcagggagacatggagcaggccctggagaactatgacatctgcacagaaatgctccagagttccaccgccatccaggtggaggcaggggctgaacgaagagacattgtcatccggctgcccaacctccataatgactctgtggtttccctggaggagattgataagaacctgaagtcgctggagcggtgccagtccctggaggagattcagcggctgtatgaagcaggcgactacaaggctgttgtgcatctgctccgccccactttgtgcaccagtgggtttgaccgggccaaacacctggagtttatgacttccattcctgagaggccagcccagctgcttcttctgcaggactccttgctccggctgaaggactatcggcagtgttttgagtgttccgatgtggctctgaacgaggctgtccagcagatggtgaactcaggtgaggctgccgccaaggaggagtgggtggccacagtgacccaactgctgatgggcatcgagcaggccctctctgcggacagcagtggtagcatcctgaaggtatcatcctccaccactggccttgtgcggctcaccaacaacctcatccaggtcattgactgcagcatggctgtgcaggaggaggccaaggagccccacgtctcttcagtgctaccctggatcattctacaccggatcatctggcaggaggaagacaccttccattctctgtgccaccagcagcagctccaaaacccagcggaggaagggatgtcagagacgcccatgctcccatcctccctcatgctgctgaacacagcccacgagtatttgggcagaaggtcctggtgctgcaattcagatggggctctgctgcgattctatgtgcgagtactccagaaggaactggctgcatccacctctgaagacacgcacccttacaaggaggagctggagacagccttggagcagtgcttctactgcctgtacagcttccccagcaagaagagtaaggccaggtacctggaggaacactcggcccagcaggtggatcttatatgggaggatgcactgttcatgtttgagtattttaagcccaagacccttcctgaatttgacagctataagaccagcaccgtgtctgctgacttggccaacctactgaagagaattgccaccattgtgcctcgcacagagaggccagcccttagcctggacaaagtctctgcctacattgagggaacttcaactgaggtaccctgcctcccagagggggctgacccctcccctccagtggtgaacgagctttactacctcctggctgattatcatttcaaaaacaaggagcagtccaaggccatcaagttctacatgcatgacatctgcatctgccccaataggtttgattcctgggcaggcatggctctggcccgggccagccgcattcaggacaagctgaactccaatgagctgaagagtgatgggcccatttggaagcatgccacgcccgtcttgaactgcttccgtcgggccctggagattgacagctccaacttgtccctatggattgagtatggcaccatgtcctatgccttgcactcattcgcctcacgtcaattgaagcagtggagaggcgagctgccccctgagctcgtgcagcagatggagggccggcgcgacagcatgctagagacagccaagcactgtttcacatcagcagcccgctgcgagggtgatggtgacgaggaggagtggctcatccactacatgctgggcaaggtggctgagaagcagcagcagccacccaccgtttacttgctgcactacaggcaggctggccactacctgcacgaggaggctgcccgctaccccaagaagatccactaccacaacccacctgagctggccatggaggccctggaggtgtactttcggctccatgcttccatcctgaagctcctggggaagcccgattctggggttggtgcagaggtcctggtcaactttatgaaggaggctgcagaaggaccctttgccaggggcgaggagaagaacacacccaaagcttcagaaaaggagaaggcctgcctggtggacgaggactcccactcttcagctgggacactgccgggccccggagcctccctcccctcctcctctggcccaggtctgacatccccaccttacacagccactccgattgaccacgattacgtcaaatgtaaaaaaccccaccagcaggcaacgccggacgaccgaagccaggacagcacagccgtagcactctcagactctagctcaacgcaggacttctttaatgagcccaccagcttactggaaggctccaggaaatcctacacagagaagaggctgcccattctcagttcccaagcaggagcgacgggtaaagatcttcagggggccacagaagaaagaggaaaaaacgaggagtcattggagagtacagaaggcttccgggctgcagagcaaggtgtccagaagcctgctgcagaaaccccagcctctgcttgcatccctggcaagccctcagcatccacacccaccctgtgggatgggaagaagagaggggacctcccaggggagccagtggccttcccccaggggctgccggctggtgctgaggagcagcggcagtttctcacagagcagtgcatcgcctccttccgcctgtgcctgagccgcttcccccagcactataagagtctctaccgtctggccttcctctacacctacagcaagacccaccggaacctccagtgggcccgcgacgtgttgctaggcagcagtatcccgtggcaacaactgcagcacatgccggcacaggggctcttctgcgagaggaacaagaccaatttcttcaacggcatctggcggatccccgtggacgagattgaccggccgggcagctttgcctggcacatgaaccgctccatcgtgctgctgctcaaggtgctggcccagctgcgggaccacagcaccctgctgaaggtgtcctccatgcttcagcggaccccagaccagggcaagaagtatctgcgagatgctgaccgccaggtcctggcgcagcgggccttcatcctcactgtgaaggtgctcgaagacacgctgagcgagctcgcagaggggtcagaacgcccagggcccaaggtctgtggcctccccggagccaggatgaccaccgatgtctcacacaaggccagtcctgaggatggccaggagggcctcccccagccgaagaagccccctctggctgatggctcagggccagggcccgagccaggaggcaaagtgggcctcctcaaccaccggcctgtggccatggatgcaggagacagtgcagaccaaagcggggagcggaaggataaagagagcccacgggcagggcccactgagcccatggacacgagtgaggccactgtttgccactcagacttggagcggacaccacccctgctgccaggtcgccccgcaagggaccggggccccgagagccggcccactgagctgtccctggaggagctgagcatcagtgcccggcagcagcccaccccgctcaccccagcccagccagcccccgcccccgcccccgccaccaccacagggaccagggcagggggccacccggaggagccgctctcccggctcagccgcaagaggaagctcctggaggacacagagtcaggcaagacacttctgttggatgcctaccgtgtgtggcagcagggccagaagggtgtggcctatgacctgggccgtgtggagaggatcatgtcggagacctacatgctcatcaagcaggtggatgaggaggctgcgctggagcaggctgtgaagttctgccaggtccatcttggggctgccgcccagagacaggcctcgggggacacccccaccactccaaagcaccccaaagacagccgagagaacttctttcctgtgacagtggtgcccacagcccctgaccctgtgccagctgactctgtccagcggcccagtgatgctcacaccaagcctcgccctgcactagctgccgccacaactattatcacctgccctccgtcagcatcagcttccaccctggaccagtccaaggaccctgggcctccccggccacacaggcctgaagctacccccagcatggcctctctgggcccagagggagaagagctggcgagagtggcagagggcaccagcttcccgcctcaggagccacggcacagtccgcaggtgaagatggcccccacaagttccccggcagagccacactgctggccggcagaggctgccctgggcacaggcgctgagcccacctgcagccaggaggggaaactgaggcctgagccgagaagggatggggaggctcaggaggctgcgagtgagactcagcccctgagctctcccccaacagctgccagctccaaggcccccagcagtgggagtgcccagccaccagagggtcacccaggcaagcctgagcccagccgggctaagtcccgccccctgcccaacatgccaaagctggtcatcccctccgccgccaccaagttcccccctgagatcaccgtcacgccacccaccccaaccctgctctcccccaaaggcagcatctcggaggagaccaagcagaagctgaagtcagccatcctttctgcccagtctgctgccaacgtgaggaaggagagcctatgccagccagccctggaggtcctggagacatccagccaggagtcctcgctggagagcgagacagacgaggacgacgactacatggacatttgaggggccactgcagccccaccgccacgccccaggggaccagccaggcctggaatgccccctgggcaggaccctgggcaggaccagaggcccacatggatgccactccccacacagcccccaggcctgcccagcccacctcctcatggcatcctccctgtacccaggtcaggctgtccacaccacatgggagcccagaggaggaggggcccgccttagccatgtgaaggtggattggtcgccatctgcacgccaggcggcatccttttctatgaagtgttgactttgtaaatctgcccacacccagctggccatatccacccctcgacgccgggatgagccggctctgcctgtgtcacagtggaggggtcctttagggccaggctcacccctcaccctttttttggttgcttttctaataaagatggaacagtt

SEQ ID NO: 427243 - DNA, 7353 bp, Homo sapiens
gggtgaggctcagcagagcccggggcacaggccggaggggctgcaggcgcgaggctgggttacgtgaggaagctgggggtttcgcgggcagctttagagccccagtcagggaaaccgaggccgggcttcctggctgcctcgcgagcctcttcatggctctcgccgccgccctgaggtgcctagaatgggttccggcctccggggaggttcccagtaaccgcaggagccaccattgatttggcgtctgctgggtgcaaagcccagcgcgctaaccctttactcgcgacctttcgcttcaccttcacagcagccctgcgaggagagttgtggactggggcaacctttgccagtgatgagaagtgatgctcgtggcagtgctgaatctctctgaatatgattcgaattgcagccttaaatgccagctccaccattgaggatgatcatgaaggaagctttaaaagtcacaaaacccagacaaaggaggctcaggaagcagaggcttttgcattgtaccacaaggcccttgatctgcagaaacatgaccggtttgaggagtctgccaaagcctaccatgagctcttggaggcgagcctgctgcgggaggcagtgatgctggactccacagatgtcaacctctggtataagattggacatgtggccctgaggctcatccggatccccctggctcgccatgcttttgaggaagggctgcggtgcaatcctgaccactggccctgtttggataacctaatcactgtcctgtacaccctcagtgattacacaacatgtctgtacttcatctgcaaagctttggagaaggattgccggtacagcaaagggctggtcctcaaggagaagatttttgaggagcagccttgtctccggaaggactctctcagaatgttcctcaaatgtgacatgtcgattcacgatgtttcggtgagtgcagctgagacacaggcgattgtagatgaggccttggggctgcgaaaaaagaggcaagcgctgattgtgcgggagaaggagccggacctgaaacttgtgcagcccattcctttcttcacctggaagtgcctcggagagagcttgctggccatgtacaatcatctcaccacctgtgagcccccacgtcccagccttggcaaaaggattgatttgtcggactaccaggaccccagccagcctcttgagtcctccatggtggtgacgccagttaacgtgatccagccaagcactgtcagcaccaacccagctgtggctgtcgccgagcctgtggtctcctacacctctgtggctacaaccagcttcccactgcacagtcctggtctgttggagacaggcgctcctgtgggtgatatttctgggggagataaatccaagaaaggggtaaaacggaagaagatttcagaagagagtggagaaacagcaaagcggcggtctgcccgtgtccgaaacaccaagtgcaaaaaagaagagaaagtagacttccaggagcttctgatgaagttcttgccgtccaggttaagaaagctggaccctgaggaggaagatgattcctttaataactatgaagtccagtcagaagccaaactggaaagcttcccaagcattgggcctcaaaggctgtcatttgactcagccacattcatggaatctgaaaagcaggacgtgcatgagttcctgctggagaacctaaccaacgggggcatcctggagctgatgatgcgctacctgaaagccatgggccacaagttcttggtaaggtggcctccaggcttggcggaggtcgtgctcagcgtctaccacagctggaggaggcacagcaccagcctgcccaacccgctgctgagggactgcagcaacaagcacatcaaggacatgatgctgatgtctctctcctgcatggaactccagctggaccagtggctgctgaccaaaggcagaagctctgcagtgtctcctcggaactgccctgctggtatggtgaatggcagatttggacctgacttcccagggacccactgcctgggtgacctcctacagctgtcatttgcctcgtcccagcgcgacctgttcgaggatggttggctggagtttgtggtccgtgtttactggctgaaggctcgcttcctggcgctgcagggagacatggagcaggccctggagaactatgacatctgcacagaaatgctccagagttccaccgccatccaggtggaggcaggggctgaacgaagagacattgtcatccggctgcccaacctccataatgactctgtggtttccctggaggagattgataagaacctgaagtcgctggagcggtgccagtccctggaggagattcagcggctgtatgaagcaggcgactacaaggctgttgtgcatctgctccgccccactttgtgcaccagtgggtttgaccgggccaaacacctggagtttatgacttccattcctgagaggccagcccagctgcttcttctgcaggactccttgctccggctgaaggactatcggcagtgttttgagtgttccgatgtggctctgaacgaggctgtccagcagatggtgaactcaggtgaggctgccgccaaggaggagtgggtggccacagtgacccaactgctgatgggcatcgagcaggccctctctgcggacagcagtggtagcatcctgaaggtatcatcctccaccactggccttgtgcggctcaccaacaacctcatccaggtcattgactgcagcatggctgtgcaggaggaggccaaggagccccacgtctcttcagtgctaccctggatcattctacaccggatcatctggcaggaggaagacaccttccattctctgtgccaccagcagcagctccaaaacccagcggaggaagggatgtcagagacgcccatgctcccatcctccctcatgctgctgaacacagcccacgagtatttgggcagaaggtcctggtgctgcaattcagatggggctctgctgcgattctatgtgcgagtactccagaaggaactggctgcatccacctctgaagacacgcacccttacaaggaggagctggagacagccttggagcagtgcttctactgcctgtacagcttccccagcaagaagagtaaggccaggtacctggaggaacactcggcccagcaggtggatcttatatgggaggatgcactgttcatgtttgagtattttaagcccaagacccttcctgaatttgacagctataagaccagcaccgtgtctgctgacttggccaacctactgaagagaattgccaccattgtgcctcgcacagagaggccagcccttagcctggacaaagtctctgcctacattgagggaacttcaactgaggtaccctgcctcccagagggggctgacccctcccctccagtggtgaacgagctttactacctcctggctgattatcatttcaaaaacaaggagcagtccaaggccatcaagttctacatgcatgacatctgcatctgccccaataggtttgattcctgggcaggcatggctctggcccgggccagccgcattcaggacaagctgaactccaatgagctgaagagtgatgggcccatttggaagcatgccacgcccgtcttgaactgcttccgtcgggccctggagattgacagctccaacttgtccctatggattgagtatggcaccatgtcctatgccttgcactcattcgcctcacgtcaattgaagcagtggagaggcgagctgccccctgagctcgtgcagcagatggagggccggcgcgacagcatgctagagacagccaagcactgtttcacatcagcagcccgctgcgagggtgatggtgacgaggaggagtggctcatccactacatgctgggcaaggtggctgagaagcagcagcagccacccaccgtttacttgctgcactacaggcaggctggccactacctgcacgaggaggctgcccgctaccccaagaagatccactaccacaacccacctgagctggccatggaggccctggaggtgtactttcggctccatgcttccatcctgaagctcctggggaagcccgattctggggttggtgcagaggtcctggtcaactttatgaaggaggctgcagaaggaccctttgccaggggcgaggagaagaacacacccaaagcttcagaaaaggagaaggcctgcctggtggacgaggactcccactcttcagctgggacactgccgggccccggagcctccctcccctcctcctctggcccaggtctgacatccccaccttacacagccactccgattgaccacgattacgtcaaatgtaaaaaaccccaccagcaggcaacgccggacgaccgaagccaggacagcacagccgtagcactctcagactctagctcaacgcaggacttctttaatgagcccaccagcttactggaaggctccaggaaatcctacacagagaagaggctgcccattctcagttcccaagcaggagcgacgggtaaagatcttcagggggccacagaagaaagaggaaaaaacgaggagtcattggagagtacagaaggcttccgggctgcagagcaaggtgtccagaagcctgctgcagaaaccccagcctctgcttgcatccctggcaagccctcagcatccacacccaccctgtgggatgggaagaagagaggggacctcccaggggagccagtggccttcccccaggggctgccggctggtgctgaggagcagcggcagtttctcacagagcagtgcatcgcctccttccgcctgtgcctgagccgcttcccccagcactataagagtctctaccgtctggccttcctctacacctacagcaagacccaccggaacctccagtgggcccgcgacgtgttgctaggcagcagtatcccgtggcaacaactgcagcacatgccggcacaggggctcttctgcgagaggaacaagaccaatttcttcaacggcatctggcggatccccgtggacgagattgaccggccgggcagctttgcctggcacatgaaccgctccatcgtgctgctgctcaaggtgctggcccagctgcgggaccacagcaccctgctgaaggtgtcctccatgcttcagcggaccccagaccagggcaagaagtatctgcgagatgctgaccgccaggtcctggcgcagcgggccttcatcctcactgtgaaggtgctcgaagacacgctgagcgagctcgcagaggggtcagaacgcccagggcccaaggtctgtggcctccccggagccaggatgaccaccgatgtctcacacaaggccagtcctgaggatggccaggagggcctcccccagccgaagaagccccctctggctgatggctcagggccagggcccgagccaggaggcaaagtgggcctcctcaaccaccggcctgtggccatggatgcaggagacagtgcagaccaaagcggggagcggaaggataaagagagcccacgggcagggcccactgagcccatggacacgagtgaggccactgtttgccactcagacttggagcggacaccacccctgctgccaggtcgccccgcaagggaccggggccccgagagccggcccactgagctgtccctggaggagctgagcatcagtgcccggcagcagcccaccccgctcaccccagcccagccagcccccgcccccgcccccgccaccaccacagggaccagggcagggggccacccggaggagccgctctcccggctcagccgcaagaggaagctcctggaggacacagagtcaggcaagacacttctgttggatgcctaccgtgtgtggcagcagggccagaagggtgtggcctatgacctgggccgtgtggagaggatcatgtcggagacctacatgctcatcaagcaggtggatgaggaggctgcgctggagcaggctgtgaagttctgccaggtccatcttggggctgccgcccagagacaggcctcgggggacacccccaccactccaaagcaccccaaagacagccgagagaacttctttcctgtgacagtggtgcccacagcccctgaccctgtgccagctgactctgtccagcggcccagtgatgctcacaccaagcctcgccctgcactagctgccgccacaactattatcacctgccctccgtcagcatcagcttccaccctggaccagtccaaggaccctgggcctccccggccacacaggcctgaagctacccccagcatggcctctctgggcccagagggagaagagctggcgagagtggcagagggcaccagcttcccgcctcaggagccacggcacagtccgcaggtgaagatggcccccacaagttccccggcagagccacactgctggccggcagaggctgccctgggcacaggcgctgagcccacctgcagccaggaggggaaactgaggcctgagccgagaagggatggggaggctcaggaggctgcgagtgagactcagcccctgagctctcccccaacagctgccagctccaaggcccccagcagtgggagtgcccagccaccagagggtcacccaggcaagcctgagcccagccgggctaagtcccgccccctgcccaacatgccaaagctggtcatcccctccgccgccaccaagttcccccctgagatcaccgtcacgccacccaccccaaccctgctctcccccaaaggcagcatctcggaggagaccaagcagaagctgaagtcagccatcctttctgcccagtctgctgccaacgtgaggaaggagagcctatgccagccagccctggaggtcctggagacatccagccaggagtcctcgctggagagcgagacagacgaggacgacgactacatggacatttgaggggccactgcagccccaccgccacgccccaggggaccagccaggcctggaatgccccctgggcaggaccctgggcaggaccagaggcccacatggatgccactccccacacagcccccaggcctgcccagcccacctcctcatggcatcctccctgtacccaggtcaggctgtccacaccacatgggagcccagaggaggaggggcccgccttagccatgtgaaggtggattggtcgccatctgcacgccaggcggcatccttttctatgaagtgttgactttgtaaatctgcccacacccagctggccatatccacccctcgacgccgggatgagccggctctgcctgtgtcacagtggaggggtcctttagggccaggctcacccctcaccctttttttggttgcttttctaataaagatggaacagtt

SEQ ID NO: 427244 - DNA, 7488 bp, Homo sapiens
gggtgaggctcagcagagcccggggcacaggccggaggggctgcaggcgcgaggctgggttacgtgaggaagctgggggtttcgcgggcagctttagagccccagtcagggaaaccgaggccgggcttcctggctgcctcgcgagcctcttcatggctctcgccgccgccctgaggtgcctagaatgggttccggcctccggggaggttcccagtaaccgcaggagccaccattgatttggcgtctgctgggtgcaaagcccagcgcgctaaccctttactcgcgacctttcgcttcaccttcacagcagccctgcgaggagagttgtggactggggcaacctttgccagtgatgagaagtgatgctcgtggcagtgctgaatctctctgaatatgattcgaattgcagccttaaatgccagctccaccattgaggatgatcatgaaggaagctttaaaagtcacaaaacccagacaaaggaggctcaggaagcagaggcttttgcattgtaccacaaggcccttgatctgcagaaacatgaccggtttgaggagtctgccaaagcctaccatgagctcttggaggcgagcctgctgcgggaggcagtttcatccggtgatgagaaagaggggttgaaacaccctgggctgatactgaaatattccacttataagaacttggcccagctggcagcccagcgggaggatctggagacagccatggagttctacttagaggcagtgatgctggactccacagatgtcaacctctggtataagattggacatgtggccctgaggctcatccggatccccctggctcgccatgcttttgaggaagggctgcggtgcaatcctgaccactggccctgtttggataacctaatcactgtcctgtacaccctcagtgattacacaacatgtctgtacttcatctgcaaagctttggagaaggattgccggtacagcaaagggctggtcctcaaggagaagatttttgaggagcagccttgtctccggaaggactctctcagaatgttcctcaaatgtgacatgtcgattcacgatgtttcggtgagtgcagctgagacacaggcgattgtagatgaggccttggggctgcgaaaaaagaggcaagcgctgattgtgcgggagaaggagccggacctgaaacttgtgcagcccattcctttcttcacctggaagtgcctcggagagagcttgctggccatgtacaatcatctcaccacctgtgagcccccacgtcccagccttggcaaaaggattgatttgtcggactaccaggaccccagccagcctcttgagtcctccatggtggtgacgccagttaacgtgatccagccaagcactgtcagcaccaacccagctgtggctgtcgccgagcctgtggtctcctacacctctgtggctacaaccagcttcccactgcacagtcctggtctgttggagacaggcgctcctgtgggtgatatttctgggggagataaatccaagaaaggggtaaaacggaagaagatttcagaagagagtggagaaacagcaaagcggcggtctgcccgtgtccgaaacaccaagtgcaaaaaagaagagaaagtagacttccaggagcttctgatgaagttcttgccgtccaggttaagaaagctggaccctgaggaggaagatgattcctttaataactatgaagtccagtcagaagccaaactggaaagcttcccaagcattgggcctcaaaggctgtcatttgactcagccacattcatggaatctgaaaagcaggacgtgcatgagttcctgctggagaacctaaccaacgggggcatcctggagctgatgatgcgctacctgaaagccatgggccacaagttcttggtaaggtggcctccaggcttggcggaggtcgtgctcagcgtctaccacagctggaggaggcacagcaccagcctgcccaacccgctgctgagggactgcagcaacaagcacatcaaggacatgatgctgatgtctctctcctgcatggaactccagctggaccagtggctgctgaccaaaggcagaagctctgcagtgtctcctcggaactgccctgctggtatggtgaatggcagatttggacctgacttcccagggacccactgcctgggtgacctcctacagctgtcatttgcctcgtcccagcgcgacctgttcgaggatggttggctggagtttgtggtccgtgtttactggctgaaggctcgcttcctggcgctgcagggagacatggagcaggccctggagaactatgacatctgcacagaaatgctccagagttccaccgccatccaggtggaggcaggggctgaacgaagagacattgtcatccggctgcccaacctccataatgactctgtggtttccctggaggagattgataagaacctgaagtcgctggagcggtgccagtccctggaggagattcagcggctgtatgaagcaggcgactacaaggctgttgtgcatctgctccgccccactttgtgcaccagtgggtttgaccgggccaaacacctggagtttatgacttccattcctgagaggccagcccagctgcttcttctgcaggactccttgctccggctgaaggactatcggcagtgttttgagtgttccgatgtggctctgaacgaggctgtccagcagatggtgaactcaggtgaggctgccgccaaggaggagtgggtggccacagtgacccaactgctgatgggcatcgagcaggccctctctgcggacagcagtggtagcatcctgaaggtatcatcctccaccactggccttgtgcggctcaccaacaacctcatccaggtcattgactgcagcatggctgtgcaggaggaggccaaggagccccacgtctcttcagtgctaccctggatcattctacaccggatcatctggcaggaggaagacaccttccattctctgtgccaccagcagcagctccaaaacccagcggaggaagggatgtcagagacgcccatgctcccatcctccctcatgctgctgaacacagcccacgagtatttgggcagaaggtcctggtgctgcaattcagatggggctctgctgcgattctatgtgcgagtactccagaaggaactggctgcatccacctctgaagacacgcacccttacaaggaggagctggagacagccttggagcagtgcttctactgcctgtacagcttccccagcaagaagagtaaggccaggtacctggaggaacactcggcccagcaggtggatcttatatgggaggatgcactgttcatgtttgagtattttaagcccaagacccttcctgaatttgacagctataagaccagcaccgtgtctgctgacttggccaacctactgaagagaattgccaccattgtgcctcgcacagagaggccagcccttagcctggacaaagtctctgcctacattgagggaacttcaactgaggtaccctgcctcccagagggggctgacccctcccctccagtggtgaacgagctttactacctcctggctgattatcatttcaaaaacaaggagcagtccaaggccatcaagttctacatgcatgacatctgcatctgccccaataggtttgattcctgggcaggcatggctctggcccgggccagccgcattcaggacaagctgaactccaatgagctgaagagtgatgggcccatttggaagcatgccacgcccgtcttgaactgcttccgtcgggccctggagattgacagctccaacttgtccctatggattgagtatggcaccatgtcctatgccttgcactcattcgcctcacgtcaattgaagcagtggagaggcgagctgccccctgagctcgtgcagcagatggagggccggcgcgacagcatgctagagacagccaagcactgtttcacatcagcagcccgctgcgagggtgatggtgacgaggaggagtggctcatccactacatgctgggcaaggtggctgagaagcagcagcagccacccaccgtttacttgctgcactacaggcaggctggccactacctgcacgaggaggctgcccgctaccccaagaagatccactaccacaacccacctgagctggccatggaggccctggaggtgtactttcggctccatgcttccatcctgaagctcctggggaagcccgattctggggttggtgcagaggtcctggtcaactttatgaaggaggctgcagaaggaccctttgccaggggcgaggagaagaacacacccaaagcttcagaaaaggagaaggcctgcctggtggacgaggactcccactcttcagctgggacactgccgggccccggagcctccctcccctcctcctctggcccaggtctgacatccccaccttacacagccactccgattgaccacgattacgtcaaatgtaaaaaaccccaccagcaggcaacgccggacgaccgaagccaggacagcacagccgtagcactctcagactctagctcaacgcaggacttctttaatgagcccaccagcttactggaaggctccaggaaatcctacacagagaagaggctgcccattctcagttcccaagcaggagcgacgggtaaagatcttcagggggccacagaagaaagaggaaaaaacgaggagtcattggagagtacagaaggcttccgggctgcagagcaaggtgtccagaagcctgctgcagaaaccccagcctctgcttgcatccctggcaagccctcagcatccacacccaccctgtgggatgggaagaagagaggggacctcccaggggagccagtggccttcccccaggggctgccggctggtgctgaggagcagcggcagtttctcacagagcagtgcatcgcctccttccgcctgtgcctgagccgcttcccccagcactataagagtctctaccgtctggccttcctctacacctacagcaagacccaccggaacctccagtgggcccgcgacgtgttgctaggcagcagtatcccgtggcaacaactgcagcacatgccggcacaggggctcttctgcgagaggaacaagaccaatttcttcaacggcatctggcggatccccgtggacgagattgaccggccgggcagctttgcctggcacatgaaccgctccatcgtgctgctgctcaaggtgctggcccagctgcgggaccacagcaccctgctgaaggtgtcctccatgcttcagcggaccccagaccagggcaagaagtatctgcgagatgctgaccgccaggtcctggcgcagcgggccttcatcctcactgtgaaggtgctcgaagacacgctgagcgagctcgcagaggggtcagaacgcccagggcccaaggtctgtggcctccccggagccaggatgaccaccgatgtctcacacaaggccagtcctgaggatggccaggagggcctcccccagccgaagaagccccctctggctgatggctcagggccagggcccgagccaggaggcaaagtgggcctcctcaaccaccggcctgtggccatggatgcaggagacagtgcagaccaaagcggggagcggaaggataaagagagcccacgggcagggcccactgagcccatggacacgagtgaggccactgtttgccactcagacttggagcggacaccacccctgctgccaggtcgccccgcaagggaccggggccccgagagccggcccactgagctgtccctggaggagctgagcatcagtgcccggcagcagcccaccccgctcaccccagcccagccagcccccgcccccgcccccgccaccaccacagggaccagggcagggggccacccggaggagccgctctcccggctcagccgcaagaggaagctcctggaggacacagagtcaggcaagacacttctgttggatgcctaccgtgtgtggcagcagggccagaagggtgtggcctatgacctgggccgtgtggagaggatcatgtcggagacctacatgctcatcaagcaggtggatgaggaggctgcgctggagcaggctgtgaagttctgccaggtccatcttggggctgccgcccagagacaggcctcgggggacacccccaccactccaaagcaccccaaagacagccgagagaacttctttcctgtgacagtggtgcccacagcccctgaccctgtgccagctgactctgtccagcggcccagtgatgctcacaccaagcctcgccctgcactagctgccgccacaactattatcacctgccctccgtcagcatcagcttccaccctggaccagtccaaggaccctgggcctccccggccacacaggcctgaagctacccccagcatggcctctctgggcccagagggagaagagctggcgagagtggcagagggcaccagcttcccgcctcaggagccacggcacagtccgcaggtgaagatggcccccacaagttccccggcagagccacactgctggccggcagaggctgccctgggcacaggcgctgagcccacctgcagccaggaggggaaactgaggcctgagccgagaagggatggggaggctcaggaggctgcgagtgagactcagcccctgagctctcccccaacagctgccagctccaaggcccccagcagtgggagtgcccagccaccagagggtcacccaggcaagcctgagcccagccgggctaagtcccgccccctgcccaacatgccaaagctggtcatcccctccgccgccaccaagttcccccctgagatcaccgtcacgccacccaccccaaccctgctctcccccaaaggcagcatctcggaggagaccaagcagaagctgaagtcagccatcctttctgcccagtctgctgccaacgtgaggaaggagagcctatgccagccagccctggaggtcctggagacatccagccaggagtcctcgctggagagcgagacagacgaggacgacgactacatggacatttgaggggccactgcagccccaccgccacgccccaggggaccagccaggcctggaatgccccctgggcaggaccctgggcaggaccagaggcccacatggatgccactccccacacagcccccaggcctgcccagcccacctcctcatggcatcctccctgtacccaggtcaggctgtccacaccacatgggagcccagaggaggaggggcccgccttagccatgtgaaggtggattggtcgccatctgcacgccaggcggcatccttttctatgaagtgttgactttgtaaatctgcccacacccagctggccatatccacccctcgacgccgggatgagccggctctgcctgtgtcacagtggaggggtcctttagggccaggctcacccctcaccctttttttggttgcttttctaataaagatggaacagtt

SEQ ID NO: 427245 - DNA, 7252 bp, Homo sapiens
tttccctggaggagattgataagaacctgaagtcgctggagcggtgccagtccctggaggagattcagcggctgtatgaagcagagagttgtggactggggcaacctttgccagtgatgagaagtgatgctcgtggcagtgctgaatctctctgaatatgattcgaattgcagccttaaatgccagctccaccattgaggatgatcatgaaggaagctttaaaagtcacaaaacccagacaaaggaggctcaggaagcagaggcttttgcattgtaccacaaggcccttgatctgcagaaacatgaccggtttgaggagtctgccaaagcctaccatgagctcttggaggcgagcctgctgcgggaggcagtttcatccggtgatgagaaagaggggttgaaacaccctgggctgatactgaaatattccacttataagaacttggcccagctggcagcccagcgggaggatctggagacagccatggagttctacttagaggcagtgatgctggactccacagatgtcaacctctggtataagattggacatgtggccctgaggctcatccggatccccctggctcgccatgcttttgaggaagggctgcggtgcaatcctgaccactggccctgtttggataacctaatcactgtcctgtacaccctcagtgattacacaacatgtctgtacttcatctgcaaagctttggagaaggattgccggtacagcaaagggctggtcctcaaggagaagatttttgaggagcagccttgtctccggaaggactctctcagaatgttcctcaaatgtgacatgtcgattcacgatgtttcggtgagtgcagctgagacacaggcgattgtagatgaggccttggggctgcgaaaaaagaggcaagcgctgattgtgcgggagaaggagccggacctgaaacttgtgcagcccattcctttcttcacctggaagtgcctcggagagagcttgctggccatgtacaatcatctcaccacctgtgagcccccacgtcccagccttggcaaaaggattgatttgtcggactaccaggaccccagccagcctcttgagtcctccatggtggtgacgccagttaacgtgatccagccaagcactgtcagcaccaacccagctgtggctgtcgccgagcctgtggtctcctacacctctgtggctacaaccagcttcccactgcacagtcctggtctgttggagacaggcgctcctgtgggtgatatttctgggggagataaatccaagaaaggggtaaaacggaagaagatttcagaagagagtggagaaacagcaaagcggcggtctgcccgtgtccgaaacaccaagtgcaaaaaagaagagaaagtagacttccaggagcttctgatgaagttcttgccgtccaggttaagaaagctggaccctgaggaggaagatgattcctttaataactatgaagtccagtcagaagccaaactggaaagcttcccaagcattgggcctcaaaggctgtcatttgactcagccacattcatggaatctgaaaagcaggacgtgcatgagttcctgctggagaacctaaccaacgggggcatcctggagctgatgatgcgctacctgaaagccatgggccacaagttcttggtaaggtggcctccaggcttggcggaggtcgtgctcagcgtctaccacagctggaggaggcacagcaccagcctgcccaacccgctgctgagggactgcagcaacaagcacatcaaggacatgatgctgatgtctctctcctgcatggaactccagctggaccagtggctgctgaccaaaggcagaagctctgcagtgtctcctcggaactgccctgctggtatggtgaatggcagatttggacctgacttcccagggacccactgcctgggtgacctcctacagctgtcatttgcctcgtcccagcgcgacctgttcgaggatggttggctggagtttgtggtccgtgtttactggctgaaggctcgcttcctggcgctgcagggagacatggagcaggccctggagaactatgacatctgcacagaaatgctccagagttccaccgccatccaggtggaggcaggggctgaacgaagagacattgtcatccggctgcccaacctccataatgactctgtggtttccctggaggagattgataagaacctgaagtcgctggagcggtgccagtccctggaggagattcagcggctgtatgaagcaggcgactacaaggctgttgtgcatctgctccgccccactttgtgcaccagtgggtttgaccgggccaaacacctggagtttatgacttccattcctgagaggccagcccagctgcttcttctgcaggactccttgctccggctgaaggactatcggcagtgttttgagtgttccgatgtggctctgaacgaggctgtccagcagatggtgaactcaggtgaggctgccgccaaggaggagtgggtggccacagtgacccaactgctgatgggcatcgagcaggccctctctgcggacagcagtggtagcatcctgaaggtatcatcctccaccactggccttgtgcggctcaccaacaacctcatccaggtcattgactgcagcatggctgtgcaggaggaggccaaggagccccacgtctcttcagtgctaccctggatcattctacaccggatcatctggcaggaggaagacaccttccattctctgtgccaccagcagcagctccaaaacccagcggaggaagggatgtcagagacgcccatgctcccatcctccctcatgctgctgaacacagcccacgagtatttgggcagaaggtcctggtgctgcaattcagatggggctctgctgcgattctatgtgcgagtactccagaaggaactggctgcatccacctctgaagacacgcacccttacaaggaggagctggagacagccttggagcagtgcttctactgcctgtacagcttccccagcaagaagagtaaggccaggtacctggaggaacactcggcccagcaggtggatcttatatgggaggatgcactgttcatgtttgagtattttaagcccaagacccttcctgaatttgacagctataagaccagcaccgtgtctgctgacttggccaacctactgaagagaattgccaccattgtgcctcgcacagagaggccagcccttagcctggacaaagtctctgcctacattgagggaacttcaactgaggtaccctgcctcccagagggggctgacccctcccctccagtggtgaacgagctttactacctcctggctgattatcatttcaaaaacaaggagcagtccaaggccatcaagttctacatgcatgacatctgcatctgccccaataggtttgattcctgggcaggcatggctctggcccgggccagccgcattcaggacaagctgaactccaatgagctgaagagtgatgggcccatttggaagcatgccacgcccgtcttgaactgcttccgtcgggccctggagattgacagctccaacttgtccctatggattgagtatggcaccatgtcctatgccttgcactcattcgcctcacgtcaattgaagcagtggagaggcgagctgccccctgagctcgtgcagcagatggagggccggcgcgacagcatgctagagacagccaagcactgtttcacatcagcagcccgctgcgagggtgatggtgacgaggaggagtggctcatccactacatgctgggcaaggtggctgagaagcagcagcagccacccaccgtttacttgctgcactacaggcaggctggccactacctgcacgaggaggctgcccgctaccccaagaagatccactaccacaacccacctgagctggccatggaggccctggaggtgtactttcggctccatgcttccatcctgaagctcctggggaagcccgattctggggttggtgcagaggtcctggtcaactttatgaaggaggctgcagaaggaccctttgccaggggcgaggagaagaacacacccaaagcttcagaaaaggagaaggcctgcctggtggacgaggactcccactcttcagctgggacactgccgggccccggagcctccctcccctcctcctctggcccaggtctgacatccccaccttacacagccactccgattgaccacgattacgtcaaatgtaaaaaaccccaccagcaggcaacgccggacgaccgaagccaggacagcacagccgtagcactctcagactctagctcaacgcaggacttctttaatgagcccaccagcttactggaaggctccaggaaatcctacacagagaagaggctgcccattctcagttcccaagcaggagcgacgggtaaagatcttcagggggccacagaagaaagaggaaaaaacgaggagtcattggagagtacagaaggcttccgggctgcagagcaaggtgtccagaagcctgctgcagaaaccccagcctctgcttgcatccctggcaagccctcagcatccacacccaccctgtgggatgggaagaagagaggggacctcccaggggagccagtggccttcccccaggggctgccggctggtgctgaggagcagcggcagtttctcacagagcagtgcatcgcctccttccgcctgtgcctgagccgcttcccccagcactataagagtctctaccgtctggccttcctctacacctacagcaagacccaccggaacctccagtgggcccgcgacgtgttgctaggcagcagtatcccgtggcaacaactgcagcacatgccggcacaggggctcttctgcgagaggaacaagaccaatttcttcaacggcatctggcggatccccgtggacgagattgaccggccgggcagctttgcctggcacatgaaccgctccatcgtgctgctgctcaaggtgctggcccagctgcgggaccacagcaccctgctgaaggtgtcctccatgcttcagcggaccccagaccagggcaagaagtatctgcgagatgctgaccgccaggtcctggcgcagcgggccttcatcctcactgtgaaggtgctcgaagacacgctgagcgagctcgcagaggggtcagaacgcccagggcccaaggtctgtggcctccccggagccaggatgaccaccgatgtctcacacaaggccagtcctgaggatggccaggagggcctcccccagccgaagaagccccctctggctgatggctcagggccagggcccgagccaggaggcaaagtgggcctcctcaaccaccggcctgtggccatggatgcaggagacagtgcagaccaaagcggggagcggaaggataaagagagcccacgggcagggcccactgagcccatggacacgagtgaggccactgtttgccactcagacttggagcggacaccacccctgctgccaggtcgccccgcaagggaccggggccccgagagccggcccactgagctgtccctggaggagctgagcatcagtgcccggcagcagcccaccccgctcaccccagcccagccagcccccgcccccgcccccgccaccaccacagggaccagggcagggggccacccggaggagccgctctcccggctcagccgcaagaggaagctcctggaggacacagagtcaggcaagacacttctgttggatgcctaccgtgtgtggcagcagggccagaagggtgtggcctatgacctgggccgtgtggagaggatcatgtcggagacctacatgctcatcaagcaggtggatgaggaggctgcgctggagcaggctgtgaagttctgccaggtccatcttggggctgccgcccagagacaggcctcgggggacacccccaccactccaaagcaccccaaagacagccgagagaacttctttcctgtgacagtggtgcccacagcccctgaccctgtgccagctgactctgtccagcggcccagtgatgctcacaccaagcctcgccctgcactagctgccgccacaactattatcacctgccctccgtcagcatcagcttccaccctggaccagtccaaggaccctgggcctccccggccacacaggcctgaagctacccccagcatggcctctctgggcccagagggagaagagctggcgagagtggcagagggcaccagcttcccgcctcaggagccacggcacagtccgcaggtgaagatggcccccacaagttccccggcagagccacactgctggccggcagaggctgccctgggcacaggcgctgagcccacctgcagccaggaggggaaactgaggcctgagccgagaagggatggggaggctcaggaggctgcgagtgagactcagcccctgagctctcccccaacagctgccagctccaaggcccccagcagtgggagtgcccagccaccagagggtcacccaggcaagcctgagcccagccgggctaagtcccgccccctgcccaacatgccaaagctggtcatcccctccgccgccaccaagttcccccctgagatcaccgtcacgccacccaccccaaccctgctctcccccaaaggcagcatctcggaggagaccaagcagaagctgaagtcagccatcctttctgcccagtctgctgccaacgtgaggaaggagagcctatgccagccagccctggaggtcctggagacatccagccaggagtcctcgctggagagcgagacagacgaggacgacgactacatggacatttgaggggccactgcagccccaccgccacgccccaggggaccagccaggcctggaatgccccctgggcaggaccctgggcaggaccagaggcccacatggatgccactccccacacagcccccaggcctgcccagcccacctcctcatggcatcctccctgtacccaggtcaggctgtccacaccacatgggagcccagaggaggaggggcccgccttagccatgtgaaggtggattggtcgccatctgcacgccaggcggcatccttttctatgaagtgttgactttgtaaatctgcccacacccagctggccatatccacccctcgacgccgggatgagccggctctgcctgtgtcacagtggaggggtcctttagggccaggctcacccctcaccctttttttggttgcttttctaataaagatggaacagtt

SEQ ID NO: 427246 - DNA, 7260 bp, Homo sapiens
gggtgaggctcagcagagcccggggcacaggccggaggggctgcaggcgcgaggctgggttacgtgaggaagctgggggtttcgcgggcagctttagagccccagtcagggaaaccgaggccgggcttcctggctgcctcgcgagcctcttcatggctctcgccgccgccctgaggtgcctagaatgggttccggcctccggggaggttcccagtaaccgcaggagccaccattgatttggcgtctgctgggtgcaaagcccagcgcgctaaccctttactcgcgacctttcgcttcaccttcacagcagccctgcgaggagagttgtggactggggcaacctttgccagtgatgagaagtgatgctcgtggcagtgctgaatctctctgaatatgattcgaattgcagccttaaatgccagctccaccattgaggatgatcatgaaggaagctttaaaagtcacaaaacccagacaaaggaggctcaggaagcagaggcttttgcattgtaccacaaggcccttgatctgcagaaacatgaccggtttgaggagtctgccaaagcctaccatgagctcttggaggcgagcctgctgcgggaggcagtgatgctggactccacagatgtcaacctctggtataagattggacatgtggccctgaggctcatccggatccccctggctcgccatgcttttgaggaagggctgcggtgcaatcctgaccactggccctgtttggataacctaatcactgtcctgtacaccctcagtgattacacaacatgtctgtacttcatctgcaaagctttggagaaggattgccggtacagcaaagggctggtcctcaaggagaagatttttgaggagcagccttgtctccggaaggactctctcagaatgttcctcaaatgtgacatgtcgattcacgatgtttcggtgagtgcagctgagacacaggcgattgtagatgaggccttggggctgcgaaaaaagaggcaagcgctgattgtgcgggagaaggagccggacctgaaacttgtgcagcccattcctttcttcacctggaagtgcctcggagagagcttgctggccatgtacaatcatctcaccacctgtgagcccccacgtcccagccttggcaaaaggattgatttgtcggactaccaggaccccagccagcctcttgagtcctccatggtggtgacgccagttaacgtgatccagccaagcactgtcagcaccaacccagctgtggctgtcgccgagcctgtggtctcctacacctctgtggctacaaccagcttcccactgcacagtcctggtctgttggagacaggcgctcctgtgggtgatatttctgggggagataaatccaagaaaggggtaaaacggaagaagatttcagaagagagtggagaaacagcaaagcggcggtctgcccgtgtccgaaacaccaagtgcaaaaaagaagagaaagtagacttccaggagcttctgatgaagttcttgccgtccaggttaagaaagctggaccctgaggaggaagatgattcctttaataactatgaagtccagtcagaagccaaactggaaagcttcccaagcattgggcctcaaaggctgtcatttgactcagccacattcatggaatctgaaaagcaggacgtgcatgagttcctgctggagaacctaaccaacgggggcatcctggagctgatgatgcgctacctgaaagccatgggccacaagttcttggtaaggtggcctccaggcttggcggaggtcgtgctcagcgtctaccacagctggaggaggcacagcaccagcctgcccaacccgctgctgagggactgcagcaacaagcacatcaaggacatgatgctgatgtctctctcctgcatggaactccagctggaccagtggctgctgaccaaaggcagaagctctgcagtgtctcctcggaactgccctgctggtatggtgaatggcagatttggacctgacttcccagggacccactgcctgggtgacctcctacagctgtcatttgcctcgtcccagcgcgacctgttcgaggatggttggctggagtttgtggtccgtgtttactggctgaaggctcgcttcctggcgctgcagggagacatggagcaggccctggagaactatgacatctgcacagaaatgctccagagttccaccgccatccaggtggaggcaggggctgaacgaagagacattgtcatccggctgcccaacctccataatgactctgtggtttccctggaggagattgataagaacctgaagtcgctggagcggtgccagtccctggaggagattcagcggctgtatgaagcaggcgactacaaggctgttgtgcatctgctccgccccactttgtgcaccagtgggtttgaccgggccaaacacctggagtttatgacttccattcctgagaggccagcccagctgcttcttctgcaggactccttgctccggctgaaggactatcggcagtgttttgagtgttccgatgtggctctgaacgaggctgtccagcagatggtgaactcaggtgaggctgccgccaaggaggagtgggtggccacagtgacccaactgctgatgggcatcgagcaggccctctctgcggacagcagtggtagcatcctgaaggtatcatcctccaccactggccttgtgcggctcaccaacaacctcatccaggtcattgactgcagcatggctgtgcaggaggaggccaaggagccccacgtctcttcagtgctaccctggatcattctacaccggatcatctggcaggaggaagacaccttccattctctgtgccaccagcagcagctccaaaacccagcggaggaagggatgtcagagacgcccatgctcccatcctccctcatgctgctgaacacagcccacgagtatttgggcagaaggtcctggtgctgcaattcagatggggctctgctgcgattctatgtgcgagtactccagaaggaactggctgcatccacctctgaagacacgcacccttacaaggaggagctggagacagccttggagcagtgcttctactgcctgtacagcttccccagcaagaagagtaaggccaggtacctggaggaacactcggcccagcaggtggatcttatatgggaggatgcactgttcatgtttgagtattttaagcccaagacccttcctgaatttgacagctataagaccagcaccgtgtctgctgacttggccaacctactgaagagaattgccaccattgtgcctcgcacagagaggccagcccttagcctggacaaagtctctgcctacattgagggaacttcaactgaggtaccctgcctcccagagggggctgacccctcccctccagtggtgaacgagctttactacctcctggctgattatcatttcaaaaacaaggagcagtccaaggccatcaagttctacatgcatgacatctgcatctgccccaataggtttgattcctgggcaggcatggctctggcccgggccagccgcattcaggacaagctgaactccaatgagctgaagagtgatgggcccatttggaagcatgccacgcccgtcttgaactgcttccgtcgggccctggagattgacagctccaacttgtccctatggattgagtatggcaccatgtcctatgccttgcactcattcgcctcacgtcaattgaagcagtggagaggcgagctgccccctgagctcgtgcagcagatggagggccggcgcgacagcatgctagagacagccaagcactgtttcacatcagcagcccgctgcgagggtgatggtgacgaggaggagtggctcatccactacatgctgggcaaggtggctgagaagcagcagcagccacccaccgtttacttgctgcactacaggcaggctggccactacctgcacgaggaggctgcccgctaccccaagaagatccactaccacaacccacctgagctggccatggaggccctggaggtgtactttcggctccatgcttccatcctgaagctcctggggaagcccgattctggggttggtgcagaggtcctggtcaactttatgaaggaggctgcagaaggaccctttgccaggggcgaggagaagaacacacccaaagcttcagaaaaggagaaggcctgcctggtggacgaggactcccactcttcagctgggacactgccgggccccggagcctccctcccctcctcctctgaccgaagccaggacagcacagccgtagcactctcagactctagctcaacgcaggacttctttaatgagcccaccagcttactggaaggctccaggaaatcctacacagagaagaggctgcccattctcagttcccaagcaggagcgacgggtaaagatcttcagggggccacagaagaaagaggaaaaaacgaggagtcattggagagtacagaaggcttccgggctgcagagcaaggtgtccagaagcctgctgcagaaaccccagcctctgcttgcatccctggcaagccctcagcatccacacccaccctgtgggatgggaagaagagaggggacctcccaggggagccagtggccttcccccaggggctgccggctggtgctgaggagcagcggcagtttctcacagagcagtgcatcgcctccttccgcctgtgcctgagccgcttcccccagcactataagagtctctaccgtctggccttcctctacacctacagcaagacccaccggaacctccagtgggcccgcgacgtgttgctaggcagcagtatcccgtggcaacaactgcagcacatgccggcacaggggctcttctgcgagaggaacaagaccaatttcttcaacggcatctggcggatccccgtggacgagattgaccggccgggcagctttgcctggcacatgaaccgctccatcgtgctgctgctcaaggtgctggcccagctgcgggaccacagcaccctgctgaaggtgtcctccatgcttcagcggaccccagaccagggcaagaagtatctgcgagatgctgaccgccaggtcctggcgcagcgggccttcatcctcactgtgaaggtgctcgaagacacgctgagcgagctcgcagaggggtcagaacgcccagggcccaaggtctgtggcctccccggagccaggatgaccaccgatgtctcacacaaggccagtcctgaggatggccaggagggcctcccccagccgaagaagccccctctggctgatggctcagggccagggcccgagccaggaggcaaagtgggcctcctcaaccaccggcctgtggccatggatgcaggagacagtgcagaccaaagcggggagcggaaggataaagagagcccacgggcagggcccactgagcccatggacacgagtgaggccactgtttgccactcagacttggagcggacaccacccctgctgccaggtcgccccgcaagggaccggggccccgagagccggcccactgagctgtccctggaggagctgagcatcagtgcccggcagcagcccaccccgctcaccccagcccagccagcccccgcccccgcccccgccaccaccacagggaccagggcagggggccacccggaggagccgctctcccggctcagccgcaagaggaagctcctggaggacacagagtcaggcaagacacttctgttggatgcctaccgtgtgtggcagcagggccagaagggtgtggcctatgacctgggccgtgtggagaggatcatgtcggagacctacatgctcatcaagcaggtggatgaggaggctgcgctggagcaggctgtgaagttctgccaggtccatcttggggctgccgcccagagacaggcctcgggggacacccccaccactccaaagcaccccaaagacagccgagagaacttctttcctgtgacagtggtgcccacagcccctgaccctgtgccagctgactctgtccagcggcccagtgatgctcacaccaagcctcgccctgcactagctgccgccacaactattatcacctgccctccgtcagcatcagcttccaccctggaccagtccaaggaccctgggcctccccggccacacaggcctgaagctacccccagcatggcctctctgggcccagagggagaagagctggcgagagtggcagagggcaccagcttcccgcctcaggagccacggcacagtccgcaggtgaagatggcccccacaagttccccggcagagccacactgctggccggcagaggctgccctgggcacaggcgctgagcccacctgcagccaggaggggaaactgaggcctgagccgagaagggatggggaggctcaggaggctgcgagtgagactcagcccctgagctctcccccaacagctgccagctccaaggcccccagcagtgggagtgcccagccaccagagggtcacccaggcaagcctgagcccagccgggctaagtcccgccccctgcccaacatgccaaagctggtcatcccctccgccgccaccaagttcccccctgagatcaccgtcacgccacccaccccaaccctgctctcccccaaaggcagcatctcggaggagaccaagcagaagctgaagtcagccatcctttctgcccagtctgctgccaacgtgaggaaggagagcctatgccagccagccctggaggtcctggagacatccagccaggagtcctcgctggagagcgagacagacgaggacgacgactacatggacatttgaggggccactgcagccccaccgccacgccccaggggaccagccaggcctggaatgccccctgggcaggaccctgggcaggaccagaggcccacatggatgccactccccacacagcccccaggcctgcccagcccacctcctcatggcatcctccctgtacccaggtcaggctgtccacaccacatgggagcccagaggaggaggggcccgccttagccatgtgaaggtggattggtcgccatctgcacgccaggcggcatccttttctatgaagtgttgactttgtaaatctgcccacacccagctggccatatccacccctcgacgccgggatgagccggctctgcctgtgtcacagtggaggggtcctttagggccaggctcacccctcaccctttttttggttgcttttctaataaagatggaacagtt

SEQ ID NO: 427247 - DNA, 3610 bp, Homo sapiens
agtgcccagtgaacggagctgaagggttatcataatgagtggttattactctcatctcactaccatgtgcctgagttactgcgtgaacgtttaagctggaatgctgacagtatacattttaattttcacagcttgttttaaattagttgtaggatggttggtttaaaagctaacaaaaacaagcagtgtgtggcagcctgttgccctggtcatgggcccatttccagtgtggctgactggcctgtggaacaaatcttagcaactgggaaggctgctcacactagaggtgtcgttctcctaggtgtactttcggctccatgcttccatcctgaagctcctggggaagcccgattctggggttggtgcagaggtcctggtcaactttatgaaggaggctgcagaaggaccctttgccaggggcgaggagaagaacacacccaaagcttcagaaaaggagaaggcctgcctggtggacgaggactcccactcttcagctgggacactgccgggccccggagcctccctcccctcctcctctggcccaggtctgacatccccaccttacacagccactccgattgaccacgattacgtcaaatgtaaaaaaccccaccagcaggcaacgccggacgaccgaagccaggacagcacagccgtagcactctcagactctagctcaacgcaggacttctttaatgagcccaccagcttactggaaggctccaggaaatcctacacagagaagaggctgcccattctcagttcccaagcaggagcgacgggtaaagatcttcagggggccacagaagaaagaggaaaaaacgaggagtcattggagagtacagaaggcttccgggctgcagagcaaggtgtccagaagcctgctgcagaaaccccagcctctgcttgcatccctggcaagccctcagcatccacacccaccctgtgggatgggaagaagagaggggacctcccaggggagccagtggccttcccccaggggctgccggctggtgctgaggagcagcggcagtttctcacagagcagtgcatcgcctccttccgcctgtgcctgagccgcttcccccagcactataagagtctctaccgtctggccttcctctacacctacagcaagacccaccggaacctccagtgggcccgcgacgtgttgctaggcagcagtatcccgtggcaacaactgcagcacatgccggcacaggggctcttctgcgagaggaacaagaccaatttcttcaacggcatctggcggatccccgtggacgagattgaccggccgggcagctttgcctggcacatgaaccgctccatcgtgctgctgctcaaggtgctggcccagctgcgggaccacagcaccctgctgaaggtgtcctccatgcttcagcggaccccagaccagggcaagaagtatctgcgagatgctgaccgccaggtcctggcgcagcgggccttcatcctcactgtgaaggtgctcgaagacacgctgagcgagctcgcagaggggtcagaacgcccagggcccaaggtctgtggcctccccggagccaggatgaccaccgatgtctcacacaaggccagtcctgaggatggccaggagggcctcccccagccgaagaagccccctctggctgatggctcagggccagggcccgagccaggaggcaaagtgggcctcctcaaccaccggcctgtggccatggatgcaggagacagtgcagaccaaagcggggagcggaaggataaagagagcccacgggcagggcccactgagcccatggacacgagtgaggccactgtttgccactcagacttggagcggacaccacccctgctgccaggtcgccccgcaagggaccggggccccgagagccggcccactgagctgtccctggaggagctgagcatcagtgcccggcagcagcccaccccgctcaccccagcccagccagcccccgcccccgcccccgccaccaccacagggaccagggcagggggccacccggaggagccgctctcccggctcagccgcaagaggaagctcctggaggacacagagtcaggcaagacacttctgttggatgcctaccgtgtgtggcagcagggccagaagggtgtggcctatgacctgggccgtgtggagaggatcatgtcggagacctacatgctcatcaagcaggtggatgaggaggctgcgctggagcaggctgtgaagttctgccaggtccatcttggggctgccgcccagagacaggcctcgggggacacccccaccactccaaagcaccccaaagacagccgagagaacttctttcctgtgacagtggtgcccacagcccctgaccctgtgccagctgactctgtccagcggcccagtgatgctcacaccaagcctcgccctgcactagctgccgccacaactattatcacctgccctccgtcagcatcagcttccaccctggaccagtccaaggaccctgggcctccccggccacacaggcctgaagctacccccagcatggcctctctgggcccagagggagaagagctggcgagagtggcagagggcaccagcttcccgcctcaggagccacggcacagtccgcaggtgaagatggcccccacaagttccccggcagagccacactgctggccggcagaggctgccctgggcacaggcgctgagcccacctgcagccaggaggggaaactgaggcctgagccgagaagggatggggaggctcaggaggctgcgagtgagactcagcccctgagctctcccccaacagctgccagctccaaggcccccagcagtgggagtgcccagccaccagagggtcacccaggcaagcctgagcccagccgggctaagtcccgccccctgcccaacatgccaaagctggtcatcccctccgccgccaccaagttcccccctgagatcaccgtcacgccacccaccccaaccctgctctcccccaaaggcagcatctcggaggagaccaagcagaagctgaagtcagccatcctttctgcccagtctgctgccaacgtgaggaaggagagcctatgccagccagccctggaggtcctggagacatccagccaggagtcctcgctggagagcgagacagacgaggacgacgactacatggacatttgaggggccactgcagccccaccgccacgccccaggggaccagccaggcctggaatgccccctgggcaggaccctgggcaggaccagaggcccacatggatgccactccccacacagcccccaggcctgcccagcccacctcctcatggcatcctccctgtacccaggtcaggctgtccacaccacatgggagcccagaggaggaggggcccgccttagccatgtgaaggtggattggtcgccatctgcacgccaggcggcatccttttctatgaagtgttgactttgtaaatctgcccacacccagctggccatatccacccctcgacgccgggatgagccggctctgcctgtgtcacagtggaggggtcctttagggccaggctcacccctcaccctttttttggttgcttttctaataaagatggaacagtt

SEQ ID NO: 427248 - DNA, 2697 bp, Homo sapiens
gccccgggctgggagctggctcgtgggggcgtgcgctgcgcgaaagcgaaagccgcccgccagagcaactttgcggcggaaggcgccgacgaggagctgtgccgtgccgctcttggggatggggcacttgatttcctgaagagcctttgcctgtgccctagaagtggaggaagctctagaaggagtcatgactgaaagaagcccagctccacctggtgtaggcagaaagccagttggcttgctaccaccctgctggctcgtgactctgcctggtggcttcactcttcagaccagctttctctggaggccagcctcatggccataggaagtcccctcaccgttcgggagggcatctggcggatccccgtggacgagattgaccggccgggcagctttgcctggcacatgaaccgctccatcgtgctgctgctcaaggtgctggcccagctgcgggaccacagcaccctgctgaaggtgtcctccatgcttcagcggaccccagaccagggcaagaagtatctgcgagatgctgaccgccaggtcctggcgcagcgggccttcatcctcactgtgaaggtgctcgaagacacgctgagcgagctcgcagaggggtcagaacgcccagggcccaaggtctgtggcctccccggagccaggatgaccaccgatgtctcacacaaggccagtcctgaggatggccaggagggcctcccccagccgaagaagccccctctggctgatggctcagggccagggcccgagccaggaggcaaagtgggcctcctcaaccaccggcctgtggccatggatgcaggagacagtgcagaccaaagcggggagcggaaggataaagagagcccacgggcagggcccactgagcccatggacacgagtgaggccactgtttgccactcagacttggagcggacaccacccctgctgccaggtcgccccgcaagggaccggggccccgagagccggcccactgagctgtccctggaggagctgagcatcagtgcccggcagcagcccaccccgctcaccccagcccagccagcccccgcccccgcccccgccaccaccacagggaccagggcagggggccacccggaggagccgctctcccggctcagccgcaagaggaagctcctggaggacacagagtcaggcaagacacttctgttggatgcctaccgtgtgtggcagcagggccagaagggtgtggcctatgacctgggccgtgtggagaggatcatgtcggagacctacatgctcatcaagcaggtggatgaggaggctgcgctggagcaggctgtgaagttctgccaggtccatcttggggctgccgcccagagacaggcctcgggggacacccccaccactccaaagcaccccaaagacagccgagagaacttctttcctgtgacagtggtgcccacagcccctgaccctgtgccagctgactctgtccagcggcccagtgatgctcacaccaagcctcgccctgcactagctgccgccacaactattatcacctgccctccgtcagcatcagcttccaccctggaccagtccaaggaccctgggcctccccggccacacaggcctgaagctacccccagcatggcctctctgggcccagagggagaagagctggcgagagtggcagagggcaccagcttcccgcctcaggagccacggcacagtccgcaggtgaagatggcccccacaagttccccggcagagccacactgctggccggcagaggctgccctgggcacaggcgctgagcccacctgcagccaggaggggaaactgaggcctgagccgagaagggatggggaggctcaggaggctgcgagtgagactcagcccctgagctctcccccaacagctgccagctccaaggcccccagcagtgggagtgcccagccaccagagggtcacccaggcaagcctgagcccagccgggctaagtcccgccccctgcccaacatgccaaagctggtcatcccctccgccgccaccaagttcccccctgagatcaccgtcacgccacccaccccaaccctgctctcccccaaaggcagcatctcggaggagaccaagcagaagctgaagtcagccatcctttctgcccagtctgctgccaacgtgaggaaggagagcctatgccagccagccctggaggtcctggagacatccagccaggagtcctcgctggagagcgagacagacgaggacgacgactacatggacatttgaggggccactgcagccccaccgccacgccccaggggaccagccaggcctggaatgccccctgggcaggaccctgggcaggaccagaggcccacatggatgccactccccacacagcccccaggcctgcccagcccacctcctcatggcatcctccctgtacccaggtcaggctgtccacaccacatgggagcccagaggaggaggggcccgccttagccatgtgaaggtggattggtcgccatctgcacgccaggcggcatccttttctatgaagtgttgactttgtaaatctgcccacacccagctggccatatccacccctcgacgccgggatgagccggctctgcctgtgtcacagtggaggggtcctttagggccaggctcacccctcaccctttttttggttgcttttctaataaagatggaacagtt

SEQ ID NO: 427249 - DNA, 6975 bp, Homo sapiens
gggtgaggctcagcagagcccggggcacaggccggaggggctgcaggcgcgaggctgggttacgtgaggaagctgggggtttcgcgggcagctttagagccccagtcagggaaaccgaggccgggcttcctggctgcctcgcgagcctcttcatggctctcgccgccgccctgaggtgcctagaatgggttccggcctccggggaggttcccagtaaccgcaggagccaccattgatttggcgtctgctgggtgcaaagcccagcgcgctaaccctttactcgcgacctttcgcttcaccttcacagcagccctgcgaggagagttgtggactggggcaacctttgccagtgatgagaagtgatgctcgtggcagtgctgaatctctctgaatatgattcgaattgcagccttaaatgccagctccaccattgaggatgatcatgaaggaagctttaaaagtcacaaaacccagacaaaggaggctcaggaagcagaggcttttgcattgtaccacaaggcccttgatctgcagaaacatgaccggtttgaggagtctgccaaagcctaccatgagctcttggaggcgagcctgctgcgggaggcagtgatgctggactccacagatgtcaacctctggtataagattggacatgtggccctgaggctcatccggatccccctggctcgccatgcttttgaggaagggctgcggtgcaatcctgaccactggccctgtttggataacctaatcactgtcctgtacaccctcagtgattacacaacatgtctgtacttcatctgcaaagctttggagaaggattgccggtacagcaaagggctggtcctcaaggagaagatttttgaggagcagccttgtctccggaaggactctctcagaatgttcctcaaatgtgacatgtcgattcacgatgtttcggtgagtgcagctgagacacaggcgattgtagatgaggccttggggctgcgaaaaaagaggcaagcgctgattgtgcgggagaaggagccggacctgaaacttgtgcagcccattcctttcttcacctggaagtgcctcggagagagcttgctggccatgtacaatcatctcaccacctgtgagcccccacgtcccagccttggcaaaaggattgatttgtcggactaccaggaccccagccagcctcttgagtcctccatggtggtgacgccagttaacgtgatccagccaagcactgtcagcaccaacccagctgtggctgtcgccgagcctgtggtctcctacacctctgtggctacaaccagcttcccactgcacagtcctggtctgttggagacaggcgctcctgtgggtgatatttctgggggagataaatccaagaaaggggtaaaacggaagaagatttcagaagagagtggagaaacagcaaagcggcggtctgcccgtgtccgaaacaccaagtgcaaaaaagaagagaaagtagacttccaggagcttctgatgaagttcttgccgtccaggttaagaaagctggaccctgaggaggaagatgattcctttaataactatgaagtccagtcagaagccaaactggaaagcttcccaagcattgggcctcaaaggctgtcatttgactcagccacattcatggaatctgaaaagcaggacgtgcatgagttcctgctggagaacctaaccaacgggggcatcctggagctgatgatgcgctacctgaaagccatgggccacaagttcttggtaaggtggcctccaggcttggcggaggtcgtgctcagcgtctaccacagctggaggaggcacagcaccagcctgcccaacccgctgctgagggactgcagcaacaagcacatcaaggacatgatgctgatgtctctctcctgcatggaactccagctggaccagtggctgctgaccaaaggcagaagctctgcagtgtctcctcggaactgccctgctggtatggtgaatggcagatttggacctgacttcccagggacccactgcctgggtgacctcctacagctgtcatttgcctcgtcccagcgcgacctgttcgaggatggttggctggagtttgtggtccgtgtttactggctgaaggctcgcttcctggcgctgcagggagacatggagcaggccctggagaactatgacatctgcacagaaatgctccagagttccaccgccatccaggtggaggcaggggctgaacgaagagacattgtcatccggctgcccaacctccataatgactctgtggtttccctggaggagattgataagaacctgaagtcgctggagcggtgccagtccctggaggagattcagcggctgtatgaagcaggcgactacaaggctgttgtgcatctgctccgccccactttgtgcaccagtgggtttgaccgggccaaacacctggagtttatgacttccattcctgagaggccagcccagctgcttcttctgcaggactccttgctccggctgaaggactatcggcagtgttttgagtgttccgatgtggctctgaacgaggctgtccagcagatggtgaactcaggtgaggctgccgccaaggaggagtgggtggccacagtgacccaactgctgatgggcatcgagcaggccctctctgcggacagcagtggtagcatcctgaaggtatcatcctccaccactggccttgtgcggctcaccaacaacctcatccaggtcattgactgcagcatggctgtgcaggaggaggccaaggagccccacgtctcttcagtgctaccctggatcattctacaccggatcatctggcaggaggaagacaccttccattctctgtgccaccagcagcagctccaaaacccagcggaggaagggatgtcagagacgcccatgctcccatcctccctcatgctgctgaacacagcccacgagtatttgggcagaaggtcctggtgctgcaattcagatggggctctgctgcgattctatgtgcgagtactccagaaggaactggctgcatccacctctgaagacacgcacccttacaaggaggagctggagacagccttggagcagtgcttctactgcctgtacagcttccccagcaagaagagtaaggccaggtacctggaggaacactcggcccagcaggtggatcttatatgggaggatgcactgttcatgtttgagtattttaagcccaagacccttcctgaatttgacagctataagaccagcaccgtgtctgctgacttggccaacctactgaagagaattgccaccattgtgcctcgcacagagaggccagcccttagcctggacaaagtctctgcctacattgagggaacttcaactgaggtaccctgcctcccagagggggctgacccctcccctccagtggtgaacgagctttactacctcctggctgattatcatttcaaaaacaaggagcagtccaaggccatcaagttctacatgcatgacatctgcatctgccccaataggtttgattcctgggcaggcatggctctggcccgggccagccgcattcaggacaagctgaactccaatgagctgaagagtgatgggcccatttggaagcatgccacgcccgtcttgaactgcttccgtcgggccctggagattgacagctccaacttgtccctatggattgagtatggcaccatgtcctatgccttgcactcattcgcctcacgtcaattgaagcagtggagaggcgagctgccccctgagctcgtgcagcagatggagggccggcgcgacagcatgctagagacagccaagcactgtttcacatcagcagcccgctgcgagggtgatggtgacgaggaggagtggctcatccactacatgctgggcaaggtggctgagaagcagcagcagccacccaccgtttacttgctgcactacaggcaggctggccactacctgcacgaggaggctgcccgctaccccaagaagatccactaccacaacccacctgagctggccatggaggccctggaggtgtactttcggctccatgcttccatcctgaagctcctggggaagcccgattctggggttggtgcagaggtcctggtcaactttatgaaggaggctgcagaaggaccctttgccaggggcgaggagaagaacacacccaaagcttcagaaaaggagaaggcctgcctggtggacgaggactcccactcttcagctgggacactgccgggccccggagcctccctcccctcctcctctggcccaggtctgacatccccaccttacacagccactccgattgaccacgattacgtcaaatgtaaaaaaccccaccagcaggcaacgccggacgaccgaagccaggacagcacagccgtagcactctcagactctagctcaacgcaggacttctttaatgagcccaccagcttactggaaggctccaggaaatcctacacagagaagaggctgcccattctcagttcccaagcaggagcgacgggtaaagatcttcagggggccacagaagaaagaggaaaaaacgaggagtcattggagagtacagaaggcttccgggctgcagagcaaggtgtccagaagcctgctgcagaaaccccagcctctgcttgcatccctggcaagccctcagcatccacacccaccctgtgggatgggaagaagagaggggacctcccaggggagccagtggccttcccccaggggctgccggctggtgctgaggagcagcggcagtttctcacagagcagtgcatcgcctccttccgcctgtgcctgagccgcttcccccagcactataagagtctctaccgtctggccttcctctacacctacagcaagacccaccggaacctccagtgggcccgcgacgtgttgctaggcagcagtatcccgtggcaacaactgcagcacatgccggcacaggggctcttctgcgagaggaacaagaccaatttcttcaacggcatctggcggatccccgtggacgagattgaccggccgggcagctttgcctggcacatgaaccgctccatcgtgctgctgctcaaggtgctggcccagctgcgggaccacagcaccctgctgaaggtgtcctccatgcttcagcggaccccagaccagggcaagaagtatctgcgagatgctgaccgccaggtcctggcgcagcgggccttcatcctcactgtgaaggtgctcgaagacacgctgagcgagctcgcagaggggtcagaacgcccagggcccaaggtctgtggcctccccggagccaggatgaccaccgatgtctcacacaaggccagtcctgaggatggccaggagggcctcccccagccgaagaagccccctctggctgatggctcagggccagggcccgagccaggaggcaaagtgggcctcctcaaccaccggcctgtggccatggatgcaggagacagtgcagaccaaagcggggagcggaaggataaagagagcccacgggcagggcccactgagcccatggacacgagtgaggccactgtttgccactcagacttggagcggacaccacccctgctgccaggtcgccccgcaagggaccggggccccgagagccggcccactgagctgtccctggaggagctgagcatcagtgcccggcagcagcccaccccgctcaccccagcccagccagcccccgcccccgcccccgccaccaccacagggaccagggcagggggccacccggaggagccgctctcccggctcagccgcaagaggaagctcctggaggacacagagtcaggcaagacacttctgttggatgcctaccgtgtgtggcagcagggccagaagggtgtggcctatgacctgggccgtgtggagaggatcatgtcggagacctacatgctcatcaagcaggtggatgaggaggctgcgctggagcaggctgtgaagttctgccaggtccatcttggggctgccgcccagagacaggcctcgggggacacccccaccactccaaagcaccccaaagacagccgagagaacttctttcctgtgacagtggtgcccacagcccctgaccctgtgccagctgactctgtccagcggcccagtgatgctcacaccaagcctcgccctgcactagctgccgccacaactattatcacctgccctccgtcagcatcagcttccaccctggaccagtccaaggaccctgggcctccccggccacacaggcctgaagctacccccagcatggcctctctgggcccagagggagaagagctggcgagagtggcagagggcaccagcttcccgcctcaggagccacggcacagtccgcaggtgaagatggcccccacaagttccccggcagagccacactgctggccggcagaggctgccctgggcacaggcgctgagcccacctgcagccaggaggggaaactgaggcctgagccgagaagggatggggaggctcaggaggctgcgagtgagactcagcccctgagctctcccccaacagctgccagctccaaggcccccagcagtgggagtgcccagccaccagagggtcacccaggcaagcctgagcccagccgggctaagtcccgccccctgggctacgtgcccagaacgctgggtcgtcccccgcgcgcgacacttggtttggcccatgttgattaccgttcaagactgccggtattccggcctctgtccccacgtggtggtgccttgtggccacatgtcagggctctccaagatgcaacgggtggctggcccccacggtcactggtggactgctctccccaagctttactacaggagaactggagctggtgaaaacgcttcagttattgaagaaacaattgaaatgcggaatgttggattcagtgtatggcctatgctcacgacggtcagaggctgatggacctgaagcgcttcaaaacg

SEQ ID NO: 427250 - DNA, 6648 bp, Homo sapiens
gggtgaggctcagcagagcccggggcacaggccggaggggctgcaggcgcgaggctgggttacgtgaggaagctgggggtttcgcgggcagctttagagccccagtcagggaaaccgaggccgggcttcctggctgcctcgcgagcctcttcatggctctcgccgccgccctgaggtgcctagaatgggttccggcctccggggaggttcccagtaaccgcaggagccaccattgatttggcgtctgctgggtgcaaagcccagcgcgctaaccctttactcgcgacctttcgcttcaccttcacagcagccctgcgaggagagttgtggactggggcaacctttgccagtgatgagaagtgatgctcgtggcagtgctgaatctctctgaatatgattcgaattgcagccttaaatgccagctccaccattgaggatgatcatgaaggaagctttaaaagtcacaaaacccagacaaaggaggctcaggaagcagaggcttttgcattgtaccacaaggcccttgatctgcagaaacatgaccggtttgaggagtctgccaaagcctaccatgagctcttggaggcgagcctgctgcgggaggcagtgatgctggactccacagatgtcaacctctggtataagattggacatgtggccctgaggctcatccggatccccctggctcgccatgcttttgaggaagggctgcggtgcaatcctgaccactggccctgtttggataacctaatcactgtcctgtacaccctcagtgattacacaacatgtctgtacttcatctgcaaagctttggagaaggattgccggtacagcaaagggctggtcctcaaggagaagatttttgaggagcagccttgtctccggaaggactctctcagaatgttcctcaaatgtgacatgtcgattcacgatgtttcggtgagtgcagctgagacacaggcgattgtagatgaggccttggggctgcgaaaaaagaggcaagcgctgattgtgcgggagaaggagccggacctgaaacttgtgcagcccattcctttcttcacctggaagtgcctcggagagagcttgctggccatgtacaatcatctcaccacctgtgagcccccacgtcccagccttggcaaaaggattgatttgtcggactaccaggaccccagccagcctcttgagtcctccatggtggtgacgccagttaacgtgatccagccaagcactgtcagcaccaacccagctgtggctgtcgccgagcctgtggtctcctacacctctgtggctacaaccagcttcccactgcacagtcctggtctgttggagacaggcgctcctgtgggtgatatttctgggggagataaatccaagaaaggggtaaaacggaagaagatttcagaagagagtggagaaacagcaaagcggcggtctgcccgtgtccgaaacaccaagtgcaaaaaagaagagaaagtagacttccaggagcttctgatgaagttcttgccgtccaggttaagaaagctggaccctgaggaggaagatgattcctttaataactatgaagtccagtcagaagccaaactggaaagcttcccaagcattgggcctcaaaggctgtcatttgactcagccacattcatggaatctgaaaagcaggacgtgcatgagttcctgctggagaacctaaccaacgggggcatcctggagctgatgatgcgctacctgaaagccatgggccacaagttcttggtaaggtggcctccaggcttggcggaggtcgtgctcagcgtctaccacagctggaggaggcacagcaccagcctgcccaacccgctgctgagggactgcagcaacaagcacatcaaggacatgatgctgatgtctctctcctgcatggaactccagctggaccagtggctgctgaccaaaggcagaagctctgcagtgtctcctcggaactgccctgctggtatggtgaatggcagatttggacctgacttcccagggacccactgcctgggtgacctcctacagctgtcatttgcctcgtcccagcgcgacctgttcgaggatggttggctggagtttgtggtccgtgtttactggctgaaggctcgcttcctggcgctgcagggagacatggagcaggccctggagaactatgacatctgcacagaaatgctccagagttccaccgccatccaggtggaggcaggggctgaacgaagagacattgtcatccggctgcccaacctccataatgactctgtggtttccctggaggagattgataagaacctgaagtcgctggagcggtgccagtccctggaggagattcagcggctgtatgaagcaggcgactacaaggctgttgtgcatctgctccgccccactttgtgcaccagtgggtttgaccgggccaaacacctggagtttatgacttccattcctgagaggccagcccagctgcttcttctgcaggactccttgctccggctgaaggactatcggcagtgttttgagtgttccgatgtggctctgaacgaggctgtccagcagatggtgaactcaggtgaggctgccgccaaggaggagtgggtggccacagtgacccaactgctgatgggcatcgagcaggccctctctgcggacagcagtggtagcatcctgaaggtatcatcctccaccactggccttgtgcggctcaccaacaacctcatccaggtcattgactgcagcatggctgtgcaggaggaggccaaggagccccacgtctcttcagtgctaccctggatcattctacaccggatcatctggcaggaggaagacaccttccattctctgtgccaccagcagcagctccaaaacccagcggaggaagggatgtcagagacgcccatgctcccatcctccctcatgctgctgaacacagcccacgagtatttgggcagaaggtcctggtgctgcaattcagatggggctctgctgcgattctatgtgcgagtactccagaaggaactggctgcatccacctctgaagacacgcacccttacaaggaggagctggagacagccttggagcagtgcttctactgcctgtacagcttccccagcaagaagagtaaggccaggtacctggaggaacactcggcccagcaggtggatcttatatgggaggatgcactgttcatgtttgagtattttaagcccaagacccttcctgaatttgacagctataagaccagcaccgtgtctgctgacttggccaacctactgaagagaattgccaccattgtgcctcgcacagagaggccagcccttagcctggacaaagtctctgcctacattgagggaacttcaactgaggtaccctgcctcccagagggggctgacccctcccctccagtggtgaacgagctttactacctcctggctgattatcatttcaaaaacaaggagcagtccaaggccatcaagttctacatgcatgacatctgcatctgccccaataggtttgattcctgggcaggcatggctctggcccgggccagccgcattcaggacaagctgaactccaatgagctgaagagtgatgggcccatttggaagcatgccacgcccgtcttgaactgcttccgtcgggccctggagattgacagctccaacttgtccctatggattgagtatggcaccatgtcctatgccttgcactcattcgcctcacgtcaattgaagcagtggagaggcgagctgccccctgagctcgtgcagcagatggagggccggcgcgacagcatgctagagacagccaagcactgtttcacatcagcagcccgctgcgagggtgatggtgacgaggaggagtggctcatccactacatgctgggcaaggtggctgagaagcagcagcagccacccaccgtttacttgctgcactacaggcaggctggccactacctgcacgaggaggctgcccgctaccccaagaagatccactaccacaacccacctgagctggccatggaggccctggaggtgtactttcggctccatgcttccatcctgaagctcctggggaagcccgattctggggttggtgcagaggtcctggtcaactttatgaaggaggctgcagaaggaccctttgccaggggcgaggagaagaacacacccaaagcttcagaaaaggagaaggcctgcctggtggacgaggactcccactcttcagctgggacactgccgggccccggagcctccctcccctcctcctctggcccaggtctgacatccccaccttacacagccactccgattgaccacgattacgtcaaatgtaaaaaaccccaccagcaggcaacgccggacgaccgaagccaggacagcacagccgtagcactctcagactctagctcaacgcaggacttctttaatgagcccaccagcttactggaaggctccaggaaatcctacacagagaagaggctgcccattctcagttcccaagcaggagcgacgggtaaagatcttcagggggccacagaagaaagaggaaaaaacgaggagtcattggagagtacagaaggcttccgggctgcagagcaaggtgtccagaagcctgctgcagaaaccccagcctctgcttgcatccctggcaagccctcagcatccacacccaccctgtgggatgggaagaagagaggggacctcccaggggagccagtggccttcccccaggggctgccggctggtgctgaggagcagcggcagtttctcacagagcagtgcatcgcctccttccgcctgtgcctgagccgcttcccccagcactataagagtctctaccgtctggccttcctctacacctacagcaagacccaccggaacctccagtgggcccgcgacgtgttgctaggcagcagtatcccgtggcaacaactgcagcacatgccggcacaggggctcttctgcgagaggaacaagaccaatttcttcaacggcatctggcggatccccgtggacgagattgaccggccgggcagctttgcctggcacatgaaccgctccatcgtgctgctgctcaaggtgctggcccagctgcgggaccacagcaccctgctgaaggtgtcctccatgcttcagcggaccccagaccagggcaagaagtatctgcgagatgctgaccgccaggtcctggcgcagcgggccttcatcctcactgtgaaggtgctcgaagacacgctgagcgagctcgcagaggggtcagaacgcccagggcccaaggtctgtggcctccccggagccaggatgaccaccgatgtctcacacaaggccagtcctgaggatggccaggagggcctcccccagccgaagaagccccctctggctgatggctcagggccagggcccgagccaggaggcaaagtgggcctcctcaaccaccggcctgtggccatggatgcaggagacagtgcagaccaaagcggggagcggaaggataaagagagcccacgggcagggcccactgagcccatggacacgagtgaggccactgtttgccactcagacttggagcggacaccacccctgctgccaggtcgccccgcaagggaccggggccccgagagccggcccactgagctgtccctggaggagctgagcatcagtgcccggcagcagcccaccccgctcaccccagcccagccagcccccgcccccgcccccgccaccaccacagggaccagggcagggggccacccggaggagccgctctcccggctcagccgcaagaggaagctcctggaggacacagagtcaggcaagacacttctgttggatgcctaccgtgtgtggcagcagggccagaagggtgtggcctatgacctgggccgtgtggagaggatcatgtcggagacctacatgctcatcaagcaggtggatgaggaggctgcgctggagcaggctgtgaagttctgccaggtccatcttggggctgccgcccagagacaggcctcgggggacacccccaccactccaaagcaccccaaagacagccgagagaacttctttcctgtgacagtggtgcccacagcccctgaccctgtgccagctgactctgtccagcggcccagtgatgctcacaccaagcctcgccctgcactagctgccgccacaactattatcacctgccctccgtcagcatcagcttccaccctggaccagtccaaggaccctgggcctccccggccacacaggcctgaagctacccccagcatggcctctctgggcccagagggagaagagctggcgagagtggcagagggcaccagcttcccgcctcaggagccacggcacagtccgcaggtgaagatggcccccacaagttccccggcagagccacactgctggccggcagaggctgccctgggcacaggcgctgagcccacctgcagccaggaggggaaactgaggcctgagccgagaagggatggggatgagatacctattaccatctttaatgtcctctcttatttattctgttttctatgtctttcctttttatatactatacttttgttgtgtacatacatcttaataattccgttccaagcttgtcccatgtctctcgtgtgtatatataaa

SEQ ID NO: 427251 - DNA, 5758 bp, Homo sapiens
gggtgaggctcagcagagcccggggcacaggccggaggggctgcaggcgcgaggctgggttacgtgaggaagctgggggtttcgcgggcagctttagagccccagtcagggaaaccgaggccgggcttcctggctgcctcgcgagcctcttcatggctctcgccgccgccctgaggtgcctagaatgggttccggcctccggggaggttcccagtaaccgcaggagccaccattgatttggcgtctgctgggtgcaaagcccagcgcgctaaccctttactcgcgacctttcgcttcaccttcacagcagccctgcgaggagagttgtggactggggcaacctttgccagtgatgagaagtgatgctcgtggcagtgctgaatctctctgaatatgattcgaattgcagccttaaatgccagctccaccattgaggatgatcatgaaggaagctttaaaagtcacaaaacccagacaaaggaggctcaggaagcagaggcttttgcattgtaccacaaggcccttgatctgcagaaacatgaccggtttgaggagtctgccaaagcctaccatgagctcttggaggcgagcctgctgcgggaggcagtgatgctggactccacagatgtcaacctctggtataagattggacatgtggccctgaggctcatccggatccccctggctcgccatgcttttgaggaagggctgcggtgcaatcctgaccactggccctgtttggataacctaatcactgtcctgtacaccctcagtgattacacaacatgtctgtacttcatctgcaaagctttggagaaggattgccggtacagcaaagggctggtcctcaaggagaagatttttgaggagcagccttgtctccggaaggactctctcagaatgttcctcaaatgtgacatgtcgattcacgatgtttcggtgagtgcagctgagacacaggcgattgtagatgaggccttggggctgcgaaaaaagaggcaagcgctgattgtgcgggagaaggagccggacctgaaacttgtgcagcccattcctttcttcacctggaagtgcctcggagagagcttgctggccatgtacaatcatctcaccacctgtgagcccccacgtcccagccttggcaaaaggattgatttgtcggactaccaggaccccagccagcctcttgagtcctccatggtggtgacgccagttaacgtgatccagccaagcactgtcagcaccaacccagctgtggctgtcgccgagcctgtggtctcctacacctctgtggctacaaccagcttcccactgcacagtcctggtctgttggagacaggcgctcctgtgggtgatatttctgggggagataaatccaagaaaggggtaaaacggaagaagatttcagaagagagtggagaaacagcaaagcggcggtctgcccgtgtccgaaacaccaagtgcaaaaaagaagagaaagtagacttccaggagcttctgatgaagttcttgccgtccaggttaagaaagctggaccctgaggaggaagatgattcctttaataactatgaagtccagtcagaagccaaactggaaagcttcccaagcattgggcctcaaaggctgtcatttgactcagccacattcatggaatctgaaaagcaggacgtgcatgagttcctgctggagaacctaaccaacgggggcatcctggagctgatgatgcgctacctgaaagccatgggccacaagttcttggtaaggtggcctccaggcttggcggaggtcgtgctcagcgtctaccacagctggaggaggcacagcaccagcctgcccaacccgctgctgagggactgcagcaacaagcacatcaaggacatgatgctgatgtctctctcctgcatggaactccagctggaccagtggctgctgaccaaaggcagaagctctgcagtgtctcctcggaactgccctgctggtatggtgaatggcagatttggacctgacttcccagggacccactgcctgggtgacctcctacagctgtcatttgcctcgtcccagcgcgacctgttcgaggatggttggctggagtttgtggtccgtgtttactggctgaaggctcgcttcctggcgctgcagggagacatggagcaggccctggagaactatgacatctgcacagaaatgctccagagttccaccgccatccaggtggaggcaggggctgaacgaagagacattgtcatccggctgcccaacctccataatgactctgtggtttccctggaggagattgataagaacctgaagtcgctggagcggtgccagtccctggaggagattcagcggctgtatgaagcaggcgactacaaggctgttgtgcatctgctccgccccactttgtgcaccagtgggtttgaccgggccaaacacctggagtttatgacttccattcctgagaggccagcccagctgcttcttctgcaggactccttgctccggctgaaggactatcggcagtgttttgagtgttccgatgtggctctgaacgaggctgtccagcagatggtgaactcaggtgaggctgccgccaaggaggagtgggtggccacagtgacccaactgctgatgggcatcgagcaggccctctctgcggacagcagtggtagcatcctgaaggtatcatcctccaccactggccttgtgcggctcaccaacaacctcatccaggtcattgactgcagcatggctgtgcaggaggaggccaaggagccccacgtctcttcagtgctaccctggatcattctacaccggatcatctggcaggaggaagacaccttccattctctgtgccaccagcagcagctccaaaacccagcggaggaagggatgtcagagacgcccatgctcccatcctccctcatgctgctgaacacagcccacgagtatttgggcagaaggtcctggtgctgcaattcagatggggctctgctgcgattctatgtgcgagtactccagaaggaactggctgcatccacctctgaagacacgcacccttacaaggaggagctggagacagccttggagcagtgcttctactgcctgtacagcttccccagcaagaagagtaaggccaggtacctggaggaacactcggcccagcaggtggatcttatatgggaggatgcactgttcatgtttgagtattttaagcccaagacccttcctgaatttgacagctataagaccagcaccgtgtctgctgacttggccaacctactgaagagaattgccaccattgtgcctcgcacagagaggccagcccttagcctggacaaagtctctgcctacattgagggaacttcaactgaggtaccctgcctcccagagggggctgacccctcccctccagtggtgaacgagctttactacctcctggctgattatcatttcaaaaacaaggagcagtccaaggccatcaagttctacatgcatgacatctgcatctgccccaataggtttgattcctgggcaggcatggctctggcccgggccagccgcattcaggacaagctgaactccaatgagctgaagagtgatgggcccatttggaagcatgccacgcccgtcttgaactgcttccgtcgggccctggagattgacagctccaacttgtccctatggattgagtatggcaccatgtcctatgccttgcactcattcgcctcacgtcaattgaagcagtggagaggcgagctgccccctgagctcgtgcagcagatggagggccggcgcgacagcatgctagagacagccaagcactgtttcacatcagcagcccgctgcgagggtgatggtgacgaggaggagtggctcatccactacatgctgggcaaggtggctgagaagcagcagcagccacccaccgtttacttgctgcactacaggcaggctggccactacctgcacgaggaggctgcccgctaccccaagaagatccactaccacaacccacctgagctggccatggaggccctggaggtgtactttcggctccatgcttccatcctgaagctcctggggaagcccgattctggggttggtgcagaggtcctggtcaactttatgaaggaggctgcagaaggaccctttgccaggggcgaggagaagaacacacccaaagcttcagaaaaggagaaggcctgcctggtggacgaggactcccactcttcagctgggacactgccgggccccggagcctccctcccctcctcctctggcccaggtctgacatccccaccttacacagccactccgattgaccacgattacgtcaaatgtaaaaaaccccaccagcaggcaacgccggacgaccgaagccaggacagcacagccgtagcactctcagactctagctcaacgcaggacttctttaatgagcccaccagcttactggaaggctccaggaaatcctacacagagaagaggctgcccattctcagttcccaagcaggagcgacgggtaaagatcttcagggggccacagaagaaagaggaaaaaacgaggagtcattggagagtacagaaggcttccgggctgcagagcaaggtgtccagaagcctgctgcagaaaccccagcctctgcttgcatccctggcaagccctcagcatccacacccaccctgtgggatgggaagaagagaggggacctcccaggggagccagtggccttcccccaggggctgccggctggtgctgaggagcagcggcagtttctcacagagcagtgcatcgcctccttccgcctgtgcctgagccgcttcccccagcactataagagtctctaccgtctggccttcctctacacctacagcaagacccaccggaacctccagtgggcccgcgacgtgttgctaggcagcagtatcccgtggcaacaactgcagcacatgccggcacaggggctcttctgcgagaggaacaagaccaatttcttcaacggcatctggcggatccccgtggacgagattgaccggccgggcagctttgcctggcacatgaaccgctccatcgtgctgctgctcaaggtgctggcccagctgcgggaccacagcaccctgctgaaggtgtcctccatgcttcagcggaccccagaccagggcaagaagtatctgcgagatgctgaccgccaggtcctggcgcagcgggccttcatcctcactgtgaaggtgctcgaagacacgctgagcgagctcgcagaggggtcagaacgcccagggcccaaggtctgtggcctccccggagccaggatgaccaccgatgtctcacacaaggccagtcctgaggatggccaggagggcctcccccagccgaagaagccccctctggctgatggctcagggccagggcccgagccaggaggcaaagtgggcctcctcaaccaccggcctgtggccatggatgcaggagacagtgcagaccaaagcggggagcggaaggataaagagagcccacgggcagggcccactgagcccatggacacgagtgaggccactgtttgccactcagacttggagcggacaccacccctgctgccaggtcgccccgcaagggaccggggccccgagagccggcccactgagctgtccctggaggagctgagcatcagtgcccggcagcagcccaccccgctcaccccagcccagcacccctcaccctttttttggttgcttttctaataaagatggaacagtt

SEQ ID NO: 427252 - DNA, 2397 bp, Homo sapiens
gggtgaggctcagcagagcccggggcacaggccggaggggctgcaggcgcgaggctgggttacgtgaggaagctgggggtttcgcgggcagctttagagccccagtcagggaaaccgaggccgggcttcctggctgcctcgcgagcctcttcatggctctcgccgccgccctgaggtgcctagaatgggttccggcctccggggaggttcccagtaaccgcaggagccaccattgatttggcgtctgctgggtgcaaagcccagcgcgctaaccctttactcgcgacctttcgcttcaccttcacagcagccctgcgaggagagttgtggactggggcaacctttgccagtgatgagaagtgatgctcgtggcagtgctgaatctctctgaatatgattcgaattgcagccttaaatgccagctccaccattgaggatgatcatgaaggaagctttaaaagtcacaaaacccagacaaaggaggctcaggaagcagaggcttttgcattgtaccacaaggcccttgatctgcagaaacatgaccggtttgaggagtctgccaaagcctaccatgagctcttggaggcgagcctgctgcgggaggcagtgatgctggactccacagatgtcaacctctggtataagattggacatgtggccctgaggctcatccggatccccctggctcgccatgcttttgaggaagggctgcggtgcaatcctgaccactggccctgtttggataacctaatcactgtcctgtacaccctcagtgattacacaacatgtctgtacttcatctgcaaagctttggagaaggattgccggtacagcaaagggctggtcctcaaggagaagatttttgaggagcagccttgtctccggaaggactctctcagaatgttcctcaaatgtgacatgtcgattcacgatgtttcggtgagtgcagctgagacacaggcgattgtagatgaggccttggggctgcgaaaaaagaggcaagcgctgattgtgcgggagaaggagccggacctgaaacttgtgcagcccattcctttcttcacctggaagtgcctcggagagagcttgctggccatgtacaatcatctcaccacctgtgagcccccacgtcccagccttggcaaaaggattgatttgtcggactaccaggaccccagccagcctcttgagtcctccatggtggtgacgccagttaacgtgatccagccaagcactgtcagcaccaacccagctgtggctgtcgccgagcctgtggtctcctacacctctgtggctacaaccagcttcccactgcacagtcctggtctgttggagacaggcgctcctgtgggtgatatttctgggggagataaatccaagaaaggggtaaaacggaagaagatttcagaagagagtggagaaacagcaaagcggcggtctgcccgtgtccgaaacaccaagtgcaaaaaagaagagaaagtagacttccaggagcttctgatgaagttcttgccgtccaggttaagaaagctggaccctgaggaggaagatgattcctttaataactatgaagtccagtcagaagccaaactggaaagcttcccaagcattgggcctcaaaggctgtcatttgactcagccacattcatggaatctgaaaagcaggacgtgcatgagttcctgctggagaacctaaccaacgggggcatcctggagctgatgatgcgctacctgaaagccatgggccacaagttcttggtaaggtggcctccaggcttggcggaggtcgtgctcagcgtctaccacagctggaggaggcacagcaccagcctgcccaacccgctgctgagggactgcagcaacaagcacatcaaggacatgatgctgatgtctctctcctgcatggaactccagctggaccagtggctgctgaccaaaggcagaagctctgcagtgtctcctcggaactgccctgctggtatggtgaatggcagatttggaccagccaggcctggaatgccccctgggcaggaccctgggcaggaccagaggcccacatggatgccactccccacacagcccccaggcctgcccagcccacctcctcatggcatcctccctgtacccaggtcaggctgtccacaccacatgggagcccagaggaggaggggcccgccttagccatgtgaaggtggattggtcgccatctgcacgccaggcggcatccttttctatgaagtgttgactttgtaaatctgcccacacccagctggccatatccacccctcgacgccgggatgagccggctctgcctgtgtcacagtggaggggtcctttagggccaggctcacccctcaccctttttttggttgcttttctaataaagatggaacagtt

SEQ ID NO: 427253 - DNA, 4629 bp, Homo sapiens
gggtgaggctcagcagagcccggggcacaggccggaggggctgcaggcgcgaggctgggttacgtgaggaagctgggggtttcgcgggcagctttagagccccagtcagggaaaccgaggccgggcttcctggctgcctcgcgagcctcttcatggctctcgccgccgccctgaggtgcctagaatgggttccggcctccggggaggttcccagtaaccgcaggagccaccattgatttggcgtctgctgggtgcaaagcccagcgcgctaaccctttactcgcgacctttcgcttcaccttcacagcagccctgcgaggagagttgtggactggggcaacctttgccagtgatgagaagtgatgctcgtggcagtgctgaatctctctgaatatgattcgaattgcagccttaaatgccagctccaccattgaggatgatcatgaaggaagctttaaaagtcacaaaacccagacaaaggaggctcaggaagcagaggcttttgcattgtaccacaaggcccttgatctgcagaaacatgaccggtttgaggagtctgccaaagcctaccatgagctcttggaggcgagcctgctgcgggaggcagtgatgctggactccacagatgtcaacctctggtataagattggacatgtggccctgaggctcatccggatccccctggctcgccatgcttttgaggaagggctgcggtgcaatcctgaccactggccctgtttggataacctaatcactgtcctgtacaccctcagtgattacacaacatgtctgtacttcatctgcaaagctttggagaaggattgccggtacagcaaagggctggtcctcaaggagaagatttttgaggagcagccttgtctccggaaggactctctcagaatgttcctcaaatgtgacatgtcgattcacgatgtttcggtgagtgcagctgagacacaggcgattgtagatgaggccttggggctgcgaaaaaagaggcaagcgctgattgtgcgggagaaggagccggacctgaaacttgtgcagcccattcctttcttcacctggaagtgcctcggagagagcttgctggccatgtacaatcatctcaccacctgtgagcccccacgtcccagccttggcaaaaggattgatttgtcggactaccaggaccccagccagcctcttgagtcctccatggtggtgacgccagttaacgtgatccagccaagcactgtcagcaccaacccagctgtggctgtcgccgagcctgtggtctcctacacctctgtggctacaaccagcttcccactgcacagtcctggtctgttggagacaggcgctcctgtgggtgatatttctgggggagataaatccaagaaaggggtaaaacggaagaagatttcagaagagagtggagaaacagcaaagcggcggtctgcccgtgtccgaaacaccaagtgcaaaaaagaagagaaagtagacttccaggagcttctgatgaagttcttgccgtccaggttaagaaagctggaccctgaggaggaagatgattcctttaataactatgaagtccagtcagaagccaaactggaaagcttcccaagcattgggcctcaaaggctgtcatttgactcagccacattcatggaatctgaaaagcaggacgtgcatgagttcctgctggagaacctaaccaacgggggcatcctggagctgatgatgcgctacctgaaagccatgggccacaagttcttggtaaggtggcctccaggcttggcggaggtcgtgctcagcgtctaccacagctggaggaggcacagcaccagcctgcccaacccgctgctgagggactgcagcaacaagcacatcaaggacatgatgctgatgtctctctcctgcatggaactccagctggaccagtggctgctgaccaaaggcagaagctctgcagtgtctcctcggaactgccctgctggtatggtgaatggcagatttggacctgacttcccagggacccactgcctgggtgacctcctacagctgtcatttgcctcgtcccagcgcgacctgttcgaggatggttggctggagtttgtggtccgtgtttactggctgaaggctcgcttcctggcgctgcagggagacatggagcaggccctggagaactatgacatctgcacagaaatgctccagagttccaccgccatccaggtggaggcaggggctgaacgaagagacattgtcatccggctgcccaacctccataatgactctgtggtttccctggaggagattgataagaacctgaagtcgctggagcggtgccagtccctggaggagattcagcggctgtatgaagcaggcgactacaaggctgttgtgcatctgctccgccccactttgtgcaccagtgggtttgaccgggccaaacacctggagtttatgacttccattcctgagaggccagcccagctgcttcttctgcaggactccttgctccggctgaaggactatcggcagtgttttgagtgttccgatgtggctctgaacgaggctgtccagcagatggtgaactcaggtgaggctgccgccaaggaggagtgggtggccacagtgacccaactgctgatgggcatcgagcaggccctctctgcggacagcagtggtagcatcctgaaggtatcatcctccaccactggccttgtgcggctcaccaacaacctcatccaggtcattgactgcagcatggctgtgcaggaggaggccaaggagccccacgtctcttcagtgctaccctggatcattctacaccggatcatctggcaggaggaagacaccttccattctctgtgccaccagcagcagctccaaaacccagcggaggaagggatgtcagagacgcccatgctcccatcctccctcatgctgctgaacacagcccacgagtatttgggcagaaggtcctggtgctgcaattcagatggggctctgctgcgattctatgtgcgagtactccagaaggaactggctgcatccacctctgaagacacgcacccttacaaggaggagctggagacagccttggagcagtgcttctactgcctgtacagcttccccagcaagaagagtaaggccaggtacctggaggaacactcggcccagcaggtggatcttatatgggaggatgcactgttcatgtttgagtattttaagcccaagacccttcctgaatttgacagctataagaccagcaccgtgtctgctgacttggccaacctactgaagagaattgccaccattgtgcctcgcacagagaggccagcccttagcctggacaaagtctctgcctacattgagggaacttcaactgaggtaccctgcctcccagagggggctgacccctcccctccagtggtgaacgagctttactacctcctggctgattatcatttcaaaaacaaggagcagtccaaggccatcaagttctacatgcatgacatctgcatctgccccaataggtttgattcctgggcaggcatggctctggcccgggccagccgcattcaggacaagctgaactccaatgagctgaagagtgatgggcccatttggaagcatgccacgcccgtcttgaactgcttccgtcgggccctggagattgacagctccaacttgtccctatggattgagtatggcaccatgtcctatgccttgcactcattcgcctcacgtcaattgaagcagtggagaggcgagctgccccctgagctcgtgcagcagatggagggccggcgcgacagcatgctagagacagccaagcactgtttcacatcagcagcccgctgcgagggtgatggtgacgaggaggagtggctcatccactacatgctgggcaaggtggctgagaagcagcagcagccacccaccgtttacttgctgcactacaggcaggctggccactacctgcacgaggaggctgcccgctaccccaagaagatccactaccacaacccacctgagctggccatggaggccctggaggtgacaccatgctggcccagggcggggaagcagggcaggggcaggctggtttctttatctccctgggcatgtggctcaaggttccagtgaccgtccttcaacctgccgcaaacttatctgtgttgagcagcttcatgtgcaattgaattaaaacatcatttcctctcttttcccaaggggtgtttatcatcctttctgggagagtgaccattttgttcttatctctcagaagaaaattgtctttcctcactaacacaggttctaagaacctgaccttggtgatgacagtcagtgctacatagcatctcccaggcccaggacattcacaccctgtagcctggcaggagggagggcaggcaccattgcctccagggtgcaaatgagacatccaaagcccagcctgtgcccaggctacccaggttggcaggggctgagctagggtgagcagcctgctctcttgacccccagtttggagtcttctgattgttgttcaagaaaagagcagttctttactccctggattttctctcatggtttccagagtgtttctgatgaatgctgtcactgttgcttatagcagtcttg

SEQ ID NO: 427254 - DNA, 3706 bp, Homo sapiens
gggtgaggctcagcagagcccggggcacaggccggaggggctgcaggcgcgaggctgggttacgtgaggaagctgggggtttcgcgggcagctttagagccccagtcagggaaaccgaggccgggcttcctggctgcctcgcgagcctcttcatggctctcgccgccgccctgaggtgcctagaatgggttccggcctccggggaggttcccagtaaccgcaggagccaccattgatttggcgtctgctgggtgcaaagcccagcgcgctaaccctttactcgcgacctttcgcttcaccttcacagcagccctgcgaggagagttgtggactggggcaacctttgccagtgatgagaagtgatgctcgtggcagtgctgaatctctctgaatatgattcgaattgcagccttaaatgccagctccaccattgaggatgatcatgaaggaagctttaaaagtcacaaaacccagacaaaggaggctcaggaagcagaggcttttgcattgtaccacaaggcccttgatctgcagaaacatgaccggtttgaggagtctgccaaagcctaccatgagctcttggaggcgagcctgctgcgggaggcagtgatgctggactccacagatgtcaacctctggtataagattggacatgtggccctgaggctcatccggatccccctggctcgccatgcttttgaggaagggctgcggtgcaatcctgaccactggccctgtttggataacctaatcactgtcctgtacaccctcagtgattacacaacatgtctgtacttcatctgcaaagctttggagaaggattgccggtacagcaaagggctggtcctcaaggagaagatttttgaggagcagccttgtctccggaaggactctctcagaatgttcctcaaatgtgacatgtcgattcacgatgtttcggtgagtgcagctgagacacaggcgattgtagatgaggccttggggctgcgaaaaaagaggcaagcgctgattgtgcgggagaaggagccggacctgaaacttgtgcagcccattcctttcttcacctggaagtgcctcggagagagcttgctggccatgtacaatcatctcaccacctgtgagcccccacgtcccagccttggcaaaaggattgatttgtcggactaccaggaccccagccagcctcttgagtcctccatggtggtgacgccagttaacgtgatccagccaagcactgtcagcaccaacccagctgtggctgtcgccgagcctgtggtctcctacacctctgtggctacaaccagcttcccactgcacagtcctggtctgttggagacaggcgctcctgtgggtgatatttctgggggagataaatccaagaaaggggtaaaacggaagaagatttcagaagagagtggagaaacagcaaagcggcggtctgcccgtgtccgaaacaccaagtgcaaaaaagaagagaaagtagacttccaggagcttctgatgaagttcttgccgtccaggttaagaaagctggaccctgaggaggaagatgattcctttaataactatgaagtccagtcagaagccaaactggaaagcttcccaagcattgggcctcaaaggctgtcatttgactcagccacattcatggaatctgaaaagcaggacgtgcatgagttcctgctggagaacctaaccaacgggggcatcctggagctgatgatgcgctacctgaaagccatgggccacaagttcttggtaaggtggcctccaggcttggcggaggtcgtgctcagcgtctaccacagctggaggaggcacagcaccagcctgcccaacccgctgctgagggactgcagcaacaagcacatcaaggacatgatgctgatgtctctctcctgcatggaactccagctggaccagtggctgctgaccaaaggcagaagctctgcagtgtctcctcggaactgccctgctggtatggtgaatggcagatttggacctgacttcccagggacccactgcctgggtgacctcctacagctgtcatttgcctcgtcccagcgcgacctgttcgaggatggttggctggagtttgtggtccgtgtttactggctgaaggctcgcttcctggcgctgcagggagacatggagcaggccctggagaactatgacatctgcacagaaatgctccagagttccaccgccatccaggtggaggcaggggctgaacgaagagacattgtcatccggctgcccaacctccataatgactctgtggtttccctggaggagattgataagaacctgaagtcgctggagcggtgccagtccctggaggagattcagcggctgtatgaagcaggcgactacaaggctgttgtgcatctgctccgccccactttgtgcaccagtgggtttgaccgggccaaacacctggagtttatgacttccattcctgagaggccagcccagctgcttcttctgcaggactccttgctccggctgaaggactatcggcagtgttttgagtgttccgatgtggctctgaacgaggctgtccagcagatggtgaactcaggtgaggctgccgccaaggaggagtgggtggccacagtgacccaactgctgatgggcatcgagcaggccctctctgcggacagcagtggtagcatcctgaaggtatcatcctccaccactggccttgtgcggctcaccaacaacctcatccaggtcattgactgcagcatggctgtgcaggaggaggccaaggagccccacgtctcttcagtgctaccctggatcattctacaccggatcatctggcaggaggaagacaccttccattctctgtgccaccagcagcagctccaaaacccagcggaggaagggatgtcagagacgcccatgctcccatcctccctcatgctgctgaacacagcccacgagtatttgggcagaaggtcctggtgctgcaattcagatggggctctgctgcgattctatgtgcgagtactccagaaggaactggctgcatccacctctgaagacacgcacccttacaaggaggagctggagacagccttggagcagtgcttctactgcctgtacagcttccccagcaagaagagtaaggccaggtacctggaggaacactcggcccagcaggtggatcttatatgggaggatgcactgttcatgtttgagtattttaagcccaagacccttcctgaatttgacagctataagaccagcaccgtgtctgctgacttggccaacctactgaagagaattgccaccattgtgcctcgcacagagaggccagcccttagcctggacaaagtctctgcctacattgagggaacttcaactgaggtaccctgcctcccagagggggctgacccctcccctccagtggtgaacgagctttactacctcctggctgattatcatttcaaaaacaaggagcagtccaaggccatcaagttctacatgcatgacatctgcatctgccccaataggtcagatatgcacagatggatgctgtgactgaggttcaccagatgtcagcattggttctctctgggctggtattttgatggataaagtgtgctcctttatattttcctatatggcttgaattgtgttttgataagcgtgtattgctttagtaaagccagtcaagtcactacttatttaaaaaggc

SEQ ID NO: 427255 - DNA, 1855 bp, Homo sapiens
gggtgaggctcagcagagcccggggcacaggccggaggggctgcaggcgcgaggctgggttacgtgaggaagctgggggtttcgcgggcagctttagagccccagtcagggaaaccgaggccgggcttcctggctgcctcgcgagcctcttcatggctctcgccgccgccctgaggtgcctagaatgggttccggcctccggggaggttcccagtaaccgcaggagccaccattgatttggcgtctgctgggtgcaaagcccagcgcgctaaccctttactcgcgacctttcgcttcaccttcacagcagccctgcgaggagagttgtggactggggcaacctttgccagtgatgagaagtgatgctcgtggcagtgctgaatctctctgaatatgattcgaattgcagccttaaatgccagctccaccattgaggatgatcatgaaggaagctttaaaagtcacaaaacccagacaaaggaggctcaggaagcagaggcttttgcattgtaccacaaggcccttgatctgcagaaacatgaccggtttgaggagtctgccaaagcctaccatgagctcttggaggcgagcctgctgcgggaggcagtgatgctggactccacagatgtcaacctctggtataagattggacatgtggccctgaggctcatccggatccccctggctcgccatgcttttgaggaagggctgcggtgcaatcctgaccactggccctgtttggataacctaatcactgtcctgtacaccctcagtgattacacaacatgtctgtacttcatctgcaaagctttggagaaggattgccggtacagcaaagggctggtcctcaaggagaagatttttgaggagcagccttgtctccggaaggactctctcagaatgttcctcaaatgtgacatgtcgattcacgatgtttcggtgagtgcagctgagacacaggcgattgtagatgaggccttggggctgcgaaaaaagaggcaagcgctgattgtgcgggagaaggagccggacctgaaacttgtgcagcccattcctttcttcacctggaagtgcctcggagagagcttgctggccatgtacaatcatctcaccacctgtgagcccccacgtcccagccttggcaaaaggattgatttgtcggactaccaggaccccagccagcctcttgagtcctccatggtggtgacgccagttaacgtgatccagccaagcactgtcagcaccaacccagctgtggctgtcgccgagcctgtggtctcctacacctctgtggctacaaccagcttcccactgcacagtcctggtctgttggagacaggcgctcctgtgggtgatatttctgggggagataaatccaagaaaggggtaaaacggaagaagatttcagaagagagtggagaaacagcaaagcggcggtctgcccgtgtccgaaacaccaagtgcaaaaaagaagagaaagtagacttccaggagcttctgatgaagttcttgccgtccaggttaagaaagctggaccctgaggaggaagatgattcctttaataactatgaagtccagtcagaagccaaactggaaagcttcccaagcattgggcctcaaaggctgtcatttgactcagccacattcatggaatctgaaaagcaggacgtgcatgagttcctgctggagaacctaaccaacgggggcatcctggagctgatgatgcgctctgctggggctcagtgggctgagctgatcatggttcttgggattttctccctaatctcccaccaatgatggcaaatgagatttggcagagtgggagttttccaggaaataaatagggtgagaagtc

SEQ ID NO: 427256 - DNA, 448 bp, Homo sapiens
ctgcagggtcgacgtcgtagagagtccccccccgacgtagcccgacaggggaccagccaggcctggaatgccccctgggcaggaccctgggcaggaccagaggcccacatggatgccactccccacacagcccccaggcctgcccagcccacctcctcatggcatcctccctgtacccaggtcaggctgtccacaccacatgggagcccagaggaggaggggcccgccttagccatgtgaaggtggattggtcgccatctgcacgccaggcggcatccttttctatgaagtgttgactttgtaaatctgcccacacccagctggccatatccacccctcgacgccgggatgagccggctctgcctgtgtcacagtggaggggtcctttagggccaggctcacccctcaccctttttttggttgcttttctaataaagatggaacagtt

SEQ ID NO: 427257 - DNA, 478 bp, Homo sapiens
agtggatgccctggggccagctcagtgaccatgcctggctgagcgaccagctctgggcttcagtgtcctccctggggcatagacaccaataggacatgcatcctaggatggttgtggaaatacgacagttcatgcaagcatgatgcctggaggtcttacagaacccagcaaggctcagggagtctcaggtcctgggctttgagttcatggtgttactgggtaaggttcacagtcccagcaccccacagctcagagccagagttgggtccctgcaggcctgagccaagtatttgcccagggtagaagccttggagcctgccagccagcacaaactacacagcataaaggcccaggacctggggggagcgggtgggggcgagataaagtgctcactgtgtgatgcggcaggcaggaagtgctcttggtacctttgtcttccagaggggaaactgaggcctgagccgagaagggatgggga

SEQ ID NO: 427258 - DNA, 2257 bp, Homo sapiens
gaacgagcctccgcggccatggcccggcgctcgccctagctccactgcacagatgccacggcggagccggcggggcatctggcggatccccgtggacgagattgaccggccgggcagctttgcctggcacatgaaccgctccatcgtgctgctgctcaaggtgctggcccagctgcgggaccacagcaccctgctgaaggtgtcctccatgcttcagcggaccccagaccagggcaagaagtatctgcgagatgctgaccgccaggtcctggcgcagcgggccttcatcctcactgtgaaggtgctcgaagacacgctgagcgagctcgcagaggggtcagaacgcccagggcccaaggtctgtggcctccccggagccaggatgaccaccgatgtctcacacaaggccagtcctgaggatggccaggagggcctcccccagccgaagaagccccctctggctgatggctcagggccagggcccgagccaggaggcaaagtgggcctcctcaaccaccggcctgtggccatggatgcaggagacagtgcagaccaaagcggggagcggaaggataaagagagcccacgggcagggcccactgagcccatggacacgagtgaggccactgtttgccactcagacttggagcggacaccacccctgctgccaggtcgccccgcaagggaccggggccccgagagccggcccactgagctgtccctggaggagctgagcatcagtgcccggcagcagcccaccccgctcaccccagcccagccagcccccgcccccgcccccgccaccaccacagggaccagggcagggggccacccggaggagccgctctcccggctcagccgcaagaggaagctcctggaggacacagagtcaggcaagacacttctgttggatgcctaccgtgtgtggcagcagggccagaagggtgtggcctatgacctgggccgtgtggagaggatcatgtcggagacctacatgctcatcaagcaggtggatgaggaggctgcgctggagcaggctgtgaagttctgccaggtccatcttggggctgccgcccagagacaggcctcgggggacacccccaccactccaaagcaccccaaagacagccgagagaacttctttcctgtgacagtggtgcccacagcccctgaccctgtgccagctgactctgtccagcggcccagtgatgctcacaccaagcctcgccctgcactagctgccgccacaactattatcacctgccctccgtcagcatcagcttccaccctggaccagtccaaggaccctgggcctccccggccacacaggcctgaagctacccccagcatggcctctctgggcccagaggggaaactgaggcctgagccgagaagggatggggaggctcaggaggctgcgagtgagactcagcccctgagctctcccccaacagctgccagctccaaggcccccagcagtgggagtgcccagccaccagagggtcacccaggcaagcctgagcccagccgggctaagtcccgccccctgcccaacatgccaaagctggtcatcccctccgccgccaccaagttcccccctgagatcaccgtcacgccacccaccccaaccctgctctcccccaaaggcagcatctcggaggagaccaagcagaagctgaagtcagccatcctttctgcccagtctgctgccaacgtgaggaaggagagcctatgccagccagccctggaggtcctggagacatccagccaggagtcctcgctggagagcgagacagacgaggacgacgactacatggacatttgaggggccactgcagccccaccgccacgccccaggggaccagccaggcctggaatgccccctgggcaggaccctgggcaggaccagaggcccacatggatgccactccccacacagcccccaggcctgcccagcccacctcctcatggcatcctccctgtacccaggtcaggctgtccacaccacatgggagcccagaggaggaggggcccgccttagccatgtgaaggtggattggtcgccatctgcacgccaggcggcatccttttctatgaagtgttgactttgtaaatctgcccacacccagctggccatatccacccctcgacgccgggatgagccggctctgcctgtgtcacagtggaggggtcctttagggccaggctcacccctcaccctttttttggttgcttttctaataaagatggaacagtt

SEQ ID NO: 427259 - DNA, 7087 bp, Homo sapiens
tgctgccggcggttctagaggatcccatcgcgtgatgagcagtgtaaggaactttaaaagtcacaaagaccagacaaaggaggctcaggaagcagaggcttttgcattgtaccacaaggcccttgatctgcagaaacatgaccggtttgaggagtctgccaaagcctaccatgagctcttggaggcgagcctgctgcgggaggcagtttcatccggtgatgagaaagaggggttgaaacaccctgggctgatactgaaatattccacttataagaacttggcccagctggcagcccagcgggaggatctggagacagccatggagttctacttagaggcagtgatgctggactccacagatgtcaacctctggtataagattggacatgtggccctgaggctcatccggatccccctggctcgccatgcttttgaggaagggctgcggtgcaatcctgaccactggccctgtttggataacctaatcactgtcctgtacaccctcagtgattacacaacatgtctgtacttcatctgcaaagctttggagaaggattgccggtacagcaaagggctggtcctcaaggagaagatttttgaggagcagccttgtctccggaaggactctctcagaatgttcctcaaatgtgacatgtcgattcacgatgtttcggtgagtgcagctgagacacaggcgattgtagatgaggccttggggctgcgaaaaaagaggcaagcgctgattgtgcgggagaaggagccggacctgaaacttgtgcagcccattcctttcttcacctggaagtgcctcggagagagcttgctggccatgtacaatcatctcaccacctgtgagcccccacgtcccagccttggcaaaaggattgatttgtcggactaccaggaccccagccagcctcttgagtcctccatggtggtgacgccagttaacgtgatccagccaagcactgtcagcaccaacccagctgtggctgtcgccgagcctgtggtctcctacacctctgtggctacaaccagcttcccactgcacagtcctggtctgttggagacaggcgctcctgtgggtgatatttctgggggagataaatccaagaaaggggtaaaacggaagaagatttcagaagagagtggagaaacagcaaagcggcggtctgcccgtgtccgaaacaccaagtgcaaaaaagaagagaaagtagacttccaggagcttctgatgaagttcttgccgtccaggttaagaaagctggaccctgaggaggaagatgattcctttaataactatgaagtccagtcagaagccaaactggaaagcttcccaagcattgggcctcaaaggctgtcatttgactcagccacattcatggaatctgaaaagcaggacgtgcatgagttcctgctggagaacctaaccaacgggggcatcctggagctgatgatgcgctacctgaaagccatgggccacaagttcttggtaaggtggcctccaggcttggcggaggtcgtgctcagcgtctaccacagctggaggaggcacagcaccagcctgcccaacccgctgctgagggactgcagcaacaagcacatcaaggacatgatgctgatgtctctctcctgcatggaactccagctggaccagtggctgctgaccaaaggcagaagctctgcagtgtctcctcggaactgccctgctggtatggtgaatggcagatttggacctgacttcccagggacccactgcctgggtgacctcctacagctgtcatttgcctcgtcccagcgcgacctgttcgaggatggttggctggagtttgtggtccgtgtttactggctgaaggctcgcttcctggcgctgcagggagacatggagcaggccctggagaactatgacatctgcacagaaatgctccagagttccaccgccatccaggtggaggcaggggctgaacgaagagacattgtcatccggctgcccaacctccataatgactctgtggtttccctggaggagattgataagaacctgaagtcgctggagcggtgccagtccctggaggagattcagcggctgtatgaagcaggcgactacaaggctgttgtgcatctgctccgccccactttgtgcaccagtgggtttgaccgggccaaacacctggagtttatgacttccattcctgagaggccagcccagctgcttcttctgcaggactccttgctccggctgaaggactatcggcagtgttttgagtgttccgatgtggctctgaacgaggctgtccagcagatggtgaactcaggtgaggctgccgccaaggaggagtgggtggccacagtgacccaactgctgatgggcatcgagcaggccctctctgcggacagcagtggtagcatcctgaaggtatcatcctccaccactggccttgtgcggctcaccaacaacctcatccaggtcattgactgcagcatggctgtgcaggaggaggccaaggagccccacgtctcttcagtgctaccctggatcattctacaccggatcatctggcaggaggaagacaccttccattctctgtgccaccagcagcagctccaaaacccagcggaggaagggatgtcagagacgcccatgctcccatcctccctcatgctgctgaacacagcccacgagtatttgggcagaaggtcctggtgctgcaattcagatggggctctgctgcgattctatgtgcgagtactccagaaggaactggctgcatccacctctgaagacacgcacccttacaaggaggagctggagacagccttggagcagtgcttctactgcctgtacagcttccccagcaagaagagtaaggccaggtacctggaggaacactcggcccagcaggtggatcttatatgggaggatgcactgttcatgtttgagtattttaagcccaagacccttcctgaatttgacagctataagaccagcaccgtgtctgctgacttggccaacctactgaagagaattgccaccattgtgcctcgcacagagaggccagcccttagcctggacaaagtctctgcctacattgagggaacttcaactgaggtaccctgcctcccagagggggctgacccctcccctccagtggtgaacgagctttactacctcctggctgattatcatttcaaaaacaaggagcagtccaaggccatcaagttctacatgcatgacatctgcatctgccccaataggtttgattcctgggcaggcatggctctggcccgggccagccgcattcaggacaagctgaactccaatgagctgaagagtgatgggcccatttggaagcatgccacgcccgtcttgaactgcttccgtcgggccctggagattgacagctccaacttgtccctatggattgagtatggcaccatgtcctatgccttgcactcattcgcctcacgtcaattgaagcagtggagaggcgagctgccccctgagctcgtgcagcagatggagggccggcgcgacagcatgctagagacagccaagcactgtttcacatcagcagcccgctgcgagggtgatggtgacgaggaggagtggctcatccactacatgctgggcaaggtggctgagaagcagcagcagccacccaccgtttacttgctgcactacaggcaggctggccactacctgcacgaggaggctgcccgctaccccaagaagatccactaccacaacccacctgagctggccatggaggccctggaggtgtactttcggctccatgcttccatcctgaagctcctggggaagcccgattctggggttggtgcagaggtcctggtcaactttatgaaggaggctgcagaaggaccctttgccaggggcgaggagaagaacacacccaaagcttcagaaaaggagaaggcctgcctggtggacgaggactcccactcttcagctgggacactgccgggccccggagcctccctcccctcctcctctggcccaggtctgacatccccaccttacacagccactccgattgaccacgattacgtcaaatgtaaaaaaccccaccagcaggcaacgccggacgaccgaagccaggacagcacagccgtagcactctcagactctagctcaacgcaggacttctttaatgagcccaccagcttactggaaggctccaggaaatcctacacagagaagaggctgcccattctcagttcccaagcaggagcgacgggtaaagatcttcagggggccacagaagaaagaggaaaaaacgaggagtcattggagagtacagaaggcttccgggctgcagagcaaggtgtccagaagcctgctgcagaaaccccagcctctgcttgcatccctggcaagccctcagcatccacacccaccctgtgggatgggaagaagagaggggacctcccaggggagccagtggccttcccccaggggctgccggctggtgctgaggagcagcggcagtttctcacagagcagtgcatcgcctccttccgcctgtgcctgagccgcttcccccagcactataagagtctctaccgtctggccttcctctacacctacagcaagacccaccggaacctccagtgggcccgcgacgtgttgctaggcagcagtatcccgtggcaacaactgcagcacatgccggcacaggggctcttctgcgagaggaacaagaccaatttcttcaacggcatctggcggatccccgtggacgagattgaccggccgggcagctttgcctggcacatgaaccgctccatcgtgctgctgctcaaggtgctggcccagctgcgggaccacagcaccctgctgaaggtgtcctccatgcttcagcggaccccagaccagggcaagaagtatctgcgagatgctgaccgccaggtcctggcgcagcgggccttcatcctcactgtgaaggtgctcgaagacacgctgagcgagctcgcagaggggtcagaacgcccagggcccaaggtctgtggcctccccggagccaggatgaccaccgatgtctcacacaaggccagtcctgaggatggccaggagggcctcccccagccgaagaagccccctctggctgatggctcagggccagggcccgagccaggaggcaaagtgggcctcctcaaccaccggcctgtggccatggatgcaggagacagtgcagaccaaagcggggagcggaaggataaagagagcccacgggcagggcccactgagcccatggacacgagtgaggccactgtttgccactcagacttggagcggacaccacccctgctgccaggtcgccccgcaagggaccggggccccgagagccggcccactgagctgtccctggaggagctgagcatcagtgcccggcagcagcccaccccgctcaccccagcccagccagcccccgcccccgcccccgccaccaccacagggaccagggcagggggccacccggaggagccgctctcccggctcagccgcaagaggaagctcctggaggacacagagtcaggcaagacacttctgttggatgcctaccgtgtgtggcagcagggccagaagggtgtggcctatgacctgggccgtgtggagaggatcatgtcggagacctacatgctcatcaagcaggtggatgaggaggctgcgctggagcaggctgtgaagttctgccaggtccatcttggggctgccgcccagagacaggcctcgggggacacccccaccactccaaagcaccccaaagacagccgagagaacttctttcctgtgacagtggtgcccacagcccctgaccctgtgccagctgactctgtccagcggcccagtgatgctcacaccaagcctcgccctgcactagctgccgccacaactattatcacctgccctccgtcagcatcagcttccaccctggaccagtccaaggaccctgggcctccccggccacacaggcctgaagctacccccagcatggcctctctgggcccagagggagaagagctggcgagagtggcagagggcaccagcttcccgcctcaggagccacggcacagtccgcaggtgaagatggcccccacaagttccccggcagagccacactgctggccggcagaggctgccctgggcacaggcgctgagcccacctgcagccaggaggggaaactgaggcctgagccgagaagggatggggaggctcaggaggctgcgagtgagactcagcccctgagctctcccccaacagctgccagctccaaggcccccagcagtgggagtgcccagccaccagagggtcacccaggcaagcctgagcccagccgggctaagtcccgccccctgcccaacatgccaaagctggtcatcccctccgccgccaccaagttcccccctgagatcaccgtcacgccacccaccccaaccctgctctcccccaaaggcagcatctcggaggagaccaagcagaagctgaagtcagccatcctttctgcccagtctgctgccaacgtgaggaaggagagcctatgccagccagccctggaggtcctggagacatccagccaggagtcctcgctggagagcgagacagacgaggacgacgactacatggacatttgaggggccactgcagccccaccgccacgccccaggggaccagccaggcctggaatgccccctgggcaggaccctgggcaggaccagaggcccacatggatgccactccccacacagcccccaggcctgcccagcccacctcctcatggcatcctccctgtacccaggtcaggctgtccacaccacatgggagcccagaggaggaggggcccgccttagccatgtgaaggtggattggtcgccatctgcacgccaggcggcatccttttctatgaagtgttgactttgtaaatctgcccacacccagctggccatatccacccctcgacgccgggatgagccggctctgcctgtgtcacagtggaggggtcctttagggccaggctcacccctcaccctttttttggttgcttttctaataaagatggaacagtt

SEQ ID NO: 427260 - DNA, 7675 bp, Homo sapiens
gggtgaggctcagcagagcccggggcacaggccggaggggctgcaggcgcgaggctgggttacgtgaggaagctgggggtttcgcgggcagctttagagccccagtcagggaaaccgaggccgggcttcctggctgcctcgcgagcctcttcatggctctcgccgccgccctgaggtgcctagaatgggttccggcctccggggaggttcccagtaaccgcaggagccaccattgatttggcgtctgctgggtgcaaagcccagcgcgctaaccctttactcgcgacctttcgcttcaccttcacagcagccctgcgaggagagttgtggactggggcaacctttgccagtgatgagaagtgatgctcgtggcagtgctgaatctctctgaatatgattcgaattgcagccttaaatgccagctccaccattgaggatgatcatgaaggaagctttaaaagtcacaaaacccagacaaaggaggctcaggaagcagaggcttttgcattgtaccacaaggcccttgatctgcagaaacatgaccggtttgaggagtctgccaaagcctaccatgagctcttggaggcgagcctgctgcgggaggcagtgatgctggactccacagatgtcaacctctggtataagattggacatgtggccctgaggctcatccggatccccctggctcgccatgcttttgaggaagggctgcggtgcaatcctgaccactggccctgtttggataacctaatcactgtcctgtacaccctcagtgattacacaacatgtctgtacttcatctgcaaagctttggagaaggattgccggtacagcaaagggctggtcctcaaggagaagatttttgaggagcagccttgtctccggaaggactctctcagaatgttcctcaaatgtgacatgtcgattcacgatgtttcggtgagtgcagctgagacacaggcgattgtagatgaggccttggggctgcgaaaaaagaggcaagcgctgattgtgcgggagaaggagccggacctgaaacttgtgcagcccattcctttcttcacctggaagtgcctcggagagagcttgctggccatgtacaatcatctcaccacctgtgagcccccacgtcccagccttggcaaaaggattgatttgtcggactaccaggaccccagccagcctcttgagtcctccatggtggtgacgccagttaacgtgatccagccaagcactgtcagcaccaacccagctgtggctgtcgccgagcctgtggtctcctacacctctgtggctacaaccagcttcccactgcacagtcctggtctgttggagacaggcgctcctgtgggtgatatttctgggggagataaatccaagaaaggggtaaaacggaagaagatttcagaagagagtggagaaacagcaaagcggcggtctgcccgtgtccgaaacaccaagtgcaaaaaagaagagaaagtagacttccaggagcttctgatgaagttcttgccgtccaggttaagaaagctggaccctgaggaggaagatgattcctttaataactatgaagtccagtcagaagccaaactggaaagcttcccaagcattgggcctcaaaggctgtcatttgactcagccacattcatggaatctgaaaagcaggacgtgcatgagttcctgctggagaacctaaccaacgggggcatcctggagctgatgatgcgctacctgaaagccatgggccacaagttcttggtaaggtggcctccaggcttggcggaggtcgtgctcagcgtctaccacagctggaggaggcacagcaccagcctgcccaacccgctgctgagggactgcagcaacaagcacatcaaggacatgatgctgatgtctctctcctgcatggaactccagctggaccagtggctgctgaccaaaggcagaagctctgcagtgtctcctcggaactgccctgctggtatggtgaatggcagatttggacctgacttcccagggacccactgcctgggtgacctcctacagctgtcatttgcctcgtcccagcgcgacctgttcgaggatggttggctggagtttgtggtccgtgtttactggctgaaggctcgcttcctggcgctgcagggagacatggagcaggccctggagaactatgacatctgcacagaaatgctccagagttccaccgccatccaggtggaggcaggggctgaacgaagagacattgtcatccggctgcccaacctccataatgactctgtggtttccctggaggagattgataagaacctgaagtcgctggagcggtgccagtccctggaggagattcagcggctgtatgaagcaggcgactacaaggctgttgtgcatctgctccgccccactttgtgcaccagtgggtttgaccgggccaaacacctggagtttatgacttccattcctgagaggccagcccagctgcttcttctgcaggactccttgctccggctgaaggactatcggcagtgttttgagtgttccgatgtggctctgaacgaggctgtccagcagatggtgaactcaggtgaggctgccgccaaggaggagtgggtggccacagtgacccaactgctgatgggcatcgagcaggccctctctgcggacagcagtggtagcatcctgaaggtatcatcctccaccactggccttgtgcggctcaccaacaacctcatccaggtcattgactgcagcatggctgtgcaggaggaggccaaggagccccacgtctcttcagtgctaccctggatcattctacaccggatcatctggcaggaggaagacaccttccattctctgtgccaccagcagcagctccaaaacccagcggaggaagggatgtcagagacgcccatgctcccatcctccctcatgctgctgaacacagcccacgagtatttgggcagaaggtcctggtgctgcaattcagatggggctctgctgcgattctatgtgcgagtactccagaaggaactggctgcatccacctctgaagacacgcacccttacaaggaggagctggagacagccttggagcagtgcttctactgcctgtacagcttccccagcaagaagagtaaggccaggtacctggaggaacactcggcccagcaggtggatcttatatgggaggatgcactgttcatgtttgagtattttaagcccaagacccttcctgaatttgacagctataagaccagcaccgtgtctgctgacttggccaacctactgaagagaattgccaccattgtgcctcgcacagagaggccagcccttagcctggacaaagtctctgcctacattgagggaacttcaactgaggtaccctgcctcccagagggggctgacccctcccctccagtggtgaacgagctttactacctcctggctgattatcatttcaaaaacaaggagcagtccaaggccatcaagttctacatgcatgacatctgcatctgccccaataggtttgattcctgggcaggcatggctctggcccgggccagccgcattcaggacaagctgaactccaatgagctgaagagtgatgggcccatttggaagcatgccacgcccgtcttgaactgcttccgtcgggccctggagattgacagctccaacttgtccctatggattgagtatggcaccatgtcctatgccttgcactcattcgcctcacgtcaattgaagcagtggagaggcgagctgccccctgagctcgtgcagcagatggagggccggcgcgacagcatgctagagacagccaagcactgtttcacatcagcagcccgctgcgagggtgatggtgacgaggaggagtggctcatccactacatgctgggcaaggtggctgagaagcagcagcagccacccaccgtttacttgctgcactacaggcaggctggccactacctgcacgaggaggctgcccgctaccccaagaagatccactaccacaacccacctgagctggccatggaggccctggaggtgtactttcggctccatgcttccatcctgaagctcctggggaagcccgattctggggttggtgcagaggtcctggtcaactttatgaaggaggctgcagaaggaccctttgccaggggcgaggagaagaacacacccaaagcttcagaaaaggagaaggcctgcctggtggacgaggactcccactcttcagctgggacactgccgggccccggagcctccctcccctcctcctctggcccaggtctgacatccccaccttacacagccactccgattgaccacgattacgtcaaatgtaaaaaaccccaccagcaggcaacgccggacgaccgaagccaggacagcacagccgtagcactctcagactctagctcaacgcaggacttctttaatgagcccaccagcttactggaaggctccaggaaatcctacacagagaagaggctgcccattctcagttcccaagcaggagcgacgggtaaagatcttcagggggccacagaagaaagaggaaaaaacgaggagtcattggagagtacagaaggcttccgggctgcagagcaaggtgtccagaagcctgctgcagaaaccccagcctctgcttgcatccctggcaagccctcagcatccacacccaccctgtgggatgggaagaagagaggggacctcccaggggagccagtggccttcccccaggggctgccggctggtgctgaggagcagcggcagtttctcacagagcagtgcatcgcctccttccgcctgtgcctgagccgcttcccccagcactataagagtctctaccgtctggccttcctctacacctacagcaagacccaccggaacctccagtgggcccgcgacgtgttgctaggcagcagtatcccgtggcaacaactgcagcacatgccggcacaggggctcttctgcgagaggaacaagaccaatttcttcaacggcatctggcggatccccgtggacgagattgaccggccgggcagctttgcctggcacatgaaccgctccatcgtgctgctgctcaaggtgctggcccagctgcgggaccacagcaccctgctgaaggtgtcctccatgcttcagcggaccccagaccagggcaagaagtatctgcgagatgctgaccgccaggtcctggcgcagcgggccttcatcctcactgtgaaggtgctcgaagacacgctgagcgagctcgcagaggggtcagaacgcccagggcccaaggtctgtggcctccccggagccaggatgaccaccgatgtctcacacaaggccagtcctgaggatggccaggagggcctcccccagccgaagaagccccctctggctgatggctcagggccagggcccgagccaggaggcaaagtgggcctcctcaaccaccggcctgtggccatggatgcaggagacagtgcagaccaaagcggggagcggaaggataaagagagcccacgggcagggcccactgagcccatggacacgagtgaggccactgtttgccactcagacttggagcggacaccacccctgctgccaggtcgccccgcaagggaccggggccccgagagccggcccactgagctgtccctggaggagctgagcatcagtgcccggcagcagcccaccccgctcaccccagcccagccagcccccgcccccgcccccgccaccaccacagggaccagggcagggggccacccggaggagccgctctcccggctcagccgcaagaggaagctcctggaggacacagagtcaggcaagacacttctgttggatgcctaccgtgtgtggcagcagggccagaagggtgtggcctatgacctgggccgtgtggagaggatcatgtcggagacctacatgctcatcaagcaggtggatgaggaggctgcgctggagcaggctgtgaagttctgccaggtccatcttggggctgccgcccagagacaggcctcgggggacacccccaccactccaaagcaccccaaagacagccgagagaacttctttcctgtgacagtggtgcccacagcccctgaccctgtgccagctgactctgtccagcggcccagtgatgctcacaccaagcctcgccctgcactagctgccgccacaactattatcacctgccctccgtcagcatcagcttccaccctggaccagtccaaggaccctgggcctccccggccacacaggcctgaagctacccccagcatggcctctctgggcccaggccctcccctgcttctccctccctgcctcaaggacccagcctgtttccttgccgcagaccctgcactggcccacagcctgtgtcacccctggaggctcacctgtcttcccagttgaatttcctacccatctgaaaaacgagacagccactctgcagaagtgcccagcagaaggcaggcctaagagcccccacagactgtgcgcctgagtggaggttgagttgagaagtcttcctcagctctttcccacggtggctcaagcagcaagcaggtgctgatgttttcacctgatgccatccacactgctttgaggattgtgaacatagggagaagagctggcgagagtggcagagggcaccagcttcccgcctcaggagccacggcacagtccgcaggtgaagatggcccccacaagttccccggcagagccacactgctggccggcagaggctgccctgggcacaggcgctgagcccacctgcagccaggaggggaaactgaggcctgagccgagaagggatggggaggctcaggaggctgcgagtgagactcagcccctgagctctcccccaacagctgccagctccaaggcccccagcagtgggagtgcccagccaccagagggtcacccaggcaagcctgagcccagccgggctaagtcccgccccctgcccaacatgccaaagctggtcatcccctccgccgccaccaagttcccccctgagatcaccgtcacgccacccaccccaaccctgctctcccccaaaggcagcatctcggaggagaccaagcagaagctgaagtcagccatcctttctgcccagtctgctgccaacgtgaggaaggagagcctatgccagccagccctggaggtcctggagacatccagccaggagtcctcgctggagagcgagacagacgaggacgacgactacatggacatttgaggggccactgcagccccaccgccacgccccaggggaccagccaggcctggaatgccccctgggcaggaccctgggcaggaccagaggcccacatggatgccactccccacacagcccccaggcctgcccagcccacctcctcatggcatcctccctgtacccaggtcaggctgtccacaccacatgggagcccagaggaggaggggcccgccttagccatgtgaaggtggattggtcgccatctgcacgccaggcggcatccttttctatgaagtgttgactttgtaaatctgcccacacccagctggccatatccacccctcgacgccgggatgagccggctctgcctgtgtcacagtggaggggtcctttagggccaggctcacccctcaccctttttttggttgcttttctaataaagatggaacagtt

SEQ ID NO: 427261 - DNA, 2470 bp, Homo sapiens
gccccgggctgggagctggctcgtgggggcgtgcgctgcgcgaaagcgaaagccgcccgccagagcaactttgcggcggaaggcgccgacgaggagctgtgccgtgccgctcttggggatgggcatctggcggatccccgtggacgagattgaccggccgggcagctttgcctggcacatgaaccgctccatcgtgctgctgctcaaggtgctggcccagctgcgggaccacagcaccctgctgaaggtgtcctccatgcttcagcggaccccagaccagggcaagaagtatctgcgagatgctgaccgccaggtcctggcgcagcgggccttcatcctcactgtgaaggtgctcgaagacacgctgagcgagctcgcagaggggtcagaacgcccagggcccaaggtctgtggcctccccggagccaggatgaccaccgatgtctcacacaaggccagtcctgaggatggccaggagggcctcccccagccgaagaagccccctctggctgatggctcagggccagggcccgagccaggaggcaaagtgggcctcctcaaccaccggcctgtggccatggatgcaggagacagtgcagaccaaagcggggagcggaaggataaagagagcccacgggcagggcccactgagcccatggacacgagtgaggccactgtttgccactcagacttggagcggacaccacccctgctgccaggtcgccccgcaagggaccggggccccgagagccggcccactgagctgtccctggaggagctgagcatcagtgcccggcagcagcccaccccgctcaccccagcccagccagcccccgcccccgcccccgccaccaccacagggaccagggcagggggccacccggaggagccgctctcccggctcagccgcaagaggaagctcctggaggacacagagtcaggcaagacacttctgttggatgcctaccgtgtgtggcagcagggccagaagggtgtggcctatgacctgggccgtgtggagaggatcatgtcggagacctacatgctcatcaagcaggtggatgaggaggctgcgctggagcaggctgtgaagttctgccaggtccatcttggggctgccgcccagagacaggcctcgggggacacccccaccactccaaagcaccccaaagacagccgagagaacttctttcctgtgacagtggtgcccacagcccctgaccctgtgccagctgactctgtccagcggcccagtgatgctcacaccaagcctcgccctgcactagctgccgccacaactattatcacctgccctccgtcagcatcagcttccaccctggaccagtccaaggaccctgggcctccccggccacacaggcctgaagctacccccagcatggcctctctgggcccagagggagaagagctggcgagagtggcagagggcaccagcttcccgcctcaggagccacggcacagtccgcaggtgaagatggcccccacaagttccccggcagagccacactgctggccggcagaggctgccctgggcacaggcgctgagcccacctgcagccaggaggggaaactgaggcctgagccgagaagggatggggaggctcaggaggctgcgagtgagactcagcccctgagctctcccccaacagctgccagctccaaggcccccagcagtgggagtgcccagccaccagagggtcacccaggcaagcctgagcccagccgggctaagtcccgccccctgcccaacatgccaaagctggtcatcccctccgccgccaccaagttcccccctgagatcaccgtcacgccacccaccccaaccctgctctcccccaaaggcagcatctcggaggagaccaagcagaagctgaagtcagccatcctttctgcccagtctgctgccaacgtgaggaaggagagcctatgccagccagccctggaggtcctggagacatccagccaggagtcctcgctggagagcgagacagacgaggacgacgactacatggacatttgaggggccactgcagccccaccgccacgccccaggggaccagccaggcctggaatgccccctgggcaggaccctgggcaggaccagaggcccacatggatgccactccccacacagcccccaggcctgcccagcccacctcctcatggcatcctccctgtacccaggtcaggctgtccacaccacatgggagcccagaggaggaggggcccgccttagccatgtgaaggtggattggtcgccatctgcacgccaggcggcatccttttctatgaagtgttgactttgtaaatctgcccacacccagctggccatatccacccctcgacgccgggatgagccggctctgcctgtgtcacagtggaggggtcctttagggccaggctcacccctcaccctttttttggttgcttttctaataaagatggaacagtt

SEQ ID NO: 427262 - DNA, 7281 bp, Homo sapiens
gggtgaggctcagcagagcccggggcacaggccggaggggctgcaggcgcgaggctgggttacgtgaggaagctgggggtttcgcgggcagctttagagccccagtcagggaaaccgaggccgggcttcctggctgcctcgcgagcctcttcatggctctcgccgccgccctgaggtgcctagaatgggttccggcctccggggaggttcccagtaaccgcaggagccaccattgatttggcgtctgctgggtgcaaagcccagcgcgctaaccctttactcgcgacctttcgcttcaccttcacagcagccctgcgaggagagttgtggactggggcaacctttgccagtgatgagaagtgatgctcgtggcagtgctgaatctctctgaatatgattcgaattgcagccttaaatgccagctccaccattgaggatgatcatgaaggaagctttaaaagtcacaaaacccagacaaaggaggctcaggaagcagaggcttttgcattgtaccacaaggcccttgatctgcagaaacatgaccggtttgaggagtctgccaaagcctaccatgagctcttggaggcgagcctgctgcgggaggcagtgatgctggactccacagatgtcaacctctggtataagattggacatgtggccctgaggctcatccggatccccctggctcgccatgcttttgaggaagggctgcggtgcaatcctgaccactggccctgtttggataacctaatcactgtcctgtacaccctcagtgattacacaacatgtctgtacttcatctgcaaagctttggagaaggattgccggtacagcaaagggctggtcctcaaggagaagatttttgaggagcagccttgtctccggaaggactctctcagaatgttcctcaaatgtgacatgtcgattcacgatgtttcggtgagtgcagctgagacacaggcgattgtagatgaggccttggggctgcgaaaaaagaggcaagcgctgattgtgcgggagaaggagccggacctgaaacttgtgcagcccattcctttcttcacctggaagtgcctcggagagagcttgctggccatgtacaatcatctcaccacctgtgagcccccacgtcccagccttggcaaaaggattgatttgtcggactaccaggaccccagccagcctcttgagtcctccatggtggtgacgccagttaacgtgatccagccaagcactgtcagcaccaacccagctgtggctgtcgccgagcctgtggtctcctacacctctgtggctacaaccagcttcccactgcacagtcctggtctgttggagacaggcgctcctgtgggtgatatttctgggggagataaatccaagaaaggggtaaaacggaagaagatttcagaagagagtggagaaacagcaaagcggcggtctgcccgtgtccgaaacaccaagtgcaaaaaagaagagaaagtagacttccaggagcttctgatgaagttcttgccgtccaggttaagaaagctggaccctgaggaggaagatgattcctttaataactatgaagtccagtcagaagccaaactggaaagcttcccaagcattgggcctcaaaggctgtcatttgactcagccacattcatggaatctgaaaagcaggacgtgcatgagttcctgctggagaacctaaccaacgggggcatcctggagctgatgatgcgctacctgaaagccatgggccacaagttcttggtaaggtggcctccaggcttggcggaggtcgtgctcagcgtctaccacagctggaggaggcacagcaccagcctgcccaacccgctgctgagggactgcagcaacaagcacatcaaggacatgatgctgatgtctctctcctgcatggaactccagctggaccagtggctgctgaccaaaggcagaagctctgcagtgtctcctcggaactgccctgctggtatggtgaatggcagatttggacctgacttcccagggacccactgcctgggtgacctcctacagctgtcatttgcctcgtcccagcgcgacctgttcgaggatggttggctggagtttgtggtccgtgtttactggctgaaggctcgcttcctggcgctgcagggagacatggagcaggccctggagaactatgacatctgcacagaaatgctccagagttccaccgccatccaggtggaggcaggggctgaacgaagagacattgtcatccggctgcccaacctccataatgactctgtggtttccctggaggagattgataagaacctgaagtcgctggagcggtgccagtccctggaggagattcagcggctgtatgaagcaggcgactacaaggctgttgtgcatctgctccgccccactttgtgcaccagtgggtttgaccgggccaaacacctggagtttatgacttccattcctgagaggccagcccagctgcttcttctgcaggactccttgctccggctgaaggactatcggcagtgttttgagtgttccgatgtggctctgaacgaggctgtccagcagatggtgaactcaggtgaggctgccgccaaggaggagtgggtggccacagtgacccaactgctgatgggcatcgagcaggccctctctgcggacagcagtggtagcatcctgaaggtatcatcctccaccactggccttgtgcggctcaccaacaacctcatccaggtcattgactgcagcatggctgtgcaggaggaggccaaggagccccacgtctcttcagtgctaccctggatcattctacaccggatcatctggcaggaggaagacaccttccattctctgtgccaccagcagcagctccaaaacccagcggaggaagggatgtcagagacgcccatgctcccatcctccctcatgctgctgaacacagcccacgagtatttgggcagaaggtcctggtgctgcaattcagatggggctctgctgcgattctatgtgcgagtactccagaaggaactggctgcatccacctctgaagacacgcacccttacaaggaggagctggagacagccttggagcagtgcttctactgcctgtacagcttccccagcaagaagagtaaggccaggtacctggaggaacactcggcccagcaggtggatcttatatgggaggatgcactgttcatgtttgagtattttaagcccaagacccttcctgaatttgacagctataagaccagcaccgtgtctgctgacttggccaacctactgaagagaattgccaccattgtgcctcgcacagagaggccagcccttagcctggacaaagtctctgcctacattgagggaacttcaactgaggtaccctgcctcccagagggggctgacccctcccctccagtggtgaacgagctttactacctcctggctgattatcatttcaaaaacaaggagcagtccaaggccatcaagttctacatgcatgacatctgcatctgccccaataggtttgattcctgggcaggcatggctctggcccgggccagccgcattcaggacaagctgaactccaatgagctgaagagtgatgggcccatttggaagcatgccacgcccgtcttgaactgcttccgtcgggccctggagattgacagctccaacttgtccctatggattgagtatggcaccatgtcctatgccttgcactcattcgcctcacgtcaattgaagcagtggagaggcgagctgccccctgagctcgtgcagcagatggagggccggcgcgacagcatgctagagacagccaagcactgtttcacatcagcagcccgctgcgagggtgatggtgacgaggaggagtggctcatccactacatgctgggcaaggtggctgagaagcagcagcagccacccaccgtttacttgctgcactacaggcaggctggccactacctgcacgaggaggctgcccgctaccccaagaagatccactaccacaacccacctgagctggccatggaggccctggaggtgtactttcggctccatgcttccatcctgaagctcctggggaagcccgattctggggttggtgcagaggtcctggtcaactttatgaaggaggctgcagaaggaccctttgccaggggcgaggagaagaacacacccaaagcttcagaaaaggagaaggcctgcctggtggacgaggactcccactcttcagctgggacactgccgggccccggagcctccctcccctcctcctctggcccaggtctgacatccccaccttacacagccactccgattgaccacgattacgtcaaatgtaaaaaaccccaccagcaggcaacgccggacgaccgaagccaggacagcacagccgtagcactctcagactctagctcaacgcaggacttctttaatgagcccaccagcttactggaaggctccaggaaatcctacacagagaagaggctgcccattctcagttcccaagcaggagcgacgggtaaagatcttcagggggccacagaagaaagaggaaaaaacgaggagtcattggagagtacagaaggcttccgggctgcagagcaaggtgtccagaagcctgctgcagaaaccccagcctctgcttgcatccctggcaagccctcagcatccacacccaccctgtgggatgggaagaagagaggggacctcccaggggagccagtggccttcccccaggggctgccggctggtgctgaggagcagcggcagtttctcacagagcagtgcatcgcctccttccgcctgtgcctgagccgcttcccccagcactataagagtctctaccgtctggccttcctctacacctacagcaagacccaccggaacctccagtgggcccgcgacgtgttgctaggcagcagtatcccgtggcaacaactgcagcacatgccggcacaggggctcttctgcgagaggaacaagaccaatttcttcaacggcatctggcggatccccgtggacgagattgaccggccgggcagctttgcctggcacatgaaccgctccatcgtgctgctgctcaaggtgctggcccagctgcgggaccacagcaccctgctgaaggtgtcctccatgcttcagcggaccccagaccagggcaagaagtatctgcgagatgctgaccgccaggtcctggcgcagcgggccttcatcctcactgtgaaggtgctcgaagacacgctgagcgagctcgcagaggggtcagaacgcccagggcccaaggtctgtggcctccccggagccaggatgaccaccgatgtctcacacaaggccagtcctgaggatggccaggagggcctcccccagccgaagaagccccctctggctgatggctcagggccagggcccgagccaggaggcaaagtgggcctcctcaaccaccggcctgtggccatggatgcaggagacagtgcagaccaaagcggggagcggaaggataaagagagcccacgggcagggcccactgagcccatggacacgagtgaggccactgtttgccactcagacttggagcggacaccacccctgctgccaggtcgccccgcaagggaccggggccccgagagccggcccactgagctgtccctggaggagctgagcatcagtgcccggcagcagcccaccccgctcaccccagcccagccagcccccgcccccgcccccgccaccaccacagggaccagggcagggggccacccggaggagccgctctcccggctcagccgcaagaggaagctcctggaggacacagagtcaggcaagacacttctgttggatgcctaccgtgtgtggcagcagggccagaagggtgtggcctatgacctgggccgtgtggagaggatcatgtcggagacctacatgctcatcaagcaggtggatgaggaggctgcgctggagcaggctgtgaagttctgccaggtccatcttggggctgccgcccagagacaggcctcgggggacacccccaccactccaaagcaccccaaagacagccgagagaacttctttcctgtgacagtggtgcccacagcccctgaccctgtgccagctgactctgtccagcggcccagtgatgctcacaccaagcctcgccctgcactagctgccgccacaactattatcacctgccctccgtcagcatcagcttccaccctggaccagtccaaggaccctgggcctccccggccacacaggcctgaagctacccccagcatggcctctctgggcccagagggagaagagctggcgagagtggcagagggcaccagcttcccgcctcaggagccacggcacagtccgcaggtgaagatggcccccacaagttccccggcagagccacactgctggccggcagaggctgccctgggcacaggcgctgagcccacctgcagccaggaggggaaactgaggcctgagccgagaagggatggggaggctcaggaggctgcgagtgagactcagcccctgagctctcccccaacagctgccagctccaaggcccccagcagtgggagtgcccagccaccagagggtcacccaggcaagcctgagcccagccgggctaagtcccgccccctgcccaacatgccaaagctggtcatcccctccgccgccaccaagttcccccctgagatcaccgtcacgccacccaccccaaccctgctctcccccaaaggcagcatctcggaggagaccaagcagaagctgaagtcagccatcctttctgcccagtctgctgccaacgtgaggaaggagagcctatgccagccagccctggaggtcctggagacatccagccaggagtcctcgctggagagcgagacagacgaggacgacgactacatggacatttgaggggccactgcagccccaccgccacgccccaggggaccagccaggcctggaatgccccctgggcaggaccctgggcaggaccagaggcccacatggatgccactccccacacagcccccaggcctgcccagcccacctcctcatggcatcctccctgtacccaggtcaggctgtccacaccacatgggagcccagaggaggaggggcccgccttagccatgtgaaggtggattggtcgccatctgcacgccaggcggcatccttttctatgaagtgttgactttgtaaatctgcccacacccagctggccacacccctcaccctttttttggttgcttttctaataaagatggaacagtt

SEQ ID NO: 427263 - DNA, 5976 bp, Homo sapiens
gggtgaggctcagcagagcccggggcacaggccggaggggctgcaggcgcgaggctgggttacgtgaggaagctgggggtttcgcgggcagctttagagccccagtcagggaaaccgaggccgggcttcctggctgcctcgcgagcctcttcatggctctcgccgccgccctgaggtgcctagaatgggttccggcctccggggaggttcccagtaaccgcaggagccaccattgatttggcgtctgctgggtgcaaagcccagcgcgctaaccctttactcgcgacctttcgcttcaccttcacagcagccctgcgaggagagttgtggactggggcaacctttgccagtgatgagaagtgatgctcgtggcagtgctgaatctctctgaatatgattcgaattgcagccttaaatgccagctccaccattgaggatgatcatgaaggaagctttaaaagtcacaaaacccagacaaaggaggctcaggaagcagaggcttttgcattgtaccacaaggcccttgatctgcagaaacatgaccggtttgaggagtctgccaaagcctaccatgagctcttggaggcgagcctgctgcgggaggcagtgatgctggactccacagatgtcaacctctggtataagattggacatgtggccctgaggctcatccggatccccctggctcgccatgcttttgaggaagggctgcggtgcaatcctgaccactggccctgtttggataacctaatcactgtcctgtacaccctcagtgattacacaacatgtctgtacttcatctgcaaagctttggagaaggattgccggtacagcaaagggctggtcctcaaggagaagatttttgaggagcagccttgtctccggaaggactctctcagaatgttcctcaaatgtgacatgtcgattcacgatgtttcggtgagtgcagctgagacacaggcgattgtagatgaggccttggggctgcgaaaaaagaggcaagcgctgattgtgcgggagaaggagccggacctgaaacttgtgcagcccattcctttcttcacctggaagtgcctcggagagagcttgctggccatgtacaatcatctcaccacctgtgagcccccacgtcccagccttggcaaaaggattgatttgtcggactaccaggaccccagccagcctcttgagtcctccatggtggtgacgccagttaacgtgatccagccaagcactgtcagcaccaacccagctgtggctgtcgccgagcctgtggtctcctacacctctgtggctacaaccagcttcccactgcacagtcctggtctgttggagacaggcgctcctgtgggtgatatttctgggggagataaatccaagaaaggggtaaaacggaagaagatttcagaagagagtggagaaacagcaaagcggcggtctgcccgtgtccgaaacaccaagtgcaaaaaagaagagaaagtagacttccaggagcttctgatgaagttcttgccgtccaggttaagaaagctggaccctgaggaggaagatgattcctttaataactatgaagtccagtcagaagccaaactggaaagcttcccaagcattgggcctcaaaggctgtcatttgactcagccacattcatggaatctgaaaagcaggacgtgcatgagttcctgctggagaacctaaccaacgggggcatcctggagctgatgatgcgctacctgaaagccatgggccacaagttcttggtaaggtggcctccaggcttggcggaggtcgtgctcagcgtctaccacagctggaggaggcacagcaccagcctgcccaacccgctgctgagggactgcagcaacaagcacatcaaggacatgatgctgatgtctctctcctgcatggaactccagctggaccagtggctgctgaccaaaggcagaagctctgcagtgtctcctcggaactgccctgctggtatggtgaatggcagatttggacctgacttcccagggacccactgcctgggtgacctcctacagctgtcatttgcctcgtcccagcgcgacctgttcgaggatggttggctggagtttgtggtccgtgtttactggctgaaggctcgcttcctggcgctgcagggagacatggagcaggccctggagaactatgacatctgcacagaaatgctccagagttccaccgccatccaggtggaggcaggggctgaacgaagagacattgtcatccggctgcccaacctccataatgactctgtggtttccctggaggagattgataagaacctgaagtcgctggagcggtgccagtccctggaggagattcagcggctgtatgaagcaggcgactacaaggctgttgtgcatctgctccgccccactttgtgcaccagtgggtttgaccgggccaaacacctggagtttatgacttccattcctgagaggccagcccagctgcttcttctgcaggactccttgctccggctgaaggactatcggcagtgttttgagtgttccgatgtggctctgaacgaggctgtccagcagatggtgaactcaggtgaggctgccgccaaggaggagtgggtggccacagtgacccaactgctgatgggcatcgagcaggccctctctgcggacagcagtggtagcatcctgaaggtatcatcctccaccactggccttgtgcggctcaccaacaacctcatccaggtcattgactgcagcatggctgtgcaggaggaggccaaggagccccacgtctcttcagtgctaccctggatcattctacaccggatcatctggcaggaggaagacaccttccattctctgtgccaccagcagcagctccaaaacccagcggaggaagggatgtcagagacgcccatgctcccatcctccctcatgctgctgaacacagcccacgagtatttgggcagaaggtcctggtgctgcaattcagatggggctctgctgcgattctatgtgcgagtactccagaaggaactggctgcatccacctctgaagacacgcacccttacaaggaggagctggagacagccttggagcagtgcttctactgcctgtacagcttccccagcaagaagagtaaggccaggtacctggaggaacactcggcccagcaggtggatcttatatgggaggatgcactgttcatgtttgagtattttaagcccaagacccttcctgaatttgacagctataagaccagcaccgtgtctgctgacttggccaacctactgaagagaattgccaccattgtgcctcgcacagagaggccagcccttagcctggacaaagtctctgcctacattgagggaacttcaactgaggtaccctgcctcccagagggggctgacccctcccctccagtggtgaacgagctttactacctcctggctgattatcatttcaaaaacaaggagcagtccaaggccatcaagttctacatgcatgacatctgcatctgccccaataggtttgattcctgggcaggcatggctctggcccgggccagccgcattcaggacaagctgaactccaatgagctgaagagtgatgggcccatttggaagcatgccacgcccgtcttgaactgcttccgtcgggccctggagattgacagctccaacttgtccctatggattgagtatggcaccatgtcctatgccttgcactcattcgcctcacgtcaattgaagcagtggagaggcgagctgccccctgagctcgtgcagcagatggagggccggcgcgacagcatgctagagacagccaagcactgtttcacatcagcagcccgctgcgagggtgatggtgacgaggaggagtggctcatccactacatgctgggcaaggtggctgagaagcagcagcagccacccaccgtttacttgctgcactacaggcaggctggccactacctgcacgaggaggctgcccgctaccccaagaagatccactaccacaacccacctgagctggccatggaggccctggaggtgtactttcggctccatgcttccatcctgaagctcctggggaagcccgattctggggttggtgcagaggtcctggtcaactttatgaaggaggctgcagaaggaccctttgccaggggcgaggagaagaacacacccaaagcttcagaaaaggagaaggcctgcctggtggacgaggactcccactcttcagctgggacactgccgggccccggagcctccctcccctcctcctctggcccaggtctgacatccccaccttacacagccactccgattgaccacgattacgtcaaatgtaaaaaaccccaccagcaggcaacgccggacgaccgaagccaggacagcacagccgtagcactctcagactctagctcaacgcaggacttctttaatgagcccaccagcttactggaaggctccaggaaatcctacacagagaagaggctgcccattctcagttcccaagcaggagcgacgggtaaagatcttcagggggccacagaagaaagaggaaaaaacgaggagtcattggagagtacagaaggcttccgggctgcagagcaaggtgtccagaagcctgctgcagaaaccccagcctctgcttgcatccctggcaagccctcagcatccacacccaccctgtgggatgggaagaagagaggggacctcccaggggagccagtggccttcccccaggggctgccggctggtgctgaggagcagcggcagtttctcacagagcagtgcatcgcctccttccgcctgtgcctgagccgcttcccccagcactataagagtctctaccgtctggccttcctctacacctacagcaagacccaccggaacctccagtgggcccgcgacgtgttgctaggcagcagtatcccgtggcaacaactgcagcacatgccggcacaggggctcttctgcgagaggaacaagaccaatttcttcaacggcatctggcggatccccgtggacgagattgaccggccgggcagctttgcctggcacatgaaccgctccatcgtgctgctgctcaaggtgctggcccagctgcgggaccacagcaccctgctgaaggtgtcctccatgcttcagcggaccccagaccagggcaagaagtatctgcgagatgctgaccgccaggtcctggcgcagcgggccttcatcctcactgtgaaggtgctcgaagacacgctgagcgagctcgcagaggggtcagaacgcccagggcccaaggtctgtggcctccccggagccaggatgaccaccgatgtctcacacaaggccagtcctgaggatggccaggagggcctcccccagccgaagaagccccctctggctgatggctcagggccagggcccgagccaggaggcaaagtgggcctcctcaaccaccggcctgtggccatggatgcaggagacagtgcagaccaaagcggggagcggaaggataaagagagcccacgggcagggcccactgagcccatggacacgagtgaggccactgtttgccactcagacttggagcggacaccacccctgctgccaggtcgccccgcaagggaccggggccccgagagccggcccactgagctgtccctggaggagctgagcatcagtgcccggcagcagcccaccccgctcaccccagcccagccagcccccgcccccgcccccgccaccaccacagggaccagggcagggggccacccggaggagccgctctcccggctcagccgcaagaggaagctcctggaggacacagagtcaggcaagacacttctgttggatgcctaccgtgttatccacccctcgacgccgggatgagccggctctgcctgtgtcacagtggaggggtcctttagggccaggctcacccctcaccctttttttggttgcttttctaataaagatggaacagtt

SEQ ID NO: 427264 - DNA, 5580 bp, Homo sapiens
gggtgaggctcagcagagcccggggcacaggccggaggggctgcaggcgcgaggctgggttacgtgaggaagctgggggtttcgcgggcagctttagagccccagtcagggaaaccgaggccgggcttcctggctgcctcgcgagcctcttcatggctctcgccgccgccctgaggtgcctagaatgggttccggcctccggggaggttcccagtaaccgcaggagccaccattgatttggcgtctgctgggtgcaaagcccagcgcgctaaccctttactcgcgacctttcgcttcaccttcacagcagccctgcgaggagagttgtggactggggcaacctttgccagtgatgagaagtgatgctcgtggcagtgctgaatctctctgaatatgattcgaattgcagccttaaatgccagctccaccattgaggatgatcatgaaggaagctttaaaagtcacaaaacccagacaaaggaggctcaggaagcagaggcttttgcattgtaccacaaggcccttgatctgcagaaacatgaccggtttgaggagtctgccaaagcctaccatgagctcttggaggcgagcctgctgcgggaggcagtgatgctggactccacagatgtcaacctctggtataagattggacatgtggccctgaggctcatccggatccccctggctcgccatgcttttgaggaagggctgcggtgcaatcctgaccactggccctgtttggataacctaatcactgtcctgtacaccctcagtgattacacaacatgtctgtacttcatctgcaaagctttggagaaggattgccggtacagcaaagggctggtcctcaaggagaagatttttgaggagcagccttgtctccggaaggactctctcagaatgttcctcaaatgtgacatgtcgattcacgatgtttcggtgagtgcagctgagacacaggcgattgtagatgaggccttggggctgcgaaaaaagaggcaagcgctgattgtgcgggagaaggagccggacctgaaacttgtgcagcccattcctttcttcacctggaagtgcctcggagagagcttgctggccatgtacaatcatctcaccacctgtgagcccccacgtcccagccttggcaaaaggattgatttgtcggactaccaggaccccagccagcctcttgagtcctccatggtggtgacgccagttaacgtgatccagccaagcactgtcagcaccaacccagctgtggctgtcgccgagcctgtggtctcctacacctctgtggctacaaccagcttcccactgcacagtcctggtctgttggagacaggcgctcctgtgggtgatatttctgggggagataaatccaagaaaggggtaaaacggaagaagatttcagaagagagtggagaaacagcaaagcggcggtctgcccgtgtccgaaacaccaagtgcaaaaaagaagagaaagtagacttccaggagcttctgatgaagttcttgccgtccaggttaagaaagctggaccctgaggaggaagatgattcctttaataactatgaagtccagtcagaagccaaactggaaagcttcccaagcattgggcctcaaaggctgtcatttgactcagccacattcatggaatctgaaaagcaggacgtgcatgagttcctgctggagaacctaaccaacgggggcatcctggagctgatgatgcgctacctgaaagccatgggccacaagttcttggtaaggtggcctccaggcttggcggaggtcgtgctcagcgtctaccacagctggaggaggcacagcaccagcctgcccaacccgctgctgagggactgcagcaacaagcacatcaaggacatgatgctgatgtctctctcctgcatggaactccagctggaccagtggctgctgaccaaaggcagaagctctgcagtgtctcctcggaactgccctgctggtatggtgaatggcagatttggacctgacttcccagggacccactgcctgggtgacctcctacagctgtcatttgcctcgtcccagcgcgacctgttcgaggatggttggctggagtttgtggtccgtgtttactggctgaaggctcgcttcctggcgctgcagggagacatggagcaggccctggagaactatgacatctgcacagaaatgctccagagttccaccgccatccaggtggaggcaggggctgaacgaagagacattgtcatccggctgcccaacctccataatgactctgtggtttccctggaggagattgataagaacctgaagtcgctggagcggtgccagtccctggaggagattcagcggctgtatgaagcaggcgactacaaggctgttgtgcatctgctccgccccactttgtgcaccagtgggtttgaccgggccaaacacctggagtttatgacttccattcctgagaggccagcccagctgcttcttctgcaggactccttgctccggctgaaggactatcggcagtgttttgagtgttccgatgtggctctgaacgaggctgtccagcagatggtgaactcaggtgaggctgccgccaaggaggagtgggtggccacagtgacccaactgctgatgggcatcgagcaggccctctctgcggacagcagtggtagcatcctgaaggtatcatcctccaccactggccttgtgcggctcaccaacaacctcatccaggtcattgactgcagcatggctgtgcaggaggaggccaaggagccccacgtctcttcagtgctaccctggatcattctacaccggatcatctggcaggaggaagacaccttccattctctgtgccaccagcagcagctccaaaacccagcggaggaagggatgtcagagacgcccatgctcccatcctccctcatgctgctgaacacagcccacgagtatttgggcagaaggtcctggtgctgcaattcagatggggctctgctgcgattctatgtgcgagtactccagaaggaactggctgcatccacctctgaagacacgcacccttacaaggaggagctggagacagccttggagcagtgcttctactgcctgtacagcttccccagcaagaagagtaaggccaggtacctggaggaacactcggcccagcaggtggatcttatatgggaggatgcactgttcatgtttgagtattttaagcccaagacccttcctgaatttgacagctataagaccagcaccgtgtctgctgacttggccaacctactgaagagaattgccaccattgtgcctcgcacagagaggccagcccttagcctggacaaagtctctgcctacattgagggaacttcaactgaggtaccctgcctcccagagggggctgacccctcccctccagtggtgaacgagctttactacctcctggctgattatcatttcaaaaacaaggagcagtccaaggccatcaagttctacatgcatgacatctgcatctgccccaataggtttgattcctgggcaggcatggctctggcccgggccagccgcattcaggacaagctgaactccaatgagctgaagagtgatgggcccatttggaagcatgccacgcccgtcttgaactgcttccgtcgggccctggagattgacagctccaacttgtccctatggattgagtatggcaccatgtcctatgccttgcactcattcgcctcacgtcaattgaagcagtggagaggcgagctgccccctgagctcgtgcagcagatggagggccggcgcgacagcatgctagagacagccaagcactgtttcacatcagcagcccgctgcgagggtgatggtgacgaggaggagtggctcatccactacatgctgggcaaggtggctgagaagcagcagcagccacccaccgtttacttgctgcactacaggcaggctggccactacctgcacgaggaggctgcccgctaccccaagaagatccactaccacaacccacctgagctggccatggaggccctggaggtgtactttcggctccatgcttccatcctgaagctcctggggaagcccgattctggggttggtgcagaggtcctggtcaactttatgaaggaggctgcagaaggaccctttgccaggggcgaggagaagaacacacccaaagcttcagaaaaggagaaggcctgcctggtggacgaggactcccactcttcagctgggacactgccgggccccggagcctccctcccctcctcctctggcccaggtctgacatccccaccttacacagccactccgattgaccacgattacgtcaaatgtaaaaaaccccaccagcaggcaacgccggacgaccgaagccaggacagcacagccgtagcactctcagactctagctcaacgcaggacttctttaatgagcccaccagcttactggaaggctccaggaaatcctacacagagaagaggctgcccattctcagttcccaagcaggagcgacgggtaaagatcttcagggggccacagaagaaagaggaaaaaacgaggagtcattggagagtacagaaggcttccgggctgcagagcaaggtgtccagaagcctgctgcagaaaccccagcctctgcttgcatccctggcaagccctcagcatccacacccaccctgtgggatgggaagaagagaggggacctcccaggggagccagtggccttcccccaggggctgccggctggtgctgaggagcagcggcagtttctcacagagcagtgcatcgcctccttccgcctgtgcctgagccgcttcccccagcactataagagtctctaccgtctggccttcctctacacctacagcaagacccaccggaacctccagtgggcccgcgacgtgttgctaggcagcagtatcccgtggcaacaactgcagcacatgccggcacaggggctcttctgcgagaggaacaagaccaatttcttcaacggcatctggcggatccccgtggacgagattgaccggccgggcagctttgcctggcacatgaaccgctccatcgtgctgctgctcaaggtgctggcccagctgcgggaccacagcaccctgctgaaggtgtcctccatgcttcagcggaccccagaccagggcaagaagtatctgcgagatgctgaccgccaggtcctggcgcagcgggccttcatcctcactgtgaaggtgctcgaagacacgctgagcgagctcgcagaggggtcagaacgcccagggcccaaggtctgtggcctccccggagccaggatgaccaccgatgtctcacacaaggccagtcctgaggatggcccgccttagccatgtgaaggtggattggtcgccatctgcacgccaggcggcatccttttctatgaagtgttgactttgtaaatctgcccacacccagctggccatatccacccctcgacgccgggatgagccggctctgcctgtgtcacagtggaggggtcctttagggccaggctcacccctcaccctttttttggttgcttttctaataaagatggaacagtt

SEQ ID NO: 427265 - DNA, 4013 bp, Homo sapiens
gggtgaggctcagcagagcccggggcacaggccggaggggctgcaggcgcgaggctgggttacgtgaggaagctgggggtttcgcgggcagctttagagccccagtcagggaaaccgaggccgggcttcctggctgcctcgcgagcctcttcatggctctcgccgccgccctgaggtgcctagaatgggttccggcctccggggaggttcccagtaaccgcaggagccaccattgatttggcgtctgctgggtgcaaagcccagcgcgctaaccctttactcgcgacctttcgcttcaccttcacagcagccctgcgaggagagttgtggactggggcaacctttgccagtgatgagaagtgatgctcgtggcagtgctgaatctctctgaatatgattcgaattgcagccttaaatgccagctccaccattgaggatgatcatgaaggaagctttaaaagtcacaaaacccagacaaaggaggctcaggaagcagaggcttttgcattgtaccacaaggcccttgatctgcagaaacatgaccggtttgaggagtctgccaaagcctaccatgagctcttggaggcgagcctgctgcgggaggcagtgatgctggactccacagatgtcaacctctggtataagattggacatgtggccctgaggctcatccggatccccctggctcgccatgcttttgaggaagggctgcggtgcaatcctgaccactggccctgtttggataacctaatcactgtcctgtacaccctcagtgattacacaacatgtctgtacttcatctgcaaagctttggagaaggattgccggtacagcaaagggctggtcctcaaggagaagatttttgaggagcagccttgtctccggaaggactctctcagaatgttcctcaaatgtgacatgtcgattcacgatgtttcggtgagtgcagctgagacacaggcgattgtagatgaggccttggggctgcgaaaaaagaggcaagcgctgattgtgcgggagaaggagccggacctgaaacttgtgcagcccattcctttcttcacctggaagtgcctcggagagagcttgctggccatgtacaatcatctcaccacctgtgagcccccacgtcccagccttggcaaaaggattgatttgtcggactaccaggaccccagccagcctcttgagtcctccatggtggtgacgccagttaacgtgatccagccaagcactgtcagcaccaacccagctgtggctgtcgccgagcctgtggtctcctacacctctgtggctacaaccagcttcccactgcacagtcctggtctgttggagacaggcgctcctgtgggtgatatttctgggggagataaatccaagaaaggggtaaaacggaagaagatttcagaagagagtggagaaacagcaaagcggcggtctgcccgtgtccgaaacaccaagtgcaaaaaagaagagaaagtagacttccaggagcttctgatgaagttcttgccgtccaggttaagaaagctggaccctgaggaggaagatgattcctttaataactatgaagtccagtcagaagccaaactggaaagcttcccaagcattgggcctcaaaggctgtcatttgactcagccacattcatggaatctgaaaagcaggacgtgcatgagttcctgctggagaacctaaccaacgggggcatcctggagctgatgatgcgctacctgaaagccatgggccacaagttcttggtaaggtggcctccaggcttggcggaggtcgtgctcagcgtctaccacagctggaggaggcacagcaccagcctgcccaacccgctgctgagggactgcagcaacaagcacatcaaggacatgatgctgatgtctctctcctgcatggaactccagctggaccagtggctgctgaccaaaggcagaagctctgcagtgtctcctcggaactgccctgctggtatggtgaatggcagatttggacctgacttcccagggacccactgcctgggtgacctcctacagctgtcatttgcctcgtcccagcgcgacctgttcgaggatggttggctggagtttgtggtccgtgtttactggctgaaggctcgcttcctggcgctgcagggagacatggagcaggccctggagaactatgacatctgcacagaaatgctccagagttccaccgccatccaggtggaggcaggggctgaacgaagagacattgtcatccggctgcccaacctccataatgactctgtggtttccctggaggagattgataagaacctgaagtcgctggagcggtgccagtccctggaggagattcagcggctgtatgaagcaggcgactacaaggctgttgtgcatctgctccgccccactttgtgcaccagtgggtttgaccgggccaaacacctggagtttatgacttccattcctgagaggccagcccagctgcttcttctgcaggactccttgctccggctgaaggactatcggcagtgttttgagtgttccgatgtggctctgaacgaggctgtccagcagatggtgaactcaggtgaggctgccgccaaggaggagtgggtggccacagtgacccaactgctgatgggcatcgagcaggccctctctgcggacagcagtggtagcatcctgaaggtatcatcctccaccactggccttgtgcggctcaccaacaacctcatccaggtcattgactgcagcatggctgtgcaggaggaggccaaggagccccacgtctcttcagtgctaccctggatcattctacaccggatcatctggcaggaggaagacaccttccattctctgtgccaccagcagcagctccaaaacccagcggaggaagggatgtcagagacgcccatgctcccatcctccctcatgctgctgaacacagcccacgagtatttgggcagaaggtcctggtgctgcaattcagatggggctctgctgcgattctatgtgcgagtactccagaaggaactggctgcatccacctctgaagacacgcacccttacaaggaggagctggagacagccttggagcagtgcttctactgcctgtacagcttccccagcaagaagagtaaggccaggtacctggaggaacactcggcccagcaggtggatcttatatgggaggatgcactgttcatgtttgagtattttaagcccaagacccttcctgaatttgacagctataagaccagcaccgtgtctgctgacttggccaacctactgaagagaattgccaccattgtgcctcgcacagagaggccagcccttagcctggacaaagtctctgcctacattgagggaacttcaactgaggtaccctgcctcccagagggggctgacccctcccctccagtggtgaacgagctttactacctcctggctgattatcatttcaaaaacaaggagcagtccaaggccatcaagttctacatgcatgacatctgcatctgccccaataggtttgattcctgggcaggcatggctctggcccgggccagccgcattcaggacaagctgaactccaatgagctgaagagtgatgggcccatttggaagcatgccacgcccgtcttgaactgcttccgtcgggccctggagattgacagctccaacttgtccctatggattgagtatggcaccatgtcctatgccttgcactcattcgcctcacgtcaattgaagcagtggagaggcgagctgccccctgagctcgtgcagcagtggccccagagttgggcaggctggggactgaagctgctgccctaggatgcagagcctgactccccaagaggccttccttgtaacagcaggagcaccattatcctctgctggggctcagtgggctgagctgatcatggttcttgggattttctccctaatctcccaccaatgatggcaaatgagatttggcagagtgggagttttccaggaaataaatagggtgagaagtc

SEQ ID NO: 427266 - DNA, 1691 bp, Homo sapiens
gggtgaggctcagcagagcccggggcacaggccggaggggctgcaggcgcgaggctgggttacgtgaggaagctgggggtttcgcgggcagctttagagccccagtcagggaaaccgaggccgggcttcctggctgcctcgcgagcctcttcatggctctcgccgccgccctgaggtgcctagaatgggttccggcctccggggaggttcccagtaaccgcaggagccaccattgatttggcgtctgctgggtgcaaagcccagcgcgctaaccctttactcgcgacctttcgcttcaccttcacagcagccctgcgaggagagttgtggactggggcaacctttgccagtgatgagaagtgatgctcgtggcagtgctgaatctctctgaatatgattcgaattgcagccttaaatgccagctccaccattgaggatgatcatgaaggaagctttaaaagtcacaaaacccagacaaaggaggctcaggaagcagaggcttttgcattgtaccacaaggcccttgatctgcagaaacatgaccggtttgaggagtctgccaaagcctaccatgagctcttggaggcgagcctgctgcgggaggcagtgatgctggactccacagatgtcaacctctggtataagattggacatgtggccctgaggctcatccggatccccctggctcgccatgcttttgaggaagggctgcggtgcaatcctgaccactggccctgtttggataacctaatcactgtcctgtacaccctcagtgattacacaacatgtctgtacttcatctgcaaagctttggagaaggattgccggtacagcaaagggctggtcctcaaggagaagatttttgaggagcagccttgtctccggaaggactctctcagaatgttcctcaaatgtgacatgtcgattcacgatgtttcggtgagtgcagctgagacacaggcgattgtagatgaggccttggggctgcgaaaaaagaggcaagcgctgattgtgcgggagaaggagccggacctgaaacttgtgcagcccattcctttcttcacctggaagtgcctcggagagagcttgctggccatgtacaatcatctcaccacctgtgagcccccacgtcccagccttggcaaaaggattgatttgtcggactaccaggaccccagccagcctcttgagtcctccatggtggtgacgccagttaacgtgatccagccaagcactgtcagcaccaacccagctgtggctgtcgccgagcctgtggtctcctacacctctgtggctacaaccagcttcccactgcacagtcctggtctgttggagacaggcgctcctgtgggtgatatttctgggggagataaatccaagaaaggggtaaaacggaagaagatttcagaagagagtggagaaacagcaaagcggcggtctgcccgtgtccgaaacaccaagtgcaaaaaagaagagaaagtagacttccaggagcttctgatgaagttcttgccgtccaggtactgtgtattttttctgattgtcagaaacaaacccacaaagctccagcatacaccatcaataacatttctcattccattgccaccctcttctctggtctcctcctctgtgttcccataacatctgtgcagatgtctgaagcacaaatctcactggagtaggatcttgga

SEQ ID NO: 427267 - DNA, 981 bp, Homo sapiens
  misc_feature (365)..(365): n is a, c, g, or t
acactggagacggaccttataaatgtagggactgtgggaaggtgttcatttttcctagtgcgttacgaacacatgaaagaactcacactggagagaaaccctatgaatgtaaacaatgtggaaaagcctttagttgttctagttacattcggatacataaaagaactcacactggggagaaaaccttatgaatgtaaggaatgcgggaaggcctttatttatcccacaagctttcaaggacacatgagaatgcatactggagagaaaccctataaatgtaaagaatgtgggaaggcctttagtcttcacagttcctttcgagagacatacaagaattcacaattatgagaaacctcttgaatgtnagcagatgtggaaaagccttcagtgtgtccacatccttaaaaaaacctatgaggaatgcgcaatccgataggaaactctataatgtgagaaataggagaaagttttcaattctaacagatgctttcaaagttgtgaaaattcccactgaagagagaaatcctgtcaatgtaagtaatatagaaagcgagatacaagatgattcatgtatagtcaggtaccacataatcatgtttcagtcaacatgatgaaaccctgtctccattagaaatacgaaaattagctgggcgttctggtgtgcctgtagtcccagctacttgggaggctgaagcaggagaatcatttgaacctgggaggtggaggctgcagtgagctgagattgtgccactacactccagcctgggcaacagagcaagactccatcccacacaccaaaaaaaagttaaaaattttttatcactggctcattcttcaagtacatctctggactatgaattgtaacttaactacttttccaagaagtcttggaagtgagataattctgtaagtactctttaagcagtggtcaaaagtttaaaaggttgtgttttctcattaaatcagttagtaaaacttttc

SEQ ID NO: 427268 - DNA, 370 bp, Homo sapiens
ccttagcaatatcaaccactaaccttccctctacacttatcatcttcacaattctatgtctactgactatcctagaaatcactgtcgccttaatccaagcctacgttttcacacttctagttaaggtcaccctgggttaggtctacctggccaggtagacctaacccaggcaggtccttaaggagatattcccggaaaaactttgttatgataggcgatgacggctccatgtgcaggactgcccctgaacgtattctggcgggacaaaacatggaggcagaagacaatgatattgatgatcctcaccccgtgtagtcctacactaatgtgtgtttgtgtcttagttagtctttaacaaaaatagtttaaa

SEQ ID NO: 427269 - DNA, 1908 bp, Homo sapiens
  misc_feature (365)..(365): n is a, c, g, or t
acactggagacggaccttataaatgtagggactgtgggaaggtgttcatttttcctagtgcgttacgaacacatgaaagaactcacactggagagaaaccctatgaatgtaaacaatgtggaaaagcctttagttgttctagttacattcggatacataaaagaactcacactggggagaaaaccttatgaatgtaaggaatgcgggaaggcctttatttatcccacaagctttcaaggacacatgagaatgcatactggagagaaaccctataaatgtaaagaatgtgggaaggcctttagtcttcacagttcctttcgagagacatacaagaattcacaattatgagaaacctcttgaatgtnagcagatgtggaaaagccttcagtgtgtccacatccttaaaaaaacctatgaggaatgcgcaatccgataggaaactctataatgtgagaaataggagaaagttttcaattctaacagatgctttcaaagttgtgaaaattcccactgaagagagaaatcctgtcaatgtaagtaatatagaaagcgagatacaagatgattcatgtatagtcaggtaccacataatcatgtttcagtcagcaatggaccatataggttggtagccccataagattatataacacctaaatcatttctatcaaccgcaatttagtagcagtagtaacaccatagtgcagcacattatttaagtgtttatggtgctggtgtaaacgtgctgcactttcagttgtataaaagtacaagacagcggccggggacggtggctcacgcctgtaatcccagcactttgggaggccaaggcgggcggatcacgaggccaggagatcaagaccatcctggctaacacggtaaaaccccatctctactaaaaatacaaaaaattagccgggcgtggtggtgggcgcagctgacagtgagctgagatccggccaacagagcgagactctgtctcaaaaaaaaaaaaaaaaaaaaaagtacaacacagctgggcatggtcacacctgtgatcccaacactgggagactaaggcagtaggattgcttgatgccaggactactctggtcaacctagtgagaccctgtctctacaaaaaataaaaacattttctaagtgtggtagcacaccctgtagtcccatctacatgggaggctgaggcaggaggattgcctgagcccaggagttcaaggctacagtgaaccaagatcacgtgatggcagtccagcatgggtgacagtgagactgtatcaaaaaaaaaaaaaaaaaaaaaattggctgggcacagtggctcatacctgtaatcccagcactttgggaggctgaggtgggagaatcagttgaggtcaggagttcaagaccagcctggtcaacatgatgaaaccctgtctccattagaaatacgaaaattagctgggcgttctggtgtgcctgtagtcccagctacttgggaggccaaagcaggagaatcgcttgaacccgggaggtggagattgcagtgagctgagatctaccactacactccagcctgggtgacagagcgagactccgtctcgaaaaaaaaaaaattacagcacagatgtgcaatatatacttgataataaatggctaagttactggtttatatatttacaatcctgttttagaatgtattcctgtgtttttttaacagtaagacagtctcaggcaggtccttaaggagatattcccggaaaaactttgttatgataggcgatgacggctccatgtgcaggactgcccctgaacgtattctggcgggacaaaacatggaggcagaagacaatgatattgatgatcctcaccccgtgtagtcctacactaatgtgtgtttgtgtcttagttagtctttaacaaaaatagtttaaa

SEQ ID NO: 427270 - DNA, 1828 bp, Homo sapiens
  misc_feature (365)..(365): n is a, c, g, or t
acactggagacggaccttataaatgtagggactgtgggaaggtgttcatttttcctagtgcgttacgaacacatgaaagaactcacactggagagaaaccctatgaatgtaaacaatgtggaaaagcctttagttgttctagttacattcggatacataaaagaactcacactggggagaaaaccttatgaatgtaaggaatgcgggaaggcctttatttatcccacaagctttcaaggacacatgagaatgcatactggagagaaaccctataaatgtaaagaatgtgggaaggcctttagtcttcacagttcctttcgagagacatacaagaattcacaattatgagaaacctcttgaatgtnagcagatgtggaaaagccttcagtgtgtccacatccttaaaaaaacctatgaggaatgcgcaatccgataggaaactctataatgtgagaaataggagaaagttttcaattctaacagatgctttcaaagttgtgaaaattcccactgaagagagaaatcctgtcaatgtaagtaatatagaaagcgagatacaagatgattcatgtatagtcaggtaccacataatcatgtttcagtcagcaatggaccatataggttggtagccccataagattatataacacctaaatcatttctatcaaccgcaatttagtagcagtagtaacaccatagtgcagcacattatttaagtgtttatggtgctggtgtaaacgtgctgcactttcagttgtataaaagtacaagacagcggccggggacggtggctcacgcctgtaatcccagcactttgggaggccaaggcgggcggatcacgaggccaggagatcaagaccatcctggctaacacggtaaaaccccatctctactaaaaatacaaaaaattagccgggcgtggtggtgggcgcctgtagtcccagctacttgggaggctgaggcaggagaatggcataaacccaggaggccgagctgacagtgagctgagatccggccaacagagcgagactctgtctcaaaaaaaaaaaaaaaaaaaaaagtacaacacagctgggcatggtcacacctgtgatcccaacactgggagactaaggcagtaggattgcttgatgccaggactactctggtcaacctagtgagaccctgtctctacaaaaaataaaaacattttctaagtgtggtagcacaccctgtagtcccatctacatgggaggctgaggcaggaggattgcctgagcccaggagttcaaggctacagtgaaccaagatcacgtgatggcagtccagcatgggtgacagtgagactgtatcaaaaaaaaaaaaaaaaaaaaaattggctgggcacagtggctcatacctgtaatcccagcactttgggaggctgaggtgggagaatcagttgaggtcaggagttcaagaccagcctggtcaacatgatgaaaccctgtctccattagaaatacgaaaattagctgggcgttctggtgtgcctgtagtcccagctacttgggaggctgaagcaggagaatcatttgaacctgggaggtggaggctgcagtgagctgagattgtgccactacactccagcctgggcaacagagcaagactccatcccacacaccaaaaaaaagttaaaaattttttatcactggctcattcttcaagtacatctctggactatgaattgtaacttaactacttttccaagaagtcttggaagtgagataattctgtaagtactctttaagcagtggtcaaaagtttaaaaggttgtgttttctcattaaatcagttagtaaaacttttc

SEQ ID NO: 427271 - DNA, 1967 bp, Homo sapiens
  misc_feature (365)..(365): n is a, c, g, or t
acactggagacggaccttataaatgtagggactgtgggaaggtgttcatttttcctagtgcgttacgaacacatgaaagaactcacactggagagaaaccctatgaatgtaaacaatgtggaaaagcctttagttgttctagttacattcggatacataaaagaactcacactggggagaaaaccttatgaatgtaaggaatgcgggaaggcctttatttatcccacaagctttcaaggacacatgagaatgcatactggagagaaaccctataaatgtaaagaatgtgggaaggcctttagtcttcacagttcctttcgagagacatacaagaattcacaattatgagaaacctcttgaatgtnagcagatgtggaaaagccttcagtgtgtccacatccttaaaaaaacctatgaggaatgcgcaatccgataggaaactctataatgtgagaaataggagaaagttttcaattctaacagatgctttcaaagttgtgaaaattcccactgaagagagaaatcctgtcaatgtaagtaatatagaaagcgagatacaagatgattcatgtatagtcaggtaccacataatcatgtttcagtcagcaatggaccatataggttggtagccccataagattatataacacctaaatcatttctatcaaccgcaatttagtagcagtagtaacaccatagtgcagcacattatttaagtgtttatggtgctggtgtaaacgtgctgcactttcagttgtataaaagtacaagacagcggccggggacggtggctcacgcctgtaatcccagcactttgggaggccaaggcgggcggatcacgaggccaggagatcaagaccatcctggctaacacggtaaaaccccatctctactaaaaatacaaaaaattagccgggcgtggtggtgggcgcctgtagtcccagctacttgggaggctgaggcaggagaatggcataaacccaggaggccgagctgacagtgagctgagatccggccaacagagcgagactctgtctcaaaaaaaaaaaaaaaaaaaaaagtacaacacagctgggcatggtcacacctgtgatcccaacactgggagactaaggcagtaggattgcttgatgccaggactactctggtcaacctagtgagaccctgtctctacaaaaaataaaaacattttctaagtgtggtagcacaccctgtagtcccatctacatgggaggctgaggcaggaggattgcctgagcccaggagttcaaggctacagtgaaccaagatcacgtgatggcagtccagcatgggtgacagtgagactgtatcaaaaaaaaaaaaaaaaaaaaaattggctgggcacagtggctcatacctgtaatcccagcactttgggaggctgaggtgggagaatcagttgaggtcaggagttcaagaccagcctggtcaacatgatgaaaccctgtctccattagaaatacgaaaattagctgggcgttctggtgtgcctgtagtcccagctacttgggaggccaaagcaggagaatcgcttgaacccgggaggtggagattgcagtgagctgagatctaccactacactccagcctgggtgacagagcgagactccgtctcgaaaaaaaaaaaattacagcacagatgtgcaatatatacttgataataaatggctaagttactggtttatatatttacaatcctgttttagaatgtattcctgtgtttttttaacagtaagacagtctcaggcaggtccttaaggagatattcccggaaaaactttgttatgataggcgatgacggctccatgtgcaggactgcccctgaacgtattctggcgggacaaaacatggaggcagaagacaatgatattgatgatcctcaccccgtgtagtcctacactaatgtgtgtttgtgtcttagttagtctttaacaaaaatagtttaaa

SEQ ID NO: 427272 - DNA, 1313 bp, Homo sapiens
cgaaacccttcccggcgcgagtccgagcgtctgagaagcagaagccacacgtcccggcgacctaagttctggatcagccggccggaggacccgtgttagcatttacaatccgaggtgagctgaagcctccggttgtcccggttcgacgctctagccctgcgagcagccgacgccggaagtctctactgctccccgctggcgcgcaggaccgcgggcatttacccgtgctttcccaagcctggaagaactcgtcatgctctttgtagcgtggtgcttctgttgctcacaggatgtttgccacacgagtcactcgagagaatctctgagtcctggcgagggctttctgaggcttcgtgtattagcagctgttgtcttccaactcagcggcaggtttgcctttccccacggacactctggaccttgtagctcctcaagcttccctgtctattgagcagataggaagccgtgtcaaatatgtggcaccttgaggaaatgcctagtgaatgacagacaacttgcctttgatgattttcaagagagttgtgctatgatgtggcaaaagtatgcaggaagcaggcggtcaatgcctctgggagcaaggatccttttccacggtgtgttctatgccgggggctttgccattgtgtattacctcattcaaaagtttcattccagggctttatattacaagttggcagtggagcagctgcagagccatcccgaggcacaggaagctctgggccctcctctcaacatccattatctcaagctcatcgacagggaaaacttcgtggacattgttgatgccaagttgaagattcctgtctctggatccaaatcagagggccttctctacgtccactcatccagaggtggcccctttcagaggtggcaccttgacgaggtctttttagagctcaaggatggtcagcagattcctgtgttcaagctcagtggggaaaacggtgatgaagtgaaaaaggagtagagacgacccagaagacccagcttgcttctagtccatccttccctcatctctaccatatggccactggggtggtggcccatctcagtgacagacactcctgcaacccagttttccagccaccagtgggatgatggtatgtgccagcacatggtaattttggtgtaattctaacttgggcacaacgaatgctatttgtcatttttaaactgaatccgaaagaaactcctattataaatttaagataatgtaatgtatttgaaagtgctttgtataaaaaagcacatgataaaaggaatcagaattaataaaatgtttgttgatcttt

SEQ ID NO: 427273 - DNA, 2867 bp, Homo sapiens
cgaaacccttcccggcgcgagtccgagcgtctgagaagcagaagccacacgtcccggcgacctaagttctggatcagccggccggaggacccgtgttagcatttacaatccgaggtgagctgaagcctccggttgtcccggttcgacgctctagccctgcgagcagccgacgccggaagtctctactgctccccgctggcgcgcaggaccgcgggcatttacccgtgctttcccaagcctggaagaactcgtcatgctctttgtagcgtggtgcttctgttgctcacagaggtgcctgcttccccttctgccatgattggaagtttcctgaggcctccccagccatgtggaactgacaacttgcctttgatgattttcaagagagttgtgctatgatgtggcaaaagtatgcaggaagcaggcggtcaatgcctctgggagcaaggatccttttccacggtgtgttctatgccgggggctttgccattgtgtattacctcattcaaaagtttcattccagggctttatattacaagttggcagtggagcagctgcagagccatcccgaggcacaggaagctctgggccctcctctcaacatccattatctcaagctcatcgacagggaaaacttcgtggacattgttgatgccaagttgaagattcctgtctctggatccaaatcagagggccttctctacgtccactcatccagaggtggcccctttcagaggtggcaccttgacgaggtctttttagagctcaaggatggtcagcagattcctgtgttcaagctcagtggggaaaacggtgatgaagtgaaaaaggagtagagacgacccagaagacccagcttgcttctagtccatccttccctcatctctaccatatggccactggggtggtggcccatctcagtgacagacactcctgcaacccagttttccagccaccagtgggatgatggcctccctattccctgagacacaacagtattgaaattgggccaattaataaccccacagtggcctctcactaaatgtgagaggtgaggaagctgcaggagaaaatttgaagctagcagtgttcatgagatgtaagtaaagaagccatctccataaaagtacaacgtgacgcagcaagtgctgatggagaagctgtagaagttacacagaagatctagcttggaccatcgatgaaagtggctacactaaacaacagattttaaatgtagataaaacagcattttattgaaaaaaagatgccatctaggactttcatagttagaaaaactcaatgcctggcttcaaaggacaagctgactcttgtcaggggctagtgcagctgtgactttcagttaaagccaatgctcattgactattctgaaaatcccagggcccttaagatatgctgtataaacgcaacaacaaagcctggatgacgttgggtctgtttacagcctggtctactgagtaagcccactgttgagacctagtgctcagaaaaaatagatttctttcaaaatatggctgggtgcagtggctcacaccggtaatcccagcactttgggaggctggggcgggtggattgcttgatgccaggagttcaagaccagcctgggcaacatggtgaaaccctgtctcaaaaaacaaatccaaaaaaccaaaatattgctactcattaacaatgcacctggttacccaagagctctgatggagatgtacaaggagatgaatactgttttcatgcctgctaacacagtatccattctgctgctgatagatcaagaagtacttttgactttcaaaacttgttatttaagaaatacattttgtggtttctctgatggttctgggcagtcagttcaaaaccttctggaaaggattcaccattctagatgccatcaagagcattcaattcacgggaggaggtcaaaatatcaacattaattggaatttggaagaaatagattccaatcctcatggaggacttggagggtttcaagacttcagaggaggaaggaactgtagatgggctgaaaatagcaagagaactagaagtggaggggcctagagatgtgaccgaattgctgtaacctcaggatcaaacttgtatggatgagaagttccttctcatggacgagcaaagaagtggtctggaactgaaagtgatgcgtatttctgagttatgcctgtatttaagaagctgagtgaaacccaaagaagtccatgataggacagacttctgaaaactaaagacagaaaaaagcttgaaagcatcaagaaagaagtgaaatcttaactagagggaaaagtaactcagatgacagtggatttctctctggaaaccatggaggccagaaggaagtgagacaagttcttttagtgccagaagaactatcaacttgtggctgggcacggtggctcacacctgtaatcccagcactttgggagaccaaggtgggcagatcacttgaagtcaggagtttgagaccagcctggccaacatggcaaaaccctgtctctactaaaaatacaaaaattagccaggcatggtggcacatgcctgtaatctcagctacttgggaggctgaggcacgagaattacttgaacccgggaggtggaggttgcagtgagccaagatcctgccactgcactccagcctgggcaacagagcaagactgcctcaaaacaaaactctgtcaactccaaattcctatttggtgaaatgatccttcaggattgatggggtaataaaaacattctcggttgatagaaaactaaaagaatttgttgaatgagtctaccctatagaccttgaaaagaccaaccctaaaggaagttcttgaaccagaaaggaaacattt

SEQ ID NO: 427274 - DNA, 3054 bp, Homo sapiens
cgaaacccttcccggcgcgagtccgagcgtctgagaagcagaagccacacgtcccggcgacctaagttctggatcagccggccggaggacccgtgttagcatttacaatccgaggtgagctgaagcctccggttgtcccggttcgacgctctagccctgcgagcagccgacgccggaagtctctactgctccccgctggcgcgcaggaccgcgggcatttacccgtgctttcccaagcctggaagaactcgtcatgctctttgtagcgtggtgcttctgttgctcacaggacaacttgcctttgatgattttcaagagagttgtgctatgatgtggcaaaagtatgcaggaagcaggcggtcaatgcctctgggagcaaggatccttttccacggtgtgttctatgccgggggctttgccattgtgtattacctcattcaaaagtttcattccagggctttatattacaagttggcagtggagcagctgcagagccatcccgaggcacaggaagctctgggccctcctctcaacatccattatctcaagctcatcgacagggaaaacttcgtggacattgttgatgccaagttgaagattcctgtctctggatccaaatcagagggccttctctacgtccactcatccagaggtggcccctttcagaggtggcaccttgacgaggtctttttagagctcaaggatggtcagcagattcctgtgttcaagctcagtggggaaaacggtgatgaagtgaaaaaggagtagagacgacccagaagacccagcttgcttctagtccatccttccctcatctctaccatatggccactggggtggtggcccatctcagtgacagacactcctgcaacccagttttccagccaccagtgggatgatggtatgtgccagcacatggtaattttggtgtaattctaacttgggcacaacgaatgctatttgtcatttttaaactgaatccgaaagaaactcctattataaatttaagataatgtaatgtatttgaaagtgctttgtataaaaaagcacatgataaaaggaatcagaattaataaaatgtttgttgatctttaaaaaaaaaaaaaaaaaaactcgagactagttctgtctctccctcgtgccgaattcggcacgaggcagagcctcttctcgtctgtaggaacaccgccagggaggtcatggcagggcaggaccaaagggtcctgtggctctttttttttctcctgttctgcattcctgcccacacccccacccctccatttccttctgctctggaggcatcctccttcattggacaccacacagtttatttcacttctgacttcaaggttgtgaattcttcccatggcttaagtcctgggatacttctgcagtgaaaggaggtcttgtacctcttcctcagagtcagaagttctgagtacctttgccctattctgaaaagggctaggggctcctgctcccagctgccctcttcctttggcttccaattcagttccctctgccccgcatcctgcagacaggcgctcccgcagggggcccttgtggacctgcactggagtctgttgccttcactgagctgcctgtgctggccttgcatggtgcctgtagggggatttgctttgctgtgccattggggtacagctgctgctcttactctagaccaaaaagtcgggttgagtgactggtggcagggccacagatagagacagcggggagggtggctgaccctggcggccctggactgagcgtctggaggagtcgtggaggctctttcccttctttctcctctgagagctcgttcttcaggctcttccagcttgtcatgtcgagtgcctggccactgctcagggttggaggctcagtccctttgccctgtctgttccagctctggagctaactcagggatccctgatcagggttacataggtttggtaaaatgagtgctggaaattaactttctcccagtagtcttaggtcatgctcagtgaacttaaactttatccagatatggttttccttcagcctttctattccctttctagccagtgaaagacccgctgccctttgacctcagcccctccaagcccccaagtttaaaacgccaccccctgccggccctggactgagcgtctggaggagtcgtggaggctctttcccttctttctcctctgagagctcgttcttcaggctcttccagcttgtcatgtcgagtgcctggccactgctcagggttggaggctcagtccctttgccctgtctgttccagctctggagctaactcagggatccctgatcagggttacataggtttggtaaaatgagtgctggaaattaactttctcccagtagtcttaggtcatgctcagtgaacttaaactttatccagatatggttttccttcagcctttctattccctttctagccagtgaaagacccgctgccctttgacctcagcccctccaagcccccaagtttaaaacgccaccccctgccaccagaaaaaacagaaaaaaaaaaaaaaaaaaaactaaaacacccatctggtctgggcatcttcctttcctttttcactatgtatcctgttactgggcttaaacagctttcagagaagagatgtcatttctattaaatgctctttcagtagcgaactgagttcacacttgactaaggatattttccggactgtctgtcatcagcatccttagtgggtttccccatatttaaattggtagaggccagggatggtggctcacacctgtaatctcagtactttgggaggccaaggtaggtggattgcttgagctcagaagaccagcctgggcaacctggtgaaaccctgtctctactaaaaattcaagttagctagctgggcatggtgatgcacttctgtagtcccagctacttggagagggggtggtgctggggcagcaggatcgcttgaacccaggaggttgaggttgcagtgagccaagatggtaccagcctaggtgacaaagtgacaccctgtctcaaaaaagaaaccaaacaaacat

SEQ ID NO: 427275 - DNA, 1169 bp, Homo sapiens
gaggtaaaatttacattctgtgaaaggcacaaatccaagcgtcctatctgatgagttttaacaaatacacccagttgtgtcactcaagccgttatctagatgtagattgttcccagcacctgaattccctcgtgccctacccaatgggtcccttctcacatcttccagctccaccagaggcagtcacttttcttttttttaaaatgatgtttgaaaattactttgtaatccatcaaaataacaacaggtttccaggacagtttagcctgttctagaatttaacataaatacttgtatactcctcctgtgtaaagccctttggcttggtgtgtttttgatattcatcgatgttgctccgtgtatcaggagtttgctcctttttaacagtggacttttgagcgatcattggaagtacccagagcattgacataggagtcctccttgccaaatggaaagactgccattgaccttaccagccaaccaaagaggggcaggacatttggaaaatcaagtggattctccagctgggctgttagaaaagaactcacttctgtggagaatcactggattttataggcttagctctagaaagcatcattttgtcatcttctgaaatgacaataattatccaattacatctctcctttctgtcattttacacccacagttgaagattcctgtctctggatccaaatcagagggccttctctacgtccactcatccagaggtggcccctttcagaggtggcaccttgacgaggtctttttagagctcaaggatggtcagcagattcctgtgttcaagctcagtggggaaaacggtgatgaagtgaaaaaggagtagagacgacccagaagacccagcttgcttctagtccatccttccctcatctctaccatatggccactggggtggtggcccatctcagtgacagacactcctgcaacccagttttccagccaccagtgggatgatggtatgtgccagcacatggtaattttggtgtaattctaacttgggcacaacgaatgctatttgtcatttttaaactgaatccgaaagaaactcctattataaatttaagataatgtaatgtatttgaaagtgctttgtataaaaaagcacatgataaaaggaatcagaattaataaaatgtttgttgatcttt

SEQ ID NO: 427276 - DNA, 839 bp, Homo sapiens
acaggggcaggacatgagagggatgggtgcacttttgggtcagggttcggctttctggtgtgacagcctttctcccttaggaggctgctaagtcggtgagacctgggcactgcagccgactgcctgggttgaatggttgaatctcggctccagctcttgaccagctatgtggccttatgggggagtccgtcacctttctgggcattagttaccttattggtgtgatgtgtggtaatgttagtgcttgtgtatgaggtgagaattgaatctcacaacacaagagctgttgaacattgtgagatgtgtggaatattgagaacagtgcctagccatagaaatcactcaataaagattagctgtctggaccctgcttctgtcccttcttttcctatcatagctggcaccgtgttcatgcctgtggtattccctgtatccctattcctgggaagcagcccaggagggggattcccttggcctctccagggtcaggtcacctttcccttcattagtgtgatgggaccttcagaagagaagcactttctgcggccaaactgaacaccctgcttgggaagcctgcctctgctccctcctttgggcagctgattattagaacttacagcttcagggaggtgcttcccggagttcccaggtagcctgtgggctcagaaggattcctgagactgagagcagtttgagttgaaatgttggcttaaatcttgatgaatgaacattttcatatcctgtttctaggcctgagggttttgttgttaatgttgtggtctttctattttatgtctcaacttagtggaacaggcagtgttgagaagtcaggtatcatg

SEQ ID NO: 427277 - DNA, 560 bp, Homo sapiens
tggtggtgggggagtatgaatgtggctttcagagttggatgttataaaacatagtcatttggaagttgggaactttttatttttgttatcttgtttttaatacaggatgtttgccacacgagtcactcgagagaatctctgagtcctggcgagggctttctgaggcttcgtgtattagcagctgttgtcttccaactcagcggcaggtttgcctttccccacggacactctggaccttgtagctcctcaagcttccctgtctattgagcagataggaagccgtgtcaaatatgtggcaccttgaggaaatgcctagtgaatgacagtatgtcctattgtgctctaactttatttcagccttatttcttttctgaatattatttttcatttatcttcatttccttacctattttcttttcttctaaagtatgtatctttgttagctccatcatcctttttggaatgagcaagtataaaaataagtaaataaataagacccatcctaagtattttaagaaaccacccttttgcggcacacttgctaccttggtcttagctct

SEQ ID NO: 427278 - DNA, 626 bp, Homo sapiens
cgaaacccttcccggcgcgagtccgagcgtctgagaagcagaagccacacgtcccggcgacctaagttctggatcagccggccggaggacccgtgttagcatttacaatccgaggtgagctgaagcctccggttgtcccggttcgacgctctagccctgcgagcagccgacgccggaagtctctactgctccccgctggcgcgcaggaccgcgggcatttacccgtgctttcccaagcctggaagaactcgtcatgctctttgtagcgtggtgcttctgttgctcacaggacaacttgcctttgatgattttcaagagagttgtgctatgatgtggcaaaagtatgcaggaagcaggcggtcaatgcctctgggagcaaggatccttttccacggtgtgttctatgccgggggctttgccattgtgtattacctcattcaaagtaagtatcctgctagccgcctgcggcctgacctcctcctagcctgctcctgctcctccatcagaggaaatacttgagatgctttgtttagattagagaaaggaggagagggtgattttaaaggctagtccaccatttcgttggctatagcttcctctgtatcctgtaatctcagtttttccag

SEQ ID NO: 427279 - DNA, 1093 bp, Homo sapiens
cgaaacccttcccggcgcgagtccgagcgtctgagaagcagaagccacacgtcccggcgacctaagttctggatcagccggccggaggacccgtgttagcatttacaatccgaggtgagctgaagcctccggttgtcccggttcgacgctctagccctgcgagcagccgacgccggaagtctctactgctccccgctggcgcgcaggaccgcgggcatttacccgtgctttcccaagcctggaagaactcgtcatgctctttgtagcgtggtgcttctgttgctcacaggacaacttgcctttgatgattttcaagagagttgtgctatgatgtggcaaaagtatgcaggaagcaggcggtcaatgcctctgggagcaaggatccttttccacggtgtgttctatgccgggggctttgccattgtgtattacctcattcaaaagtttcattccagggctttatattacaagttggcagtggagcagctgcagagccatcccgaggcacaggaagctctgggccctcctctcaacatccattatctcaagctcatcgacagggaaaacttcgtggacattgttgatgccaagttgaagattcctgtctctggatccaaatcagagggccttctctacgtccactcatccagaggtggcccctttcagaggtggcaccttgacgaggtctttttagagctcaaggatggtcagcagattcctgtgttcaagctcagtggggaaaacggtgatgaagtgaaaaaggagtagagacgacccagaagacccagcttgcttctagtccatccttccctcatctctaccatatggccactggggtggtggcccatctcagtgacagacactcctgcaacccagttttccagccaccagtgggatgatggtatgtgccagcacatggtaattttggtgtaattctaacttgggcacaacgaatgctatttgtcatttttaaactgaatccgaaagaaactcctattataaatttaagataatgtaatgtatttgaaagtgctttgtataaaaaagcacatgataaaaggaatcagaattaataaaatgtttgttgatcttt

SEQ ID NO: 427280 - DNA, 1259 bp, Homo sapiens
cgaaacccttcccggcgcgagtccgagcgtctgagaagcagaagccacacgtcccggcgacctaagttctggatcagccggccggaggacccgtgttagcatttacaatccgaggtgagctgaagcctccggttgtcccggttcgacgctctagccctgcgagcagccgacgccggaagtctctactgctccccgctggcgcgcaggaccgcgggcatttacccgtgctttcccaagcctggaagaactcgtcatgctctttgtagcgtggtgcttctgttgctcacagaggtgcctgcttccccttctgccatgattggaagtttcctgaggcctccccagccatgtggaactgatgtttgccacacgagtcactcgagagaatctctgagtcctggcgagggctttctgaggcttcgtgtattagcagctgttgtcttccaactcagcggcaggacaacttgcctttgatgattttcaagagagttgtgctatgatgtggcaaaagtatgcaggaagcaggcggtcaatgcctctgggagcaaggatccttttccacggtgtgttctatgccgggggctttgccattgtgtattacctcattcaaaagtttcattccagggctttatattacaagttggcagtggagcagctgcagagccatcccgaggcacaggaagctctgggccctcctctcaacatccattatctcaagctcatcgacagggaaaacttcgtggacattgttgatgccaagttgaagattcctgtctctggatccaaatcagagggccttctctacgtccactcatccagaggtggcccctttcagaggtggcaccttgacgaggtctttttagagctcaaggatggtcagcagattcctgtgttcaagctcagtggggaaaacggtgatgaagtgaaaaaggagtagagacgacccagaagacccagcttgcttctagtccatccttccctcatctctaccatatggccactggggtggtggcccatctcagtgacagacactcctgcaacccagttttccagccaccagtgggatgatggtatgtgccagcacatggtaattttggtgtaattctaacttgggcacaacgaatgctatttgtcatttttaaactgaatccgaaagaaactcctattataaatttaagataatgtaatgtatttgaaagtgctttgtataaaaaagcacatgataaaaggaatcagaattaataaaatgtttgttgatcttt

SEQ ID NO: 427281 - DNA, 1214 bp, Homo sapiens
cgaaacccttcccggcgcgagtccgagcgtctgagaagcagaagccacacgtcccggcgacctaagttctggatcagccggccggaggacccgtgttagcatttacaatccgaggtgagctgaagcctccggttgtcccggttcgacgctctagccctgcgagcagccgacgccggaagtctctactgctccccgctggcgcgcaggaccgcgggcatttacccgtgctttcccaagcctggaagaactcgtcatgctctttgtagcgtggtgcttctgttgctcacaggttgacttggatcagctgatggttcttttgtcccatggatgttctgctggtactgcagtcatctggtagcccacttaaactagaatgtccatgacagctcattcacatggctagtgccttggacaacttgcctttgatgattttcaagagagttgtgctatgatgtggcaaaagtatgcaggaagcaggcggtcaatgcctctgggagcaaggatccttttccacggtgtgttctatgccgggggctttgccattgtgtattacctcattcaaaagtttcattccagggctttatattacaagttggcagtggagcagctgcagagccatcccgaggcacaggaagctctgggccctcctctcaacatccattatctcaagctcatcgacagggaaaacttcgtggacattgttgatgccaagttgaagattcctgtctctggatccaaatcagagggccttctctacgtccactcatccagaggtggcccctttcagaggtggcaccttgacgaggtctttttagagctcaaggatggtcagcagattcctgtgttcaagctcagtggggaaaacggtgatgaagtgaaaaaggagtagagacgacccagaagacccagcttgcttctagtccatccttccctcatctctaccatatggccactggggtggtggcccatctcagtgacagacactcctgcaacccagttttccagccaccagtgggatgatggtatgtgccagcacatggtaattttggtgtaattctaacttgggcacaacgaatgctatttgtcatttttaaactgaatccgaaagaaactcctattataaatttaagataatgtaatgtatttgaaagtgctttgtataaaaaagcacatgataaaaggaatcagaattaataaaatgtttgttgatcttt

SEQ ID NO: 427282 - DNA, 1313 bp, Homo sapiens
cgaaacccttcccggcgcgagtccgagcgtctgagaagcagaagccacacgtcccggcgacctaagttctggatcagccggccggaggacccgtgttagcatttacaatccgaggtgagctgaagcctccggttgtcccggttcgacgctctagccctgcgagcagccgacgccggaagtctctactgctccccgctggcgcgcaggaccgcgggcatttacccgtgctttcccaagcctggaagaactcgtcatgctctttgtagcgtggtgcttctgttgctcacagaggtgcctgcttccccttctgccatgattggaagtttcctgaggcctccccagccatgtggaactagtggttcagatttactttcccggagtagtcacaggactgggcagtgaaaacaggatgtttgccacacgagtcactcgagagaatctctgagtcctggcgagggctttctgaggcttcgtgtattagcagctgttgtcttccaactcagcggcaggacaacttgcctttgatgattttcaagagagttgtgctatgatgtggcaaaagtatgcaggaagcaggcggtcaatgcctctgggagcaaggatccttttccacggtgtgttctatgccgggggctttgccattgtgtattacctcattcaaaagtttcattccagggctttatattacaagttggcagtggagcagctgcagagccatcccgaggcacaggaagctctgggccctcctctcaacatccattatctcaagctcatcgacagggaaaacttcgtggacattgttgatgccaagttgaagattcctgtctctggatccaaatcagagggccttctctacgtccactcatccagaggtggcccctttcagaggtggcaccttgacgaggtctttttagagctcaaggatggtcagcagattcctgtgttcaagctcagtggggaaaacggtgatgaagtgaaaaaggagtagagacgacccagaagacccagcttgcttctagtccatccttccctcatctctaccatatggccactggggtggtggcccatctcagtgacagacactcctgcaacccagttttccagccaccagtgggatgatggtatgtgccagcacatggtaattttggtgtaattctaacttgggcacaacgaatgctatttgtcatttttaaactgaatccgaaagaaactcctattataaatttaagataatgtaatgtatttgaaagtgctttgtataaaaaagcacatgataaaaggaatcagaattaataaaatgtttgttgatcttt

SEQ ID NO: 427283 - DNA, 2060 bp, Homo sapiens
gaggtaaaatttacattctgtgaaaggcacaaatccaagcgtcctatctgatgagttttaacaaatacacccagttgtgtcactcaagccgttatctagatgtagattgttcccagcacctgaattccctcgtgccctacccaatgggtcccttctcacatcttccagctccaccagaggcagtcacttttcttttttttaaaatgatgtttgaaaattactttgtaatccatcaaaataacaacaggtttccaggacagtttagcctgttctagaatttaacataaatacttgtatactcctcctgtgtaaagccctttggcttggtgtgtttttgatattcatcgatgttgctccgtgtatcaggagtttgctcctttttaacagtggacttttgagcgatcattggaagtacccagagcattgacataggagtcctccttgccaaatggaaagactgccattgaccttaccagccaaccaaagaggggcaggacatttggaaaatcaagtggattctccagctgggctgttagaaaagaactcacttctgtggagaatcactggattttataggcttagctctagaaagcatcattttgtcatcttctgaaatgacaataattatccaattacatctctcctttctgtcattttacacccacagttgaagattcctgtctctggatccaaatcagagggccttctctacgtccactcatccagaggtggcccctttcagaggtatcctgggaaggtgacggcagtgggggagcgggaggaagacttcctgatgaaagcaaccccaactccgttttcatttgttgttaaattactgtgggcataggaagaattatttttcaagcttgaagctgaaagcttcgtggcctgggcagcaagccagtactgcggctcttagctgagtccagtttatccatacagtctactgaattgccctctccttatgccgttgaatttgtaaaactttccagttatagtgatctgggtctatcataatttgatgctatgttacagcttctcacttgactgcctcaattgttataaatgaataaagggcatggactcttgttccagaatttattcatcacattctttgcataagctctccaccccttaattggctttgcttgtctggttgccaatagctacatccactcacttcccccacgggaagcctctctcatagatgtttgctgtttagccaggctgtattttaattcccaaggacaaaaggagcaggaggccccacctagctcaccctgggctcactgacctctgagcctgggattagtgtacaagctggctggattccatgccaggaactgaaggtcactgtgaattaggaaatgagaaataaactgctccttcttcctgatgtcccttccattcgcctgtcagtcattgttaagcctgccttgaagtcgaagctggttaaataatgagagcccatggtagaatgttaaaaattgtgttgacacagcactcgcacaaaataatgtttaaaaaaatttaaggcattattcaaaacaactgctttccgcgcccctttttttgactacggctgttgcctcagccttcatagattagagatactatacttttggtttctctcaggtggcaccttgacgaggtctttttagagctcaaggatggtcagcagattcctgtgttcaagctcagtggggaaaacggtgatgaagtgaaaaaggagtagagacgacccagaagacccagcttgcttctagtccatccttccctcatctctaccatatggccactggggtggtggcccatctcagtgacagacactcctgcaacccagttttccagccaccagtgggatgatggtatgtgccagcacatggtaattttggtgtaattctaacttgggcacaacgaatgctatttgtcatttttaaactgaatccgaaagaaactcctattataaatttaagataatgtaatgtatttgaaagtgctttgtataaaaaagcacatgataaaaggaatcagaattaataaaatgtttgttgatcttt

SEQ ID NO: 427284 - DNA, 893 bp, Homo sapiens
tctgcatgaggtcaaggcccaaggtcatctgcacatccctgcaaaacactgcctgcctgtgctttggtttttgagtctgtaaaatggacaatttagagtagatggccttaattattcgtccatccacagatttcacgtttctgtttctaccctgtacgtcagttggattatttaattttctgtgtagtagattctacctgaccaagttcaataaagaaaataagtgtgtctttcgtccttagagtttcattccagggctttatattacaagttggcagtggagcagctgcagagccatcccgaggcacaggaagctctgggccctcctctcaacatccattatctcaagctcatcgacagggaaaacttcgtggacattgttgatgccaagttgaagattcctgtctctggatccaaatcagagggccttctctacgtccactcatccagaggtggcccctttcagaggtggcaccttgacgaggtctttttagagctcaaggatggtcagcagattcctgtgttcaagctcagtggggaaaacggtgatgaagtgaaaaaggagtagagacgacccagaagacccagcttgcttctagtccatccttccctcatctctaccatatggccactggggtggtggcccatctcagtgacagacactcctgcaacccagttttccagccaccagtgggatgatggtatgtgccagcacatggtaattttggtgtaattctaacttgggcacaacgaatgctatttgtcatttttaaactgaatccgaaagaaactcctattataaatttaagataatgtaatgtatttgaaagtgctttgtataaaaaagcacatgataaaaggaatcagaattaataaaatgtttgttgatcttt

SEQ ID NO: 427285 - DNA, 1067 bp, Homo sapiens
cgaaacccttcccggcgcgagtccgagcgtctgagaagcagaagccacacgtcccggcgacctaagttctggatcagccggccggaggacccgtgttagcatttacaatccgaggtgagctgaagcctccggttgtcccggttcgacgctctagccctgcgagcagccgacgccggaagtctctactgctccccgctggcgcgcaggaccgcgggcatttacccgtgctttcccaagcctggaagaactcgtcatgctctttgtagcgtggtgcttctgttgctcacaggacaacttgcctttgatgattttcaagagagttgtgctatgatgtggcaaaagtatgcaggaagcaggcggtcaatgcctctgggagcaaggatccttttccacggtgtgttctatgccgggggctttgccattgtgtattacctcattcaaaagtttcattccagggctttatattacaagttggcagtggagcagctgcagagccatcccgaggcacaggaagctctgggccctcctctcaacatccattatctcaagctcatcgacagggaaaacttcgtggacattgttgatgccaagttgaagattcctgtctctggatccaaatcagagggccttctctacgtccactcatccagaggtggcccctttcagagagctcaaggatggtcagcagattcctgtgttcaagctcagtggggaaaacggtgatgaagtgaaaaaggagtagagacgacccagaagacccagcttgcttctagtccatccttccctcatctctaccatatggccactggggtggtggcccatctcagtgacagacactcctgcaacccagttttccagccaccagtgggatgatggtatgtgccagcacatggtaattttggtgtaattctaacttgggcacaacgaatgctatttgtcatttttaaactgaatccgaaagaaactcctattataaatttaagataatgtaatgtatttgaaagtgctttgtataaaaaagcacatgataaaaggaatcagaattaataaaatgtttgttgatcttt

SEQ ID NO: 427286 - DNA, 2003 bp, Homo sapiens
cgaaacccttcccggcgcgagtccgagcgtctgagaagcagaagccacacgtcccggcgacctaagttctggatcagccggccggaggacccgtgttagcatttacaatccgaggtgagctgaagcctccggttgtcccggttcgacgctctagccctgcgagcagccgacgccggaagtctctactgctccccgctggcgcgcaggaccgcgggcatttacccgtgctttcccaagcctggaagaactcgtcatgctctttgtagcgtggtgcttctgttgctcacagaggtgcctgcttccccttctgccatgattggaagtttcctgaggcctccccagccatgtggaactgacaacttgcctttgatgattttcaagagagttgtgctatgatgtggcaaaagtatgcaggaagcaggcggtcaatgcctctgggagcaaggatccttttccacggtgtgttctatgccgggggctttgccattgtgtattacctcattcaaaagtttcattccagggctttatattacaagttggcagtggagcagctgcagagccatcccgaggcacaggaagctctgggccctcctctcaacatccattatctcaagctcatcgacagggaaaacttcgtggacattgttgatgccaagttgaagattcctgtctctggatccaaatcagagggccttctctacgtccactcatccagaggtggcccctttcagaggtggcaccttgacgaggtctttttagagctcaaggatggtcagcagattcctgtgttcaagctcagtggggaaaacggtgatgaagtgaaaaaggagtagagacgacccagaagacccagcttgcttctagtccatccttccctcatctctaccatatggccactggggtggtggcccatctcagtgacagacactcctgcaacccagttttccagccaccagtgggatgatgaaacacaactggttttgagaatccatcccttcttcactcagtccacgtaaaggttaggatggtagaaagtgttatacctcttcctccagagttggagcctatgacactgatgacactggcatggaaagccaaagccctacaccaaccagcacacttactggttccaaattgatctacgctggtgtaatcagagtgaatctcagaactttggacagagctgtgagcagagactgactttcctgctgtctccaggtagctgcaaggctgaacagcagcacctactttattaccatcttactgtcattcaaagaaggcagagctgaatgctggagaaaaactgagtaccagcaacagtttttgaaccctgaatattgtcataactgaagctagaattatccctggacttgtttgccactaaaatttccttgttttgcttaccctggtttcagctggcaccctgatcacttgaaaggaacataactgatatactgtcctttgtttttctttccttcctcttctctgcctttgatgattttaaattagaaatctacctgcctctaatctctttaattttctcatttatttactgctgcctattttccaaaacactgcttttcgaatattcctggctcaaaaatctatgtcttcatgacatatgaaacccctagaatccagcctttccccagcttttaatatctcctaattgatttctcaattccagtgaaatgattccatttatttttttcccaaacacatcacaaatattcctaactcttgtgagcaattttctctcattcttctcaacttatctaaatcctaacttttcaaaagatctagctcaagttctgtcttatcatattttgagttcctttctttggcattgtattattttgtatctttccatgtacacatgtgtgcattatctccctgataaaactaactggctagaggataggagtaaagactcaattctaatatccttgttacctaataatacacaaacgtgaaacatgtttgaataaatcactgttaaatat

SEQ ID NO: 427287 - DNA, 1039 bp, Homo sapiens
cgaaacccttcccggcgcgagtccgagcgtctgagaagcagaagccacacgtcccggcgacctaagttctggatcagccggccggaggacccgtgttagcatttacaatccgaggtgagctgaagcctccggttgtcccggttcgacgctctagccctgcgagcagccgacgccggaagtctctactgctccccgctggcgcgcaggaccgcgggcatttacccgtgctttcccaagcctggaagaactcgtcatgctctttgtagcgtggtgcttctgttgctcacaggacaacttgcctttgatgattttcaagagagttgtgctatgatgtggcaaaagtatgcaggaagcaggcggtcaatgcctctgggagcaaggatccttttccacggtgtgttctatgccgggggctttgccattgtgtattacctcattcaaaagtttcattccagggctttatattacaagttggcagtggagcagctgcagagccatcccgaggcacaggaagctctgggccctcctctcaacatccattatctcaagctcatcgacagggaaaacttcgtggacattgttgatgccaagttgaagattcctgtctctggatccaaatcagagggccttctctacgtccactcatccagaggtggcccctttcagaggtggcaccttgacgaggtctttttagagctcaaggatggtcagcagattcctgtgttcaagctcagtggggaaaacggtgatgaagtgatcatctctaccatatggccactggggtggtggcccatctcagtgacagacactcctgcaacccagttttccagccaccagtgggatgatggtatgtgccagcacatggtaattttggtgtaattctaacttgggcacaacgaatgctatttgtcatttttaaactgaatccgaaagaaactcctattataaatttaagataatgtaatgtatttgaaagtgctttgtataaaaaagcacatgataaaaggaatcagaattaataaaatgtttgttgatcttt

SEQ ID NO: 427288 - DNA, 3160 bp, Homo sapiens
cgaaacccttcccggcgcgagtccgagcgtctgagaagcagaagccacacgtcccggcgacctaagttctggatcagccggccggaggacccgtgttagcatttacaatccgaggtgagctgaagcctccggttgtcccggttcgacgctctagccctgcgagcagccgacgccggaagtctctactgctccccgctggcgcgcaggaccgcgggcatttacccgtgctttcccaagcctggaagaactcgtcatgctctttgtagcgtggtgcttctgttgctcacagaggtgcctgcttccccttctgccatgattggaagtttcctgaggcctccccagccatgtggaactgacaacttgcctttgatgattttcaagagagttgtgctatgatgtggcaaaagtatgcaggaagcaggcggtcaatgcctctgggagcaaggatccttttccacggtgtgttctatgccgggggctttgccattgtgtattacctcattcaaattgaagattcctgtctctggatccaaatcagagggccttctctacgtccactcatccagaggtggcccctttcagaggtggcaccttgacgaggtctttttagagctcaaggatggtcagcagattcctgtgttcaagctcagtggggaaaacggtgatgaagtgaaaaaggagtagagacgacccagaagacccagcttgcttctagtccatccttccctcatctctaccatatggccactggggtggtggcccatctcagtgacagacactcctgcaacccagttttccagccaccagtgggatgatggcctccctattccctgagacacaacagtattgaaattgggccaattaataaccccacagtggcctctcactaaatgtgagaggtgaggaagctgcaggagaaaatttgaagctagcagtgttcatgagatgtaagtaaagaagccatctccataaaagtacaacgtgacgcagcaagtgctgatggagaagctgtagaagttacacagaagatctagcttggaccatcgatgaaagtggctacactaaacaacagattttaaatgtagataaaacagcattttattgaaaaaaagatgccatctaggactttcatagttagaaaaactcaatgcctggcttcaaaggacaagctgactcttgtcaggggctagtgcagctgtgactttcagttaaagccaatgctcattgactattctgaaaatcccagggcccttaagatatgctgtataaacgcaacaacaaagcctggatgacgttgggtctgtttacagcctggtctactgagtaagcccactgttgagacctagtgctcagaaaaaatagatttctttcaaaatatggctgggtgcagtggctcacaccggtaatcccagcactttgggaggctggggcgggtggattgcttgatgccaggagttcaagaccagcctgggcaacatggtgaaaccctgtctcaaaaaacaaatccaaaaaaccaaaatattgctactcattaacaatgcacctggttacccaagagctctgatggagatgtacaaggagatgaatactgttttcatgcctgctaacacagtatccattctgctgctgatagatcaagaagtacttttgactttcaaaacttgttatttaagaaatacattttgtggtttctctgatggttctgggcagtcagttcaaaaccttctggaaaggattcaccattctagatgccatcaagagcattcaattcacgggaggaggtcaaaatatcaacattaattggaatttggaagaaatagattccaatcctcatggaggacttggagggtttcaagacttcagaggaggaaggaactgtagatgggctgaaaatagcaagagaactagaagtggaggggcctagagatgtgaccgaattgctgtaacctcaggatcaaacttgtatggatgagaagttccttctcatggacgagcaaagaaggtgatttcttgaaatggaatctactcctggtgaagatgctatgaacattgttgaaatgacaaaagatttagaatattccataaacttagctgtggccagggtttgagaggattgactcctaattttgaagttctactgtgggtaaatgctgtcaaacagcattgcatgccacagaggaatctctcatgaaagagttaataaatgcagcaaacttcactgttgtcttactttaagaaactgccacagtcactgcaggcttcagcaacttatcttttcctaccctcctctcgcatttaaaagtacttttaaattaatgtatgtacattatttttaggcataacactgctgctcatttaaaaaaactacagtatgaaccatgttatatgcagtggaaaggcaaaaaattcatgtgacttacttgcttgtatttggtttattgcagtggtctggaactgaaagtgatgcgtatttctgagttatgcctgtatttaagaagctgagtgaaacccaaagaagtccatgataggacagacttctgaaaactaaagacagaaaaaagcttgaaagcatcaagaaagaagtgaaatcttaactagagggaaaagtaactcagatgacagtggatttctctctggaaaccatggaggccagaaggaagtgagacaagttcttttagtgccagaagaactatcaacttgtggctgggcacggtggctcacacctgtaatcccagcactttgggagaccaaggtgggcagatcacttgaagtcaggagtttgagaccagcctggccaacatggcaaaaccctgtctctactaaaaatacaaaaattagccaggcatggtggcacatgcctgtaatctcagctacttgggaggctgaggcacgagaattacttgaacccgggaggtggaggttgcagtgagccaagatcctgccactgcactccagcctgggcaacagagcaagactgcctcaaaacaaaactctgtcaactccaaattcctatttggtgaaatgatccttcaggattgatggggtaataaaaacattctcggttgatagaaaactaaaagaatttgttgaatgagtctaccctatagaccttgaaaagaccaaccctaaaggaagttcttgaaccagaaaggaaacattt

SEQ ID NO: 427289 - DNA, 1056 bp, Homo sapiens
cgaaacccttcccggcgcgagtccgagcgtctgagaagcagaagccacacgtcccggcgacctaagttctggatcagccggccggaggacccgtgttagcatttacaatccgaggtgagctgaagcctccggttgtcccggttcgacgctctagccctgcgagcagccgacgccggaagtctctactgctccccgctggcgcgcaggaccgcgggcatttacccgtgctttcccaagcctggaagaactcgtcatgctctttgtagcgtggtgcttctgttgctcacagaggtgcctgcttccccttctgccatgattggaagtttcctgaggcctccccagccatgtggaactgctgtacaggtgtggtgccagcatctgctcagcttctggcaggggcctcagggagcttttactcatggcagaaggtgaagtgggaccaggtacatcatatggcaagagcaggagcgagagagagctggaggaggtgccacatacttgaaacaaccagatctcgcaagaactcactattgtgaagatagcaccaagaggatggtgccaactcattcaagagaaatccaccccaatcatccagtcacctcccaccaagccccacctccaacattggggattacatttaaacatgagattttgggggacaaatacccaaactatatcaagactttagaaacagatccatactggtctgctgctaccagctagtccaagccaccaccagctctgccatggagccttttaattggactccctgcttccattcttgtcctttctagagaaatctttaacaaaaagcaagtcatactgtgtcatttcctgattgaaaccttcagcatcttctcttacactttgagtaaaatccagactccctaccatacctacaaaacctgcatgatgaagaccctgccctcttgcctggcctcctcttccacacctcattcacgagcctgccttctgcttcttgaagataccgagcctgtggctgcctcagggccttggcgtgtttggcgtgcccttcccctggttttcaaatgatcc

SEQ ID NO: 427290 - DNA, 819 bp, Homo sapiens
cgaaacccttcccggcgcgagtccgagcgtctgagaagcagaagccacacgtcccggcgacctaagttctggatcagccggccggaggacccgtgttagcatttacaatccgaggtgagctgaagcctccggttgtcccggttcgacgctctagccctgcgagcagccgacgccggaagtctctactgctccccgctggcgcgcaggaccgcgggcatttacccgtgctttcccaagcctggaagaactcgtcatgctctttgtagcgtggtgcttctgttgctcacagaggtgcctgcttccccttctgccatgattggaagtttcctgaggcctccccagccatgtggaactagtggttcagatttactttcccggagtagtcacaggactgggcagtgaaaacaggttgacttggatcagctgatggttcttttgtcccatggatgttctgctggtactgcagtcatctggtagcccacttaaactagaatgtccatgacagctcattcacatggctagtgccttggtagggatgactgggttcaactggaatattggaacagtggggcatcttctccctcccacccatcttaggcctcttcctcacaaagtggcttcttacgtggtctttttatgtagcaagaaccccactagcaggataaccataattcttatatagtggcttaggcttcccaagagtgccagagtgcaaactgccaagcctccttaaagtggaggcatggaacagttccaacatcaattctgcctcctcctgttggttgaagcgagtcatacagccagttggattaattgggg

SEQ ID NO: 427291 - DNA, 3309 bp, Homo sapiens
cgaaacccttcccggcgcgagtccgagcgtctgagaagcagaagccacacgtcccggcgacctaagttctggatcagccggccggaggacccgtgttagcatttacaatccgaggtgagctgaagcctccggttgtcccggttcgacgctctagccctgcgagcagccgacgccggaagtctctactgctccccgctggcgcgcaggaccgcgggcatttacccgtgctttcccaagcctggaagaactcgtcatgctctttgtagcgtggtgcttctgttgctcacagaggtgcctgcttccccttctgccatgattggaagtttcctgaggcctccccagccatgtggaactgacaacttgcctttgatgattttcaagagagttgtgctatgatgtggcaaaagtatgcaggaagcaggcggtcaatgcctctgggagcaaggatccttttccacggtgtgttctatgccgggggctttgccattgtgtattacctcattcaaaagtttcattccagggctttatattacaagttggcagtggagcagctgcagagccatcccgaggcacaggaagctctgggccctcctctcaacatccattatctcaagctcatcgacagggaaaacttcgtggacattgttgatgccaagttgaagattcctgtctctggatccaaatcagagggccttctctacgtccactcatccagaggtggcccctttcagaggtggcaccttgacgaggtctttttagagctcaaggatggtcagcagattcctgtgttcaagctcagtggggaaaacggtgatgaagtgaaaaaggagtagagacgacccagaagacccagcttgcttctagtccatccttccctcatctctaccatatggccactggggtggtggcccatctcagtgacagacactcctgcaacccagttttccagccaccagtgggatgatggcctccctattccctgagacacaacagtattgaaattgggccaattaataaccccacagtggcctctcactaaatgtgagaggtgaggaagctgcaggagaaaatttgaagctagcagtgttcatgagatgtaagtaaagaagccatctccataaaagtacaacgtgacgcagcaagtgctgatggagaagctgtagaagttacacagaagatctagcttggaccatcgatgaaagtggctacactaaacaacagattttaaatgtagataaaacagcattttattgaaaaaaagatgccatctaggactttcatagttagaaaaactcaatgcctggcttcaaaggacaagctgactcttgtcaggggctagtgcagctgtgactttcagttaaagccaatgctcattgactattctgaaaatcccagggcccttaagatatgctgtataaacgcaacaacaaagcctggatgacgttgggtctgtttacagcctggtctactgagtaagcccactgttgagacctagtgctcagaaaaaatagatttctttcaaaatatggctgggtgcagtggctcacaccggtaatcccagcactttgggaggctggggcgggtggattgcttgatgccaggagttcaagaccagcctgggcaacatggtgaaaccctgtctcaaaaaacaaatccaaaaaaccaaaatattgctactcattaacaatgcacctggttacccaagagctctgatggagatgtacaaggagatgaatactgttttcatgcctgctaacacagtatccattctgctgctgatagatcaagaagtacttttgactttcaaaacttgttatttaagaaatacattttgtggtttctctgatggttctgggcagtcagttcaaaaccttctggaaaggattcaccattctagatgccatcaagagcattcaattcacgggaggaggtcaaaatatcaacattaattggaatttggaagaaatagattccaatcctcatggaggacttggagggtttcaagacttcagaggaggaaggaactgtagatgggctgaaaatagcaagagaactagaagtggaggggcctagagatgtgaccgaattgctgtaacctcaggatcaaacttgtatggatgagaagttccttctcatggacgagcaaagaaggtgatttcttgaaatggaatctactcctggtgaagatgctatgaacattgttgaaatgacaaaagatttagaatattccataaacttagctgtggccagggtttgagaggattgactcctaattttgaagttctactgtgggtaaatgctgtcaaacagcattgcatgccacagaggaatctctcatgaaagagttaataaatgcagcaaacttcactgttgtcttactttaagaaactgccacagtcactgcaggcttcagcaacttatcttttcctaccctcctctcgcatttaaaagtacttttaaattaatgtatgtacattatttttaggcataacactgctgctcatttaaaaaaactacagtatgaaccatgttatatgcagtggaaaggcaaaaaattcatgtgacttacttgcttgtatttggtttattgcagtggtctggaactgaaagtgatgcgtatttctgagttatgcctgtatttaagaagctgagtgaaacccaaagaagtccatgataggacagacttctgaaaactaaagacagaaaaaagcttgaaagcatcaagaaagaagtgaaatcttaactagagggaaaagtaactcagatgacagtggatttctctctggaaaccatggaggccagaaggaagtgagacaagttcttttagtgccagaagaactatcaacttgtggctgggcacggtggctcacacctgtaatcccagcactttgggagaccaaggtgggcagatcacttgaagtcaggagtttgagaccagcctggccaacatggcaaaaccctgtctctactaaaaatacaaaaattagccaggcatggtggcacatgcctgtaatctcagctacttgggaggctgaggcacgagaattacttgaacccgggaggtggaggttgcagtgagccaagatcctgccactgcactccagcctgggcaacagagcaagactgcctcaaaacaaaactctgtcaactccaaattcctatttggtgaaatgatccttcaggattgatggggtaataaaaacattctcggttgatagaaaactaaaagaatttgttgaatgagtctaccctatagaccttgaaaagaccaaccctaaaggaagttcttgaaccagaaaggaaacattt

SEQ ID NO: 427292 - DNA, 972 bp, Homo sapiens
  misc_feature (95)..(95): n is a, c, g, or t
ctggtcattgacgtaggtgcttggattcgtctaccaataatagaaacggcccagggaggtaacctgaacgtactgatactgaatccatgatgaangtgcttgcgtgtcagttatctggattcttaatcaagcatggatgtcctaacgcagattctcgcatatcagaattactgcgcccgtcgcaggattttcaagagagttgtgctatgatgtggcaaaagtatgcaggaagcaggcggtcaatgcctctgggagcaaggatccttttccacggtgtgttctatgccgggggctttgccattgtgtattacctcattcaaaagtttcattccagggctttatattacaagttggcagtggagcagctgcagagccatcccgaggcacaggaagctctgggccctcctctcaacatccattatctcaagctcatcgacagggaaaacttcgtggacattgttgatgccaagttgaagattcctgtctctggatccaaatcagagggccttctctacgtccactcatccagaggtggcccctttcagaggtggcaccttgacgaggtctttttagagctcaaggatggtcagcagattcctgtgttcaagctcagtggggaaaacggtgatgaagtgaaaaaggagtagagacgacccagaagacccagcttgcttctagtccatccttccctcatctctaccatatggccactggggtggtggcccatctcagtgacagacactcctgcaacccagttttccagccaccagtgggatgatggtatgtgccagcacatggtaattttggtgtaattctaacttgggcacaacgaatgctatttgtcatttttaaactgaatccgaaagaaactcctattataaatttaagataatgtaatgtatttgaaagtgctttgtataaaaaagcacatgataaaaggaatcagaattaataaaatgtttgttgatcttt

SEQ ID NO: 427293 - DNA, 2784 bp, Homo sapiens
cgaaacccttcccggcgcgagtccgagcgtctgagaagcagaagccacacgtcccggcgacctaagttctggatcagccggccggaggacccgtgttagcatttacaatccgaggtgagctgaagcctccggttgtcccggttcgacgctctagccctgcgagcagccgacgccggaagtctctactgctccccgctggcgcgcaggaccgcgggcatttacccgtgctttcccaagcctggaagaactcgtcatgctctttgtagcgtggtgcttctgttgctcacaggatgtttgccacacgagtcactcgagagaatctctgagtcctggcgagggctttctgaggcttcgtgtattagcagctgttgtcttccaactcagcggcaggacaacttgcctttgatgattttcaagagagttgtgctatgatgtggcaaaagtatgcaggaagcaggcggtcaatgcctctgggagcaaggatccttttccacggtgtgttctatgccgggggctttgccattgtgtattacctcattcaaaagtttcattccagggctttatattacaagttggcagtggagcagctgcagagccatcccgaggcacaggaagctctgggccctcctctcaacatccattatctcaagctcatcgacagggaaaacttcgtggacattgttgatgccaagttgaagattcctgtctctggatccaaatcagagggccttctctacgtccactcatccagaggtggcccctttcagaggtggcaccttgacgaggtctttttagagctcaaggatggtcagcagattcctgtgttcaagctcagtggggaaaacggtgatgaagtgaaaaaggagtagagacgacccagaagacccagcttgcttctagtccatccttccctcatctctaccatatggccactggggtggtggcccatctcagtgacagacactcctgcaacccagttttccagccaccagtgggatgatgtggtctggaactgaaagtgatgcgtatttctgagttatgcctgtatttaagaagctgagtgaaacccaaagaagtccatgataggacagacttctgaaaactaaagacagaaaaaagcttgaaagcatcaagaaagaagtgaaatcttaactagagggaaaagtaactcagatgacagtggatttctctctggaaaccatggaggccagaaggaagtgagacaagttcttttagtgccagaagaactatcaacttgtggctgggcacggtggctcacacctgtaatcccagcactttgggagaccaaggtgggcagatcacttgaagtcaggagtttgagaccagcctggccaacatggcaaaaccctgtctctactaaaaatacaaaaattagccaggcatggtggcacatgcctgtaatctcagctacttgggaggctgaggcacgagaattacttgaacccgggaggtggaggttgcagtgagccaagatcctgccactgcactccagcctgggcaacagagcaagactgcctcaaaacaaaactctgtcaactccaaattcctatttggtgaaatgatccttcaggattgatgggttgcacctggacttgatatgaaagtaaccatcagaaaatcaacagagatcttaaacttgcctaccacagacacctgcaggaatatactaagaatcatcacagtggacctttattgtctcctgagcacccattcattgttctttcagaaacacaactggttttgagaatccatcccttcttcactcagtccacgtaaaggttaggatggtagaaagtgttatacctcttcctccagagttggagcctatgacactgatgacactggcatggaaagccaaagccctacaccaaccagcacacttactggttccaaattgatctacgctggtgtaatcagagtgaatctcagaactttggacagagctgtgagcagagactgactttcctgctgtctccaggtagctgcaaggctgaacagcagcacctactttattaccatcttactgtcattcaaagaaggcagagctgaatgctggagaaaaactgagtaccagcaacagtttttgaaccctgaatattgtcataactgaagctagaattatccctggacttgtttgccactaaaatttccttgttttgcttaccctggtttcagctggcaccctgatcacttgaaaggaacataactgatatactgtcctttgtttttctttccttcctcttctctgcctttgatgattttaaattagaaatctacctgcctctaatctctttaattttctcatttatttactgctgcctattttccaaaacactgcttttcgaatattcctggctcaaaaatctatgtcttcatgacatatgaaacccctagaatccagcctttccccagcttttaatatctcctaattgatttctcaattccagtgaaatgattccatttatttttttcccaaacacatcacaaatattcctaactcttgtgagcaattttctctcattcttctcaacttatctaaatcctaacttttcaaaagatctagctcaagttctgtcttatcatattttgagttcctttctttggcattgtattattttgtatctttccatgtacacatgtgtgcattatctccctgataaaactaactggctagaggataggagtaaagactcaattctaatatccttgttacctaataatacacaaacgtgaaacatgtttgaataaatcactgttaaatat

SEQ ID NO: 427294 - DNA, 1194 bp, Homo sapiens
cgaaacccttcccggcgcgagtccgagcgtctgagaagcagaagccacacgtcccggcgacctaagttctggatcagccggccggaggacccgtgttagcatttacaatccgaggtgagctgaagcctccggttgtcccggttcgacgctctagccctgcgagcagccgacgccggaagtctctactgctccccgctggcgcgcaggaccgcgggcatttacccgtgctttcccaagcctggaagaactcgtcatgctctttgtagcgtggtgcttctgttgctcacaggatgtttgccacacgagtcactcgagagaatctctgagtcctggcgagggctttctgaggcttcgtgtattagcagctgttgtcttccaactcagcggcaggacaacttgcctttgatgattttcaagagagttgtgctatgatgtggcaaaagtatgcaggaagcaggcggtcaatgcctctgggagcaaggatccttttccacggtgtgttctatgccgggggctttgccattgtgtattacctcattcaaaagtttcattccagggctttatattacaagttggcagtggagcagctgcagagccatcccgaggcacaggaagctctgggccctcctctcaacatccattatctcaagctcatcgacagggaaaacttcgtggacattgttgatgccaagttgaagattcctgtctctggatccaaatcagagggccttctctacgtccactcatccagaggtggcccctttcagaggtggcaccttgacgaggtctttttagagctcaaggatggtcagcagattcctgtgttcaagctcagtggggaaaacggtgatgaagtgaaaaaggagtagagacgacccagaagacccagcttgcttctagtccatccttccctcatctctaccatatggccactggggtggtggcccatctcagtgacagacactcctgcaacccagttttccagccaccagtgggatgatggtatgtgccagcacatggtaattttggtgtaattctaacttgggcacaacgaatgctatttgtcatttttaaactgaatccgaaagaaactcctattataaatttaagataatgtaatgtatttgaaagtgctttgtataaaaaagcacatgataaaaggaatcagaattaataaaatgtttgttgatcttt

SEQ ID NO: 427295 - DNA, 1434 bp, Homo sapiens
cgaaacccttcccggcgcgagtccgagcgtctgagaagcagaagccacacgtcccggcgacctaagttctggatcagccggccggaggacccgtgttagcatttacaatccgaggtgagctgaagcctccggttgtcccggttcgacgctctagccctgcgagcagccgacgccggaagtctctactgctccccgctggcgcgcaggaccgcgggcatttacccgtgctttcccaagcctggaagaactcgtcatgctctttgtagcgtggtgcttctgttgctcacagaggtgcctgcttccccttctgccatgattggaagtttcctgaggcctccccagccatgtggaactagtggttcagatttactttcccggagtagtcacaggactgggcagtgaaaacaggttgacttggatcagctgatggttcttttgtcccatggatgttctgctggtactgcagtcatctggtagcccacttaaactagaatgtccatgacagctcattcacatggctagtgccttggatgtttgccacacgagtcactcgagagaatctctgagtcctggcgagggctttctgaggcttcgtgtattagcagctgttgtcttccaactcagcggcaggacaacttgcctttgatgattttcaagagagttgtgctatgatgtggcaaaagtatgcaggaagcaggcggtcaatgcctctgggagcaaggatccttttccacggtgtgttctatgccgggggctttgccattgtgtattacctcattcaaaagtttcattccagggctttatattacaagttggcagtggagcagctgcagagccatcccgaggcacaggaagctctgggccctcctctcaacatccattatctcaagctcatcgacagggaaaacttcgtggacattgttgatgccaagttgaagattcctgtctctggatccaaatcagagggccttctctacgtccactcatccagaggtggcccctttcagaggtggcaccttgacgaggtctttttagagctcaaggatggtcagcagattcctgtgttcaagctcagtggggaaaacggtgatgaagtgaaaaaggagtagagacgacccagaagacccagcttgcttctagtccatccttccctcatctctaccatatggccactggggtggtggcccatctcagtgacagacactcctgcaacccagttttccagccaccagtgggatgatggtatgtgccagcacatggtaattttggtgtaattctaacttgggcacaacgaatgctatttgtcatttttaaactgaatccgaaagaaactcctattataaatttaagataatgtaatgtatttgaaagtgctttgtataaaaaagcacatgataaaaggaatcagaattaataaaatgtttgttgatcttt

SEQ ID NO: 427296 - DNA, 1784 bp, Homo sapiens
cgaaacccttcccggcgcgagtccgagcgtctgagaagcagaagccacacgtcccggcgacctaagttctggatcagccggccggaggacccgtgttagcatttacaatccgaggtgagctgaagcctccggttgtcccggttcgacgctctagccctgcgagcagccgacgccggaagtctctactgctccccgctggcgcgcaggaccgcgggcatttacccgtgctttcccaagcctggaagaactcgtcatgctctttgtagcgtggtgcttctgttgctcacagaggtgcctgcttccccttctgccatgattggaagtttcctgaggcctccccagccatgtggaactgctgtacaggtgtggtgccagcatctgctcagcttctggcaggggcctcagggagcttttactcatggcagaaggtgaagtgggaccaggtacatcatatggcaagagcaggagcgagagagagctggaggaggtgccacatacttgaaacaaccagatctcgcaagaactcactattgtgaagatagcaccaagaggatggtgccaactcattcaagagaaatccaccccaatcatccagtcacctcccaccaagccccacctccaacattggggattacatttaaacatgagattttgggggacaaatacccaaactatatcaagactttagaaacagatccatactgagtggttcagatttactttcccggagtagtcacaggactgggcagtgaaaacaggatgtttgccacacgagtcactcgagagaatctctgagtcctggcgagggctttctgaggcttcgtgtattagcagctgttgtcttccaactcagcggcaggacaacttgcctttgatgattttcaagagagttgtgctatgatgtggcaaaagtatgcaggaagcaggcggtcaatgcctctgggagcaaggatccttttccacggtgtgttctatgccgggggctttgccattgtgtattacctcattcaaaagtttcattccagggctttatattacaagttggcagtggagcagctgcagagccatcccgaggcacaggaagctctgggccctcctctcaacatccattatctcaagctcatcgacagggaaaacttcgtggacattgttgatgccaaggtaatgtgctttccctgcgaaccgcaggctggtgcctgctgaaggagaggagagtctactgtctcctggaaagtcctggagttaaggatttgggatgggaaaatccactaagtaaagctagttgaagattcctgtctctggatccaaatcagagggccttctctacgtccactcatccagaggtggcccctttcagaggtggcaccttgacgaggtctttttagagctcaaggatggtcagcagattcctgtgttcaagctcagtggggaaaacggtgatgaagtgaaaaaggagtagagacgacccagaagacccagcttgcttctagtccatccttccctcatctctaccatatggccactggggtggtggcccatctcagtgacagacactcctgcaacccagttttccagccaccagtgggatgatggtatgtgccagcacatggtaattttggtgtaattctaacttgggcacaacgaatgctatttgtcatttttaaactgaatccgaaagaaactcctattataaatttaagataatgtaatgtatttgaaagtgctttgtataaaaaagcacatgataaaaggaatcagaattaataaaatgtttgttgatcttt

SEQ ID NO: 427297 - DNA, 1682 bp, Homo sapiens
cgaaacccttcccggcgcgagtccgagcgtctgagaagcagaagccacacgtcccggcgacctaagttctggatcagccggccggaggacccgtgttagcatttacaatccgaggtgagctgaagcctccggttgtcccggttcgacgctctagccctgcgagcagccgacgccggaagtctctactgctccccgctggcgcgcaggaccgcgggcatttacccgtgctttcccaagcctggaagaactcgtcatgctctttgtagcgtggtgcttctgttgctcacagaggtgcctgcttccccttctgccatgattggaagtttcctgaggcctccccagccatgtggaactgacaacttgcctttgatgattttcaagagagttgtgctatgatgtggcaaaagtatgcaggaagcaggcggtcaatgcctctgggagcaaggatccttttccacggtgtgttctatgccgggggctttgccattgtgtattacctcattcaaaagtttcattccagggctttatattacaagttggcagtggagcagctgcagagccatcccgaggcacaggaagctctgggccctcctctcaacatccattatctcaagctcatcgacagggaaaacttcgtggacattgttgatgccaagttgaagattcctgtctctggatccaaatcagagggccttctctacgtccactcatccagaggtggcccctttcagaggtggcaccttgacgaggtctttttagagctcaaggatggtcagcagattcctgtgttcaagctcagtggggaaaacggtgatgaagtgaaaaaggagtagagacgacccagaagacccagcttgcttctagtccatccttccctcatctctaccatatggccactggggtggtggcccatctcagtgacagacactcctgcaacccagttttccagccaccagtgggatgatgtggtctggaactgaaagtgatgcgtatttctgagttatgcctgtatttaagaagctgagtgaaacccaaagaagtccatgataggacagacttctgaaaactaaagacagaaaaaagcttgaaagcatcaagaaagaagtgaaatcttaactagagggaaaagtaactcagatgacagtggatttctctctggaaaccatggaggccagaaggaagtgagacaagttcttttagtgccagaagaactatcaacttgtggctgggcacggtggctcacacctgtaatcccagcactttgggagaccaaggtgggcagatcacttgaagtcaggagtttgagaccagcctggccaacatggcaaaaccctgtctctactaaaaatacaaaaattagccaggcatggtggcacatgcctgtaatctcagctacttgggaggctgaggcacgagaattacttgaacccgggaggtggaggttgcagtgagccaagatcctgccactgcactccagcctgggcaacagagcaagactgcctcaaaacaaaactctgtcaactccaaattcctatttggtgaaatgatccttcaggattgatggggtaataaaaacattctcggttgatagaaaactaaaagaatttgttgaatgagtctaccctatagaccttgaaaagaccaaccctaaaggaagttcttgaaccagaaaggaaacattt

SEQ ID NO: 427298 - DNA, 2084 bp, Homo sapiens
cgaaacccttcccggcgcgagtccgagcgtctgagaagcagaagccacacgtcccggcgacctaagttctggatcagccggccggaggacccgtgttagcatttacaatccgaggtgagctgaagcctccggttgtcccggttcgacgctctagccctgcgagcagccgacgccggaagtctctactgctccccgctggcgcgcaggaccgcgggcatttacccgtgctttcccaagcctggaagaactcgtcatgctctttgtagcgtggtgcttctgttgctcacaggacaacttgcctttgatgattttcaagagagttgtgctatgatgtggcaaaagtatgcaggaagcaggcggtcaatgcctctgggagcaaggatccttttccacggtgtgttctatgccgggggctttgccattgtgtattacctcattcaaaagtttcattccagggctttatattacaagttggcagtggagcagctgcagagccatcccgaggcacaggaagctctgggccctcctctcaacatccattatctcaagctcatcgacagggaaaacttcgtggacattgttgatgccaagttgaagattcctgtctctggatccaaatcagagggccttctctacgtccactcatccagaggtggcccctttcagaggtggcaccttgacgaggtctttttagagctcaaggatggtcagcagattcctgtgttcaagctcagtggggaaaacggtgatgaagtgaaaaaggagtagagacgacccagaagacccagcttgcttctagtccatccttccctcatctctaccatatggccactggggtggtggcccatctcagtgacagacactcctgcaacccagttttccagccaccagtgggatgatgttgcacctggacttgatatgaaagtaaccatcagaaaatcaacagagatcttaaacttgcctaccacagacacctgcaggaatatactaagaatcatcacagtggacctttattgtctcctgagcacccattcattgttctttcagaaacacaactggttttgagaatccatcccttcttcactcagtccacgtaaaggttaggatggtagaaagtgttatacctcttcctccagagttggagcctatgacactgatgacactggcatggaaagccaaagccctacaccaaccagcacacttactggttccaaattgatctacgctggtgtaatcagagtgaatctcagaactttggacagagctgtgagcagagactgactttcctgctgtctccaggtagctgcaaggctgaacagcagcacctactttattaccatcttactgtcattcaaagaaggcagagctgaatgctggagaaaaactgagtaccagcaacagtttttgaaccctgaatattgtcataactgaagctagaattatccctggacttgtttgccactaaaatttccttgttttgcttaccctggtttcagctggcaccctgatcacttgaaaggaacataactgatatactgtcctttgtttttctttccttcctcttctctgcctttgatgattttaaattagaaatctacctgcctctaatctctttaattttctcatttatttactgctgcctattttccaaaacactgcttttcgaatattcctggctcaaaaatctatgtcttcatgacatatgaaacccctagaatccagcctttccccagcttttaatatctcctaattgatttctcaattccagtgaaatgattccatttatttttttcccaaacacatcacaaatattcctaactcttgtgagcaattttctctcattcttctcaacttatctaaatcctaacttttcaaaagatctagctcaagttctgtcttatcatattttgagttcctttctttggcattgtattattttgtatctttccatgtacacatgtgtgcattatctccctgataaaactaactggctagaggataggagtaaagactcaattctaatatccttgttacctaataatacacaaacgtgaaacatgtttgaataaatcactgttaaatat

SEQ ID NO: 427299 - DNA, 900 bp, Homo sapiens
ggcccacctgctcataaacaaaatgcccatgttgggtctcagaggtgatcggcgatcagagggcgatcacctctgagacccaccttgctcataaacaaaatgcccatgttggtcctctgccctggacctgtgacattctggactatttctgtgtttatttgtggccgagtgtaacaaccatataataaatcacctcttccgctgtttaaaaaaaaaaaaaaaaaaaaaaaaaaaaaaaaaaaaaaaaaaaaaaaaaccccgcggcggcctctcttttttgttggggggggggagaaaaaggggtgttaaggaaaggcggcgccgcgggggctcacagcggggttctctcgtgagaccccactttttttttcccaacgggggggaaaactatcgggggggctcccccctatgagggagaggggccgacattaaatttttcccgaagaaggcccgcggggttaccccggccgccttttatagtgatctgcggccgacaaaaccccgcgaagcaccagagccacgagcctatataatccatatcaacgatcgacctgaggctgagaagcgacgacaaacaccagcacgcatatcgcagcaacagcgctcgaaaacaaaggacgaggaacagaactactgccgcgcgcacacacagacgccacaacaacagaccacacccacggcacgcaacagcacgcgacgagccggagaagggaggagcagacgcacacaaacacaaccccaccatggatccccaccacagaggagccgacgcacgcaggatccaccaaccacgcgcgaagacacgaaccaaagaaagacgcagcccgaactcaagagggtagaacaagatacgcagagcagaacgcacaacaagcagagacgggacgaagacagaccaac

SEQ ID NO: 427300 - DNA, 799 bp, Homo sapiens
  misc_feature (261)..(261): n is a, c, g, or t
  misc_feature (264)..(265): n is a, c, g, or t
  misc_feature (267)..(267): n is a, c, g, or t
  misc_feature (283)..(283): n is a, c, g, or t
ctagaacttcctctgagacaagctctagatccattgagacggagctctagacagtagcatgcagtcccacaacttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgtttaaancannanaaaaaaaaaaaaaaanaaaaaaaaaaaaaaaaaaaaaaaaaaaaaaaaaaaaaaaaaaaaaaaaaaaaaaaaggggggggggggaaaaaaaaatccccggggggcggcccaaaaatgagacaccgccacacagtgtttagtagagcgaaagaagggcgcccaatataaaagggggcgagcgataaataaaagaaaagcgagagcgaagaaggcgggcgaggaagaaaaaaaaaacaaaatggtagtaacggacgaacaacacctgctggcagccagaccgaacgacaatcagagaaagagaacaaccacaaacacaccagtcggaggggagaagagaaaacaaaaacgggaggacacacacaaccacacaaaaaagaagataagacaaagcacctcagaggacaaaaaaaaaacagaaaagacgaccgaagagacaatgacgacggacaaaaacaccaacgagaacacacatagccgaaggacaaaaaagaacacaaagaggaagaggcacaaaccaaaaccacacaccgag

SEQ ID NO: 427301 - DNA, 896 bp, Homo sapiens
  misc_feature (523)..(523): n is a, c, g, or t
  misc_feature (526)..(527): n is a, c, g, or t
  misc_feature (529)..(529): n is a, c, g, or t
  misc_feature (545)..(545): n is a, c, g, or t
tcactggagacaggaggttttattggatgctgatgggggtaggaaaggtccccagaagcatgggggctgagtcagtcagcaaagtgcgtaaggcctagcgccattttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatcaaaaaaaaaaaaancannanaaaaaaaaaaaaaaanaaaaaaaaaaaaaaaaaaaaaaaaaaaaaaaaaaaaattaaaaccctgccctcttttacaaaatatgagttccgggcctatctagaaaaaaaacacccccgccccccgcgggttttttttttttttttccccccaaaaaaacatttgtggcaccaaaattttttgcggggggaaatttttgttaccccccaccaaagttttaaaccaaccttggggcttttgtgggaaaaaacaaaaaaaaaacccccccccaccccccccccacattttttgcccactttaaaaaacccccctctttttagggcggggaaagaactcttttttttttgtgggtcacaccacatttttata

SEQ ID NO: 427302 - DNA, 931 bp, Homo sapiens
tcactggagacaggaggttttattggatgctgatgggggtaggaaaggtccccagaagcatgggggctgagtcagtcagcaaagtgcgtaaggcctagcgccattttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaaaaaaaaaaaggcaaaaaaaaaaaaaaaaaaaaaattcgggggcttttttgtgtgggggggggaaaaaggggttattgaaaggggcggggcaagtgtgttttcgtggccccattttttggtcaaggggggaaaatgggagggccccaaaagggggggggaaaaaatagtggaaaaggaacgcgggttaacgtcgttttggagtatttcgtcgcacaagcaaacggagagatgcgaacagcgaacacaatcgaggagcaacagggggtagccctacacaaggggtacaaagcaacgccggctcgtgcgaaagctctgacactacacgagtacgatgtccatagaccccagacaagttaaacggaggcatatatataccagaaccaggtactagaagaaacacacaagcgagcgcagttacaaatgcgtaacgac

SEQ ID NO: 427303 - DNA, 939 bp, Homo sapiens
tcactggagacaggaggttttattggatgctgatgggggtaggaaaggtccccagaagcatgggggctgagtcagtcagcaaagtgcgtaaggcctagcgccattttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatcaaaaaaaaaaaaaaaaaaaaaaaaaaaaaaaattcgggggcttttttgtgtgggggggggaaaaaggggttattgaaaggggcggggcaagtgtgttttcgtggccccattttttggtcaaggggggaaaatgggagggccccaaaagggggggggaaaaaatagtggaaaaggaacgcgggttaacgtcgttttggagtatttcgtcgcacaagcaaacggagagatgcgaacagcgaacacaatcgaggagcaacagggggtagccctacacaaggggtacaaagcaacgccggctcgtgcgaaagctctgacactacacgagtacgatgtccatagaccccagacaagttaaacggaggcatatatataccagaaccaggtactagaagaaacacacaagcgagcgcagttacaaatgcgtaacgac

SEQ ID NO: 427304 - DNA, 491 bp, Homo sapiens
tcactggagacaggaggttttattggatgctgatgggggtaggaaaggtccccagaagcatgggggctgagtcagtcagcaaagtgcgtaaggcctagcgccattttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttt

SEQ ID NO: 427305 - DNA, 443 bp, Homo sapiens
tcactggagacaggaggttttattggatgctgatgggggtaggaaaggtccccagaagcatgggggctgagtcagtcagcaaagtgcgtaaggcctagcgccattttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagaccttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttt

SEQ ID NO: 427306 - DNA, 1261 bp, Homo sapiens
cgaccgctgtcctccaacagcgcagggcagagcggctggcgccgccggagcgcggagccacgaccctccctggccgcctttgtctactggccgtgcggcccggaaccgccactctccagggccggggacgcgcccgcagctgtcggtgacagctcctccctaccgcaaccctccggggcggaggggcggtcgggccgggccctgctagcccgcgaccgcaagcccgcgctcgcggatcgatgcccccgcagcagggggaccccgcgttccccgaccgctgcgaggcgcctccggtgccgccgcgtcgggagcgcggtggacgcgggggacgcgggcctggggagccggggggccgggggcgtgcggggggtgccgaggggcgcggcgtcaagtgcgtgctggtcggcgacggcgcggtgggcaagacgagcctggtggtgagctacaccaccaacggctaccccaccgagtacatccctactgccttcgacaacttctccgcggtggtgtctgtggatgggcggcccgtgagactccaactctgtgacactgccggacaggatgaatttgacaagctgaggcctctctgctacaccaacacagacatcttcctgctctgcttcagtgtcgtgagcccctcatccttccagaacgtcagtgagaaatgggtgccggagattcgatgccactgtcccaaagcccccatcatcctagttggaacgcagtcggatctcagagaagatgtcaaagtcctcattgagttggacaaatgcaaagaaaagccagtgcctgaagaggcggctaagctgtgcgccgaggaaatcaaagccgcctcctacatcgagtgttcagccttgactcaaaaaaacctcaaagaggtctttgatgcagccatcgtcgctggcattcaatactcggacactcagcaacagccaaagaagtctaaaagcaggactccagataaaatgaaaaacctctccaagtcctggtggaagaagtactgctgtttcgtatgatgctggcaagacacccagaaaggctattttcagatgaaatcgatattagaagctatattagctgaaacaactccttttactgcgtagaacctatatcgagagtgtgtgtatatgtattataggaggagctctcaattttatgtattctttctgcctttaattttcttgtttgtttgagcttagggatgagatacttatgcaagatatttttgaagtaaattaaacatttttcacatctctggaaa

SEQ ID NO: 427307 - DNA, 1370 bp, Homo sapiens
cgaccgctgtcctccaacagcgcagggcagagcggctggcgccgccggagcgcggagccacgaccctccctggccgcctttgtctactggccgtgcggcccggaaccgccactctccagggccggggacgcgcccgcagctgtcggtgacagctcctccctaccgcaaccctccggggcggaggggcggtcgggccgggccctgctagcccgcgaccgcaagcccgcgctcgcggatcgatgcccccgcagcagggggaccccgcgttccccgaccgctgcgaggcgcctccggtgccgccgcgtcgggagcgcggtggacgcgggggacgcgggcctggggagccggggggccgggggcgtgcggggggtgccgaggggcgcggcgtcaagtgcgtgctggtcggcgacggcgcggtgggcaagacgagcctggtggtgagctacaccaccaacggctaccccaccgagtacatccctactgccttcgacaacttctccgcggtggtgtctgtggatgggcggcccgtgagactccaactctgtgacactgccggacaggatgaatttgacaagctgaggcctctctgctacaccaacacagacatcttcctgctctgcttcagtgtcgtgagcccctcatccttccagaacgtcagtgagaaatgggtgccggagattcgatgccactgtcccaaagcccccatcatcctagttggaacgcagtcggatctcagagaagatgtcaaagtcctcattgagttggacaaatgcaaagaaaagccagtgcctgaagaggcggctaagctgtgcgccgaggaaatcaaagccgcctcctacatcgagtgttcagccttgactcaaaaaaacctcaaagaggtctttgatgcagccatcgtcgctggcattcaatactcggacactcagcaacagccaaagaagtctaaaagcaggactccagataaaatgaaaaacctctccaagtcctggtggaagaagtactgctgtttcgtatgatgctggcaagacacccagaaaggctattttcagatgaaatcgatattagaagctatattagctgaaacaactccttttactgcgtagaacctatatcgagagtgtgtgtatatgtattataggagggtcccagttatgtatctctgcttattctggtgggactgggggacttgggaatttagggcactttgcactgtgataagctacacgggtaatttgtgaaccgctggtgaaagcggcatttgagagggaggttcccggaggaggggttgatattattagtatgctatgttttttaattatttcgaggagacaagaaactagaggtgtgcaccaacaggacgagcagccgcg

SEQ ID NO: 427308 - DNA, 3881 bp, Homo sapiens
cgaccgctgtcctccaacagcgcagggcagagcggctggcgccgccggagcgcggagccacgaccctccctggccgcctttgtctactggccgtgcggcccggaaccgccactctccagggccggggacgcgcccgcagctgtcggtgacagctcctccctaccgcaaccctccggggcggaggggcggtcgggccgggccctgctagcccgcgaccgcaagcccgcgctcgcggatcgatgcccccgcagcagggggaccccgcgttccccgaccgctgcgaggcgcctccggtgccgccgcgtcgggagcgcggtggacgcgggggacgcgggcctggggagccggggggccgggggcgtgcggggggtgccgaggggcgcggcgtcaagtgcgtgctggtcggcgacggcgcggtgggcaagacgagcctggtggtgagctacaccaccaacggctaccccaccgagtacatccctactgccttcgacaacttctccggatgaatttgacaagctgaggcctctctgctacaccaacacagacatcttcctgctctgcttcagtgtcgtgagcccctcatccttccagaacgtcagtgagaaatgggtgccggagattcgatgccactgtcccaaagcccccatcatcctagttggaacgcagtcggatctcagagaagatgtcaaagtcctcattgagttggacaaatgcaaagaaaagccagtgcctgaagaggcggctaagctgtgcgccgaggaaatcaaagccgcctcctacatcgagtgttcagccttgactcaaaaaaacctcaaagaggtctttgatgcagccatcgtcgctggcattcaatactcggacactcagcaacagccaaagaagtctaaaagcaggactccagataaaatgaaaaacctctccaagtcctggtggaagaagtactgctgtttcgtatgatgctggcaagacacccagaaaggctattttcagatgaaatcgatattagaagctatattagctgaaacaactccttttactgcgtagaacctatatcgagagtgtgtgtatatgtattataggaggagctctcaattttatgtattctttctgcctttaattttcttgtttgtttgagcttagggatgagatacttatgcaagatatttttgaagtaaattaaacatttttcacatctctggaaatttagagttctagacctctggttaatttatatctaatatgaagaagacacctctaatctggatgttaagaatgaagttctgctacattataatgtacagaagagcaaaagggaggaacactatggttaaccctctcttgattaagggctacttaatgcacagtgcattatgtacacaggtcaaccatggtaacaatagttcttagctttgaaactccatgcaaaccatgccttttttttaaggagcaaaaatctgagaaaaaaagtgagagacctctgcctacaaaacctcaaaccagtcacttttgtcaattgctaatacccagttacttatgatttaaaaacaaccaacagaaaacatcccactgactgtatggcactctgtagtcaaaaaaggaaacttccttattgggacttttctttcttagtccagttgtgttgacacatatgaacacagacaaagtgctatgcggaggaaagcaagtgttggtcagtagtttcatgttttagggagtggttcctgtggagatcagaaagtgacatttgctttcggtactgtaatacgtgcaccaaactgcctcaatcctaggtaacgagggcaacagggagcacctgtctggattgtttttaaacctccatactcaagctgtctcttcggcagggaggtgaatactcttgaaaggccaacagcaagtgtttgtgggacacaacacagataattttttcttaagtcggccaagatgtacttctctgtgtgcacacccatgcacactcatgcacacagatacataggtctgtatggctgtatttgctgttgattcagactttcacaccattaatggggaaaagcgtggccacaaaaacagatgctaggaagcttggcttcctcttcttgttgacccttttttgaaccaacatcttttttattatattcagagtatgtttttaagtgtatcttaatatatacattttttaggacatcttaaatctaaacaaaaaataaaatgaacatctcttgaaacctgttaaaacaaccagttaaagccacagatggctttcagggcagtagcagcagaggccagtggactctgaggactcctgaggggcggggcgtgtagccagccaggtgcatgccgggaccatggcccccatacttggctgcttcctgtgacagtgaaatacatccttcaaggtggcagctgttagggctgaatcttctggagaaaaaggtgccatctcaggagaatagcttttactctggtaggaatgcttccgagacaccacaaggcagcctgaacactcagttgcagggtcgggcttgcggtgggtgacccagagccaccaaagtcacatccacaactaatgagggaaatctgtaaagccagttagatagaagaattttatttttctgtgggttttgtgttgtcttttttatgttaaaaagaaatccagtttgtgtttttctatagaaaaagtaaaagatcaggttatactttaggttaggggttctatttattcctgttagtaaataaaattaacaaatttctttgtttaacaaaagattaatctttaaaccactaaaatacatagactgattgattattcaacacattggaattgatgtcggtcatagtttcctgaagcatttagttacaacctgaaggaataaaatgatttgtggaaatgcttaaaatagacctaactgaatacagtctcatcttgccgcgcctggcttacctatctgtggaaagctaggcttcccaggctgggctctgcctgtctggtgcctggaggtgtgggagggaagatgagttatttaactggtaagcgatttgaaacactatttttatattaaagtaaatggcatggagtatagtgcaaattcatttttaagatagaacacaaaacttgaaagaagttttatgcgtgtgacagtgtatggggctgcagttggtctccctggaggggacttccacacctcctgcctttaggccatgggtggaaagtgctcagtgaagtacacctgtgtggcccagttctgaaagctttatacagttgaattttaagtggggttgataacaccttggactgttagtgttaaaaatctagtgggttgacctttaaatgcaacagtttttaaaatatattgctgcattttatagaatagtaaaggtacgattatacttgagattttcctccatttttatttcttcgtgaacatagagtttggggccgaaaatgtttttaaagtatgtgtttgagttaaatataaagttggttcacttcaaagctaaaaaattgttaaacttgcagcttggtattgcagagaagattttataagaattttgctttagagaatgccactttggctgaactacaagtgtaggccaccattataatttataaatacagcatacttcaaaactgtttgttatctcttgttaccatgtatgtataaatggaccttttataaccttgttctctgcttgacagactcaagagaaactacccaggtattacacaagccaaaatgggagcaaggccttctctccagactatcgtaacctggtgccttaccaagttgtgcttttctgttttcaagtgtaaatgatgttgagcagaatgttgtacttgaaaatgctataagtgagatggtatgaaataaattctgacttatgaa

SEQ ID NO: 427309 - DNA, 3886 bp, Homo sapiens
cgaccgctgtcctccaacagcgcagggcagagcggctggcgccgccggagcgcggagccacgaccctccctggccgcctttgtctactggccgtgcggcccggaaccgccactctccagggccggggacgcgcccgcagctgtcggtgacagctcctccctaccgcaaccctccggggcggaggggcggtcgggccgggccctgctagcccgcgaccgcaagcccgcgctcgcggatcgatgcccccgcagcagggggaccccgcgttccccgaccgctgcgaggcgcctccggtgccgccgcgtcgggagcgcggtggacgcgggggacgcgggcctggggagccggggggccgggggcgtgcggggggtgccgaggggcgcggcgtcaagtgcgtgctggtcggcgacggcgcggtgggcaagacgagcctggtggtgagctacaccaccaacggctaccccaccgagtacatccctactgccttcgacaacttctccgcggtggtgtctgtggatgggcggcccgtgagactccaactctgtgacactgccggacaggatgaatttgacaagctgaggcctctctgctacaccaacacagacatcttcctgctctgcttcagtgtcgtgagcccctcatccttccagaacgtcagtgagaaatgggtgccggagattcgatgccactgtcccaaagcccccatcatcctagttggaacgcagtcggatctcagagaagatgtcaaagtcctcattgagttggacaaatgcaaagaaaagccagtgcctgaagaggcggctaagctgtgcgccgaggaaatcaaagccgcctcctacatcgagtgttcagccttgactcaaaaaaacctcaaagaggtctttgatgcagccatcgtcgctggcattcaatactcggacactcagcaacagccaaagaagtctaaaagcaggactccagataaaatgaaaaacctctccaagtcctggtggaagaagtactgctgtttcgtatgatgctggcaagacacccagaaaggctattttcagatgaaatcgatattagaagctatattagctgaaacaactccttttactgcgtagaacctatatcgagagtgtgtgtatatgtattataggaggagctctcaattttatgtattctttctgcctttaattttcttgtttgtttgagcttagggatgagatacttatgcaagatatttttgaagtaaattaaacatttttcacatctctggaaatttagagttctagacctctggttaatttatatctaatatgaagaagacacctctaatctggatgttaagaatgaagttctgctacattataatgtacagaagagcaaaagggaggaacactatggttaaccctctcttgattaagggctacttaatgcacagtgcattatgtacacaggtcaaccatggtaacaatagttcttagctttgaaactccatgcaaaccatgccttttttttaaggagcaaaaatctgagaaaaaaagtgagagacctctgcctacaaaacctcaaaccagtcacttttgtcaattgctaatacccagttacttatgatttaaaaacaaccaacagaaaacatcccactgactgtatggcactctgtagtcaaaaaaggaaacttccttattgggacttttctttcttagtccagttgtgttgacacatatgaacacagacaaagtgctatgcggaggaaagcaagtgttggtcagtagtttcatgttttagggagtggttcctgtggagatcagaaagtgacatttgctttcggtactgtaatacgtgcaccaaactgcctcaatcctaggtaacgagggcaacagggagcacctgtctggattgtttttaaacctccatactcaagctgtctcttcggcagggaggtgaatactcttgaaaggccaacagcaagtgtttgtgggacacaacacagataattttttcttaagtcggccaagatgtacttctctgtgtgcacacccatgcacactcatgcacacagatacataggtctgtatggctgtatttgctgttgattcagactttcacaccattaatggggaaaagcgtggccacaaaaacagatgctaggaagcttggcttcctcttcttgttgacccttttttgaaccaacatcttttttattatattcagagtatgtttttaagtgtatcttaatatatacattttttaggacatcttaaatctaaacaaaaaataaaatgaacatctcttgaaacctgttaaaacaaccagttaaagccacagatggctttcagggcagtagcagcagaggccagtggactctgaggactcctgaggggcggggcgtgtagccagccaggtgcatgccgggaccatggcccccatacttggctgcttcctgtgacagtgaaatacatccttcaaggtggcagctgttagggctgaatcttctggagaaaaaggtgccatctcaggagaatagcttttactctggtaggaatgcttccgagacaccacaaggcagcctgaacactcagttgcagggtcgggcttgcggtgggtgacccagagccaccaaagtcacatccacaactaatgagggaaatctgtaaagccagttagatagaagaattttatttttctgtgggttttgtgttgtcttttttatgttaaaaagaaatccagtttgtgtttttctatagaaaaagtaaaagatcaggttatactttaggttaggggttctatttattcctgttagtaaataaaattaacaaatttctttgtttaacaaaagattaatctttaaaccactaaaatacatagactgattgattattcaacacattggaattgatgtcggtcatagtttcctgaagcatttagttacaacctgaaggaataaaatgatttgtggaaatgcttaaaatagacctaactgaatacagtctcatcttgccgcgcctggcttacctatctgtggaaagctaggcttcccaggctgggctctgcctgtctggtgcctggaggtgtgggagggaagatgagttatttaactggtaagcgatttgaaacactatttttatattaaagtaaatggcatggagtatagtgcaaattcatttttaagatagaacacaaaacttgaaagaagttttatgcgtgtgacagtgtatggggctgcagttggtctccctggaggggacttccacacctcctgcctttaggccatgggtggaaagtgctcagtgaagtacacctgtgtggcccagttctgaaagctttatacagttgaattttaagtggggttgataacaccttggactgttagtgttaaaaatctagtgggttgacctttaaatgcaacagtttttaaaatatattgctgcattttatagaatagtaaaggtacgattatacttgagattttcctccatttttatttcttcgtgaacatagagtttggggccgaaaatgtttttaaagtatgtgtttgagttaaatataaagttggttcaataagaattttgctttagagaatgccactttggctgaactacaagtgtaggccaccattataatttataaatacagcatacttcaaaactgtttgttatctcttgttaccatgtatgtataaatggaccttttataaccttgttctctgcttgacagactcaagagaaactacccaggtattacacaagccaaaatgggagcaaggccttctctccagactatcgtaacctggtgccttaccaagttgtgcttttctgttttcaagtgtaaatgatgttgagcagaatgttgtacttgaaaatgctataagtgagatggtatgaaataaattctgacttatgaa

SEQ ID NO: 427310 - DNA, 1776 bp, Homo sapiens
  misc_feature (1680)..(1680): n is a, c, g, or t
cgaccgctgtcctccaacagcgcagggcagagcggctggcgccgccggagcgcggagccacgaccctccctggccgcctttgtctactggccgtgcggcccggaaccgccactctccagggccggggacgcgcccgcagctgtcggtgacagctcctccctaccgcaaccctccggggcggaggggcggtcgggccgggccctgctagcccgcgaccgcaagcccgcgctcgcggatcgatgcccccgcagcagggggaccccgcgttccccgaccgctgcgaggcgcctccggtgccgccgcgtcgggagcgcggtggacgcgggggacgcgggcctggggagccggggggccgggggcgtgcggggggtgccgaggggcgcggcgtcaagtgcgtgctggtcggcgacggcgcggtgggcaagacgagcctggtggtgagctacaccaccaacggctaccccaccgagtacatccctactgccttcgacaacttctccgcggtggtgtctgtggatgggcggcccgtgagactccaactctgtgacactgccggacaggatgaatttgacaagctgaggcctctctgctacaccaacacagacatcttcctgctctgcttcagtgtcgtgagcccctcatccttccagaacgtcagtgagaaatgggtgccggagattcgatgccactgtcccaaagcccccatcatcctagttggaacgcagtcggatctcagagaagatgtcaaagtcctcattgagttggacaaatgcaaagaaaagccagtgcctgaagaggcggctaagctgtgcgccgaggaaatcaaagccgcctcctacatcgagtgttcagccttgactcaaaaaaacctcaaagaggtctttgatgcagccatcgtcgctggcattcaatactcggacactcagcaacagccaaagaagtctaaaagcaggactccagataaaatgaaaaacctctccaagtcctggtggaagaagtactgctgtttcgtatgatgctggcaagacacccagaaaggctattttcagatgaaatcgatattagaagctatattagctgaaacaactccttttactgcgtagaacctatatcgagagtgtgtgtatatgtattataggaggagctctcaattttatgtattctttctgcctttaattttcttgtttgtttgagcttagggatgagatacttatgcaagatatttttgaagtaaattaaacatttttcacatctctggaaaaaaaaaaaaaaaaaaaaaaaaaaaaaaaaaagggggggggggaaaaatttcccccgggggggcccatttggggccccggttttttgtggtccaaggtgtggggccccttatgggggaggcggggtattataagcgcgagggcaggggcgccgcgtgttaaacccaagcggtcgctgtggtccggggagcactcggctcgctgggcgctctcttggggagaagggaccctcactttccggggggggggccatactggggccaactcaccccaggggatttaagacgctcccgggggaaactcacacattccacgtggtttacgggtgtaacccgacggggtactatgcctggggggctggagcgatcggcgcacggatttgtctctggaccattttacgacgcgcgctcaaaaacaaacnggtacaaccgagcaacgcgaaccacaaaaacgaaagtaacacatcttatacaaaacacacgcagcgcaataccgactcacaaacacaacaactgaa

SEQ ID NO: 427311 - DNA, 3940 bp, Homo sapiens
cgaccgctgtcctccaacagcgcagggcagagcggctggcgccgccggagcgcggagccacgaccctccctggccgcctttgtctactggccgtgcggcccggaaccgccactctccagggccggggacgcgcccgcagctgtcggtgacagctcctccctaccgcaaccctccggggcggaggggcggtcgggccgggccctgctagcccgcgaccgcaagcccgcgctcgcggatcgatgcccccgcagcagggggaccccgcgttccccgaccgctgcgaggcgcctccggtgccgccgcgtcgggagcgcggtggacgcgggggacgcgggcctggggagccggggggccgggggcgtgcggggggtgccgaggggcgcggcgtcaagtgcgtgctggtcggcgacggcgcggtgggcaagacgagcctggtggtgagctacaccaccaacggctaccccaccgagtacatccctactgccttcgacaacttctccgcggtggtgtctgtggatgggcggcccgtgagactccaactctgtgacactgccggacaggatgaatttgacaagctgaggcctctctgctacaccaacacagacatcttcctgctctgcttcagtgtcgtgagcccctcatccttccagaacgtcagtgagaaatgggtgccggagattcgatgccactgtcccaaagcccccatcatcctagttggaacgcagtcggatctcagagaagatgtcaaagtcctcattgagttggacaaatgcaaagaaaagccagtgcctgaagaggcggctaagctgtgcgccgaggaaatcaaagccgcctcctacatcgagtgttcagccttgactcaaaaaaacctcaaagaggtctttgatgcagccatcgtcgctggcattcaatactcggacactcagcaacagccaaagaagtctaaaagcaggactccagataaaatgaaaaacctctccaagtcctggtggaagaagtactgctgtttcgtatgatgctggcaagacacccagaaaggctattttcagatgaaatcgatattagaagctatattagctgaaacaactccttttactgcgtagaacctatatcgagagtgtgtgtatatgtattataggaggagctctcaattttatgtattctttctgcctttaattttcttgtttgtttgagcttagggatgagatacttatgcaagatatttttgaagtaaattaaacatttttcacatctctggaaatttagagttctagacctctggttaatttatatctaatatgaagaagacacctctaatctggatgttaagaatgaagttctgctacattataatgtacagaagagcaaaagggaggaacactatggttaaccctctcttgattaagggctacttaatgcacagtgcattatgtacacaggtcaaccatggtaacaatagttcttagctttgaaactccatgcaaaccatgccttttttttaaggagcaaaaatctgagaaaaaaagtgagagacctctgcctacaaaacctcaaaccagtcacttttgtcaattgctaatacccagttacttatgatttaaaaacaaccaacagaaaacatcccactgactgtatggcactctgtagtcaaaaaaggaaacttccttattgggacttttctttcttagtccagttgtgttgacacatatgaacacagacaaagtgctatgcggaggaaagcaagtgttggtcagtagtttcatgttttagggagtggttcctgtggagatcagaaagtgacatttgctttcggtactgtaatacgtgcaccaaactgcctcaatcctaggtaacgagggcaacagggagcacctgtctggattgtttttaaacctccatactcaagctgtctcttcggcagggaggtgaatactcttgaaaggccaacagcaagtgtttgtgggacacaacacagataattttttcttaagtcggccaagatgtacttctctgtgtgcacacccatgcacactcatgcacacagatacataggtctgtatggctgtatttgctgttgattcagactttcacaccattaatggggaaaagcgtggccacaaaaacagatgctaggaagcttggcttcctcttcttgttgacccttttttgaaccaacatcttttttattatattcagagtatgtttttaagtgtatcttaatatatacattttttaggacatcttaaatctaaacaaaaaataaaatgaacatctcttgaaacctgttaaaacaaccagttaaagccacagatggctttcagggcagtagcagcagaggccagtggactctgaggactcctgaggggcggggcgtgtagccagccaggtgcatgccgggaccatggcccccatacttggctgcttcctgtgacagtgaaatacatccttcaaggtggcagctgttagggctgaatcttctggagaaaaaggtgccatctcaggagaatagcttttactctggtaggaatgcttccgagacaccacaaggcagcctgaacactcagttgcagggtcgggcttgcggtgggtgacccagagccaccaaagtcacatccacaactaatgagggaaatctgtaaagccagttagatagaagaattttatttttctgtgggttttgtgttgtcttttttatgttaaaaagaaatccagtttgtgtttttctatagaaaaagtaaaagatcaggttatactttaggttaggggttctatttattcctgttagtaaataaaattaacaaatttctttgtttaacaaaagattaatctttaaaccactaaaatacatagactgattgattattcaacacattggaattgatgtcggtcatagtttcctgaagcatttagttacaacctgaaggaataaaatgatttgtggaaatgcttaaaatagacctaactgaatacagtctcatcttgccgcgcctggcttacctatctgtggaaagctaggcttcccaggctgggctctgcctgtctggtgcctggaggtgtgggagggaagatgagttatttaactggtaagcgatttgaaacactatttttatattaaagtaaatggcatggagtatagtgcaaattcatttttaagatagaacacaaaacttgaaagaagttttatgcgtgtgacagtgtatggggctgcagttggtctccctggaggggacttccacacctcctgcctttaggccatgggtggaaagtgctcagtgaagtacacctgtgtggcccagttctgaaagctttatacagttgaattttaagtggggttgataacaccttggactgttagtgttaaaaatctagtgggttgacctttaaatgcaacagtttttaaaatatattgctgcattttatagaatagtaaaggtacgattatacttgagattttcctccatttttatttcttcgtgaacatagagtttggggccgaaaatgtttttaaagtatgtgtttgagttaaatataaagttggttcacttcaaagctaaaaaattgttaaacttgcagcttggtattgcagagaagattttataagaattttgctttagagaatgccactttggctgaactacaagtgtaggccaccattataatttataaatacagcatacttcaaaactgtttgttatctcttgttaccatgtatgtataaatggaccttttataaccttgttctctgcttgacagactcaagagaaactacccaggtattacacaagccaaaatgggagcaaggccttctctccagactatcgtaacctggtgccttaccaagttgtgcttttctgttttcaagtgtaaatgatgttgagcagaatgttgtacttgaaaatgctataagtgagatggtatgaaataaattctgacttatgaa

SEQ ID NO: 427312 - DNA, 3886 bp, Homo sapiens
cgaccgctgtcctccaacagcgcagggcagagcggctggcgccgccggagcgcggagccacgaccctccctggccgcctttgtctactggccgtgcggcccggaaccgccactctccagggccggggacgcgcccgcagctgtcggtgacagctcctccctaccgcaaccctccggggcggaggggcggtcgggccgggccctgctagcccgcgaccgcaagcccgcgctcgcggatcgatgcccccgcagcagggggaccccgcgttccccgaccgctgcgaggcgcctccggtgccgccgcgtcgggagcgcggtggacgcgggggacgcgggcctggggagccggggggccgggggcgtgcggggggtgccgaggggcgcggcgtcaagtgcgtgctggtcggcgacggcgcggtgggcaagacgagcctggtggtgagctacaccaccaacggctaccccaccgagtacatccctactgccttcgacaacttctccgcggtggtgtctgtggatgggcggcccgtgagactccaactctgtgacactgccggacaggatgaatttgacaagctgaggcctctctgctacaccaacacagacatcttcctgctctgcttcagtgtcgtgagcccctcatccttccagaacgtcagtgagaaatgggtgccggagattcgatgccactgtcccaaagcccccatcatcctagttggaacgcagtcggatctcagagaagatgtcaaagtcctcattgagttggacaaatgcaaagaaaagccagtgcctgaagaggcggctaagctgtgcgccgaggaaatcaaagccgcctcctacatcgagtgttcagccttgactcaaaaaaacctcaaagaggtctttgatgcagccatcgtcgctggcattcaatactcggacactcagcaacagccaaagaagtctaaaagcaggactccagataaaatgaaaaacctctccaagtcctggtggaagaagtactgctgtttcgtatgatgctggcaagacacccagaaaggctattttcagatgaaatcgatattagaagctatattagctgaaacaactccttttactgcgtagaacctatatcgagagtgtgtgtatatgtattataggaggagctctcaattttatgtattctttctgcctttaattttcttgtttgtttgagcttagggatgagatacttatgcaagatatttttgaagtaaattaaacatttttcacatctctggaaatttagagttctagacctctggttaatttatatctaatatgaagaagacacctctaatctggatgttaagaatgaagttctgctacattataatgtacagaagagcaaaagggaggaacactatggttaaccctctcttgattaagggctacttaatgcacagtgcattatgtacacaggtcaaccatggtaacaatagttcttagctttgaaactccatgcaaaccatgccttttttttaaggagcaaaaatctgagaaaaaaagtgagagacctctgcctacaaaacctcaaaccagtcacttttgtcaattgctaatacccagttacttatgatttaaaaacaaccaacagaaaacatcccactgactgtatggcactctgtagtcaaaaaaggaaacttccttattgggacttttctttcttagtccagttgtgttgacacatatgaacacagacaaagtgctatgcggaggaaagcaagtgttggtcagtagtttcatgttttagggagtggttcctgtggagatcagaaagtgacatttgctttcggtactgtaatacgtgcaccaaactgcctcaatcctaggtaacgagggcaacagggagcacctgtctggattgtttttaaacctccatactcaagctgtctcttcggcagggaggtgaatactcttgaaaggccaacagcaagtgtttgtgggacacaacacagataattttttcttaagtcggccaagatgtacttctctgtgtgcacacccatgcacactcatgcacacagatacataggtctgtatggctgtatttgctgttgattcagactttcacaccattaatggggaaaagcgtggccacaaaaacagatgctaggaagcttggcttcctcttcttgttgacccttttttgaaccaacatcttttttattatattcagagtatgtttttaagtgtatcttaatatatacattttttaggacatcttaaatctaaacaaaaaataaaatgaacatctcttgaaacctgttaaaacaaccagttaaagccacagatggctttcagggcagtagcagcagaggccagtggactctgaggactcctgaggggcggggcgtgtagccagccaggtgcatgccgggaccatggcccccatacttggctgcttcctgtgacagtgaaatacatccttcaaggtggcagctgttagggctgaatcttctggagacaccacaaggcagcctgaacactcagttgcagggtcgggcttgcggtgggtgacccagagccaccaaagtcacatccacaactaatgagggaaatctgtaaagccagttagatagaagaattttatttttctgtgggttttgtgttgtcttttttatgttaaaaagaaatccagtttgtgtttttctatagaaaaagtaaaagatcaggttatactttaggttaggggttctatttattcctgttagtaaataaaattaacaaatttctttgtttaacaaaagattaatctttaaaccactaaaatacatagactgattgattattcaacacattggaattgatgtcggtcatagtttcctgaagcatttagttacaacctgaaggaataaaatgatttgtggaaatgcttaaaatagacctaactgaatacagtctcatcttgccgcgcctggcttacctatctgtggaaagctaggcttcccaggctgggctctgcctgtctggtgcctggaggtgtgggagggaagatgagttatttaactggtaagcgatttgaaacactatttttatattaaagtaaatggcatggagtatagtgcaaattcatttttaagatagaacacaaaacttgaaagaagttttatgcgtgtgacagtgtatggggctgcagttggtctccctggaggggacttccacacctcctgcctttaggccatgggtggaaagtgctcagtgaagtacacctgtgtggcccagttctgaaagctttatacagttgaattttaagtggggttgataacaccttggactgttagtgttaaaaatctagtgggttgacctttaaatgcaacagtttttaaaatatattgctgcattttatagaatagtaaaggtacgattatacttgagattttcctccatttttatttcttcgtgaacatagagtttggggccgaaaatgtttttaaagtatgtgtttgagttaaatataaagttggttcacttcaaagctaaaaaattgttaaacttgcagcttggtattgcagagaagattttataagaattttgctttagagaatgccactttggctgaactacaagtgtaggccaccattataatttataaatacagcatacttcaaaactgtttgttatctcttgttaccatgtatgtataaatggaccttttataaccttgttctctgcttgacagactcaagagaaactacccaggtattacacaagccaaaatgggagcaaggccttctctccagactatcgtaacctggtgccttaccaagttgtgcttttctgttttcaagtgtaaatgatgttgagcagaatgttgtacttgaaaatgctataagtgagatggtatgaaataaattctgacttatgaa

SEQ ID NO: 427313 - DNA, 3621 bp, Homo sapiens
cgaccgctgtcctccaacagcgcagggcagagcggctggcgccgccggagcgcggagccacgaccctccctggccgcctttgtctactggccgtgcggcccggaaccgccactctccagggccggggacgcgcccgcagctgtcggtgacagctcctccctaccgcaaccctccggggcggaggggcggtcgggccgggccctgctagcccgcgaccgcaagcccgcgctcgcggatcgatgcccccgcagcagggggaccccgcgttccccgaccgctgcgaggcgcctccggtgccgccgcgtcgggagcgcggtggacgcgggggacgcgggcctggggagccggggggccgggggcgtgcggggggtgccgaggggcgcggcgtcaagtgcgtgctggtcggcgacggcgcggtgggcaagacgagcctggtggtgagctacaccaccaacggctaccccaccgagtacatccctactgccttcgacaacttctccgcggtggtgtctgtggatgggcggcccgtgagactccaactctgtgacactgccggacaggatgaatttgacaagctgaggcctctctgctacaccaacacagacatcttcctgctctgcttcagtgtcgtgagcccctcatccttccagaacgtcagtgagaaatgggtgccggagattcgatgccactgtcccaaagcccccatcatcctagttggaacgcagtcggatctcagagaagatgtcaaagtcctcattgagttggacaaatgcaaagaaaagccagtgcctgaagaggcggctaagctgtgcgccgaggaaatcaaagccgcctcctacatcgagtgttcagccttgactcaaaaaaacctcaaagaggtctttgatgcagccatcgtcgctggcattcaatactcggacactcagcaacagccaaagaagtctaaaagcaggactccagataaaatgaaaaacctctccaagtcctggtggaagaagtactgctgtttcgtatgatgctggcaagacacccagaaaggctattttcagatgaaatcgatattagaagctatattagctgaaacaactccttttactgcgtagaacctatatcgagagtgtgtgtatatgtattataggaggagctctcaattttatgtattctttctgcctttaattttcttgtttgtttgagcttagggatgagatacttatgcaagatatttttgaagtaaattaaacatttttcacatctctggaaatttagagttctagacctctggttaatttatatctaatatgaagaagacacctctaatctggatgttaagaatgaagttctgctacattataatgtacagaagagcaaaagggaggaacactatggttaaccctctcttgattaagggctacttaatgcacagtgcattatgtacacaggtcaaccatggtaacaatagttcttagctttgaaactccatgcaaaccatgccttttttttaaggagcaaaaatctgagaaaaaaagtgagagacctctgcctacaaaacctcaaaccagtcacttttgtcaattgctaatacccagttacttatgatttaaaaacaaccaacagaaaacatcccactgactgtatggcactctgtagtcaaaaaaggaaacttccttattgggacttttctttcttagtccagttgtgttgacacatatgaacacagacaaagtgctatgcggaggaaagcaagtgttggtcagtagtttcatgttttagggagtggttcctgtggagatcagaaagtgacatttgctttcggtactgtaatacgtgcaccaaactgcctcaatcctaggtaacgagggcaacagggagcacctgtctggattgtttttaaacctccatactcaagctgtctcttcggcagggaggtgaatactcttgaaaggccaacagcaagtgtttgtgggacacaacacagataattttttcttaagtcggccaagatgtacttctctgtgtgcacacccatgcacactcatgcacacagatacataggtctgtatggctgtatttgctgttgattcagactttcacaccattaatggggaaaagcgtggccacaaaaacagatgctaggaagcttggcttcctcttcttgttgacccttttttgaaccaacatcttttttattatattcagagtatgtttttaagtgtatcttaatatatacattttttaggacatcttaaatctaaacaaaaaataaaatgaacatctcttgaaacctgttaaaacaaccagttaaagccacagatggctttcagggcagtagcagcagaggccagtggactctgaggactcctgaggggcggggcgtgtagccagccaggtgcatgccgggaccatggcccccatacttggctgcttcctgtgacagtgaaatacatccttcaaggtggcagctgttagggctgaatcttctggagaaaaaggtgccatctcaggagaatagcttttactctggtaggaatgcttccgagacaccacaaggcagcctgaacactcagttgcagggtcgggcttgcggtgggtgacccagagccaccaaagtcacatccacaactaatgagggaaatctgtaaagccagttagatagaagaattttatttttctgtgggttttgtgttgtcttttttatgttaaaaagaaatccagtttgtgtttttctatagaaaaagtaaaagatcaggttatactttaggttaggggttctatttattcctgttagtaaataaaattaacaaatttctttgtttaacaaaagattaatctttaaaccactaaaatacatagactgattgattattcaacacattggaattgatgtcggtcatagtttcctgaagcatttagttacaacctgaaggaataaaatgatttgtggaaatgcttaaaatagacctaactgaatacagtctcatcttgccgcgcctggcttacctatctgtggaaagctaggcttcccaggctgggctctgcctgtctggtgcctggaggtgtgggagggaagatgagttatttaactggtaagcgatttgaaacactatttttatattaaagtaaatggcatggagtatagtgcaaattcatttttaagatagaacacaaaacttgaaagaagttttatgcgtgtgacagtgtatggggctgcagttggtctccctggaggggacttccacacctcctgcctttaggccatgggtggaaagtgctcagtgaagtacacctgtgtggcccagttctgaaagctttatacagttgaattttaagtggggttgataacaccttggactgttagtgttaaaaaattatgaagtatgtcaggcataccaaaagataaggaagatgttatctttacaccattacagccccatatggctcaagagaaactacccaggtattacacaagccaaaatgggagcaaggccttctctccagactatcgtaacctggtgccttaccaagttgtgcttttctgttttcaagtgtaaatgatgttgagcagaatgttgtacttgaaaatgctataagtgagatggtatgaaataaattctgacttatgaa

SEQ ID NO: 427314 - DNA, 3466 bp, Homo sapiens
aaaataaattatgacatttagtatctaaggttagaaaaccacgcccacatgctaaaatgggtgttgaaaactaggttacttataatgcaaggaatcaggaaactttagttatttatagtataatcaccattatctgtttaaaggatccatttagttaaaatcgggcactctatattcattaaggtttatgaattaaaaagaaagctttatgtagttatgcatgtcagtttgctatttaaaatgtgtgacagtgtttgtcatattaagagtgaatttggcaggaattcccaagatggacattgtgcttttaaactagaacttgtaagacattatgtgaatatcccttgccaattttttttataataagaaaacatctgactaaagtcaaagaatgatttcttatggtttattttgatgaaagttcttttaacatgtcttgaatgtacacataaaggaatccaaagctttccattctaacttaatctttgtgataacattattgccatgttctacaaccgtaagatgacagttttcaatgtagtgacacaaaagggcatgaaaaactaactgctagctttcctttcatttcaaaagtccaagaatttctagtatatttggattttagcttctgttcaaagcaaatccagatgcaactccagtaagtggcctttgctcttttttgtaccaaagagcccagatgattcctacagtccctttcttctctaacatgctgtggttccttaaatatgagtaatttctctaagatataacccaggtgctttgagaagctgcattaaggtgttcaggccctcagatatcacatggtacacttgattagtaataaaaccagagatcaatttaaattgctgataggtcctgtctcagtgtgtggcattgactgttttcaggaaaatagatacagattaatatgagttatgcgtgtaggttgtgtatagattgagaagatagatacttctcaatctagtagtttgatttatttaaccaatggtttcagtttgcttgagcatatgaaaatcctgcttaatgtgcttaagagtataataaatgtgtacttttgtcctcaaacctagtagctgggttttaacactcatggacatggtcttaatcaatggagttaaataaacaaattcagcaagttattaaatctgacatggtaggagaggggagatgtgtcctgcttattaaatgtgttggtccattgaaagttacatggattgccaatttttaaaacactaaagttgaataaaatgcatgaacaatagaaaaatgctgaacattattttggatgctagctgcttggacattaactgtgttatttctgctttgagatgaaaatatatatttatctttgcttattttatcccagatgtgttctgaatatccttcttcataaatcatggaaaactcactgctgagatagtaaaccatgaaatcgccttttcagttggtgccatgtatctgacagttccatcttggaaggtttcaaaattaccttttaaaatgatctcagaagtctgtagattctcaatgatactgaaagctttgcacctctttggtagaaaccaggtctatttagaaaatggctttatgataaatgttgcctcctgagtgataatgaagtgttcctggatattgtattgtaatttaatgtgcttaccacactgccacattttaatgagtcagagaaaaattaatttttcttcaatacaataatagaacaagtagcctattctcttaaaaagtatgtgaaaagaaaattatgaaaaaatatgcatacctaatgaagtattggttttagtaagaattaaatacatttcattgagctttaaagtactttggagaaactttggggcacgttttcctactctaattcaactaaagttataaataaagagaaaaactcattcagaaatcatggattttaaaaatattttactgcagccaagttttcatttcaaaatgtaatttcagtttggagcttttaggcattatgtatatttaaaaaatatattcttcaaaaatgcattttggcatggtgggatggatgttgcaaaagatatccggagcctccagtctgtcattaactgatatggtaaatcacctctcttctttgggtctcaattttttatttatctatatggtaaactcagagatcactccttaggggtgagtcctattgcaatatgaccgacaaagaagacaaaatagcattgaaactaacccatacaaaatatccaactctggattctgtgaataagtatcttgaccataaaaagtcattgctgttcttgtttctaatgtaaatagtgtccattagtaaaagtgaaattcagtcttaagtagggtgaattggatcaccatttacacaagagatggctttttcctttgcttgaataaacattttggatcacctccaaagaatgaaaaccagtagtacgttttagtcatattagtcaggatgagaaactataagatgtgtgtaacatttggaaatgcaccaaagtgagcgtttaaatcttctcattttattgaaaactaagagcagaaaatgtaaaatgctcatgaaggttttgaatgccaaaagatattttagaatcaatttataaaggggtaattcattaattacactttaaaattggaaagtgggataagaaatctaaagtaaaccagcttatctttgaaacaatattattttgaaattggctttaaaataaaaccattcagattgaaattctaattagctcatttgtggagtttgatcacacaattcataatgttgctgctttccattaactagtcttgaaatgcctttgtttgtaaaaataaaataatggtactttcattttataacaaggtgtttttttcaagaaataatccatgctaaaatggatatttgtgatcctgaaatgtttactaagcattgtaaatttatttataactgccatctccaactacatccttatgatgtttttaacaataaaattaaaacaactgttaaactaaaaaccacaccgttttccagtacttgatctctgagctacaatactcactaaatataattttccaatcaaaatattctattctatattctaagggttaatatgtgattatagtgtccacttgccaccatttttttaaatcaatggacttgaaaagtattaatttagatggatgcgcagatataccctcagttcagtcatagattggagtttgcatataataatgtaaatgtatgtcgacactattctaaatagttctattatgactgaaatttaattaaataaaaaaggttgtaaaatgtgatgtgtatgtgtatatactgtatgtgtactttttaaaataggtgtatgtcccaacccttttttatacaggtttgaatttaaaattacatgatatatacatatactttattgttctaaataaagaattttatgcactctcaaaa

SEQ ID NO: 427315 - DNA, 3027 bp, Homo sapiens
aaaataaattatgacatttagtatctaaggttagaaaaccacgcccacatgctaaaatgggtgttgaaaactaggttacttataatgcaaggaatcaggaaactttagttatttatagtataatcaccattatctgtttaaaggatccatttagttaaaatcgggcactctatattcattaaggtttatgaattaaaaagaaagctttatgtagttatgcatgtcagtttgctatttaaaatgtgtgacagtgtttgtcatattaagagtgaatttggcaggaattcccaagatggacattgtgcttttaaactagaacttgtaagacattatgtgaatatcccttgccaattttttttataataagaaaacatctgactaaagtcaaagaatgatttcttatggtttattttgatgaaagttcttttaacatgtcttgaatgtacacataaaggaatccaaagctttccattctaacttaatctttgtgataacattattgccatgttctacaaccgtaagatgacagttttcaatgtagtgacacaaaagggcatgaaaaactaactgctagctttcctttcatttcaaaagtccaagaatttctagtatatttggattttagcttctgttcaaagcaaatccagatgcaactccagtaagtggcctttgctcttttttgtaccaaagagcccagatgattcctacagtccctttcttctctaacatgctgtggttccttaaatatgagtaatttctctaagatataacccaggtgctttgagaagctgcattaaggtgttcaggccctcagatatcacatggtacacttgattagtaataaaaccagagatcaatttaaattgctgataggtcctgtctcagtgtgtggcattgactgttttcaggaaaatagatacagattaatatgagttatgcgtgtaggttgtgtatagattgagaagatagatacttctcaatctagtagtttgatttatttaaccaatggtttcagtttgcttgagcatatgaaaatcctgcttaatgtgcttaagagtataataaatgtgtacttttgtcctcaaacctagtagctgggttttaacactcatggacatggtcttaatcaatggagttaaataaacaaattcagcaagttattaaatctgacatggtaggagaggggagatgtgtcctgcttattaaatgtgttggtccattgaaagttacatggattgccaatttttaaaacactaaagttgaataaaatgcatgaacaatagaaaaatgctgaacattattttggatgctagctgcttggacattaactgtgttatttctgctttgagatgaaaatatatatttatctttgcttattttatcccagatgtgttctgaatatccttcttcataaatcatggaaaactcactgctgagatagtaaaccatgaaatcgccttttcagttggtgccatgtatctgacagttccatcttggaaggtttcaaaattaccttttaaaatgatctcagaagtctgtagattctcaatgatactgaaagctttgcacctctttggtagaaaccaggtctatttagaaaatggctttatgataaatgttgcctcctgagtgataatgaagtgttcctggatattgtattgtaatttaatgtgcttaccacactgccacattttaatgagtcagagaaaaattaatttttcttcaatacaataatagaacaagtagcctattctcttaaaaagtatgtgaaaagaaaattatgaaaaaatatgcatacctaatgaagtattggttttagtaagaattaaatacatttcattgagctttaaagtactttggagaaactttggggcacgttttcctactctaattcaactaaagttataaataaagagaaaaactcattcagaaatcatggattttaaaaatattttactgcagccaagttttcatttcaaaatgtaatttcagtttggagcttttaggcattatgtatatttaaaaaatatattcttcaaaaatgcattttggcatggtgggatggatgttgcaaaagatatccggagcctccagtctgtcattaactgatatggtaaatcacctctcttctttgggtctcaattttttatttatctatatggtaaactcagagatcactccttaggggtgagtcctattgcaatatgaccgacaaagaagacaaaatagcattgaaactaacccatacaaaatatccaactctggattctgtgaataagtatcttgaccataaaaagtcattgctgttcttgtttctaatgtaaatagtgtccattagtaaaagtgaaattcagtcttaagtagggtgaattggatcaccatttacacaagagatggctttttcctttgcttgaataaacattttggatcacctccaaagaatgaaaaccagtagtacgttttagtcatattagtcaggatgagaaactataagatgtgtgtaacatttggaaatgcaccaaagtgagcgtttaaatcttctcattttattgaaaactaagagcagaaaatgtaaaatgctcatgaaggttttgaatgccaaaagatattttagaatcaatttataaaggggtaattcattaattacactttaaaattggaaagtgggataagaaatctaaagtaaaccagcttatctttgaaacaatattattttgaaattggctttaaaataaaaccattcagattgaaattctaattagctcatttgtggagtttgatcacacaattcataatgttgctgctttccattaactagtcttgaaatgcctttgtttgtaaaaataaaataatggtactttcattttataacaaggtgtttttttcaagaaataatccatgctaaaatggatatttgtgatcctgaaatgtttactaagcattgtaaatttatttataactgccatctccaactacatccttatgatgtttttaacaataaaatgttctagatcgcgagcggccgct

SEQ ID NO: 427316 - DNA, 3445 bp, Homo sapiens
ttcagaaggccagccggcaggaggagccggacagcctctcctattactgcgctgctgagaccaacggggtgggtgcagcctcgggcaccccgccctccaaggctaccctggaggggaaggtggcttcccccaagcactgtgttctggctcggcccaaagggactccccctctgccccctgtccgaaagtccagcctggaccagaagaaccgggccagccctcagcacagtgccagcggcagcggcaccagcagccccctgaaccaaccagccgccttcccggcgggcctcccagacgagcctagcggcaagacgaaggacgccagcagcagcagcaagctcttcagtgccaagctggagcagctggccagcagaagcaactcgctgggcagggcgacggtcagccactacgaatgcctctccccggagcgggccgagagcctgtcctccgtgagctcccggctgcacgcgggcaaggacggcaccatgccccgcgcggggaggagcctgggccgcagcgccgggacctcgccccccagctccggggcctcgcccaaggccggccagtccaagatctccgccgtgagcagactcctcctggccagccccagagcgcacggcccgtccgcctccaccaccaaaaccctcagcttctccaccaagtccctgccgcaggcggtgggccagggctccagctcgccccccggtgggaagcacacgccctggtccacgcagtccctcagcaggaacaggagctcgggcctggcctccaagcttcccctgcgggccgtcagcgggcgcatctcggagctgctgcagggtggcgcgggcgcccggggcttgcagctgcgggccgggcccgaggcggaggcgcgcgggggggccctggccgaggacgagcccgcggccgcgcacctgctcccgtcgccctacagcaagatcacgcccccgcggaggccccaccgctgcagcagcggccacggcagcgacaacagcagcgtgctgagcggggagctcccgccggccatggggaagacggccctgttctaccacagcggcggcagcagcggctacgagagcgtgatgcgggacagcgaggccaccggcagcgcgtcctcggcgcaggactccacgagcgagaacagcagctccgtgggcggcaggtgccggagcctcaagaccccgaagaaacgctccaatccaggttctcagagacggaggcttatcccagcactatccctggacacctcttcccctgtgagaaaaccccccaacagcacaggcgtccgctgggtggatggccccttgcggagcagcccgaggggccttggggaaccctttgagattaaagtctatgaaatcgatgacgtggagcgcctgcagcggcgacgagggggtgccagcaaggaggccatgtgcttcaatgcaaagctgaagattctggaacaccgccagcagaggatcgccgaggtccgcgcgaagtacgagtggctgatgaaggagctggaggcgaccaaacagtatctgatgctggatcccaacaagtggctcagtgaatttgacttggagcaggtttgggagctggattccctggagtacctggaggcactggagtgtgtgacggagcgcctggagagccgtgtcaacttctgcaaggcccatctcatgatgatcacctgcttcgacatcacctccaggcgccggtagatgagccagacccttgtcctagtggtcccccgctccccaggacttcagagatgttgcacgcccctaggccctctgtgctggggcatcaaagacaatgaatgaggatgaaggttggtggcaagtctggagcgggcgttgagcggaaggcgagttttcttttgttttctgtaggaaaggtgcaaacgtcaaacaccgtggaaggagaaaaggatgggaagcccgaggggtgtccaagccctgtgagactgaaaaagcactttgaggaaccttaaagaccttgtttgtacataagaactgctagcaaaagagacctcactcttctcttgctttcgtgagaaaggaggggcgtggatgtaggattgctgtggaaagcgaacacaaaacaacccagaatgactgattaagtgccttgcgaatctttattattatccaaacatttatgttcatactttcttgtgtacagatggtgctagtcaagatgaaaacaacaaaacaaacaagaaaaacattttggaaatgtattcacagctctttttctcttggtgttttatcctatttctgacttgctgtttctaagtaagttgtgtttgtagagctatttcttaatcagtattgcttatgaataaatattacctgtcttttatggttattctggtgaggccactcaaacagagagacttccctcggcacgagccagtgtgtgtgtttccaaagtaggtttggagcagcaggtgacctcgatgccacatcccaacaagcagcgtggtcaggtagacccagaaggttgattgtggggcaggtgctttagagaacaggtgaggagacggcacctgcagcacaggggaggaggagtcctttgcgacctgggccctccctgctcctgggaggtgggccgtatgttctgtagaccgtttgcccccctcaagtcctccacacatgtggttccttgacccacaaatccacagtttgcgtggccctcaaaattcatattcatttttattccaaaaagtcttgaacgaaagctggaaccaattcaccagagccatatttctttctttagtattttctagtgttgtgttgtagattgattaaagtgggtttttccccagctgagagaccttctcaggcttgttcagagacttcaactgtattggattagaagaaggattcttgagactgtacatcttgtctgttgtccagagtacaaggatttcagctctcctgtgtcccaaagcctctatgccaagaagggacaggcttgtcctctcagtctttgctcctgcccaaaggcagagagagcttcccctccataactcacacgaccctggataggcagaacatagctgaagactatggatgtccaggtcttggctcccaacaactcaggacctcaaattcagatgttcctccctataacaattcccttaggaattatgatacccattttagtgttgattgatagaaacctggggtacagagtggtcaagggatttccctgataaaagctgtggtgctgatgatagtgcagcccagaatctaagagtccctgcagccttcgcatcgaggatggtacttaggcgtgtgcagagcacgcttcccttttgccctcaaatgcagcatatcttcatgagcctatttatttccaagctaggctgtctttattaaccaacaactcagccccagccactccccaagcggggaaaaaaacactacgtttcttggtcagtgtacctctggac

SEQ ID NO: 427317 - DNA, 232 bp, Homo sapiens
attatgagattaggagcccttgatctaaaggcagggagttctggaaagaggagtatagaagcctcaaggcagaagcaagctggcatgtccaatgggatagaggagcagaaggaaagctcctgcggccagagccaaagattgaggggcagagtggttggagacagaggtagggccagatcatgtgacttctttgaaagcttctgaaacttgcaaagggacctccacttcccca

SEQ ID NO: 427318 - DNA, 1701 bp, Homo sapiens
acgggattaccgagggggtgcgggatgctgatgctgaactggccaagctgggagggaagaagaaagggaggggaggggagaatcgaggacggacggcctagccaggccaagaatgcaattgccccggtggtgggagctgggagacccctgtgcttggacgggacagggtcgggggacacgcaggatgagccccgcgaccactggcacattcttgctgacagtgtacagtattttctccaaggtacactccgatcggaatgtatacccatcagcaggtgtcctctttgttcatgttttggaaagagaatattttaagggggaatttccaccttacccaaaacctggcgagattagtaatgatcccataacatttaatacaaatttaatgggttacccagaccgacctggatggcttcgatatatccaaaggacaccatatagtgatggagtcctatatgggtccccaacagctgaaaatgtggggaagccaacaatcattgagataactgcctacaacaggcgcacctttgagactgcaaggcataatttgataattaatataatgtctgcagaagacttcccgttgccatatcaagcagaattcttcattaagaatatgaatgtagaagaaatgttggccagtgaggttcttggagactttcttggcgcagtgaaaaatgtgtggcagccagagcgcctgaacgccataaacatcacatcggccctagacaggggtggcagggtgccacttcccattaatgacctgaaggagggcgtttatgtcatggttggtgcagatgtcccgttttcttcttgtttacgagaagttgaaaatccacagaatcaattgagatgtagtcaagaaatggagcctgtaataacatgtgataaaaaatttcgtactcaattttacattgactggtgcaaaatttcattggttgataaaacaaagcaagtgtccacctatcaggaagtgattcgtggagaggggattttacctgatggtggagaatacaaacccccttctgattctttgaaaagcagagactattacacggatttcctaattacactggctgtgccctcggcagtggcactggtcctttttctaatacttgcttatatcatgtgctgccgacgggaaggcgtggaaaagagaaacatgcaaacaccagacatccaactggtccatcacagtgctattcagaaatctaccaaggagcttcgagacatgtccaagaatagagagatagcatggcccctgtcaacgcttcctgtgttccaccctgtgactggggaaatcatacctcctttacacacagacaactatgatagcacaaacatgccattgatgcaaacgcagcagaacttgccacatcagactcagattccccaacagcagactacaggtaaatggtatccctgaagaaagaaaactgactgaagcaatgaatttataatcagacaatatagcagttacatcacatttcttttctcttccaataatgcatgagcttttctggcatatgttatgcatgttggcagtattaagtgtataccaaataatacaacataactttcattttactaatgtatttttttgtacttaaagcatttttgacaatttgtaaaacattgatgactttatatttgttacaataaaagttgatctttaaaataaatattattaatgaagcctaa

SEQ ID NO: 427319 - DNA, 808 bp, Homo sapiens
agaatttatttcaatcaaggccttgattcttaatctccatttttttcatttttctatgtgtttctcatcagtattccatcgctgtatgtgtactcatccaagcaatgtcataaacctggtggcaaatgctgcctggttgcatttaatagtgacaatgtcagcatttccacatcatgcaagatcccatgagcatatagtcttaatgttccaaatatcaatgctattatttaattcataaattttgttttgtttctagggaaaagagaaacatgcaaacaccagacatccaactggtccatcacagtgctattcagaaatctaccaaggagcttcgagacatgtccaagaatagagagatagcatggcccctgtcaacgcttcctgtgttccaccctgtgactggggaaatcatacctcctttacacacagacaactatgatagcacaaacatgccattgatgcaaacgcagcagaacttgccacatcagactcagattccccaacagcagactacaggtaaatggtatccctgaagaaagaaaactgactgaagcaatgaatttataatcagacaatatagcagttacatcacatttcttttctcttccaataatgcatgagcttttctggcatatgttatgcatgttggcagtattaagtgtataccaaataatacaacataactttcattttactaatgtatttttttgtacttaaagcatttttgacaatttgtaaaacattgatgactttatatttgttacaataaaagttgatctttaaaataaatattattaatgaagcctaa

SEQ ID NO: 427320 - DNA, 394 bp, Homo sapiens
  misc_feature (63)..(63): n is a, c, g, or t
tttatacagtctttcgtccctatccgcccctcacttcgcgcacagaccccgcgctaggaactncgccacatcagactctgattccccaacagcagactacaggtaaatggtatccctgaagaaagaaaactgactgaagcaatgaatttataatcagacaatatagcagttacatcacatttcttttctcttccaataatgcatgagcttttctggcatatgttatgcatgttggcagtattaagtgtataccaaataatacaacataactttcattttactaatgtatttttttgtacttaaagcatttttgacaatttgtaaaacattgatgactttatatttgttacaataaaagttgatctttaaaataaatattattaatgaagcctaa

SEQ ID NO: 427321 - DNA, 757 bp, Homo sapiens
agaatttatttcaatcaaggccttgattcttaatctccatttttttcatttttctatgtgtttctcatcagtattccatcgctgtatgtgtactcatccaagcaatgtcataaacctggtggcaaatgctgcctggttgcatttaatagtgacaatgtcagcatttccacatcatgcaagatcccatgagcatatagtcttaatgttccaaatatcaatgctattatttaattcataaattttgttttgtttctagggaaaagagaaacatgcaaacaccagagtaagtgtcttctttcctgttattttcttcatcattttttcccacctctcagttgcccatcatgctccatacatgtgtgtcaagctttttttcatttgtcatctttcatagtttatttcataaatgtgaaagctgctttctaaatagagatatttaggaggggtagaaactaaaactaaaaagggtttgaaaactaagattacacagataaaaattaaacctaaaatatttcagattcagaatattaacttaccatttatattatgtgatttccaatctgcatttctataaaccagagaacagatgaaaagacctttcatacaagttttccagaatctacagtaataacctaccataaaatgaaacttctgtgagtatttataaatgccccaccagaagcaaaaatataaaagctatggtagttttatcttaaatcatagaaaataaatagaaaactagttggttacttaggac

SEQ ID NO: 427322 - DNA, 995 bp, Homo sapiens
tctcgactagagatcccctcggtctacttgtctagggtgcacgttcctcattacgacctgaaggagggcgtttatgtcatggttggtgcagatgtcccgttttcttcttgtttacgagaagttgaaaatccacagaatcaattgagatgtagtcaagaaatggagcctgtaataacatgtgataaaaaatttcgtactcaattttacattgactggtgcaaaatttcattggttgataaaacaaagcaagtgtccacctatcaggaagtgattcgtggagaggggattttacctgatggtggagaatacaaacccccttctgattctttgaaaagcagagactattacacggatttcctaattacactggctgtgccctcggcagtggcactggtcctttttctaatacttgcttatatcatgtgctgccgacgggaaggcgtggaaaagagaaacatgcaaacaccagacatccaactggtccatcacagtgctattcagaaatctaccaaggagcttcgagacatgtccaagaatagagagatagcatggcccctgtcaacgcttcctgtgttccaccctgtgactggggaaatcatacctcctttacacacagacaactatgatagcacaaacatgccattgatgcaaacgcagcagaacttgccacatcagactcagattccccaacagcagactacaggtaaatggtatccctgaagaaagaaaactgactgaagcaatgaatttataatcagacaatatagcagttacatcacatttcttttctcttccaataatgcatgagcttttctggcatatgttatgcatgttggcagtattaagtgtataccaaataatacaacataactttcattttactaatgtatttttttgtacttaaagcatttttgacaatttgtaaaacattgatgactttatatttgttacaataaaagttgatctttaaaataaatattattaatgaagcctaa

SEQ ID NO: 427323 - DNA, 1735 bp, Homo sapiens
acgggattaccgagggggtgcgggatgctgatgctgaactggccaagctgggagggaagaagaaagggaggggaggggagaatcgaggacggacggcctagccaggccaagaatgcaattgccccggtggtgggagctgggagacccctgtgcttggacgggacagggtcgggggacacgcaggatgagccccgcgaccactggcacattcttgctgacagtgtacagtattttctccaaggtacactccgatcggaatgtatacccatcagcaggtgtcctctttgttcatgttttggaaagagaatattttaagggggaatttccaccttacccaaaacctggcgagattagtaatgatcccataacatttaatacaaatttaatgggttacccagaccgacctggatggcttcgatatatccaaaggacaccatatagtgatggagtcctatatgggtccccaacagctgaaaatgtggggaagccaacaatcattgagataactgcctacaacaggcgcacctttgagactgcaaggcataatttgataattaatataatgtctgcagaagacttcccgttgccatatcaagcagaattcttcattaagaatatgaatgtagaagaaatgttggccagtgaggttcttggagactttcttggcgcagtgaaaaatgtgtggcagccagagcgcctgaacgccataaacatcacatcggccctagacaggggtggcagggtgccacttcccattaatgacctgaaggagggcgtttatgtcatggttggtgcagatgtcccgttttcttcttgtttacgagaagttgaaaatccacagaatcaattgagatgtagtcaagaaatggagcctgtaataacatgtgataaaaaatttcgtactcaattttacattgactggtgcaaaatttcattggttgataaaacaaagcaagtgtccacctatcaggaagtgattcgtggagaggggattttacctgatggtggagaatacaaacccccttctgattctttgaaaagcagagactattacacggatttcctaattacactggctgtgccctcggcagtggcactggtcctttttctaatacttgcttatatcatgtgctgccgacgggaaggcgtggaaaagagaaacatgcaaacaccagacatccaactggtccatcacagtgctattcagaaatctaccaaggagcttcgagacatgtccaagaatagagagatagcatggcccctgtcaacgcttcctgtgttccaccctgtgactggggaaatcatacctcctttacacacagacaactatgatagcacaaacatgccattgatgcaaacgcagcagaacttgccacatcagactcagattccccaacagcagactacaggtaaatggtatccctgaagaaagaaaactgactgaagcaatgaatttataatcagacaatatagcagttacatcacatttcttttctcttccaataatgcatgagcttttctggcatatgttatgcatgttggcagtattaagtgtataccaaataatacaacataactttcattttactaatgtatttttttgtacttaaagcatttttgacaatttgtaaaacattgatgactttatattgtaacaaatataaagtcatcaatgttttacaaattgttacaataaaagttgatctttaaaataaatattattaatgaagcctaa

SEQ ID NO: 427324 - DNA, 1776 bp, Homo sapiens
acgggattaccgagggggtgcgggatgctgatgctgaactggccaagctgggagggaagaagaaagggaggggaggggagaatcgaggacggacggcctagccaggccaagaatgcaattgccccggtggtgggagctgggagacccctgtgcttggacgggacagggtcgggggacacgcaggatgagccccgcgaccactggcacattcttgctgacagtgtacagtattttctccaaggtacactccgatcggaatgtatacccatcagcaggtgtcctctttgttcatgttttggaaagagaatattttaagggggaatttccaccttacccaaaacctggcgagattagtaatgatcccataacatttaatacaaatttaatgggttacccagaccgacctggatggcttcgatatatccaaaggacaccatatagtgatggagtcctatatgggtccccaacagctgaaaatgtggggaagccaacaatcattgagataactgcctacaacaggcgcacctttgagactgcaaggcataatttgataattaatataatgtctgcagaagacttcccgttgccatatcaagcagaattcttcattaagaatatgaatgtagaagaaatgttggccagtgaggttcttggagactttcttggcgcagtgaaaaatgtgtggcagccagagcgcctgaacgccataaacatcacatcggccctagacaggggtggcagggtgccacttcccattaatgacctgaaggagggcgtttatgtcatggttggtgcagatgtcccgttttcttcttgtttacgagaagttgaaaatccacagaatcaattgagatgtagtcaagaaatggagcctgtaataacatgtgataaaaaatttcgtactcaattttacattgactggtgcaaaatttcattggttgataaaacaaagcaagtgtccacctatcaggaagtgattcgtggagaggggattttacctgatggtggagaatacaaacccccttctgattctttgaaaagcagagactattacacggatttcctaattacactggctgtgccctcggcagtggcactggtcctttttctaatacttgcttatatcatgtgctgccgacgggaaggcgtggaaaagagaaacatgcaaacaccagacatccaactggtccatcacagtgctattcagaaatctaccaaggagcttcgagacatgtccaagaatagagagatagcatggcccctgtcaacgcttcctgtgttccaccctgtgactggggaaatcatacctcctttacacacagacaactatgatagcacaaacatgccattgatgcaaacgcagcaatggagtttcgctcctgttgcccaggctggagtgcaatggagcgatcttggctcactgcagcctccgcctcccaggaacttgccacatcagactcagattccccaacagcagactacaggtaaatggtatccctgaagaaagaaaactgactgaagcaatgaatttataatcagacaatatagcagttacatcacatttcttttctcttccaataatgcatgagcttttctggcatatgttatgcatgttggcagtattaagtgtataccaaataatacaacataactttcattttactaatgtatttttttgtacttaaagcatttttgacaatttgtaaaacattgatgactttatatttgttacaataaaagttgatctttaaaataaatattattaatgaagcctaa

SEQ ID NO: 427325 - DNA, 1736 bp, Homo sapiens
acgggattaccgagggggtgcgggatgctgatgctgaactggccaagctgggagggaagaagaaagggaggggaggggagaatcgaggacggacggcctagccaggccaagaatgcaattgccccggtggtgggagctgggagacccctgtgcttggacgggacagggtcgggggacacgcaggatgagccccgcgaccactggcacattcttgctgacagtgtacagtattttctccaaggtacactccgatcggaatgtatacccatcagcaggtgtcctctttgttcatgttttggaaagagaatattttaagggggaatttccaccttacccaaaacctggcgagattagtaatgatcccataacatttaatacaaatttaatgggttacccagaccgacctggatggcttcgatatatccaaaggacaccatatagtgatggagtcctatatgggtccccaacagctgaaaatgtggggaagccaacaatcattgagataactgcctacaacaggcgcacctttgagactgcaaggcataatttgataattaatataatgtctgcagaagacttcccgttgccatatcaagcagaattcttcattaagaatatgaatgtagaagaaatgttggccagtgaggttcttggagactttcttggcgcagtgaaaaatgtgtggcagccagagcgcctgaacgccataaacatcacatcggccctagacaggggtggcagggtgccacttcccattaatgacctgaaggagggcgtttatgtcatggttggtgcagatgtcccgttttcttcttgtttacgagaagttgaaaatccacagaatcaattgagatgtagtcaagaaatggagcctgtaataacatgtgataaaaaatttcgtactcaattttacattgactggtgcaaaatttcattggttgataaaacaaagcaagtgtccacctatcaggaagtgattcgtggagaggggattttacctgatggtggagaatacaaacccccttctgattctttgaaaagcagagactattacacggatttcctaattacactggctgtgccctcggcagtggcactggtcctttttctaatacttgcttatatcatgtgctgccgacgggaaggcgtggaaaagagaaacatgcaaacaccagacatccaactggtccatcacagtgctattcagaaatctaccaaggagcttcgagacatgtccaagaatagagagatagcatggcccctgtcaacgcttcctgtgttccaccctgtgactggggaaatcatacctcctttacacacagacaactatgatagcacaaacatgccattgatgcaaacgcagcagaacttgccacatcagactcagattccccaacagcagactacaggagattttcgtttgacaacttttcaaagatttgaggtaaatggtatccctgaagaaagaaaactgactgaagcaatgaatttataatcagacaatatagcagttacatcacatttcttttctcttccaataatgcatgagcttttctggcatatgttatgcatgttggcagtattaagtgtataccaaataatacaacataactttcattttactaatgtatttttttgtacttaaagcatttttgacaatttgtaaaacattgatgactttatatttgttacaataaaagttgatctttaaaataaatattattaatgaagcctaa

SEQ ID NO: 427326 - DNA, 1170 bp, Homo sapiens
acgggattaccgagggggtgcgggatgctgatgctgaactggccaagctgggagggaagaagaaagggaggggaggggagaatcgaggacggacggcctagccaggccaagaatgcaattgccccggtggtgggagctgggagacccctgtgcttggacgggacagggtcgggggacacgcaggatgagccccgcgaccactggcacattcttgctgacagtgtacagtattttctccaaggtacactccgatcggaatgtatacccatcagcaggtgtcctctttgttcatgttttggaaagagaatattttaagggggaatttccaccttacccaaaacctggcgagattagtaatgatcccataacatttaatacaaatttaatgggttacccagaccgacctggatggcttcgatatatccaaaggacaccatatagtgatggagtcctatatgggtccccaacagctgaaaatgtggggaagccaacaatcattgagataactgcctacaacaggcgcacctttgagactgcaaggcataatttgataattaatataatgtctgcagaagacttcccgttgccatatcaagcagaattcttcattaagaatatgaatgtagaagaaatgttggccagtgaggttcttggagactttcttggcgcagtgaaaaatgtgtggcagccagagcgcctgaacgccataaacatcacatcggccctagacaggggtggcagggtgccacttcccattaatgacctgaaggagggcgtttatgtcatggttggtgcagatgtcccgttttcttcttgtttacgagaagttgaaaatccacagaatcaattgagatgtagtcaagaaatggagcctgtaataacatgtgataaaaaatttcgtactcaattttacattgactggtgcaaaatttcattggttgataaaacaaagcaagtgtccacctatcaggaagtgattcgtggagaggggattttacctgatggtggagaatacaaacccccttctgattctttgaaaagcagagactattacacggatttcctaattacactggctgtgccctcggcagtggcactggtcctttttctaatacttgcttatatcatgtgctgccgacgggaaggcgtgtgagtactttaaaactaata

SEQ ID NO: 427327 - DNA, 699 bp, Homo sapiens
tattaaaagtatgtgagatgtatgcctttctgaaatagtttattgaatgcccaaagtgccataatgtcttattattttaaaagataaaaatacttcataagtttttcaaattgatgacccatcaggctaatatatgattttaaatatatgttgttttatttctttttgacctagcatccaactggtccatcacagtgctattcagaaatctaccaaggagcttcgagacatgtccaagaatagagagatagcatggcccctgtcaacgcttcctgtgttccaccctgtgactggggaaatcatacctcctttacacacagacaactatgatagcacaaacatgccattgatgcaaacgcagcagaacttgccacatcagactcagattccccaacagcagactacaggtaaatggtatccctgaagaaagaaaactgactgaagcaatgaatttataatcagacaatatagcagttacatcacatttcttttctcttccaataatgcatgagcttttctggcatatgttatgcatgttggcagtattaagtgtataccaaataatacaacataactttcattttactaatgtatttttttgtacttaaagcatttttgacaatttgtaaaacattgatgactttatatttgttacaataaaagttgatctttaaaataaatattattaatgaagcctaa

SEQ ID NO: 427328 - DNA, 838 bp, Homo sapiens
tcatttagttccttgttttcttttaaattcctatcaaagctttaagaaatgaactagctgctggtgttgtgttcctggacttgagcactagctgggataatagagcagttaaaagctgacaattgcactaacttttggactaggcccaaaccattaggtttgatgccccttcaggttttctcattttctctgccctaccagcccacatgatatttttttaaaagccacgattaaaaggtacagttatacatcctgcagttaacctccattctttttgtttattgtgggaggaattttcagactgtacctcttgggaaatacaaaatattatagctttggtccaagaaggagaagactaatttagaattttttcttttgttttctgttttttaaaaaaaccaaatacagagaaataatgcaatgtaattattttacattgtattaagaagatggaaactttctccttgccataatttgctttgctcaaaatctaaaagtatccatgccctgactaactcctgcccatattcattcttacacattgcagtaaatggtatccctgaagaaagaaaactgactgaagcaatgaatttataatcagacaatatagcagttacatcacatttcttttctcttccaataatgcatgagcttttctggcatatgttatgcatgttggcagtattaagtgtataccaaataatacaacataactttcattttactaatgtatttttttgtacttaaagcatttttgacaatttgtaaaacattgatgactttatatttgttacaataaaagttgatctttaaaataaatattattaatgaagcctaa

SEQ ID NO: 427329 - DNA, 391 bp, Homo sapiens
  misc_feature (60)..(60): n is a, c, g, or t
gtgtctgtcctccagtctacggctgaggacaaagatgattaagcggggtttgaggaactncgccacatcagactctgattccccaacagcagactacaggtaaatggtatccctgaagaaagaaaactgactgaagcaatgaatttataatcagacaatatagcagttacatcacatttcttttctcttccaataatgcatgagcttttctggcatatgttatgcatgttggcagtattaagtgtataccaaataatacaacataactttcattttactaatgtatttttttgtacttaaagcatttttgacaatttgtaaaacattgatgactttatatttgttacaataaaagttgatctttaaaataaatattattaatgaagcctaa

SEQ ID NO: 427330 - DNA, 754 bp, Homo sapiens
agaatttatttcaatcaaggccttgattcttaatctccatttttttcatttttctatgtgtttctcatcagtattccatcgctgtatgtgtactcatccaagcaatgtcataaacctggtggcaaatgctgcctggttgcatttaatagtgacaatgtcagcatttccacatcatgcaagatcccatgagcatatagtcttaatgttccaaatatcaatgctattatttaattcataaattttgttttgtttctagggaaaagagaaacatgcaaacaccagacatccaactggtccatcacagtgctattcagaaatctaccaaggagcttcgagacatgtccaagaatagagagatagcatggcccctgtcaacgcttcctgtgttccaccctgtgactggggaaatcatacctcctttacacacagacaactatgatagcacaaacatgccattgatgcaaacgcagcagaacttgccacatcagactcagattccccaacagcagactacaggtgagtgctaagaataataaatttttcttttctcttccaataatgcatgagcttttctggcatatgttatgcatgttggcagtattaagtgtataccaaataatacaacataactttcattttactaatgtatttttttgtacttaaagcatttttgacaatttgtaaaacattgatgactttatatttgttacaataaaagttgatctttaaaataaatattattaatgaagcctaa

SEQ ID NO: 427331 - DNA, 1871 bp, Homo sapiens
acgggattaccgagggggtgcgggatgctgatgctgaactggccaagctgggagggaagaagaaagggaggggaggggagaatcgaggacggacggcctagccaggccaagaatgcaattgccccggtggtgggagctgggagacccctgtgcttggacgggacagggtcgggggacacgcaggatgagccccgcgaccactggcacattcttgctgacagtggaatatgaaagagacaaatgaagtagtggacagagaaagacttgacagtttgcttttaagcttttttattaagctgtgctgatggcataaatggaacagttaactggaagaccagacaggccaacaattttattatcagcagaaaaatggctgctgggatgaaagatgtgtacagtattttctccaaggtacactccgatcggaatgtatacccatcagcaggtgtcctctttgttcatgttttggaaagagaatattttaagggggaatttccaccttacccaaaacctggcgagattagtaatgatcccataacatttaatacaaatttaatgggttacccagaccgacctggatggcttcgatatatccaaaggacaccatatagtgatggagtcctatatgggtccccaacagctgaaaatgtggggaagccaacaatcattgagataactgcctacaacaggcgcacctttgagactgcaaggcataatttgataattaatataatgtctgcagaagacttcccgttgccatatcaagcagaattcttcattaagaatatgaatgtagaagaaatgttggccagtgaggttcttggagactttcttggcgcagtgaaaaatgtgtggcagccagagcgcctgaacgccataaacatcacatcggccctagacaggggtggcagggtgccacttcccattaatgacctgaaggagggcgtttatgtcatggttggtgcagatgtcccgttttcttcttgtttacgagaagttgaaaatccacagaatcaattgagatgtagtcaagaaatggagcctgtaataacatgtgataaaaaatttcgtactcaattttacattgactggtgcaaaatttcattggttgataaaacaaagcaagtgtccacctatcaggaagtgattcgtggagaggggattttacctgatggtggagaatacaaacccccttctgattctttgaaaagcagagactattacacggatttcctaattacactggctgtgccctcggcagtggcactggtcctttttctaatacttgcttatatcatgtgctgccgacgggaaggcgtggaaaagagaaacatgcaaacaccagacatccaactggtccatcacagtgctattcagaaatctaccaaggagcttcgagacatgtccaagaatagagagatagcatggcccctgtcaacgcttcctgtgttccaccctgtgactggggaaatcatacctcctttacacacagacaactatgatagcacaaacatgccattgatgcaaacgcagcagaacttgccacatcagactcagattccccaacagcagactacaggtaaatggtatccctgaagaaagaaaactgactgaagcaatgaatttataatcagacaatatagcagttacatcacatttcttttctcttccaataatgcatgagcttttctggcatatgttatgcatgttggcagtattaagtgtataccaaataatacaacataactttcattttactaatgtatttttttgtacttaaagcatttttgacaatttgtaaaacattgatgactttatatttgttacaataaaagttgatctttaaaataaatattattaatgaagcctaa

SEQ ID NO: 427332 - DNA, 1756 bp, Homo sapiens
acgggattaccgagggggtgcgggatgctgatgctgaactggccaagctgggagggaagaagaaagggaggggaggggagaatcgaggacggacggcctagccaggccaagaatgcaattgccccggtggtgggagctgggagacccctgtgcttggacgggacagggtcgggggacacgcaggatgagccccgcgaccactggcacattcttgctgacagtgtacagtattttctccaaggtacactccgatcggaatgtatacccatcagcaggtgtcctctttgttcatgttttggaaagagaatattttaagggggaatttccaccttacccaaaacctggcgagattagtaatgatcccataacatttaatacaaatttaatgggttacccagaccgacctggatggcttcgatatatccaaaggacaccatatagtgatggagtcctatatgggtccccaacagctgaaaatgtggggaagccaacaatcattgagataactgcctacaacaggcgcacctttgagactgcaaggcataatttgataattaatataatgtctgcagaagacttcccgttgccatatcaagcagaattcttcattaagaatatgaatgtagaagaaatgttggccagtgaggttcttggagactttcttggcgcagtgaaaaatgtgtggcagccagagcgcctgaacgccataaacatcacatcggccctagacaggggtggcagggtgccacttcccattaatgacctgaaggagggcgtttatgtcatggttggtgcagatgtcccgttttcttcttgtttacgagaagttgaaaatccacagaatcaattgagatgtagtcaagaaatggagcctgtaataacatgtgataaaaaatttcgtactcaattttacattgactggtgcaaaatttcattggttgataaaacaaagcaagtgtccacctatcaggaagtgattcgtggagaggggattttacctgatggtggagaatacaaacccccttctgattctttgaaaagcagagactattacacggatttcctaattacactggctgtgccctcggcagtggcactggtcctttttctaatacttgcttatatcatgtgctgccgacgggaaggcgtggaaaagagaaacatgcaaacaccagacatccaactggtccatcacagtgctattcagaaatctaccaaggagcttcgagacatgtccaagaatagagagatagcatggcccctgtcaacgcttcctgtgttccaccctgtgactggggaaatcatacctcctttacacacagacaactatgatagcacaaacatgccattgatgcaaacgcagcagaacttgccacatcagactcagattccccaacagcagactacaggtaaatggtatccctgaagaaagaaaactgactgaagcaatgaatttataatcagacaatatagcagttacatcacatttcttttctcttccaataatgcatgagcttttctggcatatgttatgcatgttggcagtattaagtgtataccaaataatacaacataactttcattttactaatgtatttttttgtacttaaagcatttttgacaatttgtaaaacattgatgactttatatttgttacaataaaagttgatctttaaaataaatattattaatgaagcctaaaaacaacaccaacacgaaaacaaaaaagaagggggggggcgcccgaaaaaccccc

SEQ ID NO: 427333 - DNA, 1674 bp, Homo sapiens
acgggattaccgagggggtgcgggatgctgatgctgaactggccaagctgggagggaagaagaaagggaggggaggggagaatcgaggacggacggcctagccaggccaagaatgcaattgccccggtggtgggagctgggagacccctgtgcttggacgggacagggtcgggggacacgcaggatgagccccgcgaccactggcacattcttgctgacagtgtacagtattttctccaaggtacactccgatcggaatgtatacccatcagcaggtgtcctctttgttcatgttttggaaagagaatattttaagggggaatttccaccttacccaaaacctggcgagattagtaatgatcccataacatttaatacaaatttaatgggttacccagaccgacctggatggcttcgatatatccaaaggacaccatatagtgatggagtcctatatgggtccccaacagctgaaaatgtggggaagccaacaatcattgagataactgcctacaacaggcgcacctttgagactgcaaggcataatttgataattaatataatgtctgcagaagacttcccgttgccatatcaagcagaattcttcattaagaatatgaatgtagaagaaatgttggccagtgaggttcttggagactttcttggcgcagtgaaaaatgtgtggcagccagagcgcctgaacgccataaacatcacatcggccctagacaggggtggcagggtgccacttcccattaatgacctgaaggagggcgtttatgtcatggttggtgcagatgtcccgttttcttcttgtttacgagaagttgaaaatccacagaatcaattgagatgtagtcaagaaatggagcctgtaataacatgtgataaaaaatttcgtactcaattttacattgactggtgcaaaatttcattggttgataaaacaaagcaagtgtccacctatcaggaagtgattcgtggagaggggattttacctgatggtggagaatacaaacccccttctgattctttgaaaagcagagactattacacggatttcctaattacactggctgtgccctcggcagtggcactggtcctttttctaatacttgcttatatcatgtgctgccgacgggaaggcgtcatccaactggtccatcacagtgctattcagaaatctaccaaggagcttcgagacatgtccaagaatagagagatagcatggcccctgtcaacgcttcctgtgttccaccctgtgactggggaaatcatacctcctttacacacagacaactatgatagcacaaacatgccattgatgcaaacgcagcagaacttgccacatcagactcagattccccaacagcagactacaggtaaatggtatccctgaagaaagaaaactgactgaagcaatgaatttataatcagacaatatagcagttacatcacatttcttttctcttccaataatgcatgagcttttctggcatatgttatgcatgttggcagtattaagtgtataccaaataatacaacataactttcattttactaatgtatttttttgtacttaaagcatttttgacaatttgtaaaacattgatgactttatatttgttacaataaaagttgatctttaaaataaatattattaatgaagcctaa

SEQ ID NO: 427334 - DNA, 1468 bp, Homo sapiens
acgggattaccgagggggtgcgggatgctgatgctgaactggccaagctgggagggaagaagaaagggaggggaggggagaatcgaggacggacggcctagccaggccaagaatgcaattgccccggtggtgggagctgggagacccctgtgcttggacgggacagggtcgggggacacgcaggatgagccccgcgaccactggcacattcttgctgacagtgtacagtattttctccaaggtacactccgatcggaatgtatacccatcagcaggtgtcctctttgttcatgttttggaaagagaatattttaagggggaatttccaccttacccaaaacctggcgagattagtaatgatcccataacatttaatacaaatttaatgggttacccagaccgacctggatggcttcgatatatccaaaggacaccatatagtgatggagtcctatatgggtccccaacagctgaaaatgtggggaagccaacaatcattgagataactgcctacaacaggcgcacctttgagactgcaaggcataatttgataattaatataatgtctgcagaagacttcccgttgccatatcaagcagaattcttcattaagaatatgaatgtagaagaaatgttggccagtgaggttcttggagactttcttggcgcagtgaaaaatgtgtggcagccagagcgcctgaacgccataaacatcacatcggccctagacaggggtggcagggtgccacttcccattaatgacctgaaggagggcgtttatgtcatggttggtgcagatgtcccgttttcttcttgtttacgagaagttgaaaatccacagaatcaattgagatgtagtcaagaaatggagcctgtaataacatgtgataaaaaatttcgtactcaattttacattgactggtgcaaaatttcattggttgataaaacaaagcaagtgtccacctatcaggaagtgattcgtggagaggggattttacctgatggtggagaatacaaacccccttctgattctttgaaaagcagagactattacacggatttcctaattacactggctgtgccctcggcagtggcactggtcctttttctaatacttgcttatatcatgtgctgccgacgggaaggcgtggaaaagagaaacatgcaaacaccagagtaaatggtatccctgaagaaagaaaactgactgaagcaatgaatttataatcagacaatatagcagttacatcacatttcttttctcttccaataatgcatgagcttttctggcatatgttatgcatgttggcagtattaagtgtataccaaataatacaacataactttcattttactaatgtatttttttgtacttaaagcatttttgacaatttgtaaaacattgatgactttatatttgttacaataaaagttgatctttaaaataaatattattaatgaagcctaa

SEQ ID NO: 427335 - DNA, 1159 bp, Homo sapiens
  misc_feature (1103)..(1103): n is a, c, g, or t
  misc_feature (1134)..(1134): n is a, c, g, or t
  misc_feature (1147)..(1147): n is a, c, g, or t
acgggattaccgagggggtgcgggatgctgatgctgaactggccaagctgggagggaagaagaaagggaggggaggggagaatcgaggacggacggcctagccaggccaagaatgcaattgccccggtggtgggagctgggagacccctgtgcttggacgggacagggtcgggggacacgcaggatgagccccgcgaccactggcacattcttgctgacagtgtacagtattttctccaaggtacactccgatcggaatgtatacccatcagcaggtgtcctctttgttcatgttttggaaagagaatattttaagggggaatttccaccttacccaaaacctggcgagattagtaatgatcccataacatttaatacaaatttaatgggttacccagaccgacctggatggcttcgatatatccaaaggacaccatatagtgatggagtcctatatgggtccccaacagctgaaaatgtggggaagccaacaatcattgagataactgcctacaacaggcgcacctttgagactgcaaggcataatttgataattaatataatgtctgcagaagacttcccgttgccatatcaagcagaattcttcattaagaatatgaatgtagaagaaatgttggccagtgaggttcttggagactttcttggcgcagtgaaaaatgtgtggcagccagagcgcctgaacgccataaacatcacatcggccctagacaggggtggcagggtgccacttcccattaatgacctgaaggagggcgtttatgtcatggttggtgcagatgtcccgttttcttcttgtttacgagaagttgaaaatccacagaatcaattgagatgtagtcaagaaatggagcctgtaataacatgtgataaaaaatttcgtactcaattttacattgactggtgcaaaatttcattggttgataaaacaaagcaagtgtccacctatcaggaagtgattcgtggagaggggattttacctgatggtggagaatacaaacccccttctgattctttgaaaagcagagactattacacggatttcctaattacactggctgtgccctcgggggggggggggggcngggggggaaaacgggcgggggcgggggcggnggggcgggggggngggggggggggg

SEQ ID NO: 427336 - DNA, 563 bp, Homo sapiens
taacttatctgggtgcccatctggtttaaattgctcattttacattaatttaacaataatagctgttggtggtcatgttttccccaggagaagaagttgacagacagctgtgcagagatgccatcttccccatccctgtggcctgtgatgccccatgcccgaaagactgtgtgctcagcacatggtctacgtggtcctcctgctcacacacctgctcagggaaaacgacagaagggaaacagatacgagcacgatccattctggcctatgcgggtgaagaaggtgagtcgccagcttcagacgccatctaggttcgtttcaaaagttagtgtgcatcttttttgtgtagcctggaaaagatgatattctatgaaagtcaacaaccagaaattcagccatccaagatttaatatctgttgatgtgttgagcaatttgattctgtcccccaaaattaatcttgaaaatggatctctaacaaaggagaaagactttttaaaagtgaactcattttgtttttcctaccaccttaatatatatttaactctttgctccaaaaaaaaaa

SEQ ID NO: 427337 - DNA, 2245 bp, Homo sapiens
gtccggaaattcccgggtcgactacaacaactaaattcgcgaccgtgtcgacattcatcaataactaatccaatatgtggacagtaatcttaatttcaaagccttttttgaggatactacggtgtagcttaagtgaatttaaaaagagtgcataaaagcttgtttttaattacttataacaaagcacaaattacttctaacaaggcaaatatttattgacatataagacattctgctaggcattgtaaaaaaaaaaaaaaaaaagtaatggcttttgtatacataggtacttaagacagacatccaaaagaaggaaaaaatgcttaatgagtgaagatagcactgaaacatgttgacttttactctaggtttgtttttagatggggttagtattttcccctacgtaatgtacatgtctttaggccacagtattaggagtttgatttttccctgccccaccctcaggtaggtggcagtggtcattgtagcttaatcagacccctgttaagttcctgggcatttcaaggtaaattcacgtcttccttctcacagaaattgaatagacctctcacacacttatttacctcccccaacaacctgtatccttggccctttctgattttctctgcttggtctctttctactcttgacagctattcttacctacttcccactaaacatgcccaattttttaattaaaaaaaaaagaattcctatatttccttccctattagaatcaaagtgtcactcactcagagtgtgaacatcctgatttacaccaaatccactggtcaaagaaatgaataaagggaaaaggaaaaatgtggaaggcatgcagggaaaaaaaaaaaaaaaaaagcccttttctgtaaaaatgtccatgcctacacttgctttagaccatcccatatcctcctgcctccatctcgagtctttgttcacattccacaccacaagacagtgagggaggactgtacttttcagtaccatacagaagggagagcctgttctaaagctgacgtgggtctcaatagtacatgagaagcacaattcccaaatgatctgggatctcctgtttataaatatattaccaaattcaagtgtgggttcttcttctatttccactgtaagattgagggtgttgaaaaaacagtagtccttgagcaaatctgtgaggaatcttgtcagaatgtgatctttcctgggactagtttagttgtgagaactacatctgcttgttctgggaataagggtctccccaggtcctgccctcaggtggccctggctgcaggacaggatttcaggtatcagaaactggtgtgtgagccaagcaaatagttatccatttataaaaaggatggtttgcagtgtgttataataattttatatctagcagggacaatgaaaaatggttatgtctacattattaaatgaatgaaactaatgctaaacagttaattttgcatttttatttttctgtgtttctaccaagtcagatcttaaaaatgggcagtatatgaagagctttagtttgtgggagtcatgttttcagtgatcaaaaatctctatattatttagaatataattgtcagtcttgttgtgttttgtagatttattgtttttaagccatagtttctagattacctacttttaaccctcaagtaaacttttccctatttttcagaaatctgtttgtgtttatttttagaaagtaaacatttagattccttttctggtactttttttctccatttctatcacacagatttgaagagatcagtatctatcattgtaaaatataactttattaaaatttgcaatctgtctttctataaattattattccctaaatgtgtattttatgttaatttaactacctgaatatttattttgtttaaataaggaggcagctgtctaagaatttttgttaatattactttgtaaattgcgtaatgtaatttattttacattatgtacatttcctttttaacgcacaaaatgtctatgtacaattaactacagatttgcaaataatgtcactaagctttattcagtcaatacagatggcatgtgaagatgtaatatgcttttttacattttcatatgggttatttgtaaataactatattgctgacaaacataaatacggaaatcattttcattctaatcatgtgtatctgtgttttgatttgcaccaattgcttcttaaatatggattaaaatttttttccagtgaatacctaaa

SEQ ID NO: 427338 - DNA, 9317 bp, Homo sapiens
  misc_feature (6468)..(6468): n is a, c, g, or t
gagtggagcccctgctcaaaaacatgccatgacatggtgtcccctgcaggcactcgtgtaaggacacgaaccatcaggcagtttcccattggcagtgaaaaggagtgtccagaatttgaagaaaaagaaccctgtttgtctcaaggagatggagttgtcccctgtgccacgtatggctggagaactacagagtggactgagtgccgtgtggaccctttgctcagtcagcaggacaagaggcgcggcaaccagacggccctctgtggagggggcatccagacccgagaggtgtactgcgtgcaggccaacgaaaacctcctctcacaattaagtacccacaagaacaaagaagcctcaaagccaatggacttaaaattatgcactggacctatccctaatactacacagctgtgccacattccttgtccaactgaatgtgaagtttcaccttggtcagcttggggaccttgtacttatgaaaactgtaatgatcagcaagggaaaaaaggcttcaaactgaggaagcggcgcattaccaatgagcccactggaggctctggggtaaccggaaactgccctcacttactggaagccattccctgtgaagagcctgcctgttatgactggaaagcggtgagactgggagactgcgagccagataacggaaaggagtgtggtccaggcacgcaagttcaagaggttgtgtgcatcaacagtgatggagaagaagttgacagacagctgtgcagagatgccatcttccccatccctgtggcctgtgatgccccatgcccgaaagactgtgtgctcagcacatggtctacgtggtcctcctgctcacacacctgctcagggaaaacgacagaagggaaacagatacgagcacgatccattctggcctatgcgggtgaagaaggtggaattcgctgtccaaatagcagtgctttgcaagaagtacgaagctgtaatgagcatccttgcacagtgtaccactggcaaactggtccctggggccagtgcattgaggacacctcagtatcgtccttcaacacaactacgacttggaatggggaggcctcctgctctgtcggcatgcagacaagaaaagtcatctgtgtgcgagtcaatgtgggccaagtgggacccaaaaaatgtcctgaaagccttcgacctgaaactgtaaggccttgtctgcttccttgtaagaaggactgtattgtgaccccatatagtgactggacatcatgcccctcttcgtgtaaagaaggggactccagtatcaggaagcagtctaggcatcgggtcatcattcagctgccagccaacgggggccgagactgcacagatcccctctatgaagagaaggcctgtgaggcacctcaagcgtgccaaagctacaggtggaagactcacaaatggcgcagatgccaattagtcccttggagcgtgcaacaagacagccctggagcacaggaaggctgtgggcctgggcgacaggcaagagccattacttgtcgcaagcaagatggaggacaggctggaatccatgagtgcctacagtatgcaggccctgtgccagcccttacccaggcctgccagatcccctgccaggatgactgtcaattgaccagctggtccaagttttcttcatgcaatggagactgtggtgcagttaggaccagaaagcgcactcttgttggaaaaagtaaaaagaaggaaaaatgtaaaaattcccatttgtatcccctgattgagactcagtattgtccttgtgacaaatataatgcacaacctgtggggaactggtcagactgtattttaccagagggaaaagtggaagtgttgctgggaatgaaagtacaaggagacatcaaggaatgcggacaaggatatcgttaccaagcaatggcatgctacgatcaaaatggcaggcttgtggaaacatctagatgtaacagccatggttacattgaggaggcctgcatcatcccctgcccctcagactgcaagctcagtgagtggtccaactggtcgcgctgcagcaagtcctgtgggagtggtgtgaaggttcgttctaaatggctgcgtgaaaaaccatataatggaggaaggccttgccccaaactggaccatgtcaaccaggcacaggtgtatgaggttgtcccatgccacagtgactgcaaccagtacctatgggtcacagagccctggagcatctgcaaggtgacctttgtgaatatgcgggagaactgtggagagggcgtgcaaacccgaaaagtgagatgcatgcagaatacagcagatggcccttctgaacatgtagaggattacctctgtgacccagaagagatgcccctgggctctagagtgtgcaaattaccatgccctgaggactgtgtgatatctgaatggggtccatggacccaatgtgttttgccttgcaatcaaagcagtttccggcaaaggtcagctgatcccatcagacaaccagctgatgaaggaagatcttgccctaatgctgttgagaaagaaccctgtaacctgaacaaaaactgctaccactatgattataatgtaacagactggagtacatgtcagctgagtgagaaggcagtttgtggaaatggaataaaaacaaggatgttggattgtgttcgaagtgatggcaagtcagttgacctgaaatattgtgaagcgcttggcttggagaagaactggcagatgaacacgtcctgcatggtggaatgccctgtgaactgtcagctttctgattggtctccttggtcagaatgttctcaaacatgtggcctcacaggaaaaatgatccgaagacgaacagtgacccagccctttcaaggtgatggaagaccatgcccttccctgatggaccagtccaaaccctgcccagtgaagccttgttatcggtggcaatatggccagtggtctccatgccaagtgcaggaggcccagtgtggagaagggaccagaacaaggaacatttcttgtgtagtaagtgatgggtcagctgatgatttcagcaaagtggtggatgaggaattctgtgctgacattgaactcattatagatggtaataaaaatatggttctggaggaatcctgcagccagccttgcccaggtgactgttatttgaaggactggtcttcctggagcctgtgtcagctgacctgtgtgaatggtgaggatctaggctttggtggaatacaggtcagatccagaccggtgattatacaagaactagagaatcagcatctgtgcccagagcagatgttagaaacaaaatcatgttatgatggacagtgctatgaatataaatggatggccagtgcttggaagggctcttcccgaacagtgtggtgtcaaaggtcagatggtataaatgtaacagggggctgcttggtgatgagccagcctgatgccgacaggtcttgtaacccaccgtgtagtcaaccccactcgtactgtagcgagacaaaaacatgccattgtgaagaagggtacactgaagtcatgtcttctaacagcacccttgagcaatgcacacttatccccgtggtggtattacccaccatggaggacaaaagaggagatgtgaaaaccagtcgggctgtacatccaacccaaccctccagtaacccagcaggacggggaaggacctggtttctacagccatttgggccagatgggagactaaagacctgggtttacggtgtagcagctggggcatttgtgttactcatctttattgtctccatgatttatctagcttgcaaaaagccaaagaaaccccaaagaaggcaaaacaaccgactgaaacctttaaccttagcctatgatggagatgccgacatgtaacatataacttttcctggcaacaaccagtttcggctttctgacttcatagatgtccagaggccacaacaaatgtatccaaactgtgtggattaaaatatattttaatttttaaaaatggcatcataaagacaagagtgaaaatcatactgccactggagatatttaagacagtaccacttatatacagaccatcaaccgtgagaattataggagatttagctgaatacatgctgcattctgaaagttttatgtcatcttttctgaaatctaccgactgaaaaaccactttcatctctaaaaaataatggtggaattggccagttaggatgcctgatacaagaccgtctgcagtgttaatccataaaacttcctagcatgaagagtttctaccaagatctccacaatactatggtcaaattaacatgtgtactcagttgaatgacacacattatgtcagattatgtacttgctaataagcaattttaacaatgcataacaaataaactctaagctaagcagaaaatccactgaataaattcagcatcttggtggtcgatggtagattttattgacctgcatttcagagacaaagcctcttttttaagacttcttgtctctctccaaagtaagaatgctggacaagtactagtgtcttagaagaacgagtcctcaagttcagtattttatagtggtaattgtctggaaaactaatttacttgtgttaatacaatacgtttctactttccctgattttcaaactggttgcctgcatcttttttgctatatggaaggcacatttttgcactatattagtgcagcacgataggcgcttaaccagtattgccatagaaactgcctcttttcatgtgggatgaagacatctgtgccaagagtggcatgaagacatttgcaagttcttgtatcctgaagagagtaaagttcagtttggatggcagcaagatgaaatcagctattacacctgctgtacacacacttcctcatcactgcagccattgtgaaattgacaacatggcggtaatttaagtgttgaagtccctaaccccttaaccctctaaaaggtggattcctctagttggtttgtaattgttctttgaaggctgtttatgactagatttttatatttgttatctttgttaagaaaaaaaaagaaaaaaaaaggaactggatgtctttttaattttgagcagatggagaaaataaataatgtatcaatgacctttgtaactaaaggaaatcaaaattatatgttgatttttctttctctctgatttcccagtttcagattgaatgtctgtcttgcaggcagttatttcaaaatccatagtcttttgcctttctcactggcaaaatttgaagcaatctctctcttcaatgtatgatttcaaaactaaaattttaaaagagaagaataaatatcttatccaagacttcattgcatatctagagcaagagtggcaaactttttctgtaaaggactatatagaaaatattttccacaaggtctatgttgcaacttctcaactttgccattctgctaatgcaatcttagtaaataaaagaatgaacataactgttttcctatataacttcccttacaaaaacagccagtaggccacctttgcaggtcatattttgctgacccctggtctggatgttttttaatgctagctctccatggtgtcatctttcgttttcattcatttttcaaaggtgagaatttacagtcattacatttcccactgtatcagaagtagctgtattttctacagatgtagccctgggaatggcacagtggaacaatatttaactaactcagcagacttcttgcaaatgaaaagaaaactcaaaaggtgccattaaaaagcaataccattttcaggcaacattattgcaacaacctttgtgagagaggacactagcttttcaggatatttgaaaaataatataactaacatgctattttatcttaaacagctgtgttcctgtaaaagtgttttggattagaaggtatttttaccttcatactggagtatgaactccccctgctgttcattagagtatttgcaaagattacaaaagacatcaggttaggatgtcattgtccccaaaatgaaaatatttgtatgtatttcaataagaactaaatgcagtaagcgctaattcctcattcaatattcactatattaggaaatgtaaatcatttcaaagagaacaggtagtcaggaagatgaaaattttactttaaagcaaggatttaaacaaagaaaaccataaaaacaaagtccattttatctgttttattaaagaggaagaaaaaataatattgttactttaaaactgtgattgtcaatatatataatcaggggtcttccagataatcctaaagttgatctctttgaataaaataaactccatttgtccaaaatagttaagaaagactctattgtggttacttgaaaaattcagctaaccctcttatgaaatgtgtgcaacacctattaattttgaaatgtgggatagaatacctactaaagctatatttaaggtattgtaaaatgtcattaattcagaaangattagtatcatcctacctataagaattaaattagcaaatcaaaattatagaatgttatgaaaaatacattttattcataaattaattagattttacagcatatatgcatgcatatatatatatacacacacacacacacacacccatatatatgagagagaggaaattaggttcaacatgacctaatattagagaacatattggaaggtcactgtttgttaggataaataaatactggataacctcgttagaaaggtggaaagaggagaacgtagcaatctggctattttggacaaagggaaggttattatattcatgtttataacatgaaaatggccttatttttgtttctgacatgagacaataatgagttaaatattttattggaatttcatcaaaaccttatttttactgttccttctaaaaatttgggaggggaatatagtagtaacttctctattgacacttttacctcaccgagggggtaaaagatgtagaactgctgttccctagaatgaaggtctgttgtttggtttttaaaaaaagaagagcagaaaaagtttgacacagtattatatgattttgctggactatttcactagaaaccacgtagaataggactaactgatctcttttgaaaggggctgatttgcttattcatcaataactaatccaatatgtggacagtaatcttaatttcaaagccttttttgaggatactacggtgtagcttaagtgaatttaaaaagagtgcataaaagcttgtttttaattacttataacaaagcacaaattacttctaacaaggcaaatatttattgacatataagacattctgctaggcattgtaaaaaaaaaaaaaaaaaagtaatggcttttgtatacataggtacttaagacagacatccaaaagaaggaaaaaatgcttaatgagtgaagatagcactgaaacatgttgacttttactctaggtttgtttttagatggggttagtattttcccctacgtaatgtacatgtctttaggccacagtattaggagtttgatttttccctgccccaccctcaggtaggtggcagtggtcattgtagcttaatcagacccctgttaagttcctgggcatttcaaggtaaattcacgtcttccttctcacagaaattgaatagacctctcacacacttatttacctcccccaacaacctgtatccttggccctttctgattttctctgcttggtctctttctactcttgacagctattcttacctacttcccactaaacatgcccaattttttaattaaaaaaaaaagaattcctatatttccttccctattagaatcaaagtgtcactcactcagagtgtgaacatcctgatttacaccaaatccactggtcaaagaaatgaataaagggaaaaggaaaaatgtggaaggcatgcagggaaaaaaaaaaaaaaaaaagcccttttctgtaaaaatgtccatgcctacacttgctttagaccatcccatatcctcctgcctccatctcgagtctttgttcacattccacaccacaagacagtgagggaggactgtacttttcagtaccatacagaagggagagcctgttctaaagctgacgtgggtctcaatagtacatgagaagcacaattcccaaatgatctgggatctcctgtttataaatatattaccaaattcaagtgtgggttcttcttctatttccactgtaagattgagggtgttgaaaaaacagtagtccttgagcaaatctgtgaggaatcttgtcagaatgtgatctttcctgggactagtttagttgtgagaactacatctgcttgttctgggaataagggtctccccaggtcctgccctcaggtggccctggctgcaggacaggatttcaggtatcagaaactggtgtgtgagccaagcaaatagttatccatttataaaaaggatggtttgcagtgtgttataataattttatatctagcagggacaatgaaaaatggttatgtctacattattaaatgaatgaaactaatgctaaacagttaattttgcatttttatttttctgtgtttctaccaagtcagatcttaaaaatgggcagtatatgaagagctttagtttgtgggagtcatgttttcagtgatcaaaaatctctatattatttagaatataattgtcagtcttgttgtgttttgtagatttattgtttttaagccatagtttctagattacctacttttaaccctcaagtaaacttttccctatttttcagaaatctgtttgtgtttatttttagaaagtaaacatttagattccttttctggtactttttttctccatttctatcacacagatttgaagagatcagtatctatcattgtaaaatataactttattaaaatttgcaatctgtctttctataaattattattccctaaatgtgtattttatgttaatttaactacctgaatatttattttgtttaaataaggaggcagctgtctaagaatttttgttaatattactttgtaaattgcgtaatgtaatttattttacattatgtacatttcctttttaacgcacaaaatgtctatgtacaattaactacagatttgcaaataatgtcactaagctttattcagtcaatacagatggcatgtgaagatgtaatatgcttttttacattttcatatgggttatttgtaaataactatattgctgacaaacataaatacggaaatcattttcattctaatcatgtgtatctgtgttttgatttgcaccaattgcttcttaaatatggattaaaatttttttccagtgaatacctaaa

SEQ ID NO: 427339 - DNA, 5953 bp, Homo sapiens
  misc_feature (3104)..(3104): n is a, c, g, or t
caaaatatattatttgtcaaaacatgattttctgttccgcagggggctgcttggtgatgagccagcctgatgccgacaggtcttgtaacccaccgtgtagtcaaccccactcgtactgtagcgagacaaaaacatgccattgtgaagaagggtacactgaagtcatgtcttctaacagcacccttgagcaatgcacacttatccccgtggtggtattacccaccatggaggacaaaagaggagatgtgaaaaccagtcgggctgtacatccaacccaaccctccagtaacccagcaggacggggaaggacctggtttctacagccatttgggccagatgggagactaaagacctgggtttacggtgtagcagctggggcatttgtgttactcatctttattgtctccatgatttatctagcttgcaaaaagccaaagaaaccccaaagaaggcaaaacaaccgactgaaacctttaaccttagcctatgatggagatgccgacatgtaacatataacttttcctggcaacaaccagtttcggctttctgacttcatagatgtccagaggccacaacaaatgtatccaaactgtgtggattaaaatatattttaatttttaaaaatggcatcataaagacaagagtgaaaatcatactgccactggagatatttaagacagtaccacttatatacagaccatcaaccgtgagaattataggagatttagctgaatacatgctgcattctgaaagttttatgtcatcttttctgaaatctaccgactgaaaaaccactttcatctctaaaaaataatggtggaattggccagttaggatgcctgatacaagaccgtctgcagtgttaatccataaaacttcctagcatgaagagtttctaccaagatctccacaatactatggtcaaattaacatgtgtactcagttgaatgacacacattatgtcagattatgtacttgctaataagcaattttaacaatgcataacaaataaactctaagctaagcagaaaatccactgaataaattcagcatcttggtggtcgatggtagattttattgacctgcatttcagagacaaagcctcttttttaagacttcttgtctctctccaaagtaagaatgctggacaagtactagtgtcttagaagaacgagtcctcaagttcagtattttatagtggtaattgtctggaaaactaatttacttgtgttaatacaatacgtttctactttccctgattttcaaactggttgcctgcatcttttttgctatatggaaggcacatttttgcactatattagtgcagcacgataggcgcttaaccagtattgccatagaaactgcctcttttcatgtgggatgaagacatctgtgccaagagtggcatgaagacatttgcaagttcttgtatcctgaagagagtaaagttcagtttggatggcagcaagatgaaatcagctattacacctgctgtacacacacttcctcatcactgcagccattgtgaaattgacaacatggcggtaatttaagtgttgaagtccctaaccccttaaccctctaaaaggtggattcctctagttggtttgtaattgttctttgaaggctgtttatgactagatttttatatttgttatctttgttaagaaaaaaaaagaaaaaaaaaggaactggatgtctttttaattttgagcagatggagaaaataaataatgtatcaatgacctttgtaactaaaggaaatcaaaattatatgttgatttttctttctctctgatttcccagtttcagattgaatgtctgtcttgcaggcagttatttcaaaatccatagtcttttgcctttctcactggcaaaatttgaagcaatctctctcttcaatgtatgatttcaaaactaaaattttaaaagagaagaataaatatcttatccaagacttcattgcatatctagagcaagagtggcaaactttttctgtaaaggactatatagaaaatattttccacaaggtctatgttgcaacttctcaactttgccattctgctaatgcaatcttagtaaataaaagaatgaacataactgttttcctatataacttcccttacaaaaacagccagtaggccacctttgcaggtcatattttgctgacccctggtctggatgttttttaatgctagctctccatggtgtcatctttcgttttcattcatttttcaaaggtgagaatttacagtcattacatttcccactgtatcagaagtagctgtattttctacagatgtagccctgggaatggcacagtggaacaatatttaactaactcagcagacttcttgcaaatgaaaagaaaactcaaaaggtgccattaaaaagcaataccattttcaggcaacattattgcaacaacctttgtgagagaggacactagcttttcaggatatttgaaaaataatataactaacatgctattttatcttaaacagctgtgttcctgtaaaagtgttttggattagaaggtatttttaccttcatactggagtatgaactccccctgctgttcattagagtatttgcaaagattacaaaagacatcaggttaggatgtcattgtccccaaaatgaaaatatttgtatgtatttcaataagaactaaatgcagtaagcgctaattcctcattcaatattcactatattaggaaatgtaaatcatttcaaagagaacaggtagtcaggaagatgaaaattttactttaaagcaaggatttaaacaaagaaaaccataaaaacaaagtccattttatctgttttattaaagaggaagaaaaaataatattgttactttaaaactgtgattgtcaatatatataatcaggggtcttccagataatcctaaagttgatctctttgaataaaataaactccatttgtccaaaatagttaagaaagactctattgtggttacttgaaaaattcagctaaccctcttatgaaatgtgtgcaacacctattaattttgaaatgtgggatagaatacctactaaagctatatttaaggtattgtaaaatgtcattaattcagaaangattagtatcatcctacctataagaattaaattagcaaatcaaaattatagaatgttatgaaaaatacattttattcataaattaattagattttacagcatatatgcatgcatatatatatatacacacacacacacacacacccatatatatgagagagaggaaattaggttcaacatgacctaatattagagaacatattggaaggtcactgtttgttaggataaataaatactggataacctcgttagaaaggtggaaagaggagaacgtagcaatctggctattttggacaaagggaaggttattatattcatgtttataacatgaaaatggccttatttttgtttctgacatgagacaataatgagttaaatattttattggaatttcatcaaaaccttatttttactgttccttctaaaaatttgggaggggaatatagtagtaacttctctattgacacttttacctcaccgagggggtaaaagatgtagaactgctgttccctagaatgaaggtctgttgtttggtttttaaaaaaagaagagcagaaaaagtttgacacagtattatatgattttgctggactatttcactagaaaccacgtagaataggactaactgatctcttttgaaaggggctgatttgcttattcatcaataactaatccaatatgtggacagtaatcttaatttcaaagccttttttgaggatactacggtgtagcttaagtgaatttaaaaagagtgcataaaagcttgtttttaattacttataacaaagcacaaattacttctaacaaggcaaatatttattgacatataagacattctgctaggcattgtaaaaaaaaaaaaaaaaaagtaatggcttttgtatacataggtacttaagacagacatccaaaagaaggaaaaaatgcttaatgagtgaagatagcactgaaacatgttgacttttactctaggtttgtttttagatggggttagtattttcccctacgtaatgtacatgtctttaggccacagtattaggagtttgatttttccctgccccaccctcaggtaggtggcagtggtcattgtagcttaatcagacccctgttaagttcctgggcatttcaaggtaaattcacgtcttccttctcacagaaattgaatagacctctcacacacttatttacctcccccaacaacctgtatccttggccctttctgattttctctgcttggtctctttctactcttgacagctattcttacctacttcccactaaacatgcccaattttttaattaaaaaaaaaagaattcctatatttccttccctattagaatcaaagtgtcactcactcagagtgtgaacatcctgatttacaccaaatccactggtcaaagaaatgaataaagggaaaaggaaaaatgtggaaggcatgcagggaaaaaaaaaaaaaaaaaagcccttttctgtaaaaatgtccatgcctacacttgctttagaccatcccatatcctcctgcctccatctcgagtctttgttcacattccacaccacaagacagtgagggaggactgtacttttcagtaccatacagaagggagagcctgttctaaagctgacgtgggtctcaatagtacatgagaagcacaattcccaaatgatctgggatctcctgtttataaatatattaccaaattcaagtgtgggttcttcttctatttccactgtaagattgagggtgttgaaaaaacagtagtccttgagcaaatctgtgaggaatcttgtcagaatgtgatctttcctgggactagtttagttgtgagaactacatctgcttgttctgggaataagggtctccccaggtcctgccctcaggtggccctggctgcaggacaggatttcaggtatcagaaactggtgtgtgagccaagcaaatagttatccatttataaaaaggatggtttgcagtgtgttataataattttatatctagcagggacaatgaaaaatggttatgtctacattattaaatgaatgaaactaatgctaaacagttaattttgcatttttatttttctgtgtttctaccaagtcagatcttaaaaatgggcagtatatgaagagctttagtttgtgggagtcatgttttcagtgatcaaaaatctctatattatttagaatataattgtcagtcttgttgtgttttgtagatttattgtttttaagccatagtttctagattacctacttttaaccctcaagtaaacttttccctatttttcagaaatctgtttgtgtttatttttagaaagtaaacatttagattccttttctggtactttttttctccatttctatcacacagatttgaagagatcagtatctatcattgtaaaatataactttattaaaatttgcaatctgtctttctataaattattattccctaaatgtgtattttatgttaatttaactacctgaatatttattttgtttaaataaggaggcagctgtctaagaatttttgttaatattactttgtaaattgcgtaatgtaatttattttacattatgtacatttcctttttaacgcacaaaatgtctatgtacaattaactacagatttgcaaataatgtcactaagctttattcagtcaatacagatggcatgtgaagatgtaatatgcttttttacattttcatatgggttatttgtaaataactatattgctgacaaacataaatacggaaatcattttcattctaatcatgtgtatctgtgttttgatttgcaccaattgcttcttaaatatggattaaaatttttttccagtgaatacctaaa

SEQ ID NO: 427340 - DNA, 4605 bp, Homo sapiens
  misc_feature (1756)..(1756): n is a, c, g, or t
tgtatttgcccatagtagtgcgagctctggtagaaccctcatgctaggaagttttatggattaacactgcagacgttcttgtatcctgaagagagtaaagttcagtttggatggcagcaagatgaaatcagctattacacctgctgtacacacacttcctcatcactgcagccattgtgaaattgacaacatggcggtaatttaagtgttgaagtccctaaccccttaaccctctaaaaggtggattcctctagttggtttgtaattgttctttgaaggctgtttatgactagatttttatatttgttatctttgttaagaaaaaaaaagaaaaaaaaaggaactggatgtctttttaattttgagcagatggagaaaataaataatgtatcaatgacctttgtaactaaaggaaatcaaaattatatgttgatttttctttctctctgatttcccagtttcagattgaatgtctgtcttgcaggcagttatttcaaaatccatagtcttttgcctttctcactggcaaaatttgaagcaatctctctcttcaatgtatgatttcaaaactaaaattttaaaagagaagaataaatatcttatccaagacttcattgcatatctagagcaagagtggcaaactttttctgtaaaggactatatagaaaatattttccacaaggtctatgttgcaacttctcaactttgccattctgctaatgcaatcttagtaaataaaagaatgaacataactgttttcctatataacttcccttacaaaaacagccagtaggccacctttgcaggtcatattttgctgacccctggtctggatgttttttaatgctagctctccatggtgtcatctttcgttttcattcatttttcaaaggtgagaatttacagtcattacatttcccactgtatcagaagtagctgtattttctacagatgtagccctgggaatggcacagtggaacaatatttaactaactcagcagacttcttgcaaatgaaaagaaaactcaaaaggtgccattaaaaagcaataccattttcaggcaacattattgcaacaacctttgtgagagaggacactagcttttcaggatatttgaaaaataatataactaacatgctattttatcttaaacagctgtgttcctgtaaaagtgttttggattagaaggtatttttaccttcatactggagtatgaactccccctgctgttcattagagtatttgcaaagattacaaaagacatcaggttaggatgtcattgtccccaaaatgaaaatatttgtatgtatttcaataagaactaaatgcagtaagcgctaattcctcattcaatattcactatattaggaaatgtaaatcatttcaaagagaacaggtagtcaggaagatgaaaattttactttaaagcaaggatttaaacaaagaaaaccataaaaacaaagtccattttatctgttttattaaagaggaagaaaaaataatattgttactttaaaactgtgattgtcaatatatataatcaggggtcttccagataatcctaaagttgatctctttgaataaaataaactccatttgtccaaaatagttaagaaagactctattgtggttacttgaaaaattcagctaaccctcttatgaaatgtgtgcaacacctattaattttgaaatgtgggatagaatacctactaaagctatatttaaggtattgtaaaatgtcattaattcagaaangattagtatcatcctacctataagaattaaattagcaaatcaaaattatagaatgttatgaaaaatacattttattcataaattaattagattttacagcatatatgcatgcatatatatatatacacacacacacacacacacccatatatatgagagagaggaaattaggttcaacatgacctaatattagagaacatattggaaggtcactgtttgttaggataaataaatactggataacctcgttagaaaggtggaaagaggagaacgtagcaatctggctattttggacaaagggaaggttattatattcatgtttataacatgaaaatggccttatttttgtttctgacatgagacaataatgagttaaatattttattggaatttcatcaaaaccttatttttactgttccttctaaaaatttgggaggggaatatagtagtaacttctctattgacacttttacctcaccgagggggtaaaagatgtagaactgctgttccctagaatgaaggtctgttgtttggtttttaaaaaaagaagagcagaaaaagtttgacacagtattatatgattttgctggactatttcactagaaaccacgtagaataggactaactgatctcttttgaaaggggctgatttgcttattcatcaataactaatccaatatgtggacagtaatcttaatttcaaagccttttttgaggatactacggtgtagcttaagtgaatttaaaaagagtgcataaaagcttgtttttaattacttataacaaagcacaaattacttctaacaaggcaaatatttattgacatataagacattctgctaggcattgtaaaaaaaaaaaaaaaaaagtaatggcttttgtatacataggtacttaagacagacatccaaaagaaggaaaaaatgcttaatgagtgaagatagcactgaaacatgttgacttttactctaggtttgtttttagatggggttagtattttcccctacgtaatgtacatgtctttaggccacagtattaggagtttgatttttccctgccccaccctcaggtaggtggcagtggtcattgtagcttaatcagacccctgttaagttcctgggcatttcaaggtaaattcacgtcttccttctcacagaaattgaatagacctctcacacacttatttacctcccccaacaacctgtatccttggccctttctgattttctctgcttggtctctttctactcttgacagctattcttacctacttcccactaaacatgcccaattttttaattaaaaaaaaaagaattcctatatttccttccctattagaatcaaagtgtcactcactcagagtgtgaacatcctgatttacaccaaatccactggtcaaagaaatgaataaagggaaaaggaaaaatgtggaaggcatgcagggaaaaaaaaaaaaaaaaaagcccttttctgtaaaaatgtccatgcctacacttgctttagaccatcccatatcctcctgcctccatctcgagtctttgttcacattccacaccacaagacagtgagggaggactgtacttttcagtaccatacagaagggagagcctgttctaaagctgacgtgggtctcaatagtacatgagaagcacaattcccaaatgatctgggatctcctgtttataaatatattaccaaattcaagtgtgggttcttcttctatttccactgtaagattgagggtgttgaaaaaacagtagtccttgagcaaatctgtgaggaatcttgtcagaatgtgatctttcctgggactagtttagttgtgagaactacatctgcttgttctgggaataagggtctccccaggtcctgccctcaggtggccctggctgcaggacaggatttcaggtatcagaaactggtgtgtgagccaagcaaatagttatccatttataaaaaggatggtttgcagtgtgttataataattttatatctagcagggacaatgaaaaatggttatgtctacattattaaatgaatgaaactaatgctaaacagttaattttgcatttttatttttctgtgtttctaccaagtcagatcttaaaaatgggcagtatatgaagagctttagtttgtgggagtcatgttttcagtgatcaaaaatctctatattatttagaatataattgtcagtcttgttgtgttttgtagatttattgtttttaagccatagtttctagattacctacttttaaccctcaagtaaacttttccctatttttcagaaatctgtttgtgtttatttttagaaagtaaacatttagattccttttctggtactttttttctccatttctatcacacagatttgaagagatcagtatctatcattgtaaaatataactttattaaaatttgcaatctgtctttctataaattattattccctaaatgtgtattttatgttaatttaactacctgaatatttattttgtttaaataaggaggcagctgtctaagaatttttgttaatattactttgtaaattgcgtaatgtaatttattttacattatgtacatttcctttttaacgcacaaaatgtctatgtacaattaactacagatttgcaaataatgtcactaagctttattcagtcaatacagatggcatgtgaagatgtaatatgcttttttacattttcatatgggttatttgtaaataactatattgctgacaaacataaatacggaaatcattttcattctaatcatgtgtatctgtgttttgatttgcaccaattgcttcttaaatatggattaaaatttttttccagtgaatacctaaa

SEQ ID NO: 427341 - DNA, 241 bp, Homo sapiens
ctgttcatgaagtattttagtgatagaaacatagtgttcctagtcaaatttgctatctgtgtgtgtaacaactgtgcacacctataattaccttggcctttgcacatgagtgttacatgcgtaaaacattttacacacagaaaagccaacctgtgtgaaattttagaattttctttatagtgttcaaaaactttttcctaccaccttaatatatatttaactctttgctccaaaaaaaaaa

SEQ ID NO: 427342 - DNA, 474 bp, Homo sapiens
taacttatctgggtgcccatctggtttaaattgctcattttacattaatttaacaataatagctgttggtggtcatgttttccccaggagaagaagttgacagacagctgtgcagagatgccatcttccccatccctgtggcctgtgatgccccatgcccgaaagactgtgtgctcagcacatggtctacgtggtcctcctgctcacacacctgctcagggaaaacgacagaagggaaacagatacgagcacgatccattctggcctatgcgggtgaagaaggtgagtcgccagcttcagacgccatctaggttcgtttcaaaagttagtgtgcatcttttttgtgtagcctggaaaagatgatattctatgaaagtcaacaaccagaaattcagccatccaagatttaatatctgttgatgtgttgagcaatttgattctgtcccccaaaattaatcttgaaaatggatctct

SEQ ID NO: 427343 - DNA, 5282 bp, Homo sapiens
gagtggagcccctgctcaaaaacatgccatgacatggtgtcccctgcaggcactcgtgtaaggacacgaaccatcaggcagtttcccattggcagtgaaaaggagtgtccagaatttgaagaaaaagaaccctgtttgtctcaaggagatggagttgtcccctgtgccacgtatggctggagaactacagagtggactgagtgccgtgtggaccctttgctcagtcagcaggacaagaggcgcggcaaccagacggccctctgtggagggggcatccagacccgagaggtgtactgcgtgcaggccaacgaaaacctcctctcacaattaagtacccacaagaacaaagaagcctcaaagccaatggacttaaaattatgcactggacctatccctaatactacacagctgtgccacattccttgtccaactgaatgtgaagtttcaccttggtcagcttggggaccttgtacttatgaaaactgtaatgatcagcaagggaaaaaaggcttcaaactgaggaagcggcgcattaccaatgagcccactggaggctctggggtaaccggaaactgccctcacttactggaagccattccctgtgaagagcctgcctgttatgactggaaagcggtgagactgggagactgcgagccagataacggaaaggagtgtggtccaggcacgcaagttcaagaggttgtgtgcatcaacagtgatggagaagaagttgacagacagctgtgcagagatgccatcttccccatccctgtggcctgtgatgccccatgcccgaaagactgtgtgctcagcacatggtctacgtggtcctcctgctcacacacctgctcagggaaaacgacagaagggaaacagatacgagcacgatccattctggcctatgcgggtgaagaaggtggaattcgctgtccaaatagcagtgctttgcaagaagtacgaagctgtaatgagcatccttgcacagtgtaccactggcaaactggtccctggggccagtgcattgaggacacctcagtatcgtccttcaacacaactacgacttggaatggggaggcctcctgctctgtcggcatgcagacaagaaaagtcatctgtgtgcgagtcaatgtgggccaagtgggacccaaaaaatgtcctgaaagccttcgacctgaaactgtaaggccttgtctgcttccttgtaagaaggactgtattgtgaccccatatagtgactggacatcatgcccctcttcgtgtaaagaaggggactccagtatcaggaagcagtctaggcatcgggtcatcattcagctgccagccaacgggggccgagactgcacagatcccctctatgaagagaaggcctgtgaggcacctcaagcgtgccaaagctacaggtggaagactcacaaatggcgcagatgccaattagtcccttggagcgtgcaacaagacagccctggagcacaggaaggctgtgggcctgggcgacaggcaagagccattacttgtcgcaagcaagatggaggacaggctggaatccatgagtgcctacagtatgcaggccctgtgccagcccttacccaggcctgccagatcccctgccaggatgactgtcaattgaccagctggtccaagttttcttcatgcaatggagactgtggtgcagttaggaccagaaagcgcactcttgttggaaaaagtaaaaagaaggaaaaatgtaaaaattcccatttgtatcccctgattgagactcagtattgtccttgtgacaaatataatgcacaacctgtggggaactggtcagactgtattttaccagagggaaaagtggaagtgttgctgggaatgaaagtacaaggagacatcaaggaatgcggacaaggatatcgttaccaagcaatggcatgctacgatcaaaatggcaggcttgtggaaacatctagatgtaacagccatggttacattgaggaggcctgcatcatcccctgcccctcagactgcaagctcagtgagtggtccaactggtcgcgctgcagcaagtcctgtgggagtggtgtgaaggttcgttctaaatggctgcgtgaaaaaccatataatggaggaaggccttgccccaaactggaccatgtcaaccaggcacaggtgtatgaggttgtcccatgccacagtgactgcaaccagtacctatgggtcacagagccctggagcatctgcaaggtgacctttgtgaatatgcgggagaactgtggagagggcgtgcaaacccgaaaagtgagatgcatgcagaatacagcagatggcccttctgaacatgtagaggattacctctgtgacccagaagagatgcccctgggctctagagtgtgcaaattaccatgccctgaggactgtgtgatatctgaatggggtccatggacccaatgtgttttgccttgcaatcaaagcagtttccggcaaaggtcagctgatcccatcagacaaccagctgatgaaggaagatcttgccctaatgctgttgagaaagaaccctgtaacctgaacaaaaactgctaccactatgattataatgtaacagactggagtacatgtcagctgagtgagaaggcagtttgtggaaatggaataaaaacaaggatgttggattgtgttcgaagtgatggcaagtcagttgacctgaaatattgtgaagcgcttggcttggagaagaactggcagatgaacacgtcctgcatggtggaatgccctgtgaactgtcagctttctgattggtctccttggtcagaatgttctcaaacatgtggcctcacaggaaaaatgatccgaagacgaacagtgacccagccctttcaaggtgatggaagaccatgcccttccctgatggaccagtccaaaccctgcccagtgaagccttgttatcggtggcaatatggccagtggtctccatgccaagtgcaggaggcccagtgtggagaagggaccagaacaaggaacatttcttgtgtagtaagtgatgggtcagctgatgatttcagcaaagtggtggatgaggaattctgtgctgacattgaactcattatagatggtaataaaaatatggttctggaggaatcctgcagccagccttgcccaggtgactgttatttgaaggactggtcttcctggagcctgtgtcagctgacctgtgtgaatggtgaggatctaggctttggtggaatacaggtcagatccagaccggtgattatacaagaactagagaatcagcatctgtgcccagagcagatgttagaaacaaaatcatgttatgatggacagtgctatgaatataaatggatggccagtgcttggaagggctcttcccgaacagtgtggtgtcaaaggtcagatggtataaatgtaacagggggctgcttggtgatgagccagcctgatgccgacaggtcttgtaacccaccgtgtagtcaaccccactcgtactgtagcgagacaaaaacatgccattgtgaagaagggtacactgaagtcatgtcttctaacagcacccttgagcaatgcacacttatccccgtggtggtattacccaccatggaggacaaaagaggagatgtgaaaaccagtcgggctgtacatccaacccaaccctccagtaacccagcaggacggggaaggacctggtttctacagccatttgggccagatgggagactaaagacctgggtttacggtgtagcagctggggcatttgtgttactcatctttattgtctccatgatttatctagcttgcaaaaagccaaagaaaccccaaagaaggcaaaacaaccgactgaaacctttaaccttagcctatgatggagatgccgacatgtaacatataacttttcctggcaacaaccagtttcggctttctgacttcatagatgtccagaggccacaacaaatgtatccaaactgtgtggattaaaatatattttaatttttaaaaatggcatcataaagacaagagtgaaaatcatactgccactggagatatttaagacagtaccacttatatacagaccatcaaccgtgagaattataggagatttagctgaatacatgctgcattctgaaagttttatgtcatcttttctgaaatctaccgactgaaaaaccactttcatctctaaaaaataatggtggaattggccagttaggatgcctgatacaagaccgtctgcagtgttaatccataaaacttcctagcatgaagagtttctaccaagatctccacaatactatggtcaaattaacatgtgtactcagttgaatgacacacattatgtcagattatgtacttgctaataagcaattttaacaatgcataacaaataaactctaagctaagcagaaaatccactgaataaattcagcatcttggtggtcgatggtagattttattgacctgcatttcagagacaaagcctcttttttaagacttcttgtctctctccaaagtaagaatgctggacaagtactagtgtcttagaagaacgagtcctcaagttcagtattttatagtggtaattgtctggaaaactaatttacttgtgttaatacaatacgtttctactttccctgattttcaaactggttgcctgcatcttttttgctatatggaaggcacatttttgcactatattagtgcagcacgataggcgcttaaccagtattgccatagaaactgcctcttttcatgtgggatgaagacatctgtgccaagagtggcatgaagacatttgcaagttcttgtatcctgaagagagtaaagttcagtttggatggcagcaagatgaaatcagctattacacctgctgtacacacacttcctcatcactgcagccattgtgaaattgacaacatggcggtaatttaagtgttgaagtccctaaccccttaaccctctaaaaggtggattcctctagttggtttgtaattgttctttgaaggctgtttatgactagatttttatatttgttatctttgttaagaaaaaaaaagaaaaaaaaaggaactggatgtctttttaattttgagcagatggagaaaataaataatgtatcaatgacctttgtaactaaaggaaatcaaaattatatgttgatttttctttctctctgatttcccagtttcagattgaatgtctgtcttgcaggcagttatttcaaaatccatagtcttttagtttttcttatttgtcttattttgattgcattatttctcttatattgatgtttataa

SEQ ID NO: 427344 - DNA, 3040 bp, Homo sapiens
aagaaggtagtcctctaaagcaaaatctgagtgccactaaatggggagatggggctgttaagctgtccaaatcaacaagggtcatataaatggccttaaactttggggttgctttctgcaaaaagttgctgtgactcatgccatagacaaggttgagtgcctggacccaaaggcaatactgtaatgtaaagacatttatagtactaggcaaacagcaccccaggtactccaggccctcctggctggagagggctgtggcaatagaaaattagtgccaactgcagtgagtcagcctaggttaaatagagagtgtaagagtgctggacaggaacctccaccctcatgtcacatttcttcaatgtgacccttctggcccctctcctcctgacagcggaacaatgactgccccgataggtgaggctggaggaagaatcagtcctgtccttggcaagctcttcactatgacagtaaaggctctctgcctgctgccaaggcctgtgactttctaacctggcctcacgctgggtaagcttaaggtagaggtgcaggattagcaagcccacctggctaccaggccgacagctacatcctccaactgaccctgatcaatgaagagggattcatgtgtctgtctcagttggttccaaatgaaaccagggagcaggggagttaggaatcgaacaccagtcatgcctactggctctctgctcgagagccaataccctgtgccctccactcatctggatttacaggaactgtcatagtgttcagtattgggtggtgataagcccattggattgtccccttggggggatgagctaggggtgcaaggaacacctgatgagtagataagtggagctcatggtatttcctgaaagatgctaatctatttgccaaacttggtcttgaatgtactgggggcttcaaggtatgggtatatttttcttgtgtccttgcagttagcccccatgtcttatgtgtgtcctgaaaaaataagagcctgcccaagactttgggcctcttgacagaattaaccacttttatacatctgagttctcttggtaagttctttagcagtgttcaaagtctactagctcgcattagtttctgttgctgccaacagatctgaactaatgctaacagatccccctgagggattcttgatgggctgagcagctggctggagctagtactgactgacattcattgtgatgagggcagctttctggtacaggattctaagctctatgttttatatacattttcatctgtacttgcacctcactttacacaagaggaaactatgcaaagttagctggatcgctcaaggtcacttaggtaagttggcaagtccatgcttcccactcagctcctcaggtcagcaagtctacttctctgcctattttgtatactctctttaatatgtgcctagctttggaaagtctagaatgggtccctggtgcctttttactttgaagaaatcagtttctgcctctttttggaaaagaaaacaaagtgcaattgttttttactggaaagttacccaatagcatgaggtgaacaggacgtagttaggccttcctgtaaacagaaaatcatatcaaaacactatcttcccatctgtttctcaatgcctgctacttcttgtagatatttcatttcaggagagcagcagttaaacccgtggattttgtagttaggaacctgggttcaaaccctcttccactaattggctatgtctctggacaagtttttttttttttttttttttaaaccctttctgaactttcactttctatgtctacctcaaagaattgttgtgaggcttgagataatgcatttgtaaagggtctgccagataggaagatgctagttatggatttacaaggttgttaaggctgtaagagtctaaaacctacagtgaatcacaatgcatttacccccactgacttggacataagtgaaaactagccagaagtctctttttcaaattacttacaggttattcaatataaaatttttgtaatggataatcttatttatctaaactaaagcttcctgtttatacacactcctgttattctgggataagataaatgaccacagtaccttaatttctaggtgggtgcctgtgatggttcattgtaggtaaggacattttctctttttcagcagctgtgtaggtccagagcctctgggagaggaggggggtagcatgcacccagcaggggactgaactgggaaactcaaggttctttttactgtggggtagtgagctgcctttctgtgatcggtttccctagggatgttgctgttcccctccttgctattcgcagctacatacaacgtggccaaccccagtaggctgatcctatatatgatcagtgctggtgctgactctcaatagccccacccaagctggctataggtttacagatacattaattaggcaacctaaaatattgatgctggtgttggtgtgacataatgctatggccagaactgaaacttagagttataattcatgtattagggttctccagagggacagaattagtaggatatatgtatatatgaaagggaggttattagggagaactggctcccacagttagaaggcgaagtcgcacaataggccgtctgcaagctgggttagagagaagccagtagtggctcagcctgagttcaaaaacctcaaaactggggaagctgacagtgcagccagccttcagtctgtggccaaaggcccaagagcccctggcaaccaacccactggtgcaagtcctagattccaaaggctgaagaacctggagtctgatgtccaagagcaggaagagtggaagaaagccagaagactcagcaaacaaggtagacagtgtctaccaccacagtggccataccaaagaggctaccgattccttcctgctacctggatccctgaagttgccctggtctctgcaccttctaaacctagttcttaagagctttccattacatgagctgtctcaaagccctccaataaattctcagtgtaagcttc

SEQ ID NO: 427345 - DNA, 1550 bp, Homo sapiens
aagaaggtagtcctctaaagcaaaatctgagtgccactaaatggggagatggggctgttaagctgtccaaatcaacaagggtcatataaatggccttaaactttggggttgctttctgcaaaaagttgctgtgactcatgccatagacaaggttgagtgcctggacccaaaggcaatactgtaatgtaaagacatttatagtactaggcaaacagcaccccaggtactccaggccctcctggctggagagggctgtggcaatagaaaattagtgccaactgcagtgagtcagcctaggttaaatagagagtgtaagagtgctggacaggaacctccaccctcatgtcacatttcttcaatgtgacccttctggcccctctcctcctgacagcggaacaatgactgccccgataggtgaggctggaggaagaatcagtcctgtccttggcaagctcttcactatgacagtaaaggctctctgcctgctgccaaggcctgtgactttctaacctggcctcacgctgggtaagcttaaggtagaggtgcaggattagcaagcccacctggctaccaggccgacagctacatcctccaactgaccctgatcaatgaagagggattcatgtgtctgtctcagttggttccaaatgaaaccagggagcaggggagttaggaatcgaacaccagtcatgcctactggctctctgctcgagagccaataccctgtgccctccactcatctggatttacaggaactgtcatagtgttcagtattgggtggtgataagcccattggattgtccccttggggggatgagctaggggtgcaaggaacacctgatgagtagataagtggagctcatggtatttcctgaaagatgctaatctatttgccaaacttggtcttgaatgtactgggggcttcaaggtatgggtatatttttcttgtgtccttgcagttagcccccatgtcttatgtgtgtcctgaaaaaataagagcctgcccaagactttgggcctcttgacagaattaaccacttttatacatctgagttctcttggtaagttctttagcagtgttcaaagtctactagctcgcattagtttctgttgctgccaacagatctgaactaatgctaacagatccccctgagggattcttgatgggctgagcagctggctggagctagtactgactgacattcattgtgatgagggcagctttctggtacaggattctaagctctatgttttatatacattttcatctgtacttgcacctcactttacacaagaggaaactatgcaaagttagctggatcgctcaaggtcacttaggtaagttggcaagtccatgcttcccactcagctcctcaggtcagcaagtctacttctctgcctattttgtatactctcttacagccttaacaaccttgtaaatccataactagcatcttcctatctggcagaccctttacaaatgcattatctcaagcctcacaacaattctttgaggtagacatagaaagtgaaagttcagaaagggttta

SEQ ID NO: 427346 - DNA, 306 bp, Homo sapiens
tggacagctggacagcacagaggaggtggacagcacagaggatggtggacagcacagaggaggtggacagcacagaggaggtggacagcaagagcaggaagagtggaagaaagccagaagactcagcaaacaaggtagacagtgtctaccaccacagtggccataccaaagaggctaccgattccttcctgctacctggatccctgaagttgccctggtctctgcaccttctaaacctagttcttaagagctttccattacatgagctgtctcaaagccctccaataaattctcagtgtaagcttc

SEQ ID NO: 427347 - DNA, 2913 bp, Homo sapiens
aagaaggtagtcctctaaagcaaaatctgagtgccactaaatggggagatggggctgttaagctgtccaaatcaacaagggtcatataaatggccttaaactttggggttgctttctgcaaaaagttgctgtgactcatgccatagacaaggttgagtgcctggacccaaaggcaatactgtaatgtaaagacatttatagtactaggcaaacagcaccccaggtactccaggccctcctggctggagagggctgtggcaatagaaaattagtgccaactgcagtgagtcagcctaggttaaatagagagtgtaagagtgctggacaggaacctccaccctcatgtcacatttcttcaatgtgacccttctggcccctctcctcctgacagcggaacaatgactgccccgataggtgaggctggaggaagaatcagtcctgtccttggcaagctcttcactatgacagtaaaggctctctgcctgctgccaaggcctgtgactttctaacctggcctcacgctgggtaagcttaaggtagaggtgcaggattagcaagcccacctggctaccaggccgacagctacatcctccaactgaccctgatcaatgaagagggattcatgtgtctgtctcagttggttccaaatgaaaccagggagcaggggagttaggaatcgaacaccagtcatgcctactggctctctgctcgagagccaataccctgtgccctccactcatctggatttacaggaactgtcatagtgttcagtattgggtggtgataagcccattggattgtccccttggggggatgagctaggggtgcaaggaacacctgatgagtagataagtggagctcatggtatttcctgaaagatgctaatctatttgccaaacttggtcttgaatgtactgggggcttcaaggtatgggtatatttttcttgtgtccttgcagttagcccccatgtcttatgtgtgtcctgaaaaaataagagcctgcccaagactttgggcctcttgacagaattaaccacttttatacatctgagttctcttggtaagttctttagcagtgttcaaagtctactagctcgcattagtttctgttgctgccaacagatctgaactaatgctaacagatccccctgagggattcttgatgggctgagcagctggctggagctagtactgactgacattcattgtgatgagggcagctttctggtacaggattctaagctctatgttttatatacattttcatctgtacttgcacctcactttacacaagaggaaactatgcaaagttagctggatcgctcaaggtcacttaggtaagttggcaagtccatgcttcccactcagctcctcaggtcagcaagtctacttctctgcctattttgtatactctctttaatatgtgcctagctttggaaagtctagaatgggtccctggtgcctttttactttgaagaaatcagtttctgcctctttttggaaaagaaaacaaagtgcaattgttttttactggaaagttacccaatagcatgaggtgaacaggacgtagttaggccttcctgtaaacagaaaatcatatcaaaacactatcttcccatctgtttctcaatgcctgctacttcttgtagatatttcatttcaggagagcagcagttaaacccgtggattttgtagttaggaacctgggttcaaaccctcttccactaattggctatgtctctggacaagtttttttttttttttttttttaaaccctttctgaactttcactttctatgtctacctcaaagaattgttgtgaggcttgagataatgcatttgtaaagggtctgccagataggaagatgctagttatggatttacaaggttgttaaggctgtaagagtctaaaacctacagtgaatcacaatgcatttacccccactgacttggacataagtgaaaactagccagaagtctctttttcaaattacttacaggttattcaatataaaatttttgtaatggataatcttatttatctaaactaaagcttcctgtttatacacactcctgttattctgggataagataaatgaccacagtaccttaatttctaggtgggtgcctgtgatggttcattgtaggtaaggacattttctctttttcagcagctgtgtaggtccagagcctccttgctattcgcagctacatacaacgtggccaaccccagtaggctgatcctatatatgatcagtgctggtgctgactctcaatagccccacccaagctggctataggtttacagatacattaattaggcaacctaaaatattgatgctggtgttggtgtgacataatgctatggccagaactgaaacttagagttataattcatgtattagggttctccagagggacagaattagtaggatatatgtatatatgaaagggaggttattagggagaactggctcccacagttagaaggcgaagtcgcacaataggccgtctgcaagctgggttagagagaagccagtagtggctcagcctgagttcaaaaacctcaaaactggggaagctgacagtgcagccagccttcagtctgtggccaaaggcccaagagcccctggcaaccaacccactggtgcaagtcctagattccaaaggctgaagaacctggagtctgatgtccaagagcaggaagagtggaagaaagccagaagactcagcaaacaaggtagacagtgtctaccaccacagtggccataccaaagaggctaccgattccttcctgctacctggatccctgaagttgccctggtctctgcaccttctaaacctagttcttaagagctttccattacatgagctgtctcaaagccctccaataaattctcagtgtaagcttc

SEQ ID NO: 427348 - DNA, 3469 bp, Homo sapiens
aagaaggtagtcctctaaagcaaaatctgagtgccactaaatggggagatggggctgttaagctgtccaaatcaacaagggtcatataaatggccttaaactttggggttgctttctgcaaaaagttgctgtgactcatgccatagacaaggttgagtgcctggacccaaaggcaatactgtaatgtaaagacatttatagtactaggcaaacagcaccccaggtactccaggccctcctggctggagagggctgtggcaatagaaaattagtgccaactgcagtgagtcagcctaggttaaatagagagtgtaagagtgctggacaggaacctccaccctcatgtcacatttcttcaatgtgacccttctggcccctctcctcctgacagcggaacaatgactgccccgataggtgaggctggaggaagaatcagtcctgtccttggcaagctcttcactatgacagtaaaggctctctgcctgctgccaaggcctgtgactttctaacctggcctcacgctgggtaagcttaaggtagaggtgcaggattagcaagcccacctggctaccaggccgacagctacatcctccaactgaccctgatcaatgaagagggattcatgtgtctgtctcagttggttccaaatgaaaccagggagcaggggagttaggaatcgaacaccagtcatgcctactggctctctgctcgagagccaataccctgtgccctccactcatctggatttacaggaactgtcatagtgttcagtattgggtggtgataagcccattggattgtccccttggggggatgagctaggggtgcaaggaacacctgatgagtagataagtggagctcatggtatttcctgaaagatgctaatctatttgccaaacttggtcttgaatgtactgggggcttcaaggtatgggtatatttttcttgtgtccttgcagttagcccccatgtcttatgtgtgtcctgaaaaaataagagcctgcccaagactttgggcctcttgacagaattaaccacttttatacatctgagttctcttggtaagttctttagcagtgttcaaagtctactagctcgcattagtttctgttgctgccaacagatctgaactaatgctaacagatccccctgagggattcttgatgggctgagcagctggctggagctagtactgactgacattcattgtgatgagggcagctttctggtacaggattctaagctctatgttttatatacattttcatctgtacttgcacctcactttacacaagaggaaactatgcaaagttagctggatcgctcaaggtcacttaggtaagttggcaagtccatgcttcccactcagctcctcaggtcagcaagtctacttctctgcctattttgtatactctctttaatatgtgcctagctttggaaagtctagaatgggtccctggtgcctttttactttgaagaaatcagtttctgcctctttttggaaaagaaaacaaagtgcaattgttttttactggaaagttacccaatagcatgaggtgaacaggacgtagttaggccttcctgtaaacagaaaatcatatcaaaacactatcttcccatctgtttctcaatgcctgctacttcttgtagatatttcatttcaggagagcagcagttaaacccgtggattttgtagttaggaacctgggttcaaaccctcttccactaattggctatgtctctggacaagtttttttttttttttttttttaaaccctttctgaactttcactttctatgtctacctcaaagaattgttgtgaggcttgagataatgcatttgtaaagggtctgccagataggaagatgctagttatggatttacaaggttgttaaggctgtaagagtctaaaacctacagtgaatcacaatgcatttacccccactgacttggacataagtgaaaactagccagaagtctctttttcaaattacttacaggttattcaatataaaatttttgtaatggataatcttatttatctaaactaaagcttcctgtttatacacactcctgttattctgggataagataaatgaccacagtaccttaatttctaggtgggtgcctgtgatggttcattgtaggtaaggacattttctctttttcagcagctgtgtaggtccagagcctctgggagaggaggggggtagcatgcacccagcaggggactgaactgggaaactcaaggttctttttactgtggggtagtgagctgcctttctgtgatcggtttccctagggatgttgctgttcccctccttgctattcgcagctacatacaacgtggccaaccccagtaggctgatcctatatatgatcagtgctggtgctgactctcaatagccccacccaagctggctataggtttacagatacattaattaggcaacctaaaatattgatgctggtgttggtgtgacataatgctatggccagaactgaaacttagagttataattcatgtattagggttctccagagggacagaattagtaggatatatgtatatatgaaagggaggttattagggagaactggctcccacagttagaaggcgaagtcgcacaataggccgtctgcaagctgggttagagagaagccagtagtggctcagcctgagttcaaaaacctcaaaactggggaagctgacagtgcagccagccttcagtctgtggccaaaggcccaagagcccctggcaaccaacccactggtgcaagtcctagattccaaaggctgaagaacctggagtctgatgtccaagagcaggaagagtggaagaaagccagaagactcagcaaacaaggtagacagtgtctaccaccacagtggccataccaaagaggctaccgattccttcctgctacctggatccctgaagttgccctggtctctgcaccttctaaacctagttcttaagagctttccattacatgagctgtctcaaagccctccaataaattctcagtgtaagcttcaaaaaaaaaaaaaaaaaaaaaaaaaaaacaaacaacaaaaagaaacacaaaacccaaaaaaaaacaaacaaaaaaacaaaacaaaaacacgtgtgtgggggcggcgccgcgcggagccgcccgccgaaggagaggctgtttgctcaacagaccccacggtggagggcgggcgggggggcgaccaccaagaggagtagcggagagagaacggccgagaccaaggagggtgaccaagaagagaaaaacacggcggcgagaaaaaaacaggggcggggggtgtttccccccaaaaaaaaaaaaagcgccggggggaaacacaaggggggggtttcaacaaccacagccaaggagagagacgagcaggagaacccagggggggaacaacaaaaaggggagccccagaaggacgcgggaaaaaaaaaagcccag

SEQ ID NO: 427349 - DNA, 2937 bp, Homo sapiens
aagaaggtagtcctctaaagcaaaatctgagtgccactaaatggggagatggggctgttaagctgtccaaatcaacaagggtcatataaatggccttaaactttggggttgctttctgcaaaaagttgctgtgactcatgccatagacaaggttgagtgcctggacccaaaggcaatactgtaatgtaaagacatttatagtactaggcaaacagcaccccaggtactccaggccctcctggctggagagggctgtggcaatagaaaattagtgccaactgcagtgagtcagcctaggttaaatagagagtgtaagagtgctggacaggaacctccaccctcatgtcacatttcttcaatgtgacccttctggcccctctcctcctgacagcggaacaatgactgccccgataggtgaggctggaggaagaatcagtcctgtccttggcaagctcttcactatgacagtaaaggctctctgcctgctgccaaggcctgtgactttctaacctggcctcacgctgggtaagcttaaggtagaggtgcaggattagcaagcccacctggctaccaggccgacagctacatcctccaactgaccctgatcaatgaagagggattcatgtgtctgtctcagttggttccaaatgaaaccagggagcaggggagttaggaatcgaacaccagtcatgcctactggctctctgctcgagagccaataccctgtgccctccactcatctggatttacaggaactgtcatagtgttcagtattgggtggtgataagcccattggattgtccccttggggggatgagctaggggtgcaaggaacacctgatgagtagataagtggagctcatggtatttcctgaaagatgctaatctatttgccaaacttggtcttgaatgtactgggggcttcaaggtatgggtatatttttcttgtgtccttgcagttagcccccatgtcttatgtgtgtcctgaaaaaataagagcctgcccaagactttgggcctcttgacagaattaaccacttttatacatctgagttctcttggtaagttctttagcagtgttcaaagtctactagctcgcattagtttctgttgctgccaacagatctgaactaatgctaacagatccccctgagggattcttgatgggctgagcagctggctggagctagtactgactgacattcattgtgatgagggcagctttctggtacaggattctaagctctatgttttatatacattttcatctgtacttgcacctcactttacacaagaggaaactatgcaaagttagctggatcgctcaaggtcacttaggtaagttggcaagtccatgcttcccactcagctcctcaggtcagcaagtctacttctctgcctattttgtatactctctttaatatgtgcctagctttggaaagtctagaatgggtccctggtgcctttttactttgaagaaatcagtttctgcctctttttggaaaagaaaacaaagtgcaattgttttttactggaaagttacccaatagcatgaggtgaacaggacgtagttaggccttcctgtaaacagaaaatcatatcaaaacactatcttcccatctgtttctcaatgcctgctacttcttgtagatatttcatttcaggagagcagcagttaaacccgtggattttgtagttaggaacctgggttcaaaccctcttccactaattggctatgtctctggacaagtttttttttttttttttttttaaaccctttctgaactttcactttctatgtctacctcaaagaattgttgtgaggcttgagataatgcatttgtaaagggtctgccagataggaagatgctagttatggatttacaaggttgttaaggctgtaagagtctaaaacctacagtgaatcacaatgcatttacccccactgacttggacataagtgaaaactagccagaagtctctttttcaaattacttacaggttattcaatataaaatttttgtaatggataatcttatttatctaaactaaagcttcctgtttatacacactcctgttattctgggataagataaatgaccacagtaccttaatttctaggtgggtgcctgtgatggttcattgtaggtaaggacattttctctttttcagcagctgtgtaggtccagagcctctgggagaggaggggggtagcatgcacccagcaggggactgaactgggaaactcaaggttctttttactgtggggtagtgagctgcctttctgtgatcggtttccctagggatgttgctgttcccctccttgctattcgcagctacatacaacgtggccaaccccagtaggctgatcctatatatgatcagtgctggtgctgactctcaatagccccacccaagctggctataggtttacagatacattaattaggcaacctaaaatattgatgctggtgttggtgtgacataatgctatggccagaactgaaacttagagttataattcatgtattagggttctccagagggacagaattagtaggatatatgtatatatgaaagggaggttattagggagaactggctcccacagttagaaggcgaagtctaagagtgaagtaggtgtgacttgaactagattgcatgcttcctcctttgctcttaggaagaccagctttgcagtgacagcttgagtgggttctctgcagccctcagattatttttcctctggctccttggatgtagtcagttagcatcattagtacatctttggagggtggggcaggagtatatgagcatcctctctcacatggaacgctttcataaacttcagggatcccgtgttgccatggaggcatgccaaatgttccatatgtgggtgtcagtcagggaaacaagatcttaatgcaagtagaggat

SEQ ID NO: 427350 - DNA, 5354 bp, Homo sapiens
aagaaggtagtcctctaaagcaaaatctgagtgccactaaatggggagatggggctgttaagctgtccaaatcaacaagggtcatataaatggccttaaactttggggttgctttctgcaaaaagttgctgtgactcatgccatagacaaggttgagtgcctggacccaaaggcaatactgtaatgtaaagacatttatagtactaggcaaacagcaccccaggtactccaggccctcctggctggagagggctgtggcaatagaaaattagtgccaactgcagtgagtcagcctaggttaaatagagagtgtaagagtgctggacaggaacctccaccctcatgtcacatttcttcaatgtgacccttctggcccctctcctcctgacagcggaacaatgactgccccgataggtgaggctggaggaagaatcagtcctgtccttggcaagctcttcactatgacagtaaaggctctctgcctgctgccaaggcctgtgactttctaacctggcctcacgctgggtaagcttaaggtagaggtgcaggattagcaagcccacctggctaccaggccgacagctacatcctccaactgaccctgatcaatgaagagggattcatgtgtctgtctcagttggttccaaatgaaaccagggagcaggggagttaggaatcgaacaccagtcatgcctactggctctctgctcgagagccaataccctgtgccctccactcatctggatttacaggaactgtcatagtgttcagtattgggtggtgataagcccattggattgtccccttggggggatgagctaggggtgcaaggaacacctgatgagtagataagtggagctcatggtatttcctgaaagatgctaatctatttgccaaacttggtcttgaatgtactgggggcttcaaggtatgggtatatttttcttgtgtccttgcagttagcccccatgtcttatgtgtgtcctgaaaaaataagagcctgcccaagactttgggcctcttgacagaattaaccacttttatacatctgagttctcttggtaagttctttagcagtgttcaaagtctactagctcgcattagtttctgttgctgccaacagatctgaactaatgctaacagatccccctgagggattcttgatgggctgagcagctggctggagctagtactgactgacattcattgtgatgagggcagctttctggtacaggattctaagctctatgttttatatacattttcatctgtacttgcacctcactttacacaagaggaaactatgcaaagttagctggatcgctcaaggtcacttaggtaagttggcaagtccatgcttcccactcagctcctcaggtcagcaagtctacttctctgcctattttgtatactctctttaatatgtgcctagctttggaaagtctagaatgggtccctggtgcctttttactttgaagaaatcagtttctgcctctttttggaaaagaaaacaaagtgcaattgttttttactggaaagttacccaatagcatgaggtgaacaggacgtagttaggccttcctgtaaacagaaaatcatatcaaaacactatcttcccatctgtttctcaatgcctgctacttcttgtagatatttcatttcaggagagcagcagttaaacccgtggattttgtagttaggaacctgggttcaaaccctcttccactaattggctatgtctctggacaagtttttttttttttttttttttaaaccctttctgaactttcactttctatgtctacctcaaagaattgttgtgaggcttgagataatgcatttgtaaagggtctgccagataggaagatgctagttatggatttacaaggttgttaaggctgtaagagtctaaaacctacagtgaatcacaatgcatttacccccactgacttggacataagtgaaaactagccagaagtctctttttcaaattacttacaggttattcaatataaaatttttgtaatggataatcttatttatctaaactaaagcttcctgtttatacacactcctgttattctgggataagataaatgaccacagtaccttaatttctaggtgggtgcctgtgatggttcattgtaggtaaggacattttctctttttcagcagctgtgtaggtccagagcctctgggagaggaggggggtagcatgcacccagcaggggactgaactgggaaactcaaggttctttttactgtggggtagtgagctgcctttctgtgatcggtttccctagggatgttgctgttcccctccttgctattcgcagctacatacaacgtggccaaccccagtaggctgatcctatatatgatcagtgctggtgctgactctcaatagccccacccaagctggctataggtttacagatacattaattaggcaacctaaaatattgatgctggtgttggtgtgacataatgctatggccagaactgaaacttagagttataattcatgtattagggttctccagagggacagaattagtaggatatatgtatatatgaaagggaggttattagggagaactggctcccacagttagaaggcgaagtcgcacaataggccgtctgcaagctgggttagagagaagccagtagtggctcagcctgagttcaaaaacctcaaaactggggaagctgacagtgcagccagccttcagtctgtggccaaaggcccaagagcccctggcaaccaacccactggtgcaagtcctagattccaaaggctgaagaacctggagtctgatgtccaagagcaggaagagtggaagaaagccagaagactcagcaaacaaggtagacagtgtctaccaccacagtggccataccaaagaggctaccgattccttcctgctacctggatccctgaagttgccctggtctctgcaccttctaaacctagttcttaagagctttccattacatgagctgtctcaaagccctccaataaattctcagtgtaagcttctgttgcttgtggacagaaaattctgacagacctaccctataagtgttactgtcaggataacatgagaacgcacaacagtaagtggtcactaagtgttagctacggttattttgcccaaggtagcatggctagttgatgccggttgatggggcttaaacccagctccctcatcttccaggcctctgtactccctattccactaaactacctctcaggtttatttttttaaattcttactctgcaagtacataggaccacatttacctgggaaaacaagaataaaggctgctctgcattttttagaaacttttttgaaagggagatgggaatgcctgcacccccaagtccagaccaacacaatggttaattgagatgaataataaaggaaagactgttctgggcttcccagaatagcttggtccttaaattgtggcacaaacaacctcctgtcagagccagcctcctgccaggaagaggggtaggagactagaggccgtgtgtgcagccttgccctgaaggctagggtgacaatttggaggctgtccaaacaccctggcctctagagctggcctgtctatttgaaatgccggctctgatgctaatcggcgaccctcaggcaagttacttaaccttacatgcctcagttttctcatctggaaaatgagaaccctaggtttagggttgttagaaaagttaaatgagttaagacaagtgcctgggacacagtagcctcttgtgtgtgtttatcattatgtcctcagcaggtcgtagaagcagcttctcaggtgtgaggctggcgcgattatctggagtgggttgggttttctaggatggaccccctgctgcattttcctcattcatccaccagggcttaatggggaatcaaggaatccatgtgtaactgtataataactgtagccacactccaatgaccacctactagttgtccctggcactgcttatacatatgtccatcaaatcaatcctatgaagtagatactgtcttcattttatagatcagagacaattggggttcagagagctgatgtgattttcccagggtcacagagagtcccagattcaggcacaactcttgtattccaagacacaaccactacatgtccaaaggctgcccagagccaccgggcacggcaaattgtgacatatccctaaagaggctgagcacctggtcaggatctgatggctgacagtgtgtccagatgcagagctggagtgggggaggggaaggggggctccttgggacagagaaggctttctgtgctttctctgaagggagcagtctgaggaccaagggaacccggcaaacagcacctcaggtactccaggccctcctggctggagagggctgtggcaatggaaaattagtgccaactgcaatgagtcagcctcggttaaatagagagtgaagaatgctggacaggaacctccaccctcatgtcacatttcttcagtgtgacccttctggcccctctcctcctgacagcggaacaatgactgccccgataggtgaggctggaggaagaatcagtcctgtccttggcaagctcttcactatgacagtaaaggctctctgcctgctgccaaggcctgtgactttctaacctggcctcacgctgggtaagcttaaggtagaggtgcaggattagcaagcccacctggctaccaggccgacagctacatctttcaactgaccctgatcaacgaagagggacttgtgtctctcagttggttccaaatgaaaccagggagcaggggcgttaggaagctccaacaggatggtacttaatggggcatttgagtggagaggtaggtgacatagtgctttggagcccagggagggaaaggttctgctgaagttgaattcaagactgttctttcatcacaaacttgagtttcctggacatttgtttgcagaaacaaccgtagggttttgccttaacctcgtgggtttattattacctcatagggactttgcctcctgacagcagtttatgggtgttcattgtggcacttgagttttcttgcatacttgttagagaaaccaagtttgtcatcaacttcttatttaaccccctggctataacttcatggattatgttataattaagccatccagagtaaaatctgtttagattatcttggagtaagggggaaaaaatctgtaattttttctcctcaactagatatatacataaaaaatgattgtattgcttcatttaaaaaatataacgcaaaatctcttttccttctaagggcctttaatatgtaataacaagagctaatgttgaacaca

SEQ ID NO: 427351 - DNA, 1464 bp, Homo sapiens
gccgagtgcgggctgagaaggcggtggctgcagcagcagcggcggcggaaaccctaaagtccgagtccggactacgagtgcgtggcctcctaatccggatcctagtcctgagcgtgtctgtgtgcgagtggacggtcccggacgcgatgaccctgaacggcggcggcagcggagcgggcgggagccgcggtgggggccaggagcgcgagcgccgtcggggcagcacaccctggggccccgccccgccgctgcaccgccgcagcatgccggtggacgagcgcgacctgcaggcggcgctgaccccgggtgccctgacggcggccgcggccgggacggggacccagggtcccaggctggactggcccgaggactccgaggactcgctcagctcagggggcagcgactcagacgagagcgtttacaaggtgctgctgctgggggcgcccggcgtgggcaagagcgccctggcgcgcatcttcggcggtgtggaggacgggcctgaagcagaggcagcagggcacacctatgatcgctccattgtagtggacggagaagaggcatcactcatggtctacgacatttgggagcaggacgggggccgctggttgcccggccactgcatggccatgggggatgcctatgtcattgtgtactcagtgacggacaagggcagcttcgagaaggcctcagaactgcgggtccagctgcggcgtgcacggcaaacagatgatgtgcccatcatcctcgtgggcaacaagagcgacctggtgcgctctcgtgaggtctcggtggatgagggccgggcctgcgcggtggtctttgactgcaagttcattgagacatcagcggcattgcaccacaatgtccaggcgctgtttgaaggtgtcgtgcgccagatacgcctgcgcagggacagcaaagaagccaacgcacgacggcaagcaggcacccggaggcgagagagccttggcaaaaaggcgaagcgcttcttgggccgcatcgtagctcgtaacagccgcaagatggcctttcgcgccaaatccaagtcctgccacgacctctcggttctctaggtcccacccgctcccactatggtgggagacgaacggaagggttggtgggctggcccagccaactgccccgggtgcctcagagcaggctcagactctgggtccctcggagctgccagccgggcacccccaacctcatggtcatggacagatagacagtgctgccctgcgaagtggctctcaggggccagtgagggctgggcccacagagatgcatgcgcaggctcatatgcgtcccaagcagccgcagcgcagccgccgggcaggcctgcgtgccgggagaggactctgccttttttcacagcccgggtgtgcctgccctggagggaggctcttcagtgcggtagctatttgtttacatgcagatttttgtaataaaggctatttcctgata

SEQ ID NO: 427352 - DNA, 985 bp, Homo sapiens
tcatatgcgtccaagcagccgcagcgcctggcccagccaactgccccgggtgcctcagagcaggctcagactctgggtccctcggagctgccagccgggcacccccaacctcatggtcatggacagatagacagtgctgccctgcgaagtggctctcaggggccagtgagggctagcccaccagcccttccgttcgtctcccaccatagtgggagcgggtgggacctaaggatgacccgagtaggtcgtgcgcacggactcggctttggcgcgaccggccatcttgcgcgctgttccgagctacgatgctggcccacgcagcgcttcgcctttttgcccggctctctcgcctccggggtgcctgcttgccgcccgctgcgttggcttctttgctgtccctgcgccggcgcttctggcgcacgactccttccatcagcgcctggcaccgttgtggtgcaactgccgctgatgtctcagtgaccttgcgccagaggaccaccgcgcgcggcccggccctcgctccaccgagaaccgtcacgagagcgccccaggtcgccgcttgttgccacgaggctgatgggccctcatctgtttgcgcgcccgccgctcctggccccgccgtgctgcggctctccagcctgccctgtcgtcctgacctccacgagtgagctatggcctccccatggcctgcggtggccgtgcacctgcggccccccgtcctgctccgcgcgtgtcccgacagtcgcgatgctcctcctcccgccttccatgcgcgctcctcgggcctcgtggcctgcgtcggtccggtctccgcgctacgtgctgccggccgcctgctctcgggggcccaccccgcccttctacgccgcgtggcgcctcacgacgccgtcgctcgtcccgtggcgcgcccttcttcgctctcttcggcgcgccggcaccgcgccccccggccgccccgcgctgcgcccctgtcccgccgcgcgct

SEQ ID NO: 427353 - DNA, 963 bp, Homo sapiens
gccgagtgcgggctgagaaggcggtggctgcagcagcagcggcggcggaaaccctaaagtccgagtccggactacgagtgcgtggcctcctaatccggatcctagcctgcgtgccgggagaggactctgccttttttcacagcccgggtgtgcctgccctggagggaggctcttcagtgcggtagctatttgtttacatgcagatttttgtaataaaggctatttcctgataaaaaaaaaaaaaaaaaaaaaaaaaaaattttgtgggcggccgtcggcctgaaaaaagtttttaaacccttctgtttgggggcggggccccattgggtctagtaaaccactggcgccaaaagcgcggtagccacaagggcagacccgggatcagagcccatagggcttgggttctcccccaatataaaaaacgccgggcggaaaccaccgaggggttctaggaacacaactcccagattggcgagtcgggggccacatacgcggggtcttacacacaagaggtctccacggggaggccgatattaaaattaggcgcggccggggagggcgacaccaacggcgactcaagcaacacgcacacaagggagacaccccccacggcacaccgaataacatatacaatacagcaacgaccaaccgagaccaaaaatggcggcgagtaagaggaagcagcgaacggaacaaagaaaggaggaacgagagaaggaacgagaggagaggaagaagacacagagatagaacagaggaggcgggcgagcgaaaggaggagaggggagagaccagacgacaggcgccgagcaagcaggaacgaagtaggagcaccacagagcggcaccgaggtcaacgaatgtaggaacgaagcgaggacacagagcgaaaagacacagcaggagggaaaaagaagaggctgagagggaccgggccagaatcgaagacgtcagagacgcacat

SEQ ID NO: 427354 - DNA, 1516 bp, Homo sapiens
gccgagtgcgggctgagaaggcggtggctgcagcagcagcggcggcggaaaccctaaagtccgagtccggactacgagtgcgtggcctcctaatccggatcctagtcctgagcgtgtctgtgtgcgagtggacggtcccggacgcgatgaccctgaacggcggcggcagcggagcgggcgggagccgcggtgggggccaggagcgcgagcgccgtcggggcagcacaccctggggccccgccccgccgctgcaccgccgcagcatgccggtggacgagcgcgacctgcaggcggcgctgaccccgggtgccctgacggcggccgcggccgggacggggacccagggtcccaggctggactggcccgaggactccgaggactcgctcagctcagggggcagcgactcagacgagagcgtttacaaggtgctgctgctgggggcgcccggcgtgggcaagagcgccctggcgcgcatcttcggcggtgtggaggacgggcctgaagcagaggcagcagggcacacctatgatcgctccattgtagtggacggagaagaggcatcactcatggtctacgacatttgggagcaggacgggggccgctggttgcccggccactgcatggccatgggggatgcctatgtcattgtgtactcagtgacggacaagggcagcttcgagaaggcctcagaactgcgggtccagctgcggcgtgcacggcaaacagatgatgtgcccatcatcctcgtgggcaacaagagcgacctggtgcgctctcgtgaggtctcggtggatgagggccgggcctgcgcggtggtctttgactgcaagttcattgagacatcagcggcattgcaccacaatgtccaggcgctgtttgaaggtgtcgtgcgccagatacgcctgcgcagggacagcaaagaagccaacgcacgacggcaagcaggcacccggaggcgagagagccttggcaaaaaggcgaagcgcttcttgggccgcatcgtagctcgtaacagccgcaagatggcctttcgcgccaaatccaagtcctgccacgacctctcggttctctaggtcccacccgctcccactatggtgggagacgaacggaagggttggtgggctggcccagccaactgccccgggtgcctcagagcaggctcagactctgggtccctcggagctgccagccgggcacccccaacctcatggtcatggacagatagacagtgctgccctgcgaagtggctctcaggggccagtgagggctgggcccacagagatgcatgcgcaggctcatatgcgtcccaagcagccgcagcgcagccgccgggcaggcctgcgtgccgggagaggactctgccttttttcacagcccgggtgtgcctgccctggagggaggctcttcagtgcggtagctatttgtttacatgcagatttttgtaataaaggctatttcctgataaaaaaaagtcgacgcggccgcgaatttagtagtagtaggcggccgctctaga

SEQ ID NO: 427355 - DNA, 1317 bp, Homo sapiens
gccgagtgcgggctgagaaggcggtggctgcagcagcagcggcggcggaaaccctaaagtccgagtccggactacgagtgcgtggcctcctaatccggatcctagtcctgagcgtgtctgtgtgcgagtggacggtcccggacgcgatgaccctgaacggcggcggcagcggagcgggcgggagccgcggtgggggccaggagcgcgagcgccgtcggggcagcacaccctggggccccgccccgccgctgcaccgccgcagcatgccggtggacgagcgcgacctgcaggcggcgctgaccccgggtgccctgacggcggccgcggccgggacggggacccagggtcccaggctggactggcccgaggactccgaggactcgctcagctcagggggcagcgactcagacgagagcgtttacaaggtgctgctgctgggggcgcccggcgtgggcaagagcgccctggcgcgcatcttcggcggtgtggaggacgggcctgaagcagaggcagcagggcacacctatgatcgctccattgtagtggacggagaagaggcatcactcatggtctacgacatttgggagcaggacgggggccgctggttgcccggccactgcatggccatgggggatgcctatgtcattgtgtactcagtgacggacaagggcagcttcgagaaggcctcagaactgcgggtccagctgcggcgtgcacggcaaacagatgatgtgcccatcatcctcgtgggcaacaagagcgacctggtgcgctctcgtgaggtctcggtggatgagggccgggcctgcgcggtggtctttgactgcaagttcattgagacatcagcggcattgcaccacaatgtccaggcgctgtttgaaggtgtcgtgcgccagatacgcctgcgcagggacagcaaagaagccaacgcacgacggcaagcaggcacccggaggcgagagagccttggcaaaaaggcgaagcgcttcttgggccgcatcgtagctcgtaacagccgcaagatggcctttcgcgccaaatccaagtcctgccacgacctctcggttctctaggtcccacccgctcccactatggtgggagacgaacggaagggttggtggggggcccacagagatgcatgcgcaggctcatatgcgtcccaagcagccgcagcgcagccgccgggcaggcctgcgtgccgggagaggactctgccttttttcacagcccgggtgtgcctgccctggagggaggctcttcagtgcggtagctatttgtttacatgcagatttttgtaataaaggctatttcctgata

SEQ ID NO: 427356 - DNA, 1203 bp, Homo sapiens
gccgagtgcgggctgagaaggcggtggctgcagcagcagcggcggcggaaaccctaaagtccgagtccggactacgagtgcgtggcctcctaatccggatcctagtcctgagcgtgtctgtgtgcgagtggacggtcccggacgcgatgaccctgaacggcggcggcagcggagcgggcgggagccgcggtgggggccaggagcgcgagcgccgtcggggcagcacaccctggggccccgccccgccgctgcaccgccgcagcatgccggtggacgagcgcgacctgcaggcggcgctgaccccgggtgccctgacggcggccgcggccgggacggggacccagggtcccaggctggactggcccgaggactccgaggactcgctcagctcagggggcagcgactcagacgagagcgtttacaaggtgctgctgctgggggcgcccggcgtgggcaagagcgccctggcgcgcatcttcggcggtgtggaggacgggcctgaagcagaggcagcagggcacacctatgatcgctccattgtagtggacggagaagaggcatcactcatggtctacgacatttgggagcaggacgggggccgctggttgcccggccactgcatggccatgggggatgcctatgtcattgtgtactcagtgacggacaagggcagcttcgagaaggcctcagaactgcgggtccagctgcggcgtgcacggcaaacagatgatgtgcccatcatcctcgtgggcaacaagagcgacctggtgcgctctcgtgaggtctcggtggatgagggccgggcctgcgcggtggtctttgactgcaagttcattgagacatcagcggcattgcaccacaatgtccaggcgctgtttgaaggtgtcgtgcgccagatacgcctgcgcagggacagcaaagaagccaacgcacgacggccaacctcatggtcatggacagatagacagtgctgccctgcgaagtggctctcaggggccagtgagggctgggcccacagagatgcatgcgcaggctcatatgcgtcccaagcagccgcagcgcagccgccgggcaggcctgcgtgccgggagaggactctgccttttttcacagcccgggtgtgcctgccctggagggaggctcttcagtgcggtagctatttgtttacatgcagatttttgtaataaaggctatttcctgata

SEQ ID NO: 427357 - DNA, 1368 bp, Homo sapiens
gccgagtgcgggctgagaaggcggtggctgcagcagcagcggcggcggaaaccctaaagtccgagtccggactacgagtgcgtggcctcctaatccggatcctagtcctgagcgtgtctgtgtgcgagtggatcggtcccggacatcgatgtaccctgaacgtgcggcgagcagtcggacgtcgggcgtggcatgccgctggtggtgggcctaggacgcgctgaggcgctgtcggaggcgagcgacttcagacgatgatcgtctacatagggttgctgctgtctggtgggctgcccggcgttgtggcaagaagtctgccctggacgcgccatctttcgtgccgtgtgtggaggactgggtcctgtaagcctagacggctgactagtggctgcacctatgcatcgtctccatttgtacgtgggaccggaagacagaggcaatcactacatcgtgtctacgaacattttgtggaagcatggattggtgctgctcgcgtggtatgccccgtgccaagtagagttggccattggaggtgatcgccctatgtcattgtgtactcagtgacggacaagggcagcttcgagaaggcctcagaactgcgggtccagctgcggcgtgcacggcaaacagatgatgtgcccatcatcctcgtgggcaacaagagcgacctggtgcgctctcgtgaggtctcggtggatgagggccgggcctgcgcggtggtctttgactgcaagttcattgagacatcagcggcattgcaccacaatgtccaggcgctgtttgaaggtgtcgtgcgccagatacgcctgcgcagggacagcaaagaagccaacgcacgacggcaagcaggcacccggaggcgagagagccttggcaaaaaggcgaagcgcttcttgggccgcatcgtagctcgtaacagccgcaagatggcctttcgcgccaaatccaagtcctgccacgacctctcggttctctaggtcccacccgctcccactatggtgggagacgaacggaagggttggtgggctggcccagccaactgccccgggtgcctcagagcaggctcagactctgggtccctcggagctgccagccgggcacccccaacctcatggtcatggacagatagacagtgctgccctgcgaagtggctctcaggggccagtgagggctgggcccacagagatgcatgcgcaggctcatatgcgtcccaagcagccgcagcgcagccgccgggcaggcctgcgtgccgggagaggactctgccttttttcacagcccgggtgtgcctgccctggagggaggctcttcagtgcggtagctatttgtttacatgcagatttttgtaataaaggctatttcctgata

SEQ ID NO: 427358 - DNA, 1089 bp, Homo sapiens
gccgagtgcgggctgagaaggcggtggctgcagcagcagcggcggcggaaaccctaaagtccgagtccggactacgagtgcgtggcctcctaatccggatcctagtcctgagcgtgtctgtgtgcgagtggacggtcccggacgcgatgaccctgaacggcggcggcagcggagcgggcgggagccgcggtgggggccaggagcgcgagcgccgtcggggcagcacaccctggggccccgccccgccgctgcaccgccgcagcatgccggtggacgagcgcgacctgcaggcggcgctgaccccgggtgccctgacggcggccgcggccgggacggggacccagggtcccaggctggactggcccgaggactccgaggactcgctcagctcagggggcagcgactcagacgagagcgtttacaaggtgctgctgctgggggcgcccggcgtgggcaagagcgccctggcgcgcatcttcggcggtgtggaggacgggcctgaagcagaggcagcagggcacacctatgatcgctccattgtagtggacggagaagaggcatcactcatggtctacgacatttgggagcaggacgggggccgctggttgcccggccactgcatggccatgggggatgcctatgtcattgtgtactcagtgacggacaagggcagcttcgagaaggcctcagaactgcgggtccagctgcggcgtgcacggcaaacagatgatgtgcccatcatcctcgtgggcaacaagagcgacctggtgcgctctcgtgaggtctcggtggatgagggccgggcctgcgcggtggtctttgactgcaagttcattgagacatcagcggcattgcaccacaatgtccaggcgctgtttgaaggtgtcgtgcgccagatacgcctgcgcagggacagcaaagaagccaacgcacgacggcccgcagcgcagccgccgggcaggcctgcgtgccgggagaggactctgccttttttcacagcccgggtgtgcctgccctggagggaggctcttcagtgcggtagctatttgtttacatgcagatttttgtaataaaggctatttcctgata

SEQ ID NO: 427359 - DNA, 906 bp, Homo sapiens
gccgagtgcgggctgagaaggcggtggctgcagcagcagcggcggcggaaaccctaaagtccgagtccggactacgagtgcgtggcctcctaatccggatcctagtcctgagcgtgtctgtgtgcgagtggacggtcccggacgcgatgaccctgaacggcggcggcagcggagcgggcgggagccgcggtgggggccaggagcgcgagcgccgtcggggcagcacaccctggggccccgccccgccgctgcaccgccgcagcatgccggtggacgagcgcgacctgcaggcggcgctgaccccgggtgccctgacggcggccgcggccgggacggggacccagggtcccaggctggactggcccgaggactccgaggactcgctcagctcagggggcagcgactcagacgagagcgtttacaaggtgctgctgctgggggcgcccggcgtgggcaagagcgccatggcctttcgcgccaaatccaagtcctgccacgacctctcggttctctaggtcccacccgctcccactatggtgggagacgaacggaagggttggtgggctggcccagccaactgccccgggtgcctcagagcaggctcagactctgggtccctcggagctgccagccgggcacccccaacctcatggtcatggacagatagacagtgctgccctgcgaagtggctctcaggggccagtgagggctgggcccacagagatgcatgcgcaggctcatatgcgtcccaagcagccgcagcgcagccgccgggcaggcctgcgtgccgggagaggactctgccttttttcacagcccgggtgtgcctgccctggagggaggctcttcagtgcggtagctatttgtttacatgcagatttttgtaataaaggctatttcctgata

SEQ ID NO: 427360 - DNA, 830 bp, Homo sapiens
gccgagtgcgggctgagaaggcggtggctgcagcagcagcggcggcggaaaccctaaagtccgagtccggactacgagtgcgtggcctcctaatccggatcctagtcctgagcgtgtctgtgtgcgagtggacggtcccggacgcgatgaccctgaacggcggcggcagcggagcgggcgggagccgcggtgggggccaggagcgcgagcgccgtcggggcagcacaccctggggccccgccccgccgctgcaccgccgcagcatgccggtggacgagcgcgacctgcaggcggcgctgaccccgggtgccctgacggcggccgcggccgggacggggacccagggtcccaggctggactggcccgaggactccgaggactcgctcagctcagggggcagcgactcagacgagagcgtttacaaggtgctgctgctgggggcgcccggcgtgggcaagagcgccctggcgcgcatcttcggcggtgtggaggacgggcctgaagcagaggcagcagggcacacctatgatcgctccattgtagtggacggagaagaggcatcactccaacctcatggtcatggacagatagacagtgctgccctgcgaagtggctctcaggggccagtgagggctgggcccacagagatgcatgcgcaggctcatatgcgtcccaagcagccgcagcgcagccgccgggcaggcctgcgtgccgggagaggactctgccttttttcacagcccgggtgtgcctgccctggagggaggctcttcagtgcggtagctatttgtttacatgcagatttttgtaataaaggctatttcctgata

SEQ ID NO: 427361 - DNA, 868 bp, Homo sapiens
gccgagtgcgggctgagaaggcggtggctgcagcagcagcggcggcggaaaccctaaagtccgagtccggactacgagtgcgtggcctcctaatccggatcctagtcctgagcgtgtctgtgtgcgagtggacggtcccggacgcgatgaccctgaacggcggcggcagcggagcgggcgggagccgcggtgggggccaggagcgcgagcgccgtcggggcagcacaccctggggccccgccccgccgctgcaccgccgcagcatgccggtggacgagcgcgacctgcaggcggcgctgaccccgggtgccctgacggcggccgcggccgggacggggacccagggtcccaggctggactggcccgaggactccgaggactcgctcagctcagggggcagcgactcagacgagagcgtttacaaggtgctgctgctgggggcgcccggcgtgggcaagagcgccctggcgcgcatcttcggcggtgtggaggacgggcctgaagcagaggcagcagggcacacctatgatcgctccattgtagtggacggagaagaggcatcactcatggtctacgacatttgggagcaggacgggggccgctggttgcccggccactgcatggccatgggggatgcctatgtcattgtgtactcagtgacggacaagggcaggggcccacagagatgcatgcgcaggctcatatgcgtcccaagcagccgcagcgcagccgccgggcaggcctgcgtgccgggagaggactctgccttttttcacagcccgggtgtgcctgccctggagggaggctcttcagtgcggtagctatttgtttacatgcagatttttgtaataaaggctatttcctgata

SEQ ID NO: 427362 - DNA, 363 bp, Homo sapiens
gccgcagtgtgcctggattcgctggcccagccaactgccccgggtgcctcagagcaggctcagactctgggtccctcggagctgccagccgggcacccccaacctcatggtcatggacagatagacagtgctgccctgcgaagtggctctcaggggccagtgagggctgggcccacagagatgcatgcgcaggctcatatgcgtcccaagcagccgcagcgcagccgccgggcaggcctgcgtgccgggagaggactctgccttttttcacagcccgggtgtgcctgccctggagggaggctcttcagtgcggtagctatttgtttacatgcagatttttgtaataaaggctatttcctgata

SEQ ID NO: 427363 - DNA, 627 bp, Homo sapiens
gccgagtgcgggctgagaaggcggtggctgcagcagcagcggcggcggaaaccctaaagtccgagtccggactacgagtgcgtggcctcctaatccggatcctagtcctgagcgtgtctgtgtgcgagtggacggtcccggacgcgatgaccctgaacggcggcggcagcggagcgggcgggagccgcggtgggggccaggagcgcgagcgccgtcggggcagcacaccctggggccccgccccgccgctgcaccgccgcagcatgccggtggacgagcgcgacctgcaggcggcgctgaccccgggtgccctgacggcggccgcggccgggacggggacccagggtcccaggctggactggcccgaggactccgaggactcgctcagctcagggggcagcgactcagacgagagcgtttacaaggtgctgctgctgggggcgcccggcgtgggcaagagcgccctggcgcgcatcttcggcggtgtggaggacgggcctgaagcagaggcagcagggcacacctatgatcgctccattgtagtggacggagaagaggcatcactcccatgcagtgccgggcaaccagcggcccccgtcctgctcccaaatgtcgtagaccatgagt

SEQ ID NO: 427364 - DNA, 525 bp, Homo sapiens
aaaataaaatactaagttgtccaacatagttctcattttcctgtgtttactactgtcgtactttgtttaaatatcaggcttcaaattatttcaataaatggatctccttttgagggccactgttttgggggctccttaaatgcaggcactctgcctactgggtgacgcagcagtgcccagtaccctcagtacaggagctggggtctctgtgttttcggggaggaccttgcaaattctcgagtggcagcttccatgggtggccactgttggaggggactcctcattcacccaccctttgtttactggtgcctgcctttccccacccacacagggcccacagagatgcatgcgcaggctcatatgcgtcccaagcagccgcagcgcagccgccgggcaggcctgcgtgccgggagaggactctgccttttttcacagcccgggtgtgcctgccctggagggaggctcttcagtgcggtagctatttgtttacatgcagatttttgtaataaaggctatttcctgata

SEQ ID NO: 427365 - DNA, 1589 bp, Homo sapiens
gccgagtgcgggctgagaaggcggtggctgcagcagcagcggcggcggaaaccctaaagtccgagtccggactacgagtgcgtggcctcctaatccggatcctagtcctgagcgtgtctgtgtgcgagtggacggtcccggacgcgatgaccctgaacggcggcggcagcggagcgggcgggagccgcggtgggggccaggagcgcgagcgccgtcggggcagcacaccctggggccccgccccgccgctgcaccgccgcagcatgccggtggacgagcgcgacctgcaggcggcgctgaccccgggtgccctgacggcggccgcggccgggacggggacccagggtcccaggctggactggcccgaggactccgaggactcgctcagctcagggggcagcgactcagacgagagcgtttacaaggtgctgctgctgggggcgcccggcgtgggcaagagcgccctggcgcgcatcttcggcggtgtggaggacgggcctgaagcagaggcagcagggcacacctatgatcgctccattgtagtggacggagaagaggcatcactcatggtctacgacatttgggagcaggtagggtgcaagcagagacccagggcaggggagggaggagtgagttgggttagaggtctgggagtgccaggctcgtgtcgggggcatgaggactgttgggcagatgtgtgttgtgtgttctccaggacgggggccgctggttgcccggccactgcatggccatgggggatgcctatgtcattgtgtactcagtgacggacaagggcagcttcgagaaggcctcagaactgcgggtccagctgcggcgtgcacggcaaacagatgatgtgcccatcatcctcgtgggcaacaagagcgacctggtgcgctctcgtgaggtctcggtggatgagggccgggcctgcgcggtggtctttgactgcaagttcattgagacatcagcggcattgcaccacaatgtccaggcgctgtttgaaggtgtcgtgcgccagatacgcctgcgcagggacagcaaagaagccaacgcacgacggcaagcaggcacccggaggcgagagagccttggcaaaaaggcgaagcgcttcttgggccgcatcgtagctcgtaacagccgcaagatggcctttcgcgccaaatccaagtcctgccacgacctctcggttctctaggtcccacccgctcccactatggtgggagacgaacggaagggttggtgggctggcccagccaactgccccgggtgcctcagagcaggctcagactctgggtccctcggagctgccagccgggcacccccaacctcatggtcatggacagatagacagtgctgccctgcgaagtggctctcaggggccagtgagggctgggcccacagagatgcatgcgcaggctcatatgcgtcccaagcagccgcagcgcagccgccgggcaggcctgcgtgccgggagaggactctgccttttttcacagcccgggtgtgcctgccctggagggaggctcttcagtgcggtagctatttgtttacatgcagatttttgtaataaaggctatttcctgata

SEQ ID NO: 427366 - DNA, 5012 bp, Homo sapiens
cgcgcagcatgcccgccagcgccccgccgcgccgcccgcggccgccgccgccgtcgctgtcgctgctgctggtgctgctgggcctgggcggccgccgcctgcgtgcggagccgggcgacggcgcgcagacctgggcccgtgtctcgcggcctcctgcccccgaggccgcgggcctcttccagggcaccttccccgacggcttcctctgggccgtgggcagcgccgcctaccagaccgagggcggctggcagcagcacggcaagggtgcgtccatctgggacacgttcacccaccaccccctggcacccccgggagactcccggaacgccagtctgccgttgggcgccccgtcgccgctgcagcccgccaccggggacgtagccagcgacagctacaacaacgtcttccgcgacacggaggcgctgcgcgagctcggggtcactcactaccgcttctccatctcgtgggcgcgagtgctccccaatggcagcgcgggcgtccccaaccgcgaggggctgcgctactaccggcgcctgctggagcggctgcgggagctgggcgtgcagcccgtggtcaccctgtaccactgggacctgccccagcgcctgcaggacgcctacggcggctgggccaaccgcgccctggccgaccacttcagggattacgcggagctctgcttccgccacttcggcggtcaggtcaagtactggatcaccatcgacaacccctacgtggtggcctggcacggctacgccaccgggcgcctggcccccggcatccggggcagcccgcggctcgggtacctggtggcgcacaacctcctcctggctcatgccaaagtctggcatctctacaatacttctttccgtcccactcagggaggtcaggtgtccattgccctaagctctcactggatcaatcctcgaagaatgaccgaccacagcatcaaagaatgtcaaaaatctctggactttgtactaggttggtttgccaaacccgtatttattgatggtgactatcccgagagcatgaagaataacctttcatctattctgcctgattttactgaatctgagaaaaagttcatcaaaggaactgctgacttttttgctctttgctttggacccaccttgagttttcaacttttggaccctcacatgaagttccgccaattggaatctcccaacctgaggcaactgctttcctggattgaccttgaatttaaccatcctcaaatatttattgtggaaaatggctggtttgtctcagggaccaccaagagagatgatgccaaatatatgtattacctcaaaaagttcatcatggaaaccttaaaagccatcaagctggatggggtggatgtcatcgggtataccgcatggtccctcatggatggtttcgagtggcacagaggttacagcatcaggcgtggactcttctatgttgactttctaagccaggacaagatgttgttgccaaagtcttcagccttgttctaccaaaagctgatagagaaaaatggcttccctcctttacctgaaaatcagcccctagaagggacatttccctgtgactttgcttggggagttgttgacaactacattcaagtagataccactctgtctcagtttaccgacctgaatgtttacctgtgggatgtccaccacagtaaaaggcttattaaagtggatggggttgtgaccaagaagaggaaatcctactgtgttgactttgctgccatccagccccagatcgctttactccaggaaatgcacgttacacattttcgcttctccctggactgggccctgattctccctctgggtaaccagtcccaggtgaaccacaccatcctgcagtactatcgctgcatggccagcgagcttgtccgtgtcaacatcaccccagtggtggccctgtggcagcctatggccccgaaccaaggactgccgcgcctcctggccaggcagggcgcctgggagaacccctacactgccctggcctttgcagagtatgcccgactgtgctttcaagagctcggccatcacgtcaagctttggataacgatgaatgagccgtatacaaggaatatgacatacagtgctggccacaaccttctgaaggcccatgccctggcttggcatgtgtacaatgaaaagtttaggcatgctcagaatgggaaaatatccatagccttgcaggctgattggatagaacctgcctgccctttctcccaaaaggacaaagaggtggccgagagagttttggaatttgacattggctggctggctgagcccattttcggctctggagattatccatgggtgatgagggactggctgaaccaaagaaacaattttcttcttccttatttcactgaagatgaaaaaaagctaatccagggtacctttgactttttggctttaagccattataccaccatccttgtagactcagaaaaagaagatccaataaaatacaatgattacctagaagtgcaagaaatgaccgacatcacgtggctcaactcccccagtcaggtggcggtagtgccctgggggttgcgcaaagtgctgaactggctgaagttcaagtacggagacctccccatgtacataatatccaacggaatcgatgacgggctgcatgctgaggacgaccagctgagggtgtattatatgcagaattacataaacgaagctctcaaagcccacatactggatggtatcaatctttgcggatactttgcttattcgtttaacgaccgcacagctccgaggtttggcctctatcgttatgctgcagatcagtttgagcccaaggcatccatgaaacattacaggaaaattattgacagcaatggtttcccgggcccagaaactctggaaagattttgtccagaagaattcaccgtgtgtactgagtgcagtttttttcacacccgaaagtctttactggctttcatagcttttctattttttgcttctattatttctctctcccttatattttactactcgaagaaaggcagaagaagttacaaatagttctgaacatttttctattcattcattttgaaataattatgcagacacatcagctgttaaccatttgcacctctaagtgttgtgaaactgtaaatttcatacatttgacttctagaaaacatttttgtggcttatgacagaggttttgaaatgggcataggtgatcgtaaaatattgaataatgcgaatagtgcctgaatttgttctctttttgggtgattaaaaaactgacaggcactataatttctgtaacacactaacaaaagcatgaaaaataggaaccacaccaatgcaacatttgtgcagaaatttgaatgacaagattaggaatattttcttctgcacccacttctaaatttaatgtttttctggaagtagtaattgcaagagttcgaatagaaagttatgtaccaagtaaccatttctcagctgccataataatgcctagtggcttcccctctgtcaaatctagtttcctatggaaaagaagatggcagatacaggagagacgacagagggtcctaggctggaatgttcctttcgaaagcaatgcttctatcaaatactagtattaatttatgtatctggttaatgacatacttggagagcaaattatggaaatgtgtattttatatgatttttgaggtcctgtctaaaccctgtgtccctgagggatctgtctcactggcatcttgttgagggccttgcacataggaaacttttgataagtatctgcggaaaaacaaacatgaatcctgtgatattgggctcttcaggaagcataaagcaattgtgaaatacagtataccgcagtggctctaggtggaggaaaggaggaaaaagtgcttattatgtgcaacattatgattaatctgattatacaccatttttgagcagatcttggaatgaatgacatgacctttccctagagaataaggatgaaataatcactcattctatgaacagtgacactactttctattctttagctgtactgtaatttctttgagttgatagttttacaaattcttaataggttcaaaagcaatctggtctgaataacactggatttgtttctgtgatctctgaggtctattttatgtttttgctgctacttctgtggaagtagctttgaactagttttactttgaactttcacgctgaaacatgctagtgatatctagaaagggctaattaggtctcatcctttaatgccccttaaataagtcttgctgattttcagacagggaagtctctctattacactggagctgttttatagataagtcaatattgtatcaggcaagataaaccaatgtcataacaggcattgccaacctcactgacacagggtcatagtgtataataatatactgtactatataatatatcatctttagaggtatgattttttcatgaaagataagcttttggtaatattcattttaaagtggacttattaaaattggatgctagagaatcaagtttattttatgtatatatttttctgattataagagtaatatatgttcattgtaaaaatttttaaaacacagaaactatatgcaaagaaaaaataaaaattatctataatctcagaacccagaaatagccactattaacatttcctacgtattttattttacatagatcatattgtatatagttagtatctttattaatttttattatgaaactttcctttgtcattattagtcttcaaaagcatgatttttaatagttgttgagtattccaccacaggaatgtatcacaacttaaccgttcccgtttgttagactagtttcttattaatgttgatgaatgttgtttaaaaataattttgttgctacatttactttaatttccttgactgtaaagagaagtaattttgctccttgataaagtattatattaataataaatctgcctgcaactttttgccttctttcataatcataaaaaaa

SEQ ID NO: 427367 - DNA, 5054 bp, Homo sapiens
  misc_feature (4963)..(4963): n is a, c, g, or t
cgcgcagcatgcccgccagcgccccgccgcgccgcccgcggccgccgccgccgtcgctgtcgctgctgctggtgctgctgggcctgggcggccgccgcctgcgtgcggagccgggcgacggcgcgcagacctgggcccgtgtctcgcggcctcctgcccccgaggccgcgggcctcttccagggcaccttccccgacggcttcctctgggccgtgggcagcgccgcctaccagaccgagggcggctggcagcagcacggcaagggtgcgtccatctgggacacgttcacccaccaccccctggcacccccgggagactcccggaacgccagtctgccgttgggcgccccgtcgccgctgcagcccgccaccggggacgtagccagcgacagctacaacaacgtcttccgcgacacggaggcgctgcgcgagctcggggtcactcactaccgcttctccatctcgtgggcgcgagtgctccccaatggcagcgcgggcgtccccaaccgcgaggggctgcgctactaccggcgcctgctggagcggctgcgggagctgggcgtgcagcccgtggtcaccctgtaccactgggacctgccccagcgcctgcaggacgcctacggcggctgggccaaccgcgccctggccgaccacttcagggattacgcggagctctgcttccgccacttcggcggtcaggtcaagtactggatcaccatcgacaacccctacgtggtggcctggcacggctacgccaccgggcgcctggcccccggcatccggggcagcccgcggctcgggtacctggtggcgcacaacctcctcctggctcatgccaaagtctggcatctctacaatacttctttccgtcccactcagggaggtcaggtgtccattgccctaagctctcactggatcaatcctcgaagaatgaccgaccacagcatcaaagaatgtcaaaaatctctggactttgtactaggttggtttgccaaacccgtatttattgatggtgactatcccgagagcatgaagaataacctttcatctattctgcctgattttactgaatctgagaaaaagttcatcaaaggaactgctgacttttttgctctttgctttggacccaccttgagttttcaacttttggaccctcacatgaagttccgccaattggaatctcccaacctgaggcaactgctttcctggattgaccttgaatttaaccatcctcaaatatttattgtggaaaatggctggtttgtctcagggaccaccaagagagatgatgccaaatatatgtattacctcaaaaagttcatcatggaaaccttaaaagccatcaagctggatggggtggatgtcatcgggtataccgcatggtccctcatggatggtttcgagtggcacagaggttacagcatcaggcgtggactcttctatgttgactttctaagccaggacaagatgttgttgccaaagtcttcagccttgttctaccaaaagctgatagagaaaaatggcttccctcctttacctgaaaatcagcccctagaagggacatttccctgtgactttgcttggggagttgttgacaactacattcaagtagataccactctgtctcagtttaccgacctgaatgtttacctgtgggatgtccaccacagtaaaaggcttattaaagtggatggggttgtgaccaagaagaggaaatcctactgtgttgactttgctgccatccagccccagatcgctttactccaggaaatgcacgttacacattttcgcttctccctggactgggccctgattctccctctgggtaaccagtcccaggtgaaccacaccatcctgcagtactatcgctgcatggccagcgagcttgtccgtgtcaacatcaccccagtggtggccctgtggcagcctatggccccgaaccaaggactgccgcgcctcctggccaggcagggcgcctgggagaacccctacactgccctggcctttgcagagtatgcccgactgtgctttcaagagctcggccatcacgtcaagctttggataacgatgaatgagccgtatacaaggaatatgacatacagtgctggccacaaccttctgaaggcccatgccctggcttggcatgtgtacaatgaaaagtttaggcatgctcagaatgggaaaatatccatagccttgcaggctgattggatagaacctgcctgccctttctcccaaaaggacaaagaggtggccgagagagttttggaatttgacattggctggctggctgagcccattttcggctctggagattatccatgggtgatgagggactggctgaaccaaagaaacaattttcttcttccttatttcactgaagatgaaaaaaagctaatccagggtacctttgactttttggctttaagccattataccaccatccttgtagactcagaaaaagaagatccaataaaatacaatgattacctagaagtgcaagaaatgaccgacatcacgtggctcaactcccccagtcaggtggcggtagtgccctgggggttgcgcaaagtgctgaactggctgaagttcaagtacggagacctccccatgtacataatatccaacggaatcgatgacgggctgcatgctgaggacgaccagctgagggtgtattatatgcagaattacataaacgaagctctcaaagcccacatactggatggtatcaatctttgcggatactttgcttattcgtttaacgaccgcacagctccgaggtttggcctctatcgttatgctgcagatcagtttgagcccaaggcatccatgaaacattacaggaaaattattgacagcaatggtttcccgggcccagaaactctggaaagattttgtccagaagaattcaccgtgtgtactgagtgcagtttttttcacacccgaaagtctttactggctttcatagcttttctattttttgcttctattatttctctctcccttatattttactactcgaagaaaggcagaagaagttacaaatagttctgaacatttttctattcattcattttgaaataattatgcagacacatcagctgttaaccatttgcacctctaagtgttgtgaaactgtaaatttcatacatttgacttctagaaaacatttttgtggcttatgacagaggttttgaaatgggcataggtgatcgtaaaatattgaataatgcgaatagtgcctgaatttgttctctttttgggtgattaaaaaactgacaggcactataatttctgtaacacactaacaaaagcatgaaaaataggaaccacaccaatgcaacatttgtgcagaaatttgaatgacaagattaggaatattttcttctgcacccacttctaaatttaatgtttttctggaagtagtaattgcaagagttcgaatagaaagttatgtaccaagtaaccatttctcagctgccataataatgcctagtggcttcccctctgtcaaatctagtttcctatggaaaagaagatggcagatacaggagagacgacagagggtcctaggctggaatgttcctttcgaaagcaatgcttctatcaaatactagtattaatttatgtatctggttaatgacatacttggagagcaaattatggaaatgtgtattttatatgatttttgaggtcctgtctaaaccctgtgtccctgagggatctgtctcactggcatcttgttgagggccttgcacataggaaacttttgataagtatctgcggaaaaacaaacatgaatcctgtgatattgggctcttcaggaagcataaagcaattgtgaaatacagtataccgcagtggctctaggtggaggaaaggaggaaaaagtgcttattatgtgcaacattatgattaatctgattatacaccatttttgagcagatcttggaatgaatgacatgacctttccctagagaataaggatgaaataatcactcattctatgaacagtgacactactttctattctttagctgtactgtaatttctttgagttgatagttttacaaattcttaataggttcaaaagcaatctggtctgaataacactggatttgtttctgtgatctctgaggtctattttatgtttttgctgctacttctgtggaagtagctttgaactagttttactttgaactttcacgctgaaacatgctagtgatatctagaaagggctaattaggtctcatcctttaatgccccttaaataagtcttgctgattttcagacagggaagtctctctattacactggagctgttttatagataagtcaatattgtatcaggcaagataaaccaatgtcataacaggcattgccaacctcactgacacagggtcatagtgtataataatatactgtactatataatatatcatctttagaggtatgattttttcatgaaagataagcttttggtaatattcattttaaagtggacttattaaaattggatgctagagaatcaagtttattttatgtatatatttttctgattataagagtaatatatgttcattgtaaaaatttttaaaacacagaaactatatgcaaagaaaaaataaaaattatctataatctcagaacccagaaatagccactattaacatttcctacgtattttattttacatagatcatattgtatatagttagtatctttattaatttttattatgaaactttcctttgtcattattagtcttcaaaagcatgatttttaatagttgttgagtattccaccacaggaatgtatcacaacttaaccgttcccgtttgttagactagtttcttattaatgttgatgaatgttgtttaaaaataattttgttgctacatttactttaatttccttgactgtaaagagaagtaattttgctccttgataaagtattatattanagtttcataataaaaattaataaagatactaactatatacaatatgatctatgtaaaataagtcgacgcggccgcgaatttagtagtagta

SEQ ID NO: 427368 - DNA, 1447 bp, Homo sapiens
tttctttttctcttggagctgagctataagacaacaggactgaacagggagccaactgtttctttgaacagtaaatcaggaacaccaatggaccaaaatgaacacagtcactggggaccacatgcaaagggccaatgtgccagcagatctgagctgagaatcatcctggtgggcaaaacaggaactggcaaaagtgctgcagggaacagcatcctcaggaagcaagcatttgaatcgaagctgggttcccagaccttgactaagacttgcagcaaaagtcagggaagctggggaaatagagagattgtcattattgacacaccagatatgttttcttggaaggaccactgtgaagctctgtacaaagaggtgcagaggtgctacttgctgtctgcaccaggaccccatgtgctgctcctggtgactcagctgggccgctatacctcacaggaccagcaggctgcacagagggtgaaggagatctttggagaggatgccatgggacacacaattgtcctctttacccacaaggaagacctcaatggtggctccctgatggattacatgcacgactcagataacaaagccctaagcaagctggtggcagcatgtggtgggcgaatctgtgcctttaataaccgtgctgaagggagcaatcaggatgaccaagtgaaggaactaatggactgtattgaggatctgttgatggagaaaaatggtgatcactataccaatgggttgtacagcctaatacagaggtctaaatgtggacctgtgggatcagatgaaagagtaaaggaattcaaacagagccttataaagtacatggaaactcaaagaagttacacagccttggctgaagcaaactgcctaaaaggagccttaatcaaaacacaactgtgtgttttattttgtattcagttgtttctcagattgataattctgtggctttgcatactgcacagcatgtgcaatttgttttgttgcttactctttagtatgtgcaatttattctgcagtttgctgtttattatacccaaaaagttaatgatatttttgagaacagttattagactagaacgcaagactcctaggttatagttacagatcccagttattatttactcactatcatttagtgggtgaatcacagtaatttccctgtaaaatgtggtacctgaagtcatatttgagattctatgaaatgtttaaatctgaacatcactccaattattaatgaaccaaatcatacgataagttactgtttgcattgaaatataatatcaaagccttttgaaatctgtaaacataaaattcctctcattttcaaatatctaaagccagttttatgttcctaaaatctcattttcttctttctagtactactatttctactgaatataatgaaaatggcaataaaataatattacataaactgtaaaaaaaa

SEQ ID NO: 427369 - DNA, 1332 bp, Homo sapiens
tttctttttctcttggagctgagctataagacaacaggactgaacagggagccaactgtttctttgaacagtaaatcaggaacaccaatggaccaaaatgaacacagtcactggggaccacatgcaaagggccaatgtgccagcagatctgagctgagaatcatcctggtgggcaaaacaggaactggcaaaagtgctgcagggaacagcatcctcaggaagcaagcatttgaatcgaagctgggttcccagaccttgactaagacttgcagcaaaagtcagggaagctggggaaatagagagattgtcattattgacacaccagatatgttttcttggaaggaccactgtgaagctctgtacaaagaggtgcagaggtgctacttgctgtctgcaccaggaccccatgtgctgctcctggtgactcagctgggccgctatacctcacaggaccagcaggctgcacagagggtgaaggagatctttggagaggatgccatgggacacacaattgtcctctttacccacaaggaagacctcaatggtggctccctgatggattacatgcacgactcagataacaaagccctaagcaagctggtggcagcatgtggtgggcgaatctgtgcctttaataaccgtgctgaagggagcaatcaggatgaccaagtgaaggaactaatggactgtattgaggatctgttgatggagaaaaatggtgatcactataccaatgggttgtacagcctaatacagaggtctaaatgtggacctgtgggatcagatgaaagagtaaaggaattcaaacagagccttataaagtacatggaaactcaaagaagttacacagccttggctgaagcaaactgcctaaaaggagccttaatcaaaacacaactgtgtgttttattttgtattcagttgtttctcagattgataattctgtggctttgcatactgcacagcatgtgcaatttgttttgttgcttactctttagtatgtgcaatttattctgcagtttgctgtttattatacccaaaaagttaatgatatttttgagaacagttattagactagaacgcaagactcctaggttatagttacagatcccagttattatttactcactatcatttagtgggtgaatcacagtaatttccctgtaaaatgtggtacctgaagtcatatttgagattctatgaaatgtttaaatctgaacatcactccaattattaatgaaccaaatcatacgataagttactgtttgcattgaaatataatatcaaagccttttgaaatctgtaaacataaaattcctctcattttcaaat

SEQ ID NO: 427370 - DNA, 330 bp, Homo sapiens
tttctttttctcttggagctgagctataagacaacaggactgaacagggagccaactgtttctttgaacagtaaatcaggaacaccaatggaccaaaatgaacacagtcactggggcgagaggaaggttaaacgtgcaatttggctgcctctaagcaagctccagcgcggtgtatcaggagctgcttggctgctgttttcagaatatagaaatgtgtaatgtaatgcctgcttccttttaagtacaagtgtccattgcatgtctactgtgaggccataatttcactggcctacagaaaataagattaaatgtccataaattttggccaat

SEQ ID NO: 427371 - DNA, 480 bp, Homo sapiens
tttctttttctcttggagctgagctataagacaacaggactgaacagggagccaactgtttctttgaacagtaaatcaggaacaccaatggaccaaaatgaacacagtcactgggggaatctggaagctaaaccccagagttgctacaagagacattggctcctgtgagtccaggtggcttctataactgctcaagatgccatctccttgccctgggacctccctaggtgacagtttgcagtgttccatgaattgctgcatagacttccactaggtggaaggcccaacattgtccctctggcaagcgaagttttccattcttctgagtagactagtgtcccagtgaggcccatggcagtcctgtgagcccgagaggtcatttgaaccagctaagaacaagaccactggtgggcattgcagcacctaaccctaaatcatatcattgctaggaggagtaaattaggtaatgcaggtaaacca

SEQ ID NO: 427372 - DNA, 1565 bp, Homo sapiens
gcaatatcaccattcgtcatgacgctcgggcacaggaagataaatgaactgtggtccataggctgtactctactgagatctctgtgtcaatgagcatacgtgtcttgagcatcatcgacctagataagaggaacggcccggtgttcatctgaacgtttatagatcaaagataccacgcatgtgagatcatagaagtgtacactaccacgtgcgaatcgtagtcaaccagagtagctcacagaggcgcaacttgtgatatcagattatgaccctcgaaatcatcctggtgggcaaaacaggaactggcaaaagtgctgcagggaacagcatcctcaggaagcaagcatttgaatcgaagctgggttcccagaccttgactaagacttgcagcaaaagtcagggaagctggggaaatagagagattgtcattattgacacaccagatatgttttcttggaaggaccactgtgaagctctgtacaaagaggtgcagaggtgctacttgctgtctgcaccaggaccccatgtgctgctcctggtgactcagctgggccgctatacctcacaggaccagcaggctgcacagagggtgaaggagatctttggagaggatgccatgggacacacaattgtcctctttacccacaaggaagacctcaatggtggctccctgatggattacatgcacgactcagataacaaagccctaagcaagctggtggcagcatgtggtgggcgaatctgtgcctttaataaccgtgctgaagggagcaatcaggatgaccaagtgaaggaactaatggactgtattgaggatctgttgatggagaaaaatggtgatcactataccaatgggttgtacagcctaatacagaggtctaaatgtggacctgtgggatcagatgaaagagtaaaggaattcaaacagagccttataaagtacatggaaactcaaagaagttacacagccttggctgaagcaaactgcctaaaaggagccttaatcaaaacacaactgtgtgttttattttgtattcagttgtttctcagattgataattctgtggctttgcatactgcacagcatgtgcaatttgttttgttgcttactctttagtatgtgcaatttattctgcagtttgctgtttattatacccaaaaagttaatgatatttttgagaacagttattagactagaacgcaagactcctaggttatagttacagatcccagttattatttactcactatcatttagtgggtgaatcacagtaatttccctgtaaaatgtggtacctgaagtcatatttgagattctatgaaatgtttaaatctgaacatcactccaattattaatgaaccaaatcatacgataagttactgtttgcattgaaatataatatcaaagccttttgaaatctgtaaacataaaattcctctcattttcaaatatctaaagccagttttatgttcctaaaatctcattttcttctttctagtactactatttctactgaatataatgaaaatggcaataaaataatattacataaactgtaaaaaaaa

SEQ ID NO: 427373 - DNA, 303 bp, Homo sapiens
gaactgaaaaataagtttcttgtctctctgtttctcaggaacaccaatggaccaaaatgaacacagtcactggggtaagaaggtgacttcacgtgtgtgtgtgtgtgtgtgtgtgtgtgtgtgtgtgtgtgtgtgtgtgtgtttggctcttctgatgatgttggggcaaaataaacaagggtgaaggatcttattctaactcccacagctaccaccaccagcagctgaaaattgtggggttttgttttctttgtttgtttgtttgtttgtttgttttgagacagtgtctctctctgtcaccca

SEQ ID NO: 427374 - DNA, 1356 bp, Homo sapiens
gcggccgcggcagggctgggcctgcgactacccgaggaggctgacctccagcccgggcgcccggttcagcgccgccccggccggcgccggtgcctgccaggcactcagggaggcgggggcgcagtggaggaggcggcgccatcgcgaagcgagcgcctcgcccgcactcagccttgccaccccgcccgcagtccaggctggactgggcggcatttgccgaggctcctcggccaggccccgtccgcccgagccgcgctgagacccgggcagcggccgcgtggagaggaggtggcagcggcccgggaggccggagccaagccagcgacccaccatggagacccgctacaacctgaagagtccggctgttaaacgtttaatgaaagaagcggcagaattgaaagatccaacagatcattaccatgcgcagcctttagaggataacctttttgaatggcacttcacggttagagggcccccagactccgattttgatggaggagtttatcacgggcggatagtactgccaccagagtatcccatgaaaccaccaagcattattctcctaacggctaatggtcgatttgaagtgggcaagaaaatctgtttgagcatctcaggccatcatcctgaaacttggcagccttcgtggagtataaggacagcattattagccatcattgggtttatgccaacaaaaggagagggagccataggttctctagattacactcctgaggaaagaagagcacttgccaaaaaatcacaagatttctgttgtgaaggatgtggctctgccatgaaggatgtcctgttgcctttaaaatctggaagcgattcaagccaagctgaccaagaagccaaagaactggctaggcaaataagctttaaggcagaagtcaattcatctggaaagactatctctgagtcagacttaaaccactctttttcactaactgatttacaagatgatatacctacaacattccagggtgctacggccagtacatcgtacggactccagaattcctcagcagcatcctttcatcaacctacccaacctgtagctaagaatacctccatgagccctcgacagcgccgggcccagcagcagagtcagagaaggttgtctacttcaccagatgtaatccagggccaccagccaagagacaaccacactgatcatggtgggtcagctgtactgattgtcatcctgactttggcattggcagctcttatattccgacgaatatatctggcaaacgaatacatatttgactttgagttataatatggttttgtgacttatgagctgtgactcaactgcttcattaaacattctgcattgggtataatcta

SEQ ID NO: 427375 - DNA, 4517 bp, Homo sapiens
gcggccgcggcagggctgggcctgcgactacccgaggaggctgacctccagcccgggcgcccggttcagcgccgccccggccggcgccggtgcctgccaggcactcagggaggcgggggcgcagtggaggaggcggcgccatcgcgaagcgagcgcctcgcccgcactcagccttgccaccccgcccgcagtccaggctggactgggcggcatttgccgaggctcctcggccaggccccgtccgcccgagccgcgctgagacccgggcagcggccgcgtggagaggaggtggcagcggcccgggaggccggagccaagccagcgacccaccatggagacccgctacaacctgaagagtccggctgttaaacgtttaatgaaagaagcggcagaattgaaagatccaacagatcattaccatgcgcagcctttagaggataacctttttgaatggcacttcacggttagagggcccccagactccgattttgatggaggagtttatcacgggcggatagtactgccaccagagtatcccatgaaaccaccaagcattattctcctaacggctaatggtcgatttgaagtgggcaagaaaatctgtttgagcatctcaggccatcatcctgaaacttggcagccttcgtggagtataaggacagcattattagccatcattgggtttatgccaacaaaaggagagggagccataggttctctagattacactcctgaggaaagaagagcacttgccaaaaaatcacaagatttctgttgtgaaggatgtggctctgccatgaaggatgtcctgttgcctttaaaatctggaagcgattcaagccaagctgaccaagaagccaaagaactggctaggcaaataagctttaaggcagaagtcaattcatctggaaagactatctctgagtcagacttaaaccactctttttcactaactgatttacaagatgatatacctacaacattccagggtgctacggccagtacatcgtacggactccagaattcctcagcagcatcctttcatcaacctacccaacctgtagctaagaatacctccatgagccctcgacagcgccgggcccagcagcagagtcagagaaggttgtctacttcaccagatgtaatccagggccaccagccaagagacaaccacactgatcatggtgggtcagctgtactgattgtcatcctgactttggcattggcagctcttatattccgacgaatatatctggcaaacgaatacatatttgactttgagttataatatggttttgtgacttatgagctgtgactcaactgcttcattaaacattctgcattgggtataatctaagaattgtttacaaaaagattattttgtatttacccttcattcctttttttgatccttgtaagtttagtataaatatatctagacattcagactgtgtctagcagttacgtcctgcttaaagggactagaagtcaaagttccttgtctcactatttgatctgctttgcagggaaataacttgttttttctcatgtttcatcttctttttatgtaaatttgtaatactttcctatattgccctttgaaatttttggataaaagatgatgttttaagttccaatgagtattactagttactcaataccacttattgagtactctgtttctacgtatgtagaatgtatagggatagaagagttgaaaagggaaagcaaaactcctcaagtagcttccttaaaatgtcattcataggagatgtactggaattgctcattctgtgactttatttgtgtcctaaacattcttcagtgaaaataattttatttcagtcaaacatttatgaggaaatgagatcacatctttgtcactggatgctacttgaagagggagtactttgtaaccactttgatatgctgttatcaccaccccctgccctctgctgccataatcacacaaatttaaaaagaaagaaaacagtcttccatagatttttaaggaagaaagggcccaagccaggagatcgcttggttttcttccagaagttaaatggggggatctgaagatttgaatgtttggtctgctttgaaatgtatgtcttttgggatgtattatatgcctagctttataatcagtataaattttaattattccaggaatatgcataatattgaaatatttcatgtcctattttaatagaaaacctcagggcccaagtaacagtgatagaagttagaaaaacctttacttagaattgtccacctagtcagagcccaagaaagaattttcagtggaaaaatcaatatataacttagtgctagctagcgccacagactctagtagataatattatcatcataatggctggtgaaaccatataatcacagaaaaacattgccttcagcatgttcagttcgcagcactgagggcactcttgagggtgttgttaatgaagatttaatttttaaatacaggtggttccaagctttcaaataggttatgctccaaaagtgttatttgtaagttaatttttttacaagtcaaacaatgttggaagtggtatttaggttctagatcggtccacgaaagttagcccatatgtatatcttgaatagtataggggagggtattcataaagtccttatgtggttttaactaagtgaaattatggacaagagaaataattgtaaaatcgtcttaaaggaaaatttaatttttactcctgtttatgggacattcgttctattaactgtcagacacaatttctgttttcatctgagagccagttttcctttatttctacatctaaaataagaacatattgtacactattatataatacagaattgtcttaaactttaataaattcgcattttaaaggtgtttacagattattttttatatctgtagctgaatttgttaaagtctaaaaagctcaaggactttatgaagatctcattatatgaggaaaatcataggttaccattttataactctattgccataagaaaatacactctaaaatcttgatttgaaacatattagaaaccttgattcagtgctcagtggtctcctagtaagaagtcaccgacggtagcgtcatatgagaagaaagaaatccccaccacctcaacctctgctgagattgtgtgctaggaacagccttccctccgtttcccctcagtcaaacttgagccagcctctggatcgatgtgatcttattgcatgtttccatggggtgtacctatactttaagccaatcctgctgcattcactgctaagttaaataaaaagccaagaagattttgcactgtgcagatcctttgctatctgacttgcatctcttcccccacctgtcagctagccacctgcttgtttgtgttgggatattttttagcacctgaagcaccatctgaaaggggcaccattttcttcttccctttgatctcacatatgctccctaaaaatccttaagttgtcaatctgatccccagtgtgaggttaatgagcaaaattggtctttggggccctttttgtccaagccccactgaaaggcctcttcagaaaactattatctttaaagccctactttaactccttaattccagcatacagctaaaactggatgtatattctggcaagtaaaggctgaggactcctctttaatcctcagatctagataactcatgacattttatttgaccaacatagcacatgatgagatatcaaggtaattaaaatagcatgcttgaaaaaaaaatacgtaatctgtttcacctgtaactgtttaagccaataaacttttcaaaatttatgtaatgtggggcttttatgtagcactttacgttttcatgctgcttattgttttattctactgaaaaaaatgaatttcaagattctcaacttttttaatttcaaaaattgtttattgttttgactataggaatacaaaatttcctattttgggagaataagaactctttttgtcatttttggctatgaataaactttctggtcttttgagaccacccatttttatagatcagaatcagaaaacaggtaaacctcactcacacatttggactcatttgaacaaaaatctaggccaaaatactgaaaagcctatgtgtttttttaattggaagtatatgtaaggttaatgcatttagtgaacgtgactaacaaagactaatgtgcacattaacagatgtactttttaaggttttatgggaggctgtgcattgctcaaaagctgttgggaacgccttctgaacagttgccttcagaactagtttgagctgctcaataaaaccagtgactttactcataccttgtttttgaccaaaggttgtattctttacatcatccagtcttgtctctcatccattctacctcctagaatatttctctctcatctttccacttccctaactaggcactatatcctatttagctattaactcctccaaattggtgcacacgaataacctcctaacaggtctct

SEQ ID NO: 427376 - DNA, 3827 bp, Homo sapiens
gcggccgcggcagggctgggcctgcgactacccgaggaggctgacctccagcccgggcgcccggttcagcgccgccccggccggcgccggtgcctgccaggcactcagggaggcgggggcgcagtggaggaggcggcgccatcgcgaagcgagcgcctcgcccgcactcagccttgccaccccgcccgcagtccaggctggactgggcggcatttgccgaggctcctcggccaggccccgtccgcccgagccgcgctgagacccgggcagcggccgcgtggagaggaggtggcagcggcccgggaggccggagccaagccagcgacccaccatggagacccgctacaacctgaagagtccggctgttaaacgtttaatgaaagaagcggcagaattgaaagatccaacagatcattaccatgcgcagcctttagaggataacctttttgaatggcacttcacggttagagggcccccagactccgattttgatggaggagtttatcacgggcggatagtactgccaccagagtatcccatgaaaccaccaagcattattctcctaacggctaatggtcgatttgaagtgggcaagaaaatctgtttgagcatctcaggccatcatcctgaaacttggcagccttcgtggagtataaggacagcattattagccatcattgggtttatgccaacaaaaggagagggagccataggttctctagattacactcctgaggaaagaagagcacttgccaaaaaatcacaagatttctgttgtgaaggatgtggctctgccatgaaggatgtcctgttgcctttaaaatctggaagcgattcaagccaagctgaccaagaagccaaagaactggctaggcaaataagctttaaggcagaagtcaattcatctggaaagactatctctgagtcagacttaaaccactctttttcactaactgatttacaagatgatatacctacaacattccagggtgctacggccagtacatcgtacggactccagaattcctcagcagcatcctttcatcaacctacccaacctgtagctaagaatacctccatgagccctcgacagcgccgggcccagcagcagagtcagagaaggttgtctacttcaccagatgtaatccagggccaccagccaagagacaaccacactgatcatggtgggtcagctgtactgattgtcatcctgactttggcattggcagctcttatattccgacgaatatatctggcaaacgaatacatatttgactttgagttataatatggttttgtgacttatgagctgtgactcaactgcttcattaaacattctgcattgggtataatctaagaattgtttacaaaaagattattttgtatttacccttcattcctttttttgatccttgtaagtttagtataaatatatctagacattcagactgtgtctagcagttacgtcctgcttaaagggactagaagtcaaagttccttgtctcactatttgatctgctttgcagggaaataacttgttttttctcatgtttcatcttctttttatgtaaatttgtaatactttcctatattgccctttgaaatttttggataaaagatgatgttttaagttccaatgagtattactagttactcaataccacttattgagtactctgtttctacgtatgtagaatgtatagggatagaagagttgaaaagggaaagcaaaactcctcaagtagcttccttaaaatgtcattcataggagatgtactggaattgctcattctgtgactttatttgtgtcctaaacattcttcagtgaaaataattttatttcagtcaaacatttatgaggaaatgagatcacatctttgtcactggatgctacttgaagagggagtactttgtaaccactttgatatgctgttatcaccaccccctgccctctgctgccataatcacacaaatttaaaaagaaagaaaacagtcttccatagatttttaaggaagaaagggcccaagccaggagatcgcttggttttcttccagaagttaaatggggggatctgaagatttgaatgtttggtctgctttgaaatgtatgtcttttgggatgtattatatgcctagctttataatcagtataaattttaattattccaggaatatgcataatattgaaatatttcatgtcctattttaatagaaaacctcagggcccaagtaacagtgatagaagttagaaaaacctttacttagaattgtccacctagtcagagcccaagaaagaattttcagtggaaaaatcaatatataacttagtgctagctagcgccacagactctagtagataatattatcatcataatggctggtgaaaccatataatcacagaaaaacattgccttcagcatgttcagttcgcagcactgagggcactcttgagggtgttgttaatgaagatttaatttttaaatacaggtggttccaagctttcaaataggttatgctccaaaagtgttatttgtaagttaatttttttacaagtcaaacaatgttggaagtggtatttaggttctagatcggtccacgaaagttagcccatatgtatatcttgaatagtataggggagggtattcataaagtccttatgtggttttaactaagtgaaattatggacaagagaaataattgtaaaatcgtcttaaaggaaaatttaatttttactcctgtttatgggacattcgttctattaactgtcagacacaatttctgttttcatctgagagccagttttcctttatttctacatctaaaataagaacatattgtacactattatataatacagaattgtcttaaactttaataaattcgcattttaaaggtgtttacagattattttttatatctgtagctgaatttgttaaagtctaaaaagctcaaggactttatgaagatctcattatatgaggaaaatcataggttaccattttataactctattgccataagaaaatacactctaaaatcttgatttgaaacatattagaaaccttgattcagtgctcagtggtctcctagtaagaagtcaccgacggtagcgtcatatgagaagaaagaaatccccaccacctcaacctctgctgagattgtgtgctaggaacagccttccctccgtttcccctcagtcaaacttgagccagcctctggatcgatgtgatcttattgcatgtttccatggggtgtacctatactttaagccaatcctgctgcattcactgctaagttaaataaaaagccaagaagattttgcactgtgcagatcctttgctatctgacttgcatctcttcccccacctgtcagctagccacctgcttgtttgtgttgggatattttttagcacctgaagcaccatctgaaaggggcaccattttcttcttccctttgatctcacatatgctccctaaaaatccttaagttgtcaatctgatccccagtgtgaggttaatgagcaaaattggtctttggggccctttttgtccaagccccactgaaaggcctcttcagaaaactattatctttaaagccctactttaactccttaattccagcatacagctaaaactggatgtatattctggcaagtaaaggctgaggactcctctttaatcctcagatctagataactcatgacattttatttgaccaacatagcacatgatgagatatcaaggtaattaaaatagcatgcttgaaaaaaaaatacgtaatctgtttcacctgtaactgtttaagccaataaacttttcaaaattta

SEQ ID NO: 427377 - DNA, 2896 bp, Homo sapiens
gcggccgcggcagggctgggcctgcgactacccgaggaggctgacctccagcccgggcgcccggttcagcgccgccccggccggcgccggtgcctgccaggcactcagggaggcgggggcgcagtggaggaggcggcgccatcgcgaagcgagcgcctcgcccgcactcagccttgccaccccgcccgcagtccaggctggactgggcggcatttgccgaggctcctcggccaggccccgtccgcccgagccgcgctgagacccgggcagcggccgcgtggagaggaggtggcagcggcccgggaggccggagccaagccagcgacccaccatggagacccgctacaacctgaagagtccggctgttaaacgtttaatgaaagaagcggcagaattgaaagatccaacagatcattaccatgcgcagcctttagaggataacctttttgaatggcacttcacggttagagggcccccagactccgattttgatggaggagtttatcacgggcggatagtactgccaccagagtatcccatgaaaccaccaagcattattctcctaacggctaatggtcgatttgaagtgggcaagaaaatctgtttgagcatctcaggccatcatcctgaaacttggcagccttcgtggagtataaggacagcattattagccatcattgggtttatgccaacaaaaggagagggagccataggttctctagattacactcctgaggaaagaagagcacttgccaaaaaatcacaagatttctgttgtgaaggatgtggctctgccatgaaggatgtcctgttgcctttaaaatctggaagcgattcaagccaagctgaccaagaagccaaagaactggctaggcaaataagctttaaggcagaagtcaattcatctggaaagactatctctgagtcagacttaaaccactctttttcactaactgatttacaagatgatatacctacaacattccagggtgctacggccagtacatcgtacggactccagaattcctcagcagcatcctttcatcaacctacccaacctgtagctaagaatacctccatgagccctcgacagcgccgggcccagcagcagagtcagagaaggttgtctacttcaccagatgtaatccagggccaccagccaagagacaaccacactgatcatggtgggtcagctgtactgattgtcatcctgactttggcattggcagctcttatattccgacgaatatatctggcaaacgaatacatatttgactttgagttataatatggttttgtgacttatgagctgtgactcaactgcttcattaaacattctgcattgggtataatctaagaattgtttacaaaaagattattttgtatttacccttcattcctttttttgatccttgtaagtttagtataaatatatctagacattcagactgtgtctagcagttacgtcctgcttaaagggactagaagtcaaagttccttgtctcactatttgatctgctttgcagggaaataacttgttttttctcatgtttcatcttctttttatgtaaatttgtaatactttcctatattgccctttgaaatttttggataaaagatgatgttttaagttccaatgagtattactagttactcaataccacttattgagtactctgtttctacgtatgtagaatgtatagggatagaagagttgaaaagggaaagcaaaactcctcaagtagcttccttaaaatgtcattcataggagatgtactggaattgctcattctgtgactttatttgtgtcctaaacattcttcagtgaaaataattttatttcagtcaaacatttatgaggaaatgagatcacatctttgtcactggatgctacttgaagagggagtactttgtaaccactttgatatgctgttatcaccaccccctgccctctgctgccataatcacacaaatttaaaaagaaagaaaacagtcttccatagatttttaaggaagaaagggcccaagccaggagatcgcttggttttcttccagaagttaaatggggggatctgaagatttgaatgtttggtctgctttgaaatgtatgtcttttgggatgtattatatgcctagctttataatcagtataaattttaattattccaggaatatgcataatattgaaatatttcatgtcctattttaatagaaaacctcagggcccaagtaacagtgatagaagttagaaaaacctttacttagaattgtccacctagtcagagcccaagaaagaattttcagtggaaaaatcaatatataacttagtgctagctagcgccacagactctagtagataatattatcatcataatggctggtgaaaccatataatcacagaaaaacattgccttcagcatgttcagttcgcagcactgagggcactcttgagggtgttgttaatgaagatttaatttttaaatacaggtggttccaagctttcaaataggttatgctccaaaagtgttatttgtaagttaatttttttacaagtcaaacaatgttggaagtggtatttaggttctagatcggtccacgaaagttagcccatatgtatatcttgaatagtataggggagggtattcataaagtccttatgtggttttaactaagtgaaattatggacaagagaaataattgtaaaatcgtcttaaaggaaaatttaatttttactcctgtttatgggacattcgttctattaactgtcagacacaatttctgttttcatctgagagccagttttcctttatttctacatctaaaataagaacatattgtacactattatataatacagaattgtcttaaactttaataaattcgcattttaaaggtg

SEQ ID NO: 427378 - DNA, 4436 bp, Homo sapiens
gcggccgcggcagggctgggcctgcgactacccgaggaggctgacctccagcccgggcgcccggttcagcgccgccccggccggcgccggtgcctgccaggcactcagggaggcgggggcgcagtggaggaggcggcgccatcgcgaagcgagcgcctcgcccgcactcagccttgccaccccgggcagcggccgcgtggagaggaggtggcagcggcccgggaggccggagccaagccagcgacccaccatggagacccgctacaacctgaagagtccggctgttaaacgtttaatgaaagaagcggcagaattgaaagatccaacagatcattaccatgcgcagcctttagaggataacctttttgaatggcacttcacggttagagggcccccagactccgattttgatggaggagtttatcacgggcggatagtactgccaccagagtatcccatgaaaccaccaagcattattctcctaacggctaatggtcgatttgaagtgggcaagaaaatctgtttgagcatctcaggccatcatcctgaaacttggcagccttcgtggagtataaggacagcattattagccatcattgggtttatgccaacaaaaggagagggagccataggttctctagattacactcctgaggaaagaagagcacttgccaaaaaatcacaagatttctgttgtgaaggatgtggctctgccatgaaggatgtcctgttgcctttaaaatctggaagcgattcaagccaagctgaccaagaagccaaagaactggctaggcaaataagctttaaggcagaagtcaattcatctggaaagactatctctgagtcagacttaaaccactctttttcactaactgatttacaagatgatatacctacaacattccagggtgctacggccagtacatcgtacggactccagaattcctcagcagcatcctttcatcaacctacccaacctgtagctaagaatacctccatgagccctcgacagcgccgggcccagcagcagagtcagagaaggttgtctacttcaccagatgtaatccagggccaccagccaagagacaaccacactgatcatggtgggtcagctgtactgattgtcatcctgactttggcattggcagctcttatattccgacgaatatatctggcaaacgaatacatatttgactttgagttataatatggttttgtgacttatgagctgtgactcaactgcttcattaaacattctgcattgggtataatctaagaattgtttacaaaaagattattttgtatttacccttcattcctttttttgatccttgtaagtttagtataaatatatctagacattcagactgtgtctagcagttacgtcctgcttaaagggactagaagtcaaagttccttgtctcactatttgatctgctttgcagggaaataacttgttttttctcatgtttcatcttctttttatgtaaatttgtaatactttcctatattgccctttgaaatttttggataaaagatgatgttttaagttccaatgagtattactagttactcaataccacttattgagtactctgtttctacgtatgtagaatgtatagggatagaagagttgaaaagggaaagcaaaactcctcaagtagcttccttaaaatgtcattcataggagatgtactggaattgctcattctgtgactttatttgtgtcctaaacattcttcagtgaaaataattttatttcagtcaaacatttatgaggaaatgagatcacatctttgtcactggatgctacttgaagagggagtactttgtaaccactttgatatgctgttatcaccaccccctgccctctgctgccataatcacacaaatttaaaaagaaagaaaacagtcttccatagatttttaaggaagaaagggcccaagccaggagatcgcttggttttcttccagaagttaaatggggggatctgaagatttgaatgtttggtctgctttgaaatgtatgtcttttgggatgtattatatgcctagctttataatcagtataaattttaattattccaggaatatgcataatattgaaatatttcatgtcctattttaatagaaaacctcagggcccaagtaacagtgatagaagttagaaaaacctttacttagaattgtccacctagtcagagcccaagaaagaattttcagtggaaaaatcaatatataacttagtgctagctagcgccacagactctagtagataatattatcatcataatggctggtgaaaccatataatcacagaaaaacattgccttcagcatgttcagttcgcagcactgagggcactcttgagggtgttgttaatgaagatttaatttttaaatacaggtggttccaagctttcaaataggttatgctccaaaagtgttatttgtaagttaatttttttacaagtcaaacaatgttggaagtggtatttaggttctagatcggtccacgaaagttagcccatatgtatatcttgaatagtataggggagggtattcataaagtccttatgtggttttaactaagtgaaattatggacaagagaaataattgtaaaatcgtcttaaaggaaaatttaatttttactcctgtttatgggacattcgttctattaactgtcagacacaatttctgttttcatctgagagccagttttcctttatttctacatctaaaataagaacatattgtacactattatataatacagaattgtcttaaactttaataaattcgcattttaaaggtgtttacagattattttttatatctgtagctgaatttgttaaagtctaaaaagctcaaggactttatgaagatctcattatatgaggaaaatcataggttaccattttataactctattgccataagaaaatacactctaaaatcttgatttgaaacatattagaaaccttgattcagtgctcagtggtctcctagtaagaagtcaccgacggtagcgtcatatgagaagaaagaaatccccaccacctcaacctctgctgagattgtgtgctaggaacagccttccctccgtttcccctcagtcaaacttgagccagcctctggatcgatgtgatcttattgcatgtttccatggggtgtacctatactttaagccaatcctgctgcattcactgctaagttaaataaaaagccaagaagattttgcactgtgcagatcctttgctatctgacttgcatctcttcccccacctgtcagctagccacctgcttgtttgtgttgggatattttttagcacctgaagcaccatctgaaaggggcaccattttcttcttccctttgatctcacatatgctccctaaaaatccttaagttgtcaatctgatccccagtgtgaggttaatgagcaaaattggtctttggggccctttttgtccaagccccactgaaaggcctcttcagaaaactattatctttaaagccctactttaactccttaattccagcatacagctaaaactggatgtatattctggcaagtaaaggctgaggactcctctttaatcctcagatctagataactcatgacattttatttgaccaacatagcacatgatgagatatcaaggtaattaaaatagcatgcttgaaaaaaaaatacgtaatctgtttcacctgtaactgtttaagccaataaacttttcaaaatttatgtaatgtggggcttttatgtagcactttacgttttcatgctgcttattgttttattctactgaaaaaaatgaatttcaagattctcaacttttttaatttcaaaaattgtttattgttttgactataggaatacaaaatttcctattttgggagaataagaactctttttgtcatttttggctatgaataaactttctggtcttttgagaccacccatttttatagatcagaatcagaaaacaggtaaacctcactcacacatttggactcatttgaacaaaaatctaggccaaaatactgaaaagcctatgtgtttttttaattggaagtatatgtaaggttaatgcatttagtgaacgtgactaacaaagactaatgtgcacattaacagatgtactttttaaggttttatgggaggctgtgcattgctcaaaagctgttgggaacgccttctgaacagttgccttcagaactagtttgagctgctcaataaaaccagtgactttactcataccttgtttttgaccaaaggttgtattctttacatcatccagtcttgtctctcatccattctacctcctagaatatttctctctcatctttccacttccctaactaggcactatatcctatttagctattaactcctccaaattggtgcacacgaataacctcctaacaggtctct

SEQ ID NO: 427379 - DNA, 4547 bp, Homo sapiens
gcggccgcggcagggctgggcctgcgactacccgaggaggctgacctccagcccgggcgcccggttcagcgccgccccggccggcgccggtgcctgccaggcactcagggaggcgggggcgcagtggaggaggcggcgccatcgcgaagcgagcgcctcgcccgcactcagccttgccaccccgcccgcagtccaggctggactgggcggcatttgccgaggctcctcggccaggccccgtccgcccgagccgcgctgagacccgggcagcggccgcgtggagaggaggtggcagcggcccgggaggccggagccaagccagcgacccaccatggagacccgctacaacctgaagagtccggctgttaaacgtttaatgaaagaagcggcagaattgaaagatccaacagatcattaccatgcgcagcctttagaggataacctttttgaatggcacttcacggttagagggcccccagactccgattttgatggaggagtttatcacgggcggatagtactgccaccagagtatcccatgaaaccaccaagcattattctcctaacggctaatggtcgatttgaagtgggcaagaaaatctgtttgagcatctcaggccatcatcctgaaacttggcagccttcgtggagtataaggacagcattattagccatcattgggtttatgccaacaaaaggagagggagccataggttctctagattacactcctgaggaaagaagagcacttgccaaaaaatcacaagatttctgttgtgaaggatgtggctctgccatgaaggatgtcctgttgcctttaaaatctggaagcgattcaagccaagctgaccaagaagccaaagaactggctaggcaaataagctttaaggcagaagtcaattcatctggaaagactatctctgagtcagacttaaaccactctttttcactaactgatttacaagatgatatacctacaacattccagggtgctacggccagtacatcgtttcaaacaaagtttcttaaaatttcctagtacggactccagaattcctcagcagcatcctttcatcaacctacccaacctgtagctaagaatacctccatgagccctcgacagcgccgggcccagcagcagagtcagagaaggttgtctacttcaccagatgtaatccagggccaccagccaagagacaaccacactgatcatggtgggtcagctgtactgattgtcatcctgactttggcattggcagctcttatattccgacgaatatatctggcaaacgaatacatatttgactttgagttataatatggttttgtgacttatgagctgtgactcaactgcttcattaaacattctgcattgggtataatctaagaattgtttacaaaaagattattttgtatttacccttcattcctttttttgatccttgtaagtttagtataaatatatctagacattcagactgtgtctagcagttacgtcctgcttaaagggactagaagtcaaagttccttgtctcactatttgatctgctttgcagggaaataacttgttttttctcatgtttcatcttctttttatgtaaatttgtaatactttcctatattgccctttgaaatttttggataaaagatgatgttttaagttccaatgagtattactagttactcaataccacttattgagtactctgtttctacgtatgtagaatgtatagggatagaagagttgaaaagggaaagcaaaactcctcaagtagcttccttaaaatgtcattcataggagatgtactggaattgctcattctgtgactttatttgtgtcctaaacattcttcagtgaaaataattttatttcagtcaaacatttatgaggaaatgagatcacatctttgtcactggatgctacttgaagagggagtactttgtaaccactttgatatgctgttatcaccaccccctgccctctgctgccataatcacacaaatttaaaaagaaagaaaacagtcttccatagatttttaaggaagaaagggcccaagccaggagatcgcttggttttcttccagaagttaaatggggggatctgaagatttgaatgtttggtctgctttgaaatgtatgtcttttgggatgtattatatgcctagctttataatcagtataaattttaattattccaggaatatgcataatattgaaatatttcatgtcctattttaatagaaaacctcagggcccaagtaacagtgatagaagttagaaaaacctttacttagaattgtccacctagtcagagcccaagaaagaattttcagtggaaaaatcaatatataacttagtgctagctagcgccacagactctagtagataatattatcatcataatggctggtgaaaccatataatcacagaaaaacattgccttcagcatgttcagttcgcagcactgagggcactcttgagggtgttgttaatgaagatttaatttttaaatacaggtggttccaagctttcaaataggttatgctccaaaagtgttatttgtaagttaatttttttacaagtcaaacaatgttggaagtggtatttaggttctagatcggtccacgaaagttagcccatatgtatatcttgaatagtataggggagggtattcataaagtccttatgtggttttaactaagtgaaattatggacaagagaaataattgtaaaatcgtcttaaaggaaaatttaatttttactcctgtttatgggacattcgttctattaactgtcagacacaatttctgttttcatctgagagccagttttcctttatttctacatctaaaataagaacatattgtacactattatataatacagaattgtcttaaactttaataaattcgcattttaaaggtgtttacagattattttttatatctgtagctgaatttgttaaagtctaaaaagctcaaggactttatgaagatctcattatatgaggaaaatcataggttaccattttataactctattgccataagaaaatacactctaaaatcttgatttgaaacatattagaaaccttgattcagtgctcagtggtctcctagtaagaagtcaccgacggtagcgtcatatgagaagaaagaaatccccaccacctcaacctctgctgagattgtgtgctaggaacagccttccctccgtttcccctcagtcaaacttgagccagcctctggatcgatgtgatcttattgcatgtttccatggggtgtacctatactttaagccaatcctgctgcattcactgctaagttaaataaaaagccaagaagattttgcactgtgcagatcctttgctatctgacttgcatctcttcccccacctgtcagctagccacctgcttgtttgtgttgggatattttttagcacctgaagcaccatctgaaaggggcaccattttcttcttccctttgatctcacatatgctccctaaaaatccttaagttgtcaatctgatccccagtgtgaggttaatgagcaaaattggtctttggggccctttttgtccaagccccactgaaaggcctcttcagaaaactattatctttaaagccctactttaactccttaattccagcatacagctaaaactggatgtatattctggcaagtaaaggctgaggactcctctttaatcctcagatctagataactcatgacattttatttgaccaacatagcacatgatgagatatcaaggtaattaaaatagcatgcttgaaaaaaaaatacgtaatctgtttcacctgtaactgtttaagccaataaacttttcaaaatttatgtaatgtggggcttttatgtagcactttacgttttcatgctgcttattgttttattctactgaaaaaaatgaatttcaagattctcaacttttttaatttcaaaaattgtttattgttttgactataggaatacaaaatttcctattttgggagaataagaactctttttgtcatttttggctatgaataaactttctggtcttttgagaccacccatttttatagatcagaatcagaaaacaggtaaacctcactcacacatttggactcatttgaacaaaaatctaggccaaaatactgaaaagcctatgtgtttttttaattggaagtatatgtaaggttaatgcatttagtgaacgtgactaacaaagactaatgtgcacattaacagatgtactttttaaggttttatgggaggctgtgcattgctcaaaagctgttgggaacgccttctgaacagttgccttcagaactagtttgagctgctcaataaaaccagtgactttactcataccttgtttttgaccaaaggttgtattctttacatcatccagtcttgtctctcatccattctacctcctagaatatttctctctcatctttccacttccctaactaggcactatatcctatttagctattaactcctccaaattggtgcacacgaataacctcctaacaggtctct

SEQ ID NO: 427380 - DNA, 4443 bp, Homo sapiens
gcggccgcggcagggctgggcctgcgactacccgaggaggctgacctccagcccgggcgcccggttcagcgccgccccggccggcgccggtgcctgccaggcactcagggaggcgggggcgcagtggaggaggcggcgccatcgcgaagcgagcgcctcgcccgcactcagccttgccaccccgcccgcagtccaggctggactgggcggcatttgccgaggctcctcggccaggccccgtccgcccgagccgcgctgagacccgggcagcggccgcgtggagaggaggtggcagcggcccgggaggccggagccaagccagcgacccaccatggagacccgctacaacctgaagagtccgggataacctttttgaatggcacttcacggttagagggcccccagactccgattttgatggaggagtttatcacgggcggatagtactgccaccagagtatcccatgaaaccaccaagcattattctcctaacggctaatggtcgatttgaagtgggcaagaaaatctgtttgagcatctcaggccatcatcctgaaacttggcagccttcgtggagtataaggacagcattattagccatcattgggtttatgccaacaaaaggagagggagccataggttctctagattacactcctgaggaaagaagagcacttgccaaaaaatcacaagatttctgttgtgaaggatgtggctctgccatgaaggatgtcctgttgcctttaaaatctggaagcgattcaagccaagctgaccaagaagccaaagaactggctaggcaaataagctttaaggcagaagtcaattcatctggaaagactatctctgagtcagacttaaaccactctttttcactaactgatttacaagatgatatacctacaacattccagggtgctacggccagtacatcgtacggactccagaattcctcagcagcatcctttcatcaacctacccaacctgtagctaagaatacctccatgagccctcgacagcgccgggcccagcagcagagtcagagaaggttgtctacttcaccagatgtaatccagggccaccagccaagagacaaccacactgatcatggtgggtcagctgtactgattgtcatcctgactttggcattggcagctcttatattccgacgaatatatctggcaaacgaatacatatttgactttgagttataatatggttttgtgacttatgagctgtgactcaactgcttcattaaacattctgcattgggtataatctaagaattgtttacaaaaagattattttgtatttacccttcattcctttttttgatccttgtaagtttagtataaatatatctagacattcagactgtgtctagcagttacgtcctgcttaaagggactagaagtcaaagttccttgtctcactatttgatctgctttgcagggaaataacttgttttttctcatgtttcatcttctttttatgtaaatttgtaatactttcctatattgccctttgaaatttttggataaaagatgatgttttaagttccaatgagtattactagttactcaataccacttattgagtactctgtttctacgtatgtagaatgtatagggatagaagagttgaaaagggaaagcaaaactcctcaagtagcttccttaaaatgtcattcataggagatgtactggaattgctcattctgtgactttatttgtgtcctaaacattcttcagtgaaaataattttatttcagtcaaacatttatgaggaaatgagatcacatctttgtcactggatgctacttgaagagggagtactttgtaaccactttgatatgctgttatcaccaccccctgccctctgctgccataatcacacaaatttaaaaagaaagaaaacagtcttccatagatttttaaggaagaaagggcccaagccaggagatcgcttggttttcttccagaagttaaatggggggatctgaagatttgaatgtttggtctgctttgaaatgtatgtcttttgggatgtattatatgcctagctttataatcagtataaattttaattattccaggaatatgcataatattgaaatatttcatgtcctattttaatagaaaacctcagggcccaagtaacagtgatagaagttagaaaaacctttacttagaattgtccacctagtcagagcccaagaaagaattttcagtggaaaaatcaatatataacttagtgctagctagcgccacagactctagtagataatattatcatcataatggctggtgaaaccatataatcacagaaaaacattgccttcagcatgttcagttcgcagcactgagggcactcttgagggtgttgttaatgaagatttaatttttaaatacaggtggttccaagctttcaaataggttatgctccaaaagtgttatttgtaagttaatttttttacaagtcaaacaatgttggaagtggtatttaggttctagatcggtccacgaaagttagcccatatgtatatcttgaatagtataggggagggtattcataaagtccttatgtggttttaactaagtgaaattatggacaagagaaataattgtaaaatcgtcttaaaggaaaatttaatttttactcctgtttatgggacattcgttctattaactgtcagacacaatttctgttttcatctgagagccagttttcctttatttctacatctaaaataagaacatattgtacactattatataatacagaattgtcttaaactttaataaattcgcattttaaaggtgtttacagattattttttatatctgtagctgaatttgttaaagtctaaaaagctcaaggactttatgaagatctcattatatgaggaaaatcataggttaccattttataactctattgccataagaaaatacactctaaaatcttgatttgaaacatattagaaaccttgattcagtgctcagtggtctcctagtaagaagtcaccgacggtagcgtcatatgagaagaaagaaatccccaccacctcaacctctgctgagattgtgtgctaggaacagccttccctccgtttcccctcagtcaaacttgagccagcctctggatcgatgtgatcttattgcatgtttccatggggtgtacctatactttaagccaatcctgctgcattcactgctaagttaaataaaaagccaagaagattttgcactgtgcagatcctttgctatctgacttgcatctcttcccccacctgtcagctagccacctgcttgtttgtgttgggatattttttagcacctgaagcaccatctgaaaggggcaccattttcttcttccctttgatctcacatatgctccctaaaaatccttaagttgtcaatctgatccccagtgtgaggttaatgagcaaaattggtctttggggccctttttgtccaagccccactgaaaggcctcttcagaaaactattatctttaaagccctactttaactccttaattccagcatacagctaaaactggatgtatattctggcaagtaaaggctgaggactcctctttaatcctcagatctagataactcatgacattttatttgaccaacatagcacatgatgagatatcaaggtaattaaaatagcatgcttgaaaaaaaaatacgtaatctgtttcacctgtaactgtttaagccaataaacttttcaaaatttatgtaatgtggggcttttatgtagcactttacgttttcatgctgcttattgttttattctactgaaaaaaatgaatttcaagattctcaacttttttaatttcaaaaattgtttattgttttgactataggaatacaaaatttcctattttgggagaataagaactctttttgtcatttttggctatgaataaactttctggtcttttgagaccacccatttttatagatcagaatcagaaaacaggtaaacctcactcacacatttggactcatttgaacaaaaatctaggccaaaatactgaaaagcctatgtgtttttttaattggaagtatatgtaaggttaatgcatttagtgaacgtgactaacaaagactaatgtgcacattaacagatgtactttttaaggttttatgggaggctgtgcattgctcaaaagctgttgggaacgccttctgaacagttgccttcagaactagtttgagctgctcaataaaaccagtgactttactcataccttgtttttgaccaaaggttgtattctttacatcatccagtcttgtctctcatccattctacctcctagaatatttctctctcatctttccacttccctaactaggcactatatcctatttagctattaactcctccaaattggtgcacacgaataacctcctaacaggtctct

SEQ ID NO: 427381 - DNA, 4261 bp, Homo sapiens
tgaaccaagaatgcttcatctggagaatttcaaagagacaaccaaccacctgttgtcgagggccattcaccaccctaagtgttaatgtatctctggtttcctaaagctgttaaacgtttaatgaaagaagcggcagaattgaaagatccaacagatcattaccatgcgcagcctttagaggataacctttttgaatggcacttcacggttagagggcccccagactccgattttgatggaggagtttatcacgggcggatagtactgccaccagagtatcccatgaaaccaccaagcattattctcctaacggctaatggtcgatttgaagtgggcaagaaaatctgtttgagcatctcaggccatcatcctgaaacttggcagccttcgtggagtataaggacagcattattagccatcattgggtttatgccaacaaaaggagagggagccataggttctctagattacactcctgaggaaagaagagcacttgccaaaaaatcacaagatttctgttgtgaaggatgtggctctgccatgaaggatgtcctgttgcctttaaaatctggaagcgattcaagccaagctgaccaagaagccaaagaactggctaggcaaataagctttaaggcagaagtcaattcatctggaaagactatctctgagtcagacttaaaccactctttttcactaactgatttacaagatgatatacctacaacattccagggtgctacggccagtacatcgtacggactccagaattcctcagcagcatcctttcatcaacctacccaacctgtagctaagaatacctccatgagccctcgacagcgccgggcccagcagcagagtcagagaaggttgtctacttcaccagatgtaatccagggccaccagccaagagacaaccacactgatcatggtgggtcagctgtactgattgtcatcctgactttggcattggcagctcttatattccgacgaatatatctggcaaacgaatacatatttgactttgagttataatatggttttgtgacttatgagctgtgactcaactgcttcattaaacattctgcattgggtataatctaagaattgtttacaaaaagattattttgtatttacccttcattcctttttttgatccttgtaagtttagtataaatatatctagacattcagactgtgtctagcagttacgtcctgcttaaagggactagaagtcaaagttccttgtctcactatttgatctgctttgcagggaaataacttgttttttctcatgtttcatcttctttttatgtaaatttgtaatactttcctatattgccctttgaaatttttggataaaagatgatgttttaagttccaatgagtattactagttactcaataccacttattgagtactctgtttctacgtatgtagaatgtatagggatagaagagttgaaaagggaaagcaaaactcctcaagtagcttccttaaaatgtcattcataggagatgtactggaattgctcattctgtgactttatttgtgtcctaaacattcttcagtgaaaataattttatttcagtcaaacatttatgaggaaatgagatcacatctttgtcactggatgctacttgaagagggagtactttgtaaccactttgatatgctgttatcaccaccccctgccctctgctgccataatcacacaaatttaaaaagaaagaaaacagtcttccatagatttttaaggaagaaagggcccaagccaggagatcgcttggttttcttccagaagttaaatggggggatctgaagatttgaatgtttggtctgctttgaaatgtatgtcttttgggatgtattatatgcctagctttataatcagtataaattttaattattccaggaatatgcataatattgaaatatttcatgtcctattttaatagaaaacctcagggcccaagtaacagtgatagaagttagaaaaacctttacttagaattgtccacctagtcagagcccaagaaagaattttcagtggaaaaatcaatatataacttagtgctagctagcgccacagactctagtagataatattatcatcataatggctggtgaaaccatataatcacagaaaaacattgccttcagcatgttcagttcgcagcactgagggcactcttgagggtgttgttaatgaagatttaatttttaaatacaggtggttccaagctttcaaataggttatgctccaaaagtgttatttgtaagttaatttttttacaagtcaaacaatgttggaagtggtatttaggttctagatcggtccacgaaagttagcccatatgtatatcttgaatagtataggggagggtattcataaagtccttatgtggttttaactaagtgaaattatggacaagagaaataattgtaaaatcgtcttaaaggaaaatttaatttttactcctgtttatgggacattcgttctattaactgtcagacacaatttctgttttcatctgagagccagttttcctttatttctacatctaaaataagaacatattgtacactattatataatacagaattgtcttaaactttaataaattcgcattttaaaggtgtttacagattattttttatatctgtagctgaatttgttaaagtctaaaaagctcaaggactttatgaagatctcattatatgaggaaaatcataggttaccattttataactctattgccataagaaaatacactctaaaatcttgatttgaaacatattagaaaccttgattcagtgctcagtggtctcctagtaagaagtcaccgacggtagcgtcatatgagaagaaagaaatccccaccacctcaacctctgctgagattgtgtgctaggaacagccttccctccgtttcccctcagtcaaacttgagccagcctctggatcgatgtgatcttattgcatgtttccatggggtgtacctatactttaagccaatcctgctgcattcactgctaagttaaataaaaagccaagaagattttgcactgtgcagatcctttgctatctgacttgcatctcttcccccacctgtcagctagccacctgcttgtttgtgttgggatattttttagcacctgaagcaccatctgaaaggggcaccattttcttcttccctttgatctcacatatgctccctaaaaatccttaagttgtcaatctgatccccagtgtgaggttaatgagcaaaattggtctttggggccctttttgtccaagccccactgaaaggcctcttcagaaaactattatctttaaagccctactttaactccttaattccagcatacagctaaaactggatgtatattctggcaagtaaaggctgaggactcctctttaatcctcagatctagataactcatgacattttatttgaccaacatagcacatgatgagatatcaaggtaattaaaatagcatgcttgaaaaaaaaatacgtaatctgtttcacctgtaactgtttaagccaataaacttttcaaaatttatgtaatgtggggcttttatgtagcactttacgttttcatgctgcttattgttttattctactgaaaaaaatgaatttcaagattctcaacttttttaatttcaaaaattgtttattgttttgactataggaatacaaaatttcctattttgggagaataagaactctttttgtcatttttggctatgaataaactttctggtcttttgagaccacccatttttatagatcagaatcagaaaacaggtaaacctcactcacacatttggactcatttgaacaaaaatctaggccaaaatactgaaaagcctatgtgtttttttaattggaagtatatgtaaggttaatgcatttagtgaacgtgactaacaaagactaatgtgcacattaacagatgtactttttaaggttttatgggaggctgtgcattgctcaaaagctgttgggaacgccttctgaacagttgccttcagaactagtttgagctgctcaataaaaccagtgactttactcataccttgtttttgaccaaaggttgtattctttacatcatccagtcttgtctctcatccattctacctcctagaatatttctctctcatctttccacttccctaactaggcactatatcctatttagctattaactcctccaaattggtgcacacgaataacctcctaacaggtctct

SEQ ID NO: 427382 - DNA, 4665 bp, Homo sapiens
gcggccgcggcagggctgggcctgcgactacccgaggaggctgacctccagcccgggcgcccggttcagcgccgccccggccggcgccggtgcctgccaggcactcagggaggcgggggcgcagtggaggaggcggcgccatcgcgaagcgagcgcctcgcccgcactcagccttgccaccccgcccgcagtccaggctggactgggcggcatttgccgaggctcctcggccaggccccgtccgcccgagccgcgctgagacccgggcagcggccgcgtggagaggaggtggcagcggcccgggaggccggagccaagccagcgacccaccatggagacccgctacaacctgaagagtccggctgttaaacgtttaatgaaagaagcggcagaattgaaagatccaacagatcattaccatgcgcagcctttagaggataacctttttgaatggcacttcacggttagagggcccccagactccgattttgatggaggagtttatcacgggcggatagtactgccaccagagtatcccatgaaaccaccaagcattattctcctaacggctaatggtcgatttgaagtgggcaagaaaatctgtttgagcatctcaggccatcatcctgaaacttggcagccttcgtggagtagtaagtgttaatttatagtgaatataaatctcataacttcagtcaattcatagttatgaagtataatactctgattttttctttttccagaataaacccagttgcttttacaaagcaatttagattgatatttacttttttatttcagtaaggacagcattattagccatcattgggtttatgccaacaaaaggagagggagccataggttctctagattacactcctgaggaaagaagagcacttgccaaaaaatcacaagatttctgttgtgaaggatgtggctctgccatgaaggatgtcctgttgcctttaaaatctggaagcgattcaagccaagctgaccaagaagccaaagaactggctaggcaaataagctttaaggcagaagtcaattcatctggaaagactatctctgagtcagacttaaaccactctttttcactaactgatttacaagatgatatacctacaacattccagggtgctacggccagtacatcgtacggactccagaattcctcagcagcatcctttcatcaacctacccaacctgtagctaagaatacctccatgagccctcgacagcgccgggcccagcagcagagtcagagaaggttgtctacttcaccagatgtaatccagggccaccagccaagagacaaccacactgatcatggtgggtcagctgtactgattgtcatcctgactttggcattggcagctcttatattccgacgaatatatctggcaaacgaatacatatttgactttgagttataatatggttttgtgacttatgagctgtgactcaactgcttcattaaacattctgcattgggtataatctaagaattgtttacaaaaagattattttgtatttacccttcattcctttttttgatccttgtaagtttagtataaatatatctagacattcagactgtgtctagcagttacgtcctgcttaaagggactagaagtcaaagttccttgtctcactatttgatctgctttgcagggaaataacttgttttttctcatgtttcatcttctttttatgtaaatttgtaatactttcctatattgccctttgaaatttttggataaaagatgatgttttaagttccaatgagtattactagttactcaataccacttattgagtactctgtttctacgtatgtagaatgtatagggatagaagagttgaaaagggaaagcaaaactcctcaagtagcttccttaaaatgtcattcataggagatgtactggaattgctcattctgtgactttatttgtgtcctaaacattcttcagtgaaaataattttatttcagtcaaacatttatgaggaaatgagatcacatctttgtcactggatgctacttgaagagggagtactttgtaaccactttgatatgctgttatcaccaccccctgccctctgctgccataatcacacaaatttaaaaagaaagaaaacagtcttccatagatttttaaggaagaaagggcccaagccaggagatcgcttggttttcttccagaagttaaatggggggatctgaagatttgaatgtttggtctgctttgaaatgtatgtcttttgggatgtattatatgcctagctttataatcagtataaattttaattattccaggaatatgcataatattgaaatatttcatgtcctattttaatagaaaacctcagggcccaagtaacagtgatagaagttagaaaaacctttacttagaattgtccacctagtcagagcccaagaaagaattttcagtggaaaaatcaatatataacttagtgctagctagcgccacagactctagtagataatattatcatcataatggctggtgaaaccatataatcacagaaaaacattgccttcagcatgttcagttcgcagcactgagggcactcttgagggtgttgttaatgaagatttaatttttaaatacaggtggttccaagctttcaaataggttatgctccaaaagtgttatttgtaagttaatttttttacaagtcaaacaatgttggaagtggtatttaggttctagatcggtccacgaaagttagcccatatgtatatcttgaatagtataggggagggtattcataaagtccttatgtggttttaactaagtgaaattatggacaagagaaataattgtaaaatcgtcttaaaggaaaatttaatttttactcctgtttatgggacattcgttctattaactgtcagacacaatttctgttttcatctgagagccagttttcctttatttctacatctaaaataagaacatattgtacactattatataatacagaattgtcttaaactttaataaattcgcattttaaaggtgtttacagattattttttatatctgtagctgaatttgttaaagtctaaaaagctcaaggactttatgaagatctcattatatgaggaaaatcataggttaccattttataactctattgccataagaaaatacactctaaaatcttgatttgaaacatattagaaaccttgattcagtgctcagtggtctcctagtaagaagtcaccgacggtagcgtcatatgagaagaaagaaatccccaccacctcaacctctgctgagattgtgtgctaggaacagccttccctccgtttcccctcagtcaaacttgagccagcctctggatcgatgtgatcttattgcatgtttccatggggtgtacctatactttaagccaatcctgctgcattcactgctaagttaaataaaaagccaagaagattttgcactgtgcagatcctttgctatctgacttgcatctcttcccccacctgtcagctagccacctgcttgtttgtgttgggatattttttagcacctgaagcaccatctgaaaggggcaccattttcttcttccctttgatctcacatatgctccctaaaaatccttaagttgtcaatctgatccccagtgtgaggttaatgagcaaaattggtctttggggccctttttgtccaagccccactgaaaggcctcttcagaaaactattatctttaaagccctactttaactccttaattccagcatacagctaaaactggatgtatattctggcaagtaaaggctgaggactcctctttaatcctcagatctagataactcatgacattttatttgaccaacatagcacatgatgagatatcaaggtaattaaaatagcatgcttgaaaaaaaaatacgtaatctgtttcacctgtaactgtttaagccaataaacttttcaaaatttatgtaatgtggggcttttatgtagcactttacgttttcatgctgcttattgttttattctactgaaaaaaatgaatttcaagattctcaacttttttaatttcaaaaattgtttattgttttgactataggaatacaaaatttcctattttgggagaataagaactctttttgtcatttttggctatgaataaactttctggtcttttgagaccacccatttttatagatcagaatcagaaaacaggtaaacctcactcacacatttggactcatttgaacaaaaatctaggccaaaatactgaaaagcctatgtgtttttttaattggaagtatatgtaaggttaatgcatttagtgaacgtgactaacaaagactaatgtgcacattaacagatgtactttttaaggttttatgggaggctgtgcattgctcaaaagctgttgggaacgccttctgaacagttgccttcagaactagtttgagctgctcaataaaaccagtgactttactcataccttgtttttgaccaaaggttgtattctttacatcatccagtcttgtctctcatccattctacctcctagaatatttctctctcatctttccacttccctaactaggcactatatcctatttagctattaactcctccaaattggtgcacacgaataacctcctaacaggtctct

SEQ ID NO: 427383 - DNA, 3522 bp, Homo sapiens
gcacgagccgttaggagaataatgcttggtggtttcatgggatactctggtggcagtactatccgcccgtgataaactcctccatgagccctcgacagcgccgggcccagcagcagagtcagagaaggttgtctacttcaccagatgtaatccagggccaccagccaagagacaaccacactgatcatggtgggtcagctgtactgattgtcatcctgactttggcattggcagctcttatattccgacgaatatatctggcaaacgaatacatatttgactttgagttataatatggttttgtgacttatgagctgtgactcaactgcttcattaaacattctgcattgggtataatctaagaattgtttacaaaaagattattttgtatttacccttcattcctttttttgatccttgtaagtttagtataaatatatctagacattcagactgtgtctagcagttacgtcctgcttaaagggactagaagtcaaagttccttgtctcactatttgatctgctttgcagggaaataacttgttttttctcatgtttcatcttctttttatgtaaatttgtaatactttcctatattgccctttgaaatttttggataaaagatgatgttttaagttccaatgagtattactagttactcaataccacttattgagtactctgtttctacgtatgtagaatgtatagggatagaagagttgaaaagggaaagcaaaactcctcaagtagcttccttaaaatgtcattcataggagatgtactggaattgctcattctgtgactttatttgtgtcctaaacattcttcagtgaaaataattttatttcagtcaaacatttatgaggaaatgagatcacatctttgtcactggatgctacttgaagagggagtactttgtaaccactttgatatgctgttatcaccaccccctgccctctgctgccataatcacacaaatttaaaaagaaagaaaacagtcttccatagatttttaaggaagaaagggcccaagccaggagatcgcttggttttcttccagaagttaaatggggggatctgaagatttgaatgtttggtctgctttgaaatgtatgtcttttgggatgtattatatgcctagctttataatcagtataaattttaattattccaggaatatgcataatattgaaatatttcatgtcctattttaatagaaaacctcagggcccaagtaacagtgatagaagttagaaaaacctttacttagaattgtccacctagtcagagcccaagaaagaattttcagtggaaaaatcaatatataacttagtgctagctagcgccacagactctagtagataatattatcatcataatggctggtgaaaccatataatcacagaaaaacattgccttcagcatgttcagttcgcagcactgagggcactcttgagggtgttgttaatgaagatttaatttttaaatacaggtggttccaagctttcaaataggttatgctccaaaagtgttatttgtaagttaatttttttacaagtcaaacaatgttggaagtggtatttaggttctagatcggtccacgaaagttagcccatatgtatatcttgaatagtataggggagggtattcataaagtccttatgtggttttaactaagtgaaattatggacaagagaaataattgtaaaatcgtcttaaaggaaaatttaatttttactcctgtttatgggacattcgttctattaactgtcagacacaatttctgttttcatctgagagccagttttcctttatttctacatctaaaataagaacatattgtacactattatataatacagaattgtcttaaactttaataaattcgcattttaaaggtgtttacagattattttttatatctgtagctgaatttgttaaagtctaaaaagctcaaggactttatgaagatctcattatatgaggaaaatcataggttaccattttataactctattgccataagaaaatacactctaaaatcttgatttgaaacatattagaaaccttgattcagtgctcagtggtctcctagtaagaagtcaccgacggtagcgtcatatgagaagaaagaaatccccaccacctcaacctctgctgagattgtgtgctaggaacagccttccctccgtttcccctcagtcaaacttgagccagcctctggatcgatgtgatcttattgcatgtttccatggggtgtacctatactttaagccaatcctgctgcattcactgctaagttaaataaaaagccaagaagattttgcactgtgcagatcctttgctatctgacttgcatctcttcccccacctgtcagctagccacctgcttgtttgtgttgggatattttttagcacctgaagcaccatctgaaaggggcaccattttcttcttccctttgatctcacatatgctccctaaaaatccttaagttgtcaatctgatccccagtgtgaggttaatgagcaaaattggtctttggggccctttttgtccaagccccactgaaaggcctcttcagaaaactattatctttaaagccctactttaactccttaattccagcatacagctaaaactggatgtatattctggcaagtaaaggctgaggactcctctttaatcctcagatctagataactcatgacattttatttgaccaacatagcacatgatgagatatcaaggtaattaaaatagcatgcttgaaaaaaaaatacgtaatctgtttcacctgtaactgtttaagccaataaacttttcaaaatttatgtaatgtggggcttttatgtagcactttacgttttcatgctgcttattgttttattctactgaaaaaaatgaatttcaagattctcaacttttttaatttcaaaaattgtttattgttttgactataggaatacaaaatttcctattttgggagaataagaactctttttgtcatttttggctatgaataaactttctggtcttttgagaccacccatttttatagatcagaatcagaaaacaggtaaacctcactcacacatttggactcatttgaacaaaaatctaggccaaaatactgaaaagcctatgtgtttttttaattggaagtatatgtaaggttaatgcatttagtgaacgtgactaacaaagactaatgtgcacattaacagatgtactttttaaggttttatgggaggctgtgcattgctcaaaagctgttgggaacgccttctgaacagttgccttcagaactagtttgagctgctcaataaaaccagtgactttactcataccttgtttttgaccaaaggttgtattctttacatcatccagtcttgtctctcatccattctacctcctagaatatttctctctcatctttccacttccctaactaggcactatatcctatttagctattaactcctccaaattggtgcacacgaataacctcctaacaggtctct

SEQ ID NO: 427384 - DNA, 3313 bp, Homo sapiens
aatatgtattcgtttgccagatatattataactcaaagtcaaatatgtattcgtttgccagatatatttgactttgagttataatatggttttgtgacttatgagctgtgactcaactgcttcattaaacattctgcattgggtataatctaagaattgtttacaaaaagattattttgtatttacccttcattcctttttttgatccttgtaagtttagtataaatatatctagacattcagactgtgtctagcagttacgtcctgcttaaagggactagaagtcaaagttccttgtctcactatttgatctgctttgcagggaaataacttgttttttctcatgtttcatcttctttttatgtaaatttgtaatactttcctatattgccctttgaaatttttggataaaagatgatgttttaagttccaatgagtattactagttactcaataccacttattgagtactctgtttctacgtatgtagaatgtatagggatagaagagttgaaaagggaaagcaaaactcctcaagtagcttccttaaaatgtcattcataggagatgtactggaattgctcattctgtgactttatttgtgtcctaaacattcttcagtgaaaataattttatttcagtcaaacatttatgaggaaatgagatcacatctttgtcactggatgctacttgaagagggagtactttgtaaccactttgatatgctgttatcaccaccccctgccctctgctgccataatcacacaaatttaaaaagaaagaaaacagtcttccatagatttttaaggaagaaagggcccaagccaggagatcgcttggttttcttccagaagttaaatggggggatctgaagatttgaatgtttggtctgctttgaaatgtatgtcttttgggatgtattatatgcctagctttataatcagtataaattttaattattccaggaatatgcataatattgaaatatttcatgtcctattttaatagaaaacctcagggcccaagtaacagtgatagaagttagaaaaacctttacttagaattgtccacctagtcagagcccaagaaagaattttcagtggaaaaatcaatatataacttagtgctagctagcgccacagactctagtagataatattatcatcataatggctggtgaaaccatataatcacagaaaaacattgccttcagcatgttcagttcgcagcactgagggcactcttgagggtgttgttaatgaagatttaatttttaaatacaggtggttccaagctttcaaataggttatgctccaaaagtgttatttgtaagttaatttttttacaagtcaaacaatgttggaagtggtatttaggttctagatcggtccacgaaagttagcccatatgtatatcttgaatagtataggggagggtattcataaagtccttatgtggttttaactaagtgaaattatggacaagagaaataattgtaaaatcgtcttaaaggaaaatttaatttttactcctgtttatgggacattcgttctattaactgtcagacacaatttctgttttcatctgagagccagttttcctttatttctacatctaaaataagaacatattgtacactattatataatacagaattgtcttaaactttaataaattcgcattttaaaggtgtttacagattattttttatatctgtagctgaatttgttaaagtctaaaaagctcaaggactttatgaagatctcattatatgaggaaaatcataggttaccattttataactctattgccataagaaaatacactctaaaatcttgatttgaaacatattagaaaccttgattcagtgctcagtggtctcctagtaagaagtcaccgacggtagcgtcatatgagaagaaagaaatccccaccacctcaacctctgctgagattgtgtgctaggaacagccttccctccgtttcccctcagtcaaacttgagccagcctctggatcgatgtgatcttattgcatgtttccatggggtgtacctatactttaagccaatcctgctgcattcactgctaagttaaataaaaagccaagaagattttgcactgtgcagatcctttgctatctgacttgcatctcttcccccacctgtcagctagccacctgcttgtttgtgttgggatattttttagcacctgaagcaccatctgaaaggggcaccattttcttcttccctttgatctcacatatgctccctaaaaatccttaagttgtcaatctgatccccagtgtgaggttaatgagcaaaattggtctttggggccctttttgtccaagccccactgaaaggcctcttcagaaaactattatctttaaagccctactttaactccttaattccagcatacagctaaaactggatgtatattctggcaagtaaaggctgaggactcctctttaatcctcagatctagataactcatgacattttatttgaccaacatagcacatgatgagatatcaaggtaattaaaatagcatgcttgaaaaaaaaatacgtaatctgtttcacctgtaactgtttaagccaataaacttttcaaaatttatgtaatgtggggcttttatgtagcactttacgttttcatgctgcttattgttttattctactgaaaaaaatgaatttcaagattctcaacttttttaatttcaaaaattgtttattgttttgactataggaatacaaaatttcctattttgggagaataagaactctttttgtcatttttggctatgaataaactttctggtcttttgagaccacccatttttatagatcagaatcagaaaacaggtaaacctcactcacacatttggactcatttgaacaaaaatctaggccaaaatactgaaaagcctatgtgtttttttaattggaagtatatgtaaggttaatgcatttagtgaacgtgactaacaaagactaatgtgcacattaacagatgtactttttaaggttttatgggaggctgtgcattgctcaaaagctgttgggaacgccttctgaacagttgccttcagaactagtttgagctgctcaataaaaccagtgactttactcataccttgtttttgaccaaaggttgtattctttacatcatccagtcttgtctctcatccattctacctcctagaatatttctctctcatctttccacttccctaactaggcactatatcctatttagctattaactcctccaaattggtgcacacgaataacctcctaacaggtctct

SEQ ID NO: 427385 - DNA, 1236 bp, Homo sapiens
gcggccgcggcagggctgggcctgcgactacccgaggaggctgacctccagcccgggcgcccggttcagcgccgccccggccggcgccggtgcctgccaggcactcagggaggcgggggcgcagtggaggaggcggcgccatcgcgaagcgagcgcctcgcccgcactcagccttgccaccccgcccgcagtccaggctggactgggcggcatttgccgaggctcctcggccaggccccgtccgcccgagccgcgctgagacccgggcagcggccgcgtggagaggaggtggcagcggcccgggaggccggagccaagccagcgacccaccatggagacccgctacaacctgaagagtccggctgttaaacgtttaatgaaagaagcggcagaattgaaagatccaacagatcattaccatgcgcagcctttagaggataacctttttgaatggcacttcacggttagagggcccccagactccgattttgatggaggagtttatcacgggcggatagtactgccaccagagtatcccatgaaaccaccaagcattattctcctaacggctaatggtcgatttgaagtgggcaagaaaatctgtttgagcatctcaggccatcatcctgaaacttggcagccttcgtggagtataaggacagcattattagccatcattgggtttatgccaacaaaaggagagggagccataggttctctagattacactcctgaggaaagaagagcacttgccaaaaaatcacaagatttctgttgtgaaggatgtggctctgccatgaaggatgtcctgttgcctttaaaatctggaagcgattcaagccaagctgaccaagaagccaaagaactggctaggcaaataagctttaagtacggactccagaattcctcagcagcatcctttcatcaacctacccaacctgtagctaagaatacctccatgagccctcgacagcgccgggcccagcagcagagtcagagaaggttgtctacttcaccagatgtaatccagggccaccagccaagagacaaccacactgatcatggtgggtcagctgtactgattgtcatcctgactttggcattggcagctcttatattccgacgaatatatctggcaaacgaatacatatttgactttgagttataatatggttttgtgacttatgagctgtgactcaactgcttcattaaacattctgcattgggtataatcta

SEQ ID NO: 427386 - DNA, 1148 bp, Homo sapiens
gcggccgcggcagggctgggcctgcgactacccgaggaggctgacctccagcccgggcgcccggttcagcgccgccccggccggcgccggtgcctgccaggcactcagggaggcgggggcgcagtggaggaggcggcgccatcgcgaagcgagcgcctcgcccgcactcagccttgccaccccgcccgcagtccaggctggactgggcggcatttgccgaggctcctcggccaggccccgtccgcccgagccgcgctgagacccgggcagcggccgcgtggagaggaggtggcagcggcccgggaggccggagccaagccagcgacccaccatggagacccgctacaacctgaagagtccggctgttaaacgtttaatgaaagaagcggcagaattgaaagatccaacagatcattaccatgcgcagcctttagaggataacctttttgaatggcacttcacggttagagggcccccagactccgattttgatggaggagtttatcacgggcggatagtactgccaccagagtatcccatgaaaccaccaagcattattctcctaacggctaatggtcgatttgaagtgggcaagaaaatctgtttgagcatctcaggccatcatcctgaaacttggcagccttcgtggagtataaggacagcattattagccatcattgggtttatgccaacaaaaggagagggagccataggttctctagattacactcctgaggaaagaagagcacttgccaaaaagtaagttttgcatttcattcttcttgaggtctgaatagtattcagggtaatggctattaggaggtagggcctacctcttactatgtgacttattttctgagtgactgtagctacaggatcttatctcagttttgctcttttaggaattcagttgtaataatttccttggagtgaccagaatctaagtaatttatttaatgctatctagtcttaaaaagtagttgatactatttcactatttttaaaaaattcagtgggagatatattctcctggaaaacaataccagtcatttgtttccactatggcattatagatggaaaagaaccagagcaattatttgtagctttccacaagattacaaacctcttgagggccaagaggtaatcca

SEQ ID NO: 427387 - DNA, 1296 bp, Homo sapiens
gcggccgcggcagggctgggcctgcgactacccgaggaggctgacctccagcccgggcgcccggttcagcgccgccccggccggcgccggtgcctgccaggcactcagggaggcgggggcgcagtggaggaggcggcgccatcgcgaagcgagcgcctcgcccgcactcagccttgccaccccgcccgcagtccaggctggactgggcggcatttgccgaggctcctcggccaggccccgtccgcccgagccgcgctgagacccgggcagcggccgcgtggagaggaggtggcagcggcccgggaggccggagccaagccagcgacccaccatggagacccgctacaacctgaagagtccggctgttaaacgtttaatgaaagaagcggcagaattgaaagatccaacagatcattaccatgcgcagcctttagaggataacctttttgaatggcacttcacggttagagggcccccagactccgattttgatggaggagtttatcacgggcggatagtactgccaccagagtatcccatgaaaccaccaagcattattctcctaacggctaatggtcgatttgaagtgggcaagaaaatctgtttgagcatctcaggccatcatcctgaaacttggcagccttcgtggagtagtaagtgttaatttatagtgaatataaatctcataacttcagtcaattcatagttatgaagtataatactctgattttttctttttccagaataaacccagttgcttttacaaagcaatttagattgatatttacttttttatttcagtaaggacagcattattagccatcattgggtttatgccaacaaaaggagagggagccataggttctctagattacactcctgaggaaagaagagcacttgccaaaaagtaagttttgcatttcattcttcttgaggtctgaatagtattcagggtaatggctattaggaggtagggcctacctcttactatgtgacttattttctgagtgactgtagctacaggatcttatctcagttttgctcttttaggaattcagttgtaataatttccttggagtgaccagaatctaagtaatttatttaatgctatctagtcttaaaaagtagttgatactatttcactatttttaaaaaattcagtgggagatatattctcctggaaaacaataccagtcatttgtttccactatggcattatagatggaaaagaaccagagcaattatttgtagctttccacaagattacaaacctcttgagggccaagaggtaatcca

SEQ ID NO: 427388 - DNA, 3963 bp, Homo sapiens
ccctctcggggccgcgcgggtgcccgggcggcggcggcgacgcgacgtcgcgaggaggaggaggcggcgggggtccaggaggccggccagcgcatggaggaggaggccatgaacggcgaccggactgagagcgactggcaggggctggtgagcgagtacctggtgtgtaagaggaagctggagagtaagaaggaagccctgctgatcctctccaaggagctggacacctgtcaacaggaaagggaccagtacaaactcatggccaatcagctccgggagcgccaccagtcactgaagaagaagtaccgagagctgattgatggagatccatcacttcctcctgaaaaaaggaaacaggctaatcttgcacaactattgagagattctcaggaccgaaataaacatctgggagaagaaattaaagaacttcagcaaaggcttggagaagtccagggcgacaacaagctcttgaggatgacgattgccaaacaaaggctcggagacgaagcaatcggcgtgcgacactttgcagcccatgagcgtgaagacttggtgcagcagctagagcgagctaaggaacagattgagtctctggagcacgacctgcaggcttctgtggacgagcttcaggatgttaaagaagaacggtcttcctaccaggacaaagtggagaggctcaaccaggagctgaaccatatcctgagtgggcacgagaaccgcatcattgacgtggacgccctgtgtatggagaacaggtaccttcaagagagattaaagcaactccatgaagaggtcaacctcttgaaatcaaacattgccaaatacaagaatgctctggagagacggaaaaactcgaagggccagggtaaatccagcagcagtgctctgacaggagtcctgtctgcaaagcaagttcaggatctgctatctgaggatcatggatgcagcctcccagctactccgcagtccatttctgacctgaaatctctggcaacagccctgttggaaacaatccacgagaaaaacatggtcattcagcaccagaggcaaaccaacaaaatcctagggaatcgggtggctgagctggaaaaaaaattaagaactctggaagtttctggtttgtggagtcttccagggggcaaggacaccatactgttcagcgaccccactcttcctagtggacagaggtcgagatccccactgctgaagtttgtcgagcagcccactgagaacaaagcagatcccaaggatggggaggctcagaagcaagaagaagatgaaagttgtgccgctgctgaggcgttgacagcgcctgaggatgctgggaggcccgctgtcaactccccagcaaatcagagccgcgggaaccaatgcaagctctttcatccttcattaccccagttaccttctgaggaagaagtaaacagccttgggagggaaataattaaactgacaaaggaacaggcagctgcagaactggaagaggtcagaagagagagtcccatagaaggtcagaggagtgagacggggccagccccgccaggcctggccatccagggggagctccctaaatctcacctggactccttcgaggccagccggccagcagccaaagcttccacaccggaagacggcaaagggatcccagagggcggaggcatgaggagcaccgtgaaaacctgaaggggagagggatctgacacaatgacacattgaaagccccagagagggtcaagaatgaagcatcggaatggtgcgctcacgtcgccttctcctgaaatacctccgagtctgcaagtgagaaaacgcgctgatcctgttgcaaactgtgaatattctgatgatgccagtacagtttgatttattaaatgtaggtcctcaagcttctcagtgtcatctcttttctgccagagagtgctactgtgaacagggccaggcccaggaatcgtgtccaccatatggctggttttcagcatccgtctttctgtcagcttttgttttatcagagataagatgtttttgtattagcatttaatgttgtcaatcaaaattatgggaagagctagaaactgatggggtttttaatcaggtccccatcttggtcaaggttaggcagctggagaggaaggtataattgagcaaaacgtgtccagaggacccatggctgcaccccatcaagtcagggcccaggaggactgcctggcatgggtgtgcttggcattgtgcccacagcactgctgtcgtggtacagactggcagttggaaggggccttaagccggctgagaagtttgggcttctgggttgaaatccacggccccggttgaggcctgtgtgctgagtgccagagctggagttttctagcttgtaaatctggagaattaactgatctgaagtgactgggaggggtgagcataaaagccggggaacaggactcccagtggtggtctggttttttttgtgagatgagatgagagctaccacctggaaatgctcattctctgcattcagcctgtctcacatacaggattgtatggccatttcaggtttgggaaagatctacctgctgggagccagtctagtttcctgcaccacctggaacttccaaacccttcactccttcaacagaatgttgaggctgcctcatttgtgccaccaagtacgggaatcttaaagacagaaacagagctcatgaccttttatgggaaagagagaggaaaacaaaacaacttcacaacagcatggcaaggggggatgtggaaccaaggacatgatacagggatgggaaaggagggcatgctcaattctagctggttctttcctttcagataaaaatgagcttttctagttggcatccggcactgcagaaaactaaaagtcatccagccatagctttttccttccctggaaagcctgagactagatcccaaagctcagaatgcctctgagaaccagaatcactcctttgagaggcgctccttgcaggaaaaagagaggctcccagagtggtagcctctcagtgaaaatgcatcctaaaaattcaatgtttataccaggctcatgacactaagatgtgacatctggacacgaggggtcagccacgtggatacatccctcccagattgcatctccaggaatcactctgctagcagaatgggcgccccatcccttactatgctgctcctcctcaaagtgcagcccagaaggacccaggcctttgatgcacattgggtgggtctcccactactttagttgaaatgggagcatgctggagtcggcgttctgttgcttctggtgagaaggacatcccattgacccctggccaccaggtccagtattccatccttccttctgtcccagcctatcgccctccccaccaggcccacccccacaacttctcctcaagggaggttgctcccgcagctggagggcttgcacagaccagcagtcacagaaatcattcttcctgctgtactgggccttaactgcctgcaaatgtccagcactactgcataggatgccagagccaccgaaggaaaacacagccaagtttaataataataaaaggaaaaatctcagcctgcagaactctggttttgacccaccatcggccagatgcacatcttcagggcctgttgagcaccttctgaaaagcagggctcgtaatagactccagcacattccatcagagtcaggaaaactgcggtgagtcccagagaatctagggtgcagggcagggagcaggagtcataaggagtgataacctaaactgtgtgtagtcagcggggagggtcttatgttatcaggtgaaatgagagccagtaagttagttgatcctgtcacagatataaccctgataacaccccatagatacgcgacacgtgtgtcctgcccctgctttccccatccaacatggttcttctgttccacagacattaaaggggctttctgcaattaaaaaaagc

SEQ ID NO: 427389 - DNA, 3176 bp, Homo sapiens
ccctctcggggccgcgcgggtgcccgggcggcggcggcgacgcgacgtcgcgaggaggaggaggcggcgggggtccaggaggccggccagcgcatggaggaggaggccatgaacggcgaccggactgagagcgactggcaggggctggtgagcgagtacctggtgtgtaagaggaagctggagagtaagaaggaagccctgctgatcctctccaaggagctggacacctgtcaacaggaaagggaccagtacaaactcatggccaatcagctccgggagcgccaccagtcactgaagaagaagtaccgagagctgattgatggagatccatcacttcctcctgaaaaaaggaaacaggctaatcttgcacaactattgagagattctcaggaccgaaataaacatctgggagaagaaattaaagaacttcagcaaaggcttggagaagtccagggcgacaacaaggggaggctcagaagcaagaagaagatgaaagttgtgccgctgctgaggcgttgacagcgcctgaggatgctgggaggcccgctgtcaactccccagcaaatcagagccgcgggaaccaatgcaagctctttcatccttcattaccccagttaccttctgaggaagaagtaaacagccttgggagggaaataattaaactgacaaaggaacaggcagctgcagaactggaagaggtcagaagagagagtcccatagaaggtcagaggagtgagacggggccagccccgccaggcctggccatccagggggagctccctaaatctcacctggactccttcgaggccagccggccagcagccaaagcttccacaccggaagacggcaaagggatcccagagggcggaggcatgaggagcaccgtgaaaacctgaaggggagagggatctgacacaatgacacattgaaagccccagagagggtcaagaatgaagcatcggaatggtgcgctcacgtcgccttctcctgaaatacctccgagtctgcaagtgagaaaacgcgctgatcctgttgcaaactgtgaatattctgatgatgccagtacagtttgatttattaaatgtaggtcctcaagcttctcagtgtcatctcttttctgccagagagtgctactgtgaacagggccaggcccaggaatcgtgtccaccatatggctggttttcagcatccgtctttctgtcagcttttgttttatcagagataagatgtttttgtattagcatttaatgttgtcaatcaaaattatgggaagagctagaaactgatggggtttttaatcaggtccccatcttggtcaaggttaggcagctggagaggaaggtataattgagcaaaacgtgtccagaggacccatggctgcaccccatcaagtcagggcccaggaggactgcctggcatgggtgtgcttggcattgtgcccacagcactgctgtcgtggtacagactggcagttggaaggggccttaagccggctgagaagtttgggcttctgggttgaaatccacggccccggttgaggcctgtgtgctgagtgccagagctggagttttctagcttgtaaatctggagaattaactgatctgaagtgactgggaggggtgagcataaaagccggggaacaggactcccagtggtggtctggttttttttgtgagatgagatgagagctaccacctggaaatgctcattctctgcattcagcctgtctcacatacaggattgtatggccatttcaggtttgggaaagatctacctgctgggagccagtctagtttcctgcaccacctggaacttccaaacccttcactccttcaacagaatgttgaggctgcctcatttgtgccaccaagtacgggaatcttaaagacagaaacagagctcatgaccttttatgggaaagagagaggaaaacaaaacaacttcacaacagcatggcaaggggggatgtggaaccaaggacatgatacagggatgggaaaggagggcatgctcaattctagctggttctttcctttcagataaaaatgagcttttctagttggcatccggcactgcagaaaactaaaagtcatccagccatagctttttccttccctggaaagcctgagactagatcccaaagctcagaatgcctctgagaaccagaatcactcctttgagaggcgctccttgcaggaaaaagagaggctcccagagtggtagcctctcagtgaaaatgcatcctaaaaattcaatgtttataccaggctcatgacactaagatgtgacatctggacacgaggggtcagccacgtggatacatccctcccagattgcatctccaggaatcactctgctagcagaatgggcgccccatcccttactatgctgctcctcctcaaagtgcagcccagaaggacccaggcctttgatgcacattgggtgggtctcccactactttagttgaaatgggagcatgctggagtcggcgttctgttgcttctggtgagaaggacatcccattgacccctggccaccaggtccagtattccatccttccttctgtcccagcctatcgccctccccaccaggcccacccccacaacttctcctcaagggaggttgctcccgcagctggagggcttgcacagaccagcagtcacagaaatcattcttcctgctgtactgggccttaactgcctgcaaatgtccagcactactgcataggatgccagagccaccgaaggaaaacacagccaagtttaataataataaaaggaaaaatctcagcctgcagaactctggttttgacccaccatcggccagatgcacatcttcagggcctgttgagcaccttctgaaaagcagggctcgtaatagactccagcacattccatcagagtcaggaaaactgcggtgagtcccagagaatctagggtgcagggcagggagcaggagtcataaggagtgataacctaaactgtgtgtagtcagcggggagggtcttatgttatcaggtgaaatgagagccagtaagttagttgatcctgtcacagatataaccctgataacaccccatagatacgcgacacgtgtgtcctgcccctgctttccccatccaacatggttcttctgttccacagacattaaaggggctttctgcaattaaaaaaagc

SEQ ID NO: 427390 - DNA, 2283 bp, Homo sapiens
ccctctcggggccgcgcgggtgcccgggcggcggcggcgacgcgacgtcgcgaggaggaggaggcggcgggggtccaggaggccggccagcgcatggaggaggaggccatgaacggcgaccggactgagagcgactggcaggggctggtgagcgagtacctggtgtgtaagaggaagctggagagtaagaaggaagccctgctgatcctctccaaggagctggacacctgtcaacaggaaagggaccagtacaaactcatggccaatcagctccgggagcgccaccagtcactgaagaagaagtaccgagagctgattgatggagatccatcacttcctcctgaaaaaaggaaacaggctaatcttgcacaactattgagagattctcaggaccgaaataaacatctgggagaagaaattaaagaacttcagcaaaggcttggagaagtccagggcgacaacaagctcttgaggatgacgattgccaaacaaaggctcggagacgaagcaatcggcgtgcgacactttgcagcccatgagcgtgaagacttggtgcagcagctagagcgagctaaggaacagattgagtctctggagcacgacctgcaggcttctgtggacgagcttcaggatgttaaagaagaacggtcttcctaccaggacaaagtggagaggctcaaccaggagctgaaccatatcctgagtgggcacgagaaccgcatcattgacgtggacgccctgtgtatggagaacaggtaccttcaagagagattaaagcaactccatgaagaggtcaacctcttgaaatcaaacattgccaaatacaagaatgctctggagagacggaaaaactcgaagggccagggtaaatccagcagcagtgctctgacaggagtcctgtctgcaaagcaagttcaggatctgctatctgaggatcatggatgcagcctcccagctactccgcagtccatttctgacctgaaatctctggcaacagccctgttggaaacaatccacgagaaaaacatggtcattcagcaccagaggcaaaccaacaaaatcctagggaatcgggtggctgagctggaaaaaaaattaagaactctggaagtttctggtttgtggagtcttccagggggcaaggacaccatactgttcagcgaccccactcttcctagtggacagaggtcgagatccccactgctgaagtttgtcgagcagcccactgagaacaaagcagatcccaaggatggggaggctcagaagcaagaagaagatgaaagttgtgccgctgctgaggcgttgacagcgcctgaggatgctgggaggcccgctgtcaactccccagcaaatcagagccgcgggaaccaatgcaagctctttcatccttcattaccccagttaccttctgaggaagaagtaaacagccttgggagggaaataattaaactgacaaaggaacaggcagctgcagaactggaagaggtcagaagagagagtcccatagaaggtcagaggagtgagacggggccagccccgccaggcctggccatccagggggagctccctaaatctcacctggactccttcgaggccagccggccagcagccaaagcttccacaccggaagacggcaaagggatcccagagggcggaggcatgaggagcaccgtgaaaacctgaaggggagagggatctgacacaatgacacattgaaagccccagagagggtcaagaatgaagcatcggaatggtgcgctcacgtcgccttctcctgaaatacctccgagtctgcaagtgagaaaacgcgctgatcctgttgcaaactgtgaatattctgatgatgccagtacagtttgatttattaaatgtaggtcctcaaaaaaaaaaaaaaaaaaaaaaaaaaaaaaaaaaaaaaaaaaaaaaaaaaaaaaaaacctcgagtttttttttttttggagacagagtctaactctgttgcccaggctggagtgcaggggcaccatctaagctcactgcaacctttgcctcctgggttcaagtgatgctgtgcctcagcctccagagtagctgggattacaggcgtgtgccaccacgtccagctaatttttgcatttttagtagagacaaggtttcaccatgttggccaggctggtctcaaactcctgacctcaagagatccatccaccttggcctcccaaaatgctgagattacaggcgtgagccaccattcccggcctcttccaatattatttcatttactcagcaaataataattgaggg

SEQ ID NO: 427391 - DNA, 333 bp, Homo sapiens
gtaggtggccaaactcttgtgttggggggtgggcgcgaaggaagtgggacgaggctaccagaagtgaatgtcaaccagctggaacgacggacctgcagggaaggtgagacccctcaaatcaagaaggaaacttattaaactagaatggtgcttctgctttatatcagcatcttggctatcagctggagccaagcaaggaaagggtaccagccatactgaatgcttactctgagctacacactgagtagtatgtatttcatggatgagttccataaaataatcgcctgggtgacttgacccacctctcctccagctcttcttttaggggagaaa

SEQ ID NO: 427392 - DNA, 3293 bp, Homo sapiens
  misc_feature (57)..(57): n is a, c, g, or t
  misc_feature (69)..(69): n is a, c, g, or t
  misc_feature (83)..(83): n is a, c, g, or t
cccgggacaggtaacaggagctgggcatatcgggggggggtgagaagcggagtcatngacgtggacgcncgtgtatggagaanaggtaccttcaagagagattaaagcaactccatgaagaggtcaacctcttgaaatcaaacattgccaaatacaagaatgctctggagagacggaaaaactcgaagggccagggtaaatccagcagcagtgctctgacaggagtcctgtctgcaaagcaagttcaggatctgctatctgaggatcatggatgcagcctcccagctactccgcagtccatttctgacctgaaatctctggcaacagccctgttggaaacaatccacgagaaaaacatggtcattcagcaccagaggcaaaccaacaaaatcctagggaatcgggtggctgagctggaaaaaaaattaagaactctggaagtttctggtttgtggagtcttccagggggcaaggacaccatactgttcagcgaccccactcttcctagtggacagaggtcgagatccccactgctgaagtttgtcgagcagcccactgagaacaaagcagatcccaaggatggggaggctcagaagcaagaagaagatgaaagttgtgccgctgctgaggcgttgacagcgcctgaggatgctgggaggcccgctgtcaactccccagcaaatcagagccgcgggaaccaatgcaagctctttcatccttcattaccccagttaccttctgaggaagaagtaaacagccttgggagggaaataattaaactgacaaaggaacaggcagctgcagaactggaagaggtcagaagagagagtcccatagaaggtcagaggagtgagacggggccagccccgccaggcctggccatccagggggagctccctaaatctcacctggactccttcgaggccagccggccagcagccaaagcttccacaccggaagacggcaaagggatcccagagggcggaggcatgaggagcaccgtgaaaacctgaaggggagagggatctgacacaatgacacattgaaagccccagagagggtcaagaatgaagcatcggaatggtgcgctcacgtcgccttctcctgaaatacctccgagtctgcaagtgagaaaacgcgctgatcctgttgcaaactgtgaatattctgatgatgccagtacagtttgatttattaaatgtaggtcctcaagcttctcagtgtcatctcttttctgccagagagtgctactgtgaacagggccaggcccaggaatcgtgtccaccatatggctggttttcagcatccgtctttctgtcagcttttgttttatcagagataagatgtttttgtattagcatttaatgttgtcaatcaaaattatgggaagagctagaaactgatggggtttttaatcaggtccccatcttggtcaaggttaggcagctggagaggaaggtataattgagcaaaacgtgtccagaggacccatggctgcaccccatcaagtcagggcccaggaggactgcctggcatgggtgtgcttggcattgtgcccacagcactgctgtcgtggtacagactggcagttggaaggggccttaagccggctgagaagtttgggcttctgggttgaaatccacggccccggttgaggcctgtgtgctgagtgccagagctggagttttctagcttgtaaatctggagaattaactgatctgaagtgactgggaggggtgagcataaaagccggggaacaggactcccagtggtggtctggttttttttgtgagatgagatgagagctaccacctggaaatgctcattctctgcattcagcctgtctcacatacaggattgtatggccatttcaggtttgggaaagatctacctgctgggagccagtctagtttcctgcaccacctggaacttccaaacccttcactccttcaacagaatgttgaggctgcctcatttgtgccaccaagtacgggaatcttaaagacagaaacagagctcatgaccttttatgggaaagagagaggaaaacaaaacaacttcacaacagcatggcaaggggggatgtggaaccaaggacatgatacagggatgggaaaggagggcatgctcaattctagctggttctttcctttcagataaaaatgagcttttctagttggcatccggcactgcagaaaactaaaagtcatccagccatagctttttccttccctggaaagcctgagactagatcccaaagctcagaatgcctctgagaaccagaatcactcctttgagaggcgctccttgcaggaaaaagagaggctcccagagtggtagcctctcagtgaaaatgcatcctaaaaattcaatgtttataccaggctcatgacactaagatgtgacatctggacacgaggggtcagccacgtggatacatccctcccagattgcatctccaggaatcactctgctagcagaatgggcgccccatcccttactatgctgctcctcctcaaagtgcagcccagaaggacccaggcctttgatgcacattgggtgggtctcccactactttagttgaaatgggagcatgctggagtcggcgttctgttgcttctggtgagaaggacatcccattgacccctggccaccaggtccagtattccatccttccttctgtcccagcctatcgccctccccaccaggcccacccccacaacttctcctcaagggaggttgctcccgcagctggagggcttgcacagaccagcagtcacagaaatcattcttcctgctgtactgggccttaactgcctgcaaatgtccagcactactgcataggatgccagagccaccgaaggaaaacacagccaagtttaataataataaaaggaaaaatctcagcctgcagaactctggttttgacccaccatcggccagatgcacatcttcagggcctgttgagcaccttctgaaaagcagggctcgtaatagactccagcacattccatcagagtcaggaaaactgcggtgagtcccagagaatctagggtgcagggcagggagcaggagtcataaggagtgataacctaaactgtgtgtagtcagcggggagggtcttatgttatcaggtgaaatgagagccagtaagttagttgatcctgtcacagatataaccctgataacaccccatagatacgcgacacgtgtgtcctgcccctgctttccccatccaacatggttcttctgttccacagacattaaaggggctttctgcaattaaaaaaagc

SEQ ID NO: 427393 - DNA, 1882 bp, Homo sapiens
ccctctcggggccgcgcgggtgcccgggcggcggcggcgacgcgacgtcgcgaggaggaggaggcggcgggggtccaggaggccggccagcgcatggaggaggaggccatgaacggcgaccggactgagagcgactggcaggggctggtgagcgagtacctggtgtgtaagaggaagctggagagtaagaaggaagccctgctgatcctctccaaggagctggacacctgtcaacaggaaagggaccagtacaaactcatggccaatcagctccgggagcgccaccagtcactgaagaagaagtaccgagagctgattgatggagatccatcacttcctcctgaaaaaaggaaacaggctaatcttgcacaactattgagagattctcaggaccgaaataaacatctgggagaagaaattaaagaacttcagcaaaggcttggagaagtccagggcgacaacaagctcttgaggatgacgattgccaaacaaaggctcggagacgaagcaatcggcgtgcgacactttgcagcccatgagcgtgaagacttggtgcagcagctagagcgagctaaggaacagattgagtctctggagcacgacctgcaggcttctgtggacgagcttcaggatgttaaagaagaacggtcttcctaccaggacaaagtggagaggctcaaccaggagctgaaccatatcctgagtgggcacgagaaccgcatcattgacgtggacgccctgtgtatggagaacaggtaccttcaagagagattaaagcaactccatgaagaggtcaacctcttgaaatcaaacattgccaaatacaagaatgctctggagagacggaaaaactcgaagggccagggtaaatccagcagcagtgctctgacaggagtcctgtctgcaaagcaagttcaggatctgctatctgaggatcatggatgcagcctcccagctactccgcagtccatttctgacctgaaatctctggcaacagccctgttggaaacaatccacgagaaaaacatggtcattcagcaccagaggcaaaccaacaaaatcctagggaatcgggtggctgagctggaaaaaaaattaagaactctggaagtttctggtttgtggagtcttccagggggcaaggacaccatactgttcagcgaccccactcttcctagtggacagaggtcgagatccccactgctgaagtttgtcgagcagcccactgagaacaaagcagatcccaaggatggggaggctcagaagcaagaagaagatgaaagttgtgccgctgctgaggcgttgacagcgcctgaggatgctgggaggcccgctgtcaactccccagcaaatcagagccgcgggaaccaatgcaagctctttcatccttcattaccccagttaccttctgaggaagaagtaaacagccttgggagggaaataattaaactgacaaaggaacaggcagctgcagaactggaagaggtcagaagagagagtcccatagaaggtcagaggagtgagacggggccagccccgccaggcctggccatccagggggagctccctaaatctcacctggactccttcgaggccagccggccagcagccaaagcttccacaccggaagacggcaaagggatcccagagggcggaggcatgaggagcaccgtgaaaacctgaaggggagagggatctgacacaatgacacattgaaagccccagagagggtcaagaatgaagcatcggaatggtgcgctcacgtcgccttctcctgaaatacctccgagtctgcaagtgagaaaacgcgctgatcctgttgcaaactgtgaatattctgatgatgccagtacagtttgatttattaaatgtaggtcctcaa

SEQ ID NO: 427394 - DNA, 524 bp, Homo sapiens
agaggttaaaaagataacagatggactgcatgcccttcaagaagcaagtaataaagatgctgaagctctggccgcgcacagcagcacttcaatgctgtttccgctggcctgtccagtaatgaagatggagcagaagcaactcttgctggtcaaatgatggcctgtaaaaatgatataagtaaagctcagacagaagccaaacaggctcagatgaagttgaagcatgctcagctgaggaattaaaagaaatgcaagataaagttataaagcttcaggaagaattgtctgagaatgataaaaaaataaaagcacttaatcatgaaatagaagaattggaaaaaagaaaagataaggaaactggaggtatacttcgatctttagaagatgctcttgcagaggctcagcgagttaatactaaatctcaaagcgcatttgatctcaagaagaaaaatctggcatgtgaggaaagcaaacgcaaagagctggaaaaaaatatggttgaggtaagtgagcttaatgtgcca

SEQ ID NO: 427395 - DNA, 6442 bp, Homo sapiens
ggcgccgaaattcaaaggaataaatagttccggcgcgggtgttgagagcggtgtggtaggtgttgtagccgctatggtgaagttcgctttgtagcggccccggctagagagttggcctgttccctgcctttgtgacccggaggagcttttggggtgcgtcaagcccctggcctgaggcagcgaactggtttgtggcctgtttgattcctgtcagaggtttgctgacccaagacagtatcgaaaatgcatattaagtcaattattctagagggattcaagtcctatgctcagaggaccgaagtcaatggttttgaccccctcttcaatgctatcactggcttaaatggtagtgggaaatccaacatattggactccatctgctttttgctgggcatctccaacctgtctcaggttcgggcttctaatttacaagatttagtttacaaaaatgggcaggctggtattaccaaagcctctgtgtcaatcacttttgataattctgacaaaaagcaaagtcctttaggatttgaggttcatgatgaaatcacagtaacaaggcaggtggttattggtggtagaaataaatatttaatcaatggagtcaatgccaacaacaccagagtacaggatctcttctgttctgttggccttaatgttaacaaccctcactttctcatcatgcagggccgaattacaaaagtattgaatatgaaacctccagagattttatccatgatagaagaagcagctggaaccaggatgtatgaatacaaaaaaatagctgcacagaaaactatagaaaaaaaggaggctaagctgaaagaaattaagacgatacttgaagaagagattactccaaccattcaaaaattaaaagaggaaagatcgtcctacttggagtaccaaaaagtaatgagagaaatagaacatttgagtcgtttatatattgcttatcagtttttgctggctgaagataccaaagtacgctcagctgaggaattaaaagaaatgcaagataaagttataaagcttcaggaagaattgtctgagaatgataaaaaaataaaagcacttaatcatgaaatagaagaattggaaaaaagaaaagataaggaaactggaggtatacttcgatctttagaagatgctcttgcagaggctcagcgagttaatactaaatctcaaagcgcatttgatctcaagaagaaaaatctggcatgtgaggaaagcaaacgcaaagagctggaaaaaaatatggttgaggactcaaaaactttagcagcaaaggaaaaagaggttaaaaagataacagatggactgcatgcccttcaagaagcaagtaataaagatgctgaagctctggcagctgcacagcagcacttcaatgctgtttccgctggcctgtccagtaatgaagatggagcagaagcaactcttgctggtcaaatgatggcctgtaaaaatgatataagtaaagctcagacagaagccaaacaggctcagatgaagttgaagcatgctcaacaggaattaaagaataaacaagctgaagttaagaagatggatagtggctacaggaaggatcaagaagctctagaagctgtaaaaagacttaaagaaaaacttgaagctgaaatgaaaaagctaaattatgaagaaaataaagaggaaagccttttggaaaagcgcaggcagctgtctcgtgatattggtagattgaaagaaacatatgaagctctattagccagatttcccaatcttcgatttgcatacaaggatccagagaagaactggaatagaaattgtgtgaaaggacttgtggcttctctgattagtgtgaaagacacttctgcaaccacagctttagaattagtggctggagaacgactctacaatgttgtagtagacacagaagttactggtaaaaagctactagaaaggggggaactgaaacgtcgatacactataattccactcaataaaatttcagccagatgtattgcaccagaaactctgagagttgctcagaatcttgttggccctgacaacgttcatgtggctctttccttggttgaatataaaccagaacttcagaaagcaatggagtttgtctttggaacaacatttgtttgtgacaatatggataatgccaaaaaagtggcctttgataagaggataatgactagaactgtaactctcggaggtgatgtgtttgatcctcatgggacattgagtggaggtgctcgatcccaggcagcttccattttaaccaagtttcaagaactcaaagatgttcaggatgaactgagaatcaaagagaatgagctgcgggctctagaagaggaattagcaggtcttaaaaacactgctgaaaagtatcgccaactaaaacagcagtgggagatgaaaactgaagaggcagatttattacaaaccaagctccagcaaagctcatatcacaagcaacaagaagaattagatgcccttaaaaaaaccattgaggaaagtgaggagactttgaaaaacactaaagaaatccaaagaaaagcagaagaaaaatatgaagtattggaaaataaaatgaaaaatgcagaagctgaaagagagcgagaactgaaagatgctcagaaaaaactggattgtgccaaaacaaaggcagatgcatctagcaagaagatgaaagaaaaacaacaggaagttgaagctatcactctggaactggaagagctcaagagagagcatacatcttacaaacaacagcttgaagctgtaaatgaagctatcaaatcctatgaaagtcagattgaagtaatggcagctgaggtggctaaaaataaggagtcagtaaataaagctcaagaagaggtgaccaagcaaaaagaggtgataacagcccaagacactgtaattaaagctaaatatgcagaagtggcaaaacacaaggagcaaaacaatgattctcagcttaaaattaaggaattagaccacaacatcagcaaacataaacgggaggctgaagatggtgctgcaaaggtatccaaaatgttgaaagattatgactggattaatgcagagagacacctctttggccaacccaatagtgcctatgatttcaaaactaacaaccctaaagaagctggtcagagacttcagaagttgcaagaaatgaaggagaaactaggaagaaatgtcaatatgagagctatgaatgtattgacagaagctgaagagcgatacaatgacttgatgaagaagaagagaattgtagaaaatgacaaatccaaaattcttacaactatagaagaccttgaccagaagaaaaaccaagccctaaatattgcatggcaaaaggtgaacaaggactttgggtctattttttctactcttttgcctggtgctaatgctatgcttgcaccaccagagggtcaaactgttttggatggtctggagttcaaggttgccttgggaaatacctggaaagaaaacctaactgaacttagtggtggtcagaggtctttagtggccttgtcattaatactgtccatgcttctcttcaaacctgctccaatttatatccttgatgaggtagatgcagccttggatctttctcatacccaaaacattggacagatgctgcgtactcatttcacacattctcagttcattgtggtgtcactaaaagaaggtatgttcaacaatgcaaacgttcttttcaaaaccaagtttgtggatggtgtttctacagtagccagatttactcaatgtcaaaatggaaagatttcaaaggaagcaaaatccaaggcaaaaccacccaaaggagcacatgtggaagtttaaactacaaagttatttcttcatcttgacctgtttttttaaatgtaaacttttaaggacttgagataactaatttgtttatatacaaaaattaatgttactgtgttacttaacccatgttttctctttatataatcacttatcgcttacaaatgagcatatattcctcatctcttaactagtctaattatggtccaattattgtggttgtgattttatgcatatcatcaaatgtttttttcttatgcgggtcttttatatattagggatcctgagatacccgattctatatgtaaaagctaatatacaaaaaagcagattaaattacatgataaatgtagctgatcatcagtgtttaattgatttaattcctaaggcaatattaatgtgttttctaaagtcattcaggtaaggaagaattataaatcaggtaactggaccaacaaagggaacacatataaagctattatgcatgcatggagccgtttgaggctagttttttaaggccacaactccagacccctgatttagactgagataggaaacagatcttgaaagaatccttattttaatgatacatgaatatcatgttcctatacgcttaataattggtctctacgttttaatgatacatgaatatcatgttcctatacgcttaataattggtctctacgactttaatgtttttgtttttttaagctgtgtaagtatttttaaatcaaagcttaggaggtgtgttgcgtggtactatctgctgcaaatttatctgaagtttgttaatattttccaagatttttgtcagccttttcataatccagtcattaacaacctattggtaaacaagaatgtaggtgccagtagactaaaccaaatttatttttccctgagtctgatatatatatgtataaatataaataactcaatccatctgttccaccaaaataactcaaaagttggatgattatttgtcttccgctttccagttcaaagggatgaaattcctttagaacttgaaagatgacactagcgaacaccatgagaatactgtctacagtttttggtacgtcatcactagaacagtgaccccaaactgaatcatgaaaggtctgacatgatgtaatctgatcttccatgtgttattttggccccacatctcttcttgattttttagtcttatttccttagtgttattatcatacttcccctgatatatggccgtacttcctggccctgggcttgacatttcccacccttcattctccatacatatgagatgtcagaaaacatgcagtaattgatattatgggacacattggaaaggattgaatctggaattagttctgtccactgtggaggggagaggaaataatgctgtaaatgttgagttacagaaagtccaatgtcaaatatagtttttttgtttcctttcaaatgtattacagactgtgccaaaacagttaccaattcacactgtcaatattaaagtataccatagtatacaaattagtcagtacttgctgttaattttaatatttctgatttaacagttagttattaagtggtacttcattgctgttttagccaacgttttaaaaataatttgggagtttgactattttggcttacgtactcatttccttttctctgctaaaaatgttttgcttgtgtgcgttcctgatttttgtcttgtataatcttgatctttgaaaaccctcaaacatgtattaaattgttgtaactttttttcattagagggaagacattaaggggattggggacatttgtttcacacatctgcagtaatatgagttaactaatatttaacaagctctttctttacattagctgctgttctcatttgtatgtattgtcatatttaatcctcagagtaacctagtgaggtaaatactgttgttgtcagcatggtgtaatcgaggaattgagtgagttgagcagaaaagttaggaaacttgctcagggtgataatacagttaggagtgtcagggcccatggacaaatcttgtcagtctccagaacctaagatatactacgtcactgacagcttgaacatttgtatttattgtacagaataaatttaagaaaaatacctgtatgagcagtatgtacaacgtgaatgttaccttaaagaagaacctcaaccatgtgaagagaggattcattgtggtggtggcggttttggcatttcaagtaagctcacagcaaatgcaaagcaaagacatgaaattttctcttccaatagggtggcataatctaaaggccaacattcccacagatgataaatatagattctgagcaaaatactagaaacaactacctgagagttcaggaaactgaagaaaaactagaaagattttggatgggagataaaatacggaggaagagacaggcacaagctaaggttaatgtttttaacctaagtaccagctatagtcatgatgcagctgtaggacagctaaggctgcagtggaaagcctggggtctttctggtctggagaactaaaagatgggatctgggctaaccacagcttccagaaagtgaaggagacgtctcagaagggataaacgaggacctggagaaagaggtccc

SEQ ID NO: 427396 - DNA, 5339 bp, Homo sapiens
ggcgccgaaattcaaaggaataaatagttccggcgcgggtgttgagagcggtgtggtaggtgttgtagccgctatggtgaagttcgctttgtagcggccccggctagagagttggcctgttccctgcctttgtgacccggaggagcttttggggtgcgtcaagcccctggcctgaggcagcgaactggtttgtggcctgtttgattcctgtcagaggtttgctgacccaagacagtatcgaaaatgcatattaagtcaattattctagagggattcaagtcctatgctcagaggaccgaagtcaatggttttgaccccctcttcaatgctatcactggcttaaatggtagtgggaaatccaacatattggactccatctgctttttgctgggcatctccaacctgtctcaggttcgggcttctaatttacaagatttagtttacaaaaatgggcaggctggtattaccaaagcctctgtgtcaatcacttttgataattctgacaaaaagcaaagtcctttaggatttgaggttcatgatgaaatcacagtaacaaggcaggtggttattggtggtagaaataaatatttaatcaatggagtcaatgccaacaacaccagagtacaggatctcttctgttctgttggccttaatgttaacaaccctcactttctcatcatgcagggccgaattacaaaagtattgaatatgaaacctccagagattttatccatgatagaagaagcagctggaaccaggatgtatgaatacaaaaaaatagctgcacagaaaactatagaaaaaaaggaggctaagctgaaagaaattaagacgatacttgaagaagagattactccaaccattcaaaaattaaaagaggaaagatcgtcctacttggagtaccaaaaagtaatgagagaaatagaacatttgagtcgtttatatattgcttatcagtttttgctggctgaagataccaaagtacgctcagctgaggaattaaaagaaatgcaagataaagttataaagcttcaggaagaattgtctgagaatgataaaaaaataaaagcacttaatcatgaaatagaagaattggaaaaaagaaaagataaggaaactggaggtatacttcgatctttagaagatgctcttgcagaggctcagcgagttaatactaaatctcaaagcgcatttgatctcaagaagaaaaatctggcatgtgaggaaagcaaacgcaaagagctggaaaaaaatatggttgaggactcaaaaactttagcagcaaaggaaaaagaggttaaaaagataacagatggactgcatgcccttcaagaagcaagtaataaagatgctgaagctctggcagctgcacagcagcacttcaatgctgtttccgctggcctgtccagtaatgaagatggagcagaagcaactcttgctggtcaaatgatggcctgtaaaaatgatataagtaaagctcagacagaagccaaacaggctcagatgaagttgaagcatgctcaacaggaattaaagaataaacaagctgaagttaagaagatggatagtggctacaggaaggatcaagaagctctagaagctgtaaaaagacttaaagaaaaacttgaagctgaaatgaaaaagctaaattatgaagaaaataaagaggaaagccttttggaaaagcgcaggcagctgtctcgtgatattggtagattgaaagaaacatatgaagctctattagccagatttcccaatcttcgatttgcatacaaggatccagagaagaactggaatagaaattgtgtgaaaggacttgtggcttctctgattagtgtgaaagacacttctgcaaccacagctttagaattagtggctggagaacgactctacaatgttgtagtagacacagaagttactggtaaaaagctactagaaaggggggaactgaaacgtcgatacactataattccactcaataaaatttcagccagatgtattgcaccagaaactctgagagttgctcagaatcttgttggccctgacaacgttcatgtggctctttccttggttgaatataaaccagaacttcagaaagcaatggagtttgtctttggaacaacatttgtttgtgacaatatggataatgccaaaaaagtggcctttgataagaggataatgactagaactgtaactctcggaggtgatgtgtttgatcctcatgggacattgagtggaggtgctcgatcccaggcagcttccattttaaccaagtttcaagaactcaaagatgttcaggatgaactgagaatcaaagagaatgagctgcgggctctagaagaggaattagcaggtcttaaaaacactgctgaaaagtatcgccaactaaaacagcagtgggagatgaaaactgaagaggcagatttattacaaaccaagctccagcaaagctcatatcacaagcaacaagaagaattagatgcccttaaaaaaaccattgaggaaagtgaggagactttgaaaaacactaaagaaatccaaagaaaagcagaagaaaaatatgaagtattggaaaataaaatgaaaaatgcagaagctgaaagagagcgagaactgaaagatgctcagaaaaaactggattgtgccaaaacaaaggcagatgcatctagcaagaagatgaaagaaaaacaacaggaagttgaagctatcactctggaactggaagagctcaagagagagcatacatcttacaaacaacagcttgaagctgtaaatgaagctatcaaatcctatgaaagtcagattgaagtaatggcagctgaggtggctaaaaataaggagtcagtaaataaagctcaagaagaggtgaccaagcaaaaagaggtgataacagcccaagacactgtaattaaagctaaatatgcagaagtggcaaaacacaaggagcaaaacaatgattctcagcttaaaattaaggaattagaccacaacatcagcaaacataaacgggaggctgaagatggtgctgcaaaggtatccaaaatgttgaaagattatgactggattaatgcagagagacacctctttggccaacccaatagtgcctatgatttcaaaactaacaaccctaaagaagctggtcagagacttcagaagttgcaagaaatgaaggagaaactaggaagaaatgtcaatatgagagctatgaatgtattgacagaagctgaagagcgatacaatgacttgatgaagaagaagagaattgtagaaaatgacaaatccaaaattcttacaactatagaagaccttgaccagaagaaaaaccaagccctaaatattgcatggcaaaaggtgaacaaggactttgggtctattttttctactcttttgcctggtgctaatgctatgcttgcaccaccagagggtcaaactgttttggatggtctggagttcaaggttgccttgggaaatacctggaaagaaaacctaactgaacttagtggtggtcagaggtctttagtggccttgtcattaatactgtccatgcttctcttcaaacctgctccaatttatatccttgatgaggtagatgcagccttggatctttctcatacccaaaacattggacagatgctgcgtactcatttcacacattctcagttcattgtggtgtcactaaaagaaggtatgttcaacaatgcaaacgttcttttcaaaaccaagtttgtggatggtgtttctacagtagccagatttactcaatgtcaaaatggaaagatttcaaaggaagcaaaatccaaggcaaaaccacccaaaggagcacatgtggaagtttaaactacaaagttatttcttcatcttgacctgtttttttaaatgtaaacttttaaggacttgagataactaatttgtttatatacaaaaattaatgttactgtgttacttaacccatgttttctctttatataatcacttatcgcttacaaatgagcatatattcctcatctcttaactagtctaattatggtccaattattgtggttgtgattttatgcatatcatcaaatgtttttttcttatgcgggtcttttatatattagggatcctgagatacccgattctatatgtaaaagctaatatacaaaaaagcagattaaattacatgataaatgtagctgatcatcagtgtttaattgatttaattcctaaggcaatattaatgtgttttctaaagtcattcaggtaaggaagaattataaatcaggtaactggaccaacaaagggaacacatataaagctattatgcatgcatggagccgtttgaggctagttttttaaggccacaactccagacccctgatttagactgagataggaaacagatcttgaaagaatccttattttaatgatacatgaatatcatgttcctatacgcttaataattggtctctacgttttaatgatacatgaatatcatgttcctatacgcttaataattggtctctacgactttaatgtttttgtttttttaagctgtgtaagtatttttaaatcaaagcttaggaggtgtgttgcgtggtactatctgctgcaaatttatctgaagtttgttaatattttccaagatttttgtcagccttttcataatccagtcattaacaacctattggtaaacaagaatgtaggtgccagtagactaaaccaaatttatttttccctgagtctgatatatatatgtataaatataaataactcaatccatctgttccaccaaaataactcaaaagttggatgattatttgtcttccgctttccagttcaaagggatgaaattcctttagaacttgaaagatgacactagcgaacaccatgagaatactgtctacagtttttggtacgtcatcactagaacagtgaccccaaactgaatcatgaaaggtctgacatgatgtaatctgatcttccatgtgttattttggccccacatctcttcttgattttttagtcttatttccttagtgttattatcatacttcccctgatatatggccgtacttcctggccctgggcttgacatttcccacccttcattctccatacatatgagatgtcagaaaacatgcagtaattgatattatgggacacattggaaaggattgaatctggaattagttctgtccactgtggaggggagaggaaataatgctgtaaatgttgagtccccccccccccaaccccgcacatagtttttcctttcggttcaaacgggtatcaaaaggaggcttttcaaaaaacaaatcacaacagacaaaattaaagtataccatagtatacaaatt

SEQ ID NO: 427397 - DNA, 6540 bp, Homo sapiens
ggcgcgggggctgtagggagggggaccagtggcagagggaccttaggtgatccttagaaataaaggctagcttctgttcgaccttggagtagggcgaagaggtgtagacaggcctggagaagcgaggtaaaagcctgagtaaaagcaagaagttggagaatatgagatacatctcatctctagtaaatacttaaatgacttcccctcctcccggagtcaagcacaattcggggatgcaatgacggacgtaggtgaagacactgcgggaacttacagacaaaactggtttgtggcctgtttgattcctgtcagaggtttgctgacccaagacagtatcgaaaatgcatattaagtcaattattctagagggattcaagtcctatgctcagaggaccgaagtcaatggttttgaccccctcttcaatgctatcactggcttaaatggtagtgggaaatccaacatattggactccatctgctttttgctgggcatctccaacctgtctcaggttcgggcttctaatttacaagatttagtttacaaaaatgggcaggctggtattaccaaagcctctgtgtcaatcacttttgataattctgacaaaaagcaaagtcctttaggatttgaggttcatgatgaaatcacagtaacaaggcaggtggttattggtggtagaaataaatatttaatcaatggagtcaatgccaacaacaccagagtacaggatctcttctgttctgttggccttaatgttaacaaccctcactttctcatcatgcagggccgaattacaaaagtattgaatatgaaacctccagagattttatccatgatagaagaagcagctggaaccaggatgtatgaatacaaaaaaatagctgcacagaaaactatagaaaaaaaggaggctaagctgaaagaaattaagacgatacttgaagaagagattactccaaccattcaaaaattaaaagaggaaagatcgtcctacttggagtaccaaaaagtaatgagagaaatagaacatttgagtcgtttatatattgcttatcagtttttgctggctgaagataccaaagtacgctcagctgaggaattaaaagaaatgcaagataaagttataaagcttcaggaagaattgtctgagaatgataaaaaaataaaagcacttaatcatgaaatagaagaattggaaaaaagaaaagataaggaaactggaggtatacttcgatctttagaagatgctcttgcagaggctcagcgagttaatactaaatctcaaagcgcatttgatctcaagaagaaaaatctggcatgtgaggaaagcaaacgcaaagagctggaaaaaaatatggttgaggactcaaaaactttagcagcaaaggaaaaagaggttaaaaagataacagatggactgcatgcccttcaagaagcaagtaataaagatgctgaagctctggcagctgcacagcagcacttcaatgctgtttccgctggcctgtccagtaatgaagatggagcagaagcaactcttgctggtcaaatgatggcctgtaaaaatgatataagtaaagctcagacagaagccaaacaggctcagatgaagttgaagcatgctcaacaggaattaaagaataaacaagctgaagttaagaagatggatagtggctacaggaaggatcaagaagctctagaagctgtaaaaagacttaaagaaaaacttgaagctgaaatgaaaaagctaaattatgaagaaaataaagaggaaagccttttggaaaagcgcaggcagctgtctcgtgatattggtagattgaaagaaacatatgaagctctattagccagatttcccaatcttcgatttgcatacaaggatccagagaagaactggaatagaaattgtgtgaaaggacttgtggcttctctgattagtgtgaaagacacttctgcaaccacagctttagaattagtggctggagaacgactctacaatgttgtagtagacacagaagttactggtaaaaagctactagaaaggggggaactgaaacgtcgatacactataattccactcaataaaatttcagccagatgtattgcaccagaaactctgagagttgctcagaatcttgttggccctgacaacgttcatgtggctctttccttggttgaatataaaccagaacttcagaaagcaatggagtttgtctttggaacaacatttgtttgtgacaatatggataatgccaaaaaagtggcctttgataagaggataatgactagaactgtaactctcggaggtgatgtgtttgatcctcatgggacattgagtggaggtgctcgatcccaggcagcttccattttaaccaagtttcaagaactcaaagatgttcaggatgaactgagaatcaaagagaatgagctgcgggctctagaagaggaattagcaggtcttaaaaacactgctgaaaagtatcgccaactaaaacagcagtgggagatgaaaactgaagaggcagatttattacaaaccaagctccagcaaagctcatatcacaagcaacaagaagaattagatgcccttaaaaaaaccattgaggaaagtgaggagactttgaaaaacactaaagaaatccaaagaaaagcagaagaaaaatatgaagtattggaaaataaaatgaaaaatgcagaagctgaaagagagcgagaactgaaagatgctcagaaaaaactggattgtgccaaaacaaaggcagatgcatctagcaagaagatgaaagaaaaacaacaggaagttgaagctatcactctggaactggaagagctcaagagagagcatacatcttacaaacaacagcttgaagctgtaaatgaagctatcaaatcctatgaaagtcagattgaagtaatggcagctgaggtggctaaaaataaggagtcagtaaataaagctcaagaagaggtgaccaagcaaaaagaggtgataacagcccaagacactgtaattaaagctaaatatgcagaagtggcaaaacacaaggagcaaaacaatgattctcagcttaaaattaaggaattagaccacaacatcagcaaacataaacgggaggctgaagatggtgctgcaaaggtatccaaaatgttgaaagattatgactggattaatgcagagagacacctctttggccaacccaatagtgcctatgatttcaaaactaacaaccctaaagaagctggtcagagacttcagaagttgcaagaaatgaaggagaaactaggaagaaatgtcaatatgagagctatgaatgtattgacagaagctgaagagcgatacaatgacttgatgaagaagaagagaattgtagaaaatgacaaatccaaaattcttacaactatagaagaccttgaccagaagaaaaaccaagccctaaatattgcatggcaaaaggtgaacaaggactttgggtctattttttctactcttttgcctggtgctaatgctatgcttgcaccaccagagggtcaaactgttttggatggtctggagttcaaggttgccttgggaaatacctggaaagaaaacctaactgaacttagtggtggtcagaggtctttagtggccttgtcattaatactgtccatgcttctcttcaaacctgctccaatttatatccttgatgaggtagatgcagccttggatctttctcatacccaaaacattggacagatgctgcgtactcatttcacacattctcagttcattgtggtgtcactaaaagaaggtatgttcaacaatgcaaacgttcttttcaaaaccaagtttgtggatggtgtttctacagtagccagatttactcaatgtcaaaatggaaagatttcaaaggaagcaaaatccaaggcaaaaccacccaaaggagcacatgtggaagtttaaactacaaagttatttcttcatcttgacctgtttttttaaatgtaaacttttaaggacttgagataactaatttgtttatatacaaaaattaatgttactgtgttacttaacccatgttttctctttatataatcacttatcgcttacaaatgagcatatattcctcatctcttaactagtctaattatggtccaattattgtggttgtgattttatgcatatcatcaaatgtttttttcttatgcgggtcttttatatattagggatcctgagatacccgattctatatgtaaaagctaatatacaaaaaagcagattaaattacatgataaatgtagctgatcatcagtgtttaattgatttaattcctaaggcaatattaatgtgttttctaaagtcattcaggtaaggaagaattataaatcaggtaactggaccaacaaagggaacacatataaagctattatgcatgcatggagccgtttgaggctagttttttaaggccacaactccagacccctgatttagactgagataggaaacagatcttgaaagaatccttattttaatgatacatgaatatcatgttcctatacgcttaataattggtctctacgttttaatgatacatgaatatcatgttcctatacgcttaataattggtctctacgactttaatgtttttgtttttttaagctgtgtaagtatttttaaatcaaagcttaggaggtgtgttgcgtggtactatctgctgcaaatttatctgaagtttgttaatattttccaagatttttgtcagccttttcataatccagtcattaacaacctattggtaaacaagaatgtaggtgccagtagactaaaccaaatttatttttccctgagtctgatatatatatgtataaatataaataactcaatccatctgttccaccaaaataactcaaaagttggatgattatttgtcttccgctttccagttcaaagggatgaaattcctttagaacttgaaagatgacactagcgaacaccatgagaatactgtctacagtttttggtacgtcatcactagaacagtgaccccaaactgaatcatgaaaggtctgacatgatgtaatctgatcttccatgtgttattttggccccacatctcttcttgattttttagtcttatttccttagtgttattatcatacttcccctgatatatggccgtacttcctggccctgggcttgacatttcccacccttcattctccatacatatgagatgtcagaaaacatgcagtaattgatattatgggacacattggaaaggattgaatctggaattagttctgtccactgtggaggggagaggaaataatgctgtaaatgttgagttacagaaagtccaatgtcaaatatagtttttttgtttcctttcaaatgtattacagactgtgccaaaacagttaccaattcacactgtcaatattaaagtataccatagtatacaaattagtcagtacttgctgttaattttaatatttctgatttaacagttagttattaagtggtacttcattgctgttttagccaacgttttaaaaataatttgggagtttgactattttggcttacgtactcatttccttttctctgctaaaaatgttttgcttgtgtgcgttcctgatttttgtcttgtataatcttgatctttgaaaaccctcaaacatgtattaaattgttgtaactttttttcattagagggaagacattaaggggattggggacatttgtttcacacatctgcagtaatatgagttaactaatatttaacaagctctttctttacattagctgctgttctcatttgtatgtattgtcatatttaatcctcagagtaacctagtgaggtaaatactgttgttgtcagcatggtgtaatcgaggaattgagtgagttgagcagaaaagttaggaaacttgctcagggtgataatacagttaggagtgtcagggcccatggacaaatcttgtcagtctccagaacctaagatatactacgtcactgacagcttgaacatttgtatttattgtacagaataaatttaagaaaaatacctgtatgagcagtatgtacaacgtgaatgttaccttaaagaagaacctcaaccatgtgaagagaggattcattgtggtggtggcggttttggcatttcaagtaagctcacagcaaatgcaaagcaaagacatgaaattttctcttccaatagggtggcataatctaaaggccaacattcccacagatgataaatatagattctgagcaaaatactagaaacaactacctgagagttcaggaaactgaagaaaaactagaaagattttggatgggagataaaatacggaggaagagacaggcacaagctaaggttaatgtttttaacctaagtaccagctatagtcatgatgcagctgtaggacagctaaggctgcagtggaaagcctggggtctttctggtctggagaactaaaagatgggatctgggctaaccacagcttccagaaagtgaaggagacgtctcagaagggataaacgaggacctggagaaagaggtccc

SEQ ID NO: 427398 - DNA, 4613 bp, Homo sapiens
ggcgcgggggctgtagggagggggaccagtggcagagggaccttaggtgatccttagaaataaaggctagcttctgttcgaccttggagtagggcgaagaggtgtagacaggcctggagaagcgaggtaaaagcctgagtaaaagcaagaagttggagaatatgagatacatctcatctctagtaaatacttaaatgacttcccctcctcccggagtcaagcacaattcggggatgcaatgacggacgtaggtgaagacactgcgggaacttacagacaaaactggtttgtggcctgtttgattcctgtcagaggtttgctgacccaagacagtatcgaaaatgcatattaagtcaattattctagagggattcaagtcctatgctcagaggaccgaagtcaatggttttgaccccctcttcaatgctatcactggcttaaatggtagtgggaaatccaacatattggactccatctgctttttgctgggcatctccaacctgtctcaggttcgggcttctaatttacaagatttagtttacaaaaatgggcaggctggtattaccaaagcctctgtgtcaatcacttttgataattctgacaaaaagcaaagtcctttaggatttgaggttcatgatgaaatcacagtaacaaggcaggtggttattggtggtagaaataaatatttaatcaatggagtcaatgccaacaacaccagagtacaggatctcttctgttctgttggccttaatgttaacaaccctcactttctcatcatgcagggccgaattacaaaagtattgaatatgaaacctccagagattttatccatgatagaagaagcagctggaaccaggatgtatgaatacaaaaaaatagctgcacagaaaactatagaaaaaaaggaggctaagctgaaagaaattaagacgatacttgaagaagagattactccaaccattcaaaaattaaaagaggaaagatcgtcctacttggagtaccaaaaagtaatgagagaaatagaacatttgagtcgtttatatattgcttatcagtttttgctggctgaagataccaaagtacgctcagctgaggaattaaaagaaatgcaagataaagttataaagcttcaggaagaattgtctgagaatgataaaaaaataaaagcacttaatcatgaaatagaagaattggaaaaaagaaaagataaggaaactggaggtatacttcgatctttagaagatgctcttgcagaggctcagcgagttaatactaaatctcaaagcgcatttgatctcaagaagaaaaatctggcatgtgaggaaagcaaacgcaaagagctggaaaaaaatatggttgaggactcaaaaactttagcagcaaaggaaaaagaggttaaaaagataacagatggactgcatgcccttcaagaagcaagtaataaagatgctgaagctctggcagctgcacagcagcacttcaatgctgtttccgctggcctgtccagtaatgaagatggagcagaagcaactcttgctggtcaaatgatggcctgtaaaaatgatataagtaaagctcagacagaagccaaacaggctcagatgaagttgaagcatgctcaacaggaattaaagaataaacaagctgaagttaagaagatggatagtggctacaggaaggatcaagaagctctagaagctgtaaaaagacttaaagaaaaacttgaagctgaaatgaaaaagctaaattatgaagaaaataaagaggaaagccttttggaaaagcgcaggcagctgtctcgtgatattggtagattgaaagaaacatatgaagctctattagccagatttcccaatcttcgatttgcatacaaggatccagagaagaactggaatagaaattgtgtgaaaggacttgtggcttctctgattagtgtgaaagacacttctgcaaccacagctttagaattagtggctggagaacgactctacaatgttgtagtagacacagaagttactggtaaaaagctactagaaaggggggaactgaaacgtcgatacactataattccactcaataaaatttcagccagatgtattgcaccagaaactctgagagttgctcagaatcttgttggccctgacaacgttcatgtggctctttccttggttgaatataaaccagaacttcagaaagcaatggagtttgtctttggaacaacatttgtttgtgacaatatggataatgccaaaaaagtggcctttgataagaggataatgactagaactgtaactctcggaggtgatgtgtttgatcctcatgggacattgagtggaggtgctcgatcccaggcagcttccattttaaccaagtttcaagaactcaaagatgttcaggatgaactgagaatcaaagagaatgagctgcgggctctagaagaggaattagcaggtcttaaaaacactgctgaaaagtatcgccaactaaaacagcagtgggagatgaaaactgaagaggcagatttattacaaaccaagctccagcaaagctcatatcacaagcaacaagaagaattagatgcccttaaaaaaaccattgaggaaagtgaggagactttgaaaaacactaaagaaatccaaagaaaagcagaagaaaaatatgaagtattggaaaataaaatgaaaaatgcagaagctgaaagagagcgagaactgaaagatgctcagaaaaaactggattgtgccaaaacaaaggcagatgcatctagcaagaagatgaaagaaaaacaacaggaagttgaagctatcactctggaactggaagagctcaagagagagcatacatcttacaaacaacagcttgaagctgtaaatgaagctatcaaatcctatgaaagtcagattgaagtaatggcagctgaggtggctaaaaataaggagtcagtaaataaagctcaagaagaggtgaccaagcaaaaagaggtgataacagcccaagacactgtaattaaagctaaatatgcagaagtggcaaaacacaaggagcaaaacaatgattctcagcttaaaattaaggaattagaccacaacatcagcaaacataaacgggaggctgaagatggtgctgcaaaggtatccaaaatgttgaaagattatgactggattaatgcagagagacacctctttggccaacccaatagtgcctatgatttcaaaactaacaaccctaaagaagctggtcagagacttcagaagttgcaagaaatgaaggagaaactaggaagaaatgtcaatatgagagctatgaatgtattgacagaagctgaagagcgatacaatgacttgatgaagaagaagagaattgtagaaaatgacaaatccaaaattcttacaactatagaagaccttgaccagaagaaaaaccaagccctaaatattgcatggcaaaaggtgaacaaggactttgggtctattttttctactcttttgcctggtgctaatgctatgcttgcaccaccagagggtcaaactgttttggatggtctggagttcaaggttgccttgggaaatacctggaaagaaaacctaactgaacttagtggtggtcagaggtctttagtggccttgtcattaatactgtccatgcttctcttcaaacctgctccaatttatatccttgatgaggtagatgcagccttggatctttctcatacccaaaacattggacagatgctgcgtactcatttcacacattctcagttcattgtggtgtcactaaaagaaggtatgttcaacaatgcaaacgttcttttcaaaaccaagtttgtggatggtgtttctacagtagccagatttactcaatgtcaaaatggaaagatttcaaaggaagcaaaatccaaggcaaaaccacccaaaggagcacatgtggaagtttaaactacaaagttatttcttcatcttgacctgtttttttaaatgtaaacttttaaggacttgagataactaatttgtttatatacaaaaattaatgttactgtgttacttaacccatgttttctctttatataatcacttatcgcttacaaatgagcatatattcctcatctcttaactagtctaattatggtccaattattgtggttgtgattttatgcatatcatcaaatgtttttttcttatgcgggtcttttatatattagggatcctgagatacccgattctatatgtaaaagctaatatacaaaaaagcagattaaattacatgacgaaaaaaaacaaaaaaaaacaaaaaaaaaaacaatttttgggccgcgccttgggccctctcgaaaggtttttaaacaccattcggttggcgccgggggccccagggggtaggggaaccgtggtcaaagagtgtgttcccgagagggaacaccgcgggccacacgaacaagaggcgcggggattttctccacgcatgtgaagataagcggcccgcgggggcacacacgagaagctggttctggaaacaattccgagagaggagaagtctcggagggccacacaacgggggacttaatcacgaggggattcccagggaaactctcattttcaaatttagccccgttgccg

SEQ ID NO: 427399 - DNA, 4447 bp, Homo sapiens
ggcgcgggggctgtagggagggggaccagtggcagagggaccttaggtgatccttagaaataaaggctagcttctgttcgaccttggagtagggcgaagaggtgtagacaggcctggagaagcgaggtaaaagcctgagtaaaagcaagaagttggagaatatgagatacatctcatctctagtaaatacttaaatgacttcccctcctcccggagtcaagcacaattcggggatgcaatgacggacgtaggtgaagacactgcgggaacttacagacaaaactggtttgtggcctgtttgattcctgtcagaggtttgctgacccaagacagtatcgaaaatgcatattaagtcaattattctagagggattcaagtcctatgctcagaggaccgaagtcaatggttttgaccccctcttcaatgctatcactggcttaaatggtagtgggaaatccaacatattggactccatctgctttttgctgggcatctccaacctgtctcaggttcgggcttctaatttacaagatttagtttacaaaaatgggcaggctggtattaccaaagcctctgtgtcaatcacttttgataattctgacaaaaagcaaagtcctttaggatttgaggttcatgatgaaatcacagtaacaaggcaggtggttattggtggtagaaataaatatttaatcaatggagtcaatgccaacaacaccagagtacaggatctcttctgttctgttggccttaatgttaacaaccctcactttctcatcatgcagggccgaattacaaaagtattgaatatgaaacctccagagattttatccatgatagaagaagcagctggaaccaggatgtatgaatacaaaaaaatagctgcacagaaaactatagaaaaaaaggaggctaagctgaaagaaattaagacgatacttgaagaagagattactccaaccattcaaaaattaaaagaggaaagatcgtcctacttggagtaccaaaaagtaatgagagaaatagaacatttgagtcgtttatatattgcttatcagtttttgctggctgaagataccaaagtacgctcagctgaggaattaaaagaaatgcaagataaagttataaagcttcaggaagaattgtctgagaatgataaaaaaataaaagcacttaatcatgaaatagaagaattggaaaaaagaaaagataaggaaactggaggtatacttcgatctttagaagatgctcttgcagaggctcagcgagttaatactaaatctcaaagcgcatttgatctcaagaagaaaaatctggcatgtgaggaaagcaaacgcaaagagctggaaaaaaatatggttgaggactcaaaaactttagcagcaaaggaaaaagaggttaaaaagataacagatggactgcatgcccttcaagaagcaagtaataaagatgctgaagctctggcagctgcacagcagcacttcaatgctgtttccgctggcctgtccagtaatgaagatggagcagaagcaactcttgctggtcaaatgatggcctgtaaaaatgatataagtaaagctcagacagaagccaaacaggctcagatgaagttgaagcatgctcaacaggaattaaagaataaacaagctgaagttaagaagatggatagtggctacaggaaggatcaagaagctctagaagctgtaaaaagacttaaagaaaaacttgaagctgaaatgaaaaagctaaattatgaagaaaataaagaggaaagccttttggaaaagcgcaggcagctgtctcgtgatattggtagattgaaagaaacatatgaagctctattagccagatttcccaatcttcgatttgcatacaaggatccagagaagaactggaatagaaattgtgtgaaaggacttgtggcttctctgattagtgtgaaagacacttctgcaaccacagctttagaattagtggctggagaacgactctacaatgttgtagtagacacagaagttactggtaaaaagctactagaaaggggggaactgaaacgtcgatacactataattccactcaataaaatttcagccagatgtattgcaccagaaactctgagagttgctcagaatcttgttggccctgacaacgttcatgtggctctttccttggttgaatataaaccagaacttcagaaagcaatggagtttgtctttggaacaacatttgtttgtgacaatatggataatgccaaaaaagtggcctttgataagaggataatgactagaactgtaactctcggaggtgatgtgtttgatcctcatgggacattgagtggaggtgctcgatcccaggcagcttccattttaaccaagtttcaagaactcaaagatgttcaggatgaactgagaatcaaagagaatgagctgcgggctctagaagaggaattagcaggtcttaaaaacactgctgaaaagtatcgccaactaaaacagcagtgggagatgaaaactgaagaggcagatttattacaaaccaagctccagcaaagctcatatcacaagcaacaagaagaattagatgcccttaaaaaaaccattgaggaaagtgaggagactttgaaaaacactaaagaaatccaaagaaaagcagaagaaaaatatgaagtattggaaaataaaatgaaaaatgcagaagctgaaagagagcgagaactgaaagatgctcagaaaaaactggattgtgccaaaacaaaggcagatgcatctagcaagaagatgaaagaaaaacaacaggaagttgaagctatcactctggaactggaagagctcaagagagagcatacatcttacaaacaacagcttgaagctgtaaatgaagctatcaaatcctatgaaagtcagattgaagtaatggcagctgaggtggctaaaaataaggagtcagtaaataaagctcaagaagaggtgaccaagcaaaaagaggtgataacagcccaagacactgtaattaaagctaaatatgcagaagtggcaaaacacaaggagcaaaacaatgattctcagcttaaaattaaggaattagaccacaacatcagcaaacataaacgggaggctgaagatggtgctgcaaaggtatccaaaatgttgaaagattatgactggattaatgcagagagacacctctttggccaacccaatagtgcctatgatttcaaaactaacaaccctaaagaagctggtcagagacttcagaagttgcaagaaatgaaggagaaactaggaagaaatgtcaatatgagagctatgaatgtattgacagaagctgaagagcgatacaatgacttgatgaagaagaagagaattgtagaaaatgacaaatccaaaattcttacaactatagaagaccttgaccagaagaaaaaccaagccctaaatattgcatggcaaaaggtgaacaaggactttgggtctattttttctactcttttgcctggtgctaatgctatgcttgcaccaccagagggtcaaactgttttggatggtctggagttcaaggttgccttgggaaatacctggaaagaaaacctaactgaacttagtggtggtcagaggtctttagtggccttgtcattaatactgtccatgcttctcttcaaacctgctccaatttatatccttgatgaggtagatgcagccttggatctttctcatacccaaaacattggacagatgctgcgtactcatttcacacattctcagttcattgtggtgtcactaaaagaaggtatgttcaacaatgcaaacgttcttttcaaaaccaagtttgtggatggtgtttctacagtagccagatttactcaatgtcaaaatggaaagatttcaaaggaagcaaaatccaaggcaaaaccacccaaaggagcacatgtggaagtttaaactacaaagttatttcttcatcttgacctgtttttttaaatgtaaacttttaaggacttgagataactaatttgtttatatacaaaaattaatgttactgtgttacttaacccatgttttctctttatataatcacttatcgcttacaaatgagcatatattcctcatctcttaactagtctaattatggtccaattattgtggttgtgattttatgcatatcatcaaatgtttttttcttatgcgggtcttttatatattagggatcctgagatacccgattctatatgtaaaagctaatatacaaaaaagcagattaaattacatgagtgaaataaacggaagaacaatagcagaaagcaccaagaaagaacaagaaaactctgtgtgtcgtcggcgccggcccgggggccgcttcgaagaagcgcttttttgaaaccacttcggttggggcgcgcggggggcccaggaggggcgacgggcacaggggcacaaggggggcccaaggggac

SEQ ID NO: 427400 - DNA, 6635 bp, Homo sapiens
ggcgccgaaattcaaaggaataaatagttccggcgcgggtgttgagagcggtgtggtaggtgttgtagccgctatggtgaagttcgctttgtagcggccccggctagagagttggcctgttccctgcctttgtgacccggaggagcttttggggtgcgtcaagcccctggcctgaggcagcgaactggtttgtggcctgtttgattcctgtcagaggtttgctgacccaagacagtatcgaaaatgcatattaagtcaattattctagagggattcaagtcctatgctcagaggaccgaagtcaatggttttgaccccctcttcaatgctatcactggcttaaatggtagtgggaaatccaacatattggactccatctgctttttgctgggcatctccaacctgtctcaggttcgggcttctaatttacaagatttagtttacaaaaatgggcaggctggtattaccaaagcctctgtgtcaatcacttttgataattctgacaaaaagcaaagtcctttaggatttgaggttcatgatgaaatcacagtaacaaggcaggtggttattggtggtagaaataaatatttaatcaatggagtcaatgccaacaacaccagagtacaggatctcttctgttctgttggccttaatgttaacaaccctcactttctcatcatgcagggccgaattacaaaagtattgaatatgaaacctccagagattttatccatgatagaagaagcagctggaaccaggatgtatgaatacaaaaaaatagctgcacagaaaactatagaaaaaaaggaggctaagctgaaagaaattaagacgatacttgaagaagagattactccaaccattcaaaaattaaaagaggaaagatcgtcctacttggagtaccaaaaagtaatgagagaaatagaacatttgagtcgtttatatattgcttatcagtttttgctggctgaagataccaaagtacgctcagctgaggaattaaaagaaatgcaagataaagttataaagcttcaggaagaattgtctgagaatgataaaaaaataaaagcacttaatcatgaaatagaagaattggaaaaaagaaaagataaggaaactggaggtatacttcgatctttagaagatgctcttgcagaggctcagcgagttaatactaaatctcaaagcgcatttgatctcaagaagaaaaatctggcatgtgaggaaagcaaacgcaaagagctggaaaaaaatatggttgaggactcaaaaactttagcagcaaaggaaaaagaggttaaaaagataacagatggactgcatgcccttcaagaagcaagtaataaagatgctgaagctctggcagctgcacagcagcacttcaatgctgtttccgctggcctgtccagtaatgaagatggagcagaagcaactcttgctggtcaaatgatggcctgtaaaaatgatataagtaaagctcagacagaagccaaacaggctcagatgaagttgaagcatgctcaacaggaattaaagaataaacaagctgaagttaagaagatggatagtggctacaggaaggatcaagaagctctagaagctgtaaaaagacttaaagaaaaacttgaagctgaaatgaaaaagctaaattatgaagaaaataaagaggaaagccttttggaaaagcgcaggcagctgtctcgtgatattggtagattgaaagaaacatatgaagctctattagccagatttcccaatcttcgatttgcatacaaggatccagagaagaactggaatagaaattgtgtgaaaggacttgtggcttctctgattagtgtgaaagacacttctgcaaccacagctttagaattagtggctggagaacgactctacaatgttgtagtagacacagaagttactggtaaaaagctactagaaaggggggaactgaaacgtcgatacactataattccactcaataaaatttcagccagatgtattgcaccagaaactctgagagttgctcagaatcttgttggccctgacaacgttcatgtggctctttccttggttgaatataaaccagaacttcagaaagcaatggagtttgtctttggaacaacatttgtttgtgacaatatggataatgccaaaaaagtggcctttgataagaggataatgactagaactgtaactctcggaggtgatgtgtttgatcctcatgggacattgagtggaggtgctcgatcccaggcagcttccattttaaccaagtttcaagaactcaaagatgttcaggatgaactgagaatcaaagagaatgagctgcgggctctagaagaggaattagcaggtcttaaaaacactgctgaaaagtatcgccaactaaaacagcagtgggagatgaaaactgaagaggcagatttattacaaaccaagctccagcaaagctcatatcacaagcaacaagaagaattagatgcccttaaaaaaaccattgaggaaagtgaggagactttgaaaaacactaaagaaatccaaagaaaagcagaagaaaaatatgaagtattggaaaataaaatgaaaaatgcagaagctgaaagagagcgagaactgaaagatgctcagaaaaaactggattgtgccaaaacaaaggcagatgcatctagcaagaagatgaaagaaaaacaacaggaagttgaagctatcactctggaactggaagagctcaagagagagcatacatcttacaaacaacagcttgaagctgtaaatgaagctatcaaatcctatgaaagtcagattgaagtaatggcagctgaggtggctaaaaataaggagtcagtaaataaagctcaagaagaggtgaccaagcaaaaagaggtgataacagcccaagacactgtaattaaagctaaatatgcagaagtggcaaaacacaaggagcaaaacaatgattctcagcttaaaattaaggaattagaccacaacatcagcaaacataaacgggaggctgaagatggtgctgcaaaggtatccaaaatgttgaaagattatgactggattaatgcagagagacacctctttggccaacccaatagtgcctatgatttcaaaactaacaaccctaaagaagctggtcagagacttcagaagttgcaagaaatgaaggagaaactaggaagaaatgtcaatatgagagctatgaatgtattgacagaagctgaagagcgatacaatgacttgatgaagaagaagagaattgtagaaaatgacaaatccaaaattcttacaactatagaagaccttgaccagaagaaaaaccaagccctaaatattgcatggcaaaaggtgaacaaggactttgggtctattttttctactcttttgcctggtgctaatgctatgcttgcaccaccagagggtcaaactgttttggatggtctggagttcaaggttgccttgggaaatacctggaaagaaaacctaactgaacttagtggtggtcagagacaaaaacagcagaaccatactacaggttaaaggaagttctcaggcaaaaggaaaatgataccagatggaaccttggatctacataaaggaaagaagagtgttggaaactaacatggatttggagttcagggaagtttctcctgaccttacacagtgattcagaaaatcagcatagtgatagaaacctaaaaggtctttagtggccttgtcattaatactgtccatgcttctcttcaaacctgctccaatttatatccttgatgaggtagatgcagccttggatctttctcatacccaaaacattggacagatgctgcgtactcatttcacacattctcagttcattgtggtgtcactaaaagaaggtatgttcaacaatgcaaacgttcttttcaaaaccaagtttgtggatggtgtttctacagtagccagatttactcaatgtcaaaatggaaagatttcaaaggaagcaaaatccaaggcaaaaccacccaaaggagcacatgtggaagtttaaactacaaagttatttcttcatcttgacctgtttttttaaatgtaaacttttaaggacttgagataactaatttgtttatatacaaaaattaatgttactgtgttacttaacccatgttttctctttatataatcacttatcgcttacaaatgagcatatattcctcatctcttaactagtctaattatggtccaattattgtggttgtgattttatgcatatcatcaaatgtttttttcttatgcgggtcttttatatattagggatcctgagatacccgattctatatgtaaaagctaatatacaaaaaagcagattaaattacatgataaatgtagctgatcatcagtgtttaattgatttaattcctaaggcaatattaatgtgttttctaaagtcattcaggtaaggaagaattataaatcaggtaactggaccaacaaagggaacacatataaagctattatgcatgcatggagccgtttgaggctagttttttaaggccacaactccagacccctgatttagactgagataggaaacagatcttgaaagaatccttattttaatgatacatgaatatcatgttcctatacgcttaataattggtctctacgttttaatgatacatgaatatcatgttcctatacgcttaataattggtctctacgactttaatgtttttgtttttttaagctgtgtaagtatttttaaatcaaagcttaggaggtgtgttgcgtggtactatctgctgcaaatttatctgaagtttgttaatattttccaagatttttgtcagccttttcataatccagtcattaacaacctattggtaaacaagaatgtaggtgccagtagactaaaccaaatttatttttccctgagtctgatatatatatgtataaatataaataactcaatccatctgttccaccaaaataactcaaaagttggatgattatttgtcttccgctttccagttcaaagggatgaaattcctttagaacttgaaagatgacactagcgaacaccatgagaatactgtctacagtttttggtacgtcatcactagaacagtgaccccaaactgaatcatgaaaggtctgacatgatgtaatctgatcttccatgtgttattttggccccacatctcttcttgattttttagtcttatttccttagtgttattatcatacttcccctgatatatggccgtacttcctggccctgggcttgacatttcccacccttcattctccatacatatgagatgtcagaaaacatgcagtaattgatattatgggacacattggaaaggattgaatctggaattagttctgtccactgtggaggggagaggaaataatgctgtaaatgttgagttacagaaagtccaatgtcaaatatagtttttttgtttcctttcaaatgtattacagactgtgccaaaacagttaccaattcacactgtcaatattaaagtataccatagtatacaaattagtcagtacttgctgttaattttaatatttctgatttaacagttagttattaagtggtacttcattgctgttttagccaacgttttaaaaataatttgggagtttgactattttggcttacgtactcatttccttttctctgctaaaaatgttttgcttgtgtgcgttcctgatttttgtcttgtataatcttgatctttgaaaaccctcaaacatgtattaaattgttgtaactttttttcattagagggaagacattaaggggattggggacatttgtttcacacatctgcagtaatatgagttaactaatatttaacaagctctttctttacattagctgctgttctcatttgtatgtattgtcatatttaatcctcagagtaacctagtgaggtaaatactgttgttgtcagcatggtgtaatcgaggaattgagtgagttgagcagaaaagttaggaaacttgctcagggtgataatacagttaggagtgtcagggcccatggacaaatcttgtcagtctccagaacctaagatatactacgtcactgacagcttgaacatttgtatttattgtacagaataaatttaagaaaaatacctgtatgagcagtatgtacaacgtgaatgttaccttaaagaagaacctcaaccatgtgaagagaggattcattgtggtggtggcggttttggcatttcaagtaagctcacagcaaatgcaaagcaaagacatgaaattttctcttccaatagggtggcataatctaaaggccaacattcccacagatgataaatatagattctgagcaaaatactagaaacaactacctgagagttcaggaaactgaagaaaaactagaaagattttggatgggagataaaatacggaggaagagacaggcacaagctaaggttaatgtttttaacctaagtaccagctatagtcatgatgcagctgtaggacagctaaggctgcagtggaaagcctggggtctttctggtctggagaactaaaagatgggatctgggctaaccacagcttccagaaagtgaaggagacgtctcagaagggataaacgaggacctggagaaagaggtccc

SEQ ID NO: 427401 - DNA, 6413 bp, Homo sapiens
ggcgccgaaattcaaaggaataaatagttccggcgcgggtgttgagagcggtgtggtaggtgttgtagccgctatggtgaagttcgctttgtagcggccccggctagagagttggcctgttccctgcctttgtgacccggaggagcttttgggaactggtttgtggcctgtttgattcctgtcagaggtttgctgacccaagacagtatcgaaaatgcatattaagtcaattattctagagggattcaagtcctatgctcagaggaccgaagtcaatggttttgaccccctcttcaatgctatcactggcttaaatggtagtgggaaatccaacatattggactccatctgctttttgctgggcatctccaacctgtctcaggttcgggcttctaatttacaagatttagtttacaaaaatgggcaggctggtattaccaaagcctctgtgtcaatcacttttgataattctgacaaaaagcaaagtcctttaggatttgaggttcatgatgaaatcacagtaacaaggcaggtggttattggtggtagaaataaatatttaatcaatggagtcaatgccaacaacaccagagtacaggatctcttctgttctgttggccttaatgttaacaaccctcactttctcatcatgcagggccgaattacaaaagtattgaatatgaaacctccagagattttatccatgatagaagaagcagctggaaccaggatgtatgaatacaaaaaaatagctgcacagaaaactatagaaaaaaaggaggctaagctgaaagaaattaagacgatacttgaagaagagattactccaaccattcaaaaattaaaagaggaaagatcgtcctacttggagtaccaaaaagtaatgagagaaatagaacatttgagtcgtttatatattgcttatcagtttttgctggctgaagataccaaagtacgctcagctgaggaattaaaagaaatgcaagataaagttataaagcttcaggaagaattgtctgagaatgataaaaaaataaaagcacttaatcatgaaatagaagaattggaaaaaagaaaagataaggaaactggaggtatacttcgatctttagaagatgctcttgcagaggctcagcgagttaatactaaatctcaaagcgcatttgatctcaagaagaaaaatctggcatgtgaggaaagcaaacgcaaagagctggaaaaaaatatggttgaggactcaaaaactttagcagcaaaggaaaaagaggttaaaaagataacagatggactgcatgcccttcaagaagcaagtaataaagatgctgaagctctggcagctgcacagcagcacttcaatgctgtttccgctggcctgtccagtaatgaagatggagcagaagcaactcttgctggtcaaatgatggcctgtaaaaatgatataagtaaagctcagacagaagccaaacaggctcagatgaagttgaagcatgctcaacaggaattaaagaataaacaagctgaagttaagaagatggatagtggctacaggaaggatcaagaagctctagaagctgtaaaaagacttaaagaaaaacttgaagctgaaatgaaaaagctaaattatgaagaaaataaagaggaaagccttttggaaaagcgcaggcagctgtctcgtgatattggtagattgaaagaaacatatgaagctctattagccagatttcccaatcttcgatttgcatacaaggatccagagaagaactggaatagaaattgtgtgaaaggacttgtggcttctctgattagtgtgaaagacacttctgcaaccacagctttagaattagtggctggagaacgactctacaatgttgtagtagacacagaagttactggtaaaaagctactagaaaggggggaactgaaacgtcgatacactataattccactcaataaaatttcagccagatgtattgcaccagaaactctgagagttgctcagaatcttgttggccctgacaacgttcatgtggctctttccttggttgaatataaaccagaacttcagaaagcaatggagtttgtctttggaacaacatttgtttgtgacaatatggataatgccaaaaaagtggcctttgataagaggataatgactagaactgtaactctcggaggtgatgtgtttgatcctcatgggacattgagtggaggtgctcgatcccaggcagcttccattttaaccaagtttcaagaactcaaagatgttcaggatgaactgagaatcaaagagaatgagctgcgggctctagaagaggaattagcaggtcttaaaaacactgctgaaaagtatcgccaactaaaacagcagtgggagatgaaaactgaagaggcagatttattacaaaccaagctccagcaaagctcatatcacaagcaacaagaagaattagatgcccttaaaaaaaccattgaggaaagtgaggagactttgaaaaacactaaagaaatccaaagaaaagcagaagaaaaatatgaagtattggaaaataaaatgaaaaatgcagaagctgaaagagagcgagaactgaaagatgctcagaaaaaactggattgtgccaaaacaaaggcagatgcatctagcaagaagatgaaagaaaaacaacaggaagttgaagctatcactctggaactggaagagctcaagagagagcatacatcttacaaacaacagcttgaagctgtaaatgaagctatcaaatcctatgaaagtcagattgaagtaatggcagctgaggtggctaaaaataaggagtcagtaaataaagctcaagaagaggtgaccaagcaaaaagaggtgataacagcccaagacactgtaattaaagctaaatatgcagaagtggcaaaacacaaggagcaaaacaatgattctcagcttaaaattaaggaattagaccacaacatcagcaaacataaacgggaggctgaagatggtgctgcaaaggtatccaaaatgttgaaagattatgactggattaatgcagagagacacctctttggccaacccaatagtgcctatgatttcaaaactaacaaccctaaagaagctggtcagagacttcagaagttgcaagaaatgaaggagaaactaggaagaaatgtcaatatgagagctatgaatgtattgacagaagctgaagagcgatacaatgacttgatgaagaagaagagaattgtagaaaatgacaaatccaaaattcttacaactatagaagaccttgaccagaagaaaaaccaagccctaaatattgcatggcaaaaggtgaacaaggactttgggtctattttttctactcttttgcctggtgctaatgctatgcttgcaccaccagagggtcaaactgttttggatggtctggagttcaaggttgccttgggaaatacctggaaagaaaacctaactgaacttagtggtggtcagaggtctttagtggccttgtcattaatactgtccatgcttctcttcaaacctgctccaatttatatccttgatgaggtagatgcagccttggatctttctcatacccaaaacattggacagatgctgcgtactcatttcacacattctcagttcattgtggtgtcactaaaagaaggtatgttcaacaatgcaaacgttcttttcaaaaccaagtttgtggatggtgtttctacagtagccagatttactcaatgtcaaaatggaaagatttcaaaggaagcaaaatccaaggcaaaaccacccaaaggagcacatgtggaagtttaaactacaaagttatttcttcatcttgacctgtttttttaaatgtaaacttttaaggacttgagataactaatttgtttatatacaaaaattaatgttactgtgttacttaacccatgttttctctttatataatcacttatcgcttacaaatgagcatatattcctcatctcttaactagtctaattatggtccaattattgtggttgtgattttatgcatatcatcaaatgtttttttcttatgcgggtcttttatatattagggatcctgagatacccgattctatatgtaaaagctaatatacaaaaaagcagattaaattacatgataaatgtagctgatcatcagtgtttaattgatttaattcctaaggcaatattaatgtgttttctaaagtcattcaggtaaggaagaattataaatcaggtaactggaccaacaaagggaacacatataaagctattatgcatgcatggagccgtttgaggctagttttttaaggccacaactccagacccctgatttagactgagataggaaacagatcttgaaagaatccttattttaatgatacatgaatatcatgttcctatacgcttaataattggtctctacgttttaatgatacatgaatatcatgttcctatacgcttaataattggtctctacgactttaatgtttttgtttttttaagctgtgtaagtatttttaaatcaaagcttaggaggtgtgttgcgtggtactatctgctgcaaatttatctgaagtttgttaatattttccaagatttttgtcagccttttcataatccagtcattaacaacctattggtaaacaagaatgtaggtgccagtagactaaaccaaatttatttttccctgagtctgatatatatatgtataaatataaataactcaatccatctgttccaccaaaataactcaaaagttggatgattatttgtcttccgctttccagttcaaagggatgaaattcctttagaacttgaaagatgacactagcgaacaccatgagaatactgtctacagtttttggtacgtcatcactagaacagtgaccccaaactgaatcatgaaaggtctgacatgatgtaatctgatcttccatgtgttattttggccccacatctcttcttgattttttagtcttatttccttagtgttattatcatacttcccctgatatatggccgtacttcctggccctgggcttgacatttcccacccttcattctccatacatatgagatgtcagaaaacatgcagtaattgatattatgggacacattggaaaggattgaatctggaattagttctgtccactgtggaggggagaggaaataatgctgtaaatgttgagttacagaaagtccaatgtcaaatatagtttttttgtttcctttcaaatgtattacagactgtgccaaaacagttaccaattcacactgtcaatattaaagtataccatagtatacaaattagtcagtacttgctgttaattttaatatttctgatttaacagttagttattaagtggtacttcattgctgttttagccaacgttttaaaaataatttgggagtttgactattttggcttacgtactcatttccttttctctgctaaaaatgttttgcttgtgtgcgttcctgatttttgtcttgtataatcttgatctttgaaaaccctcaaacatgtattaaattgttgtaactttttttcattagagggaagacattaaggggattggggacatttgtttcacacatctgcagtaatatgagttaactaatatttaacaagctctttctttacattagctgctgttctcatttgtatgtattgtcatatttaatcctcagagtaacctagtgaggtaaatactgttgttgtcagcatggtgtaatcgaggaattgagtgagttgagcagaaaagttaggaaacttgctcagggtgataatacagttaggagtgtcagggcccatggacaaatcttgtcagtctccagaacctaagatatactacgtcactgacagcttgaacatttgtatttattgtacagaataaatttaagaaaaatacctgtatgagcagtatgtacaacgtgaatgttaccttaaagaagaacctcaaccatgtgaagagaggattcattgtggtggtggcggttttggcatttcaagtaagctcacagcaaatgcaaagcaaagacatgaaattttctcttccaatagggtggcataatctaaaggccaacattcccacagatgataaatatagattctgagcaaaatactagaaacaactacctgagagttcaggaaactgaagaaaaactagaaagattttggatgggagataaaatacggaggaagagacaggcacaagctaaggttaatgtttttaacctaagtaccagctatagtcatgatgcagctgtaggacagctaaggctgcagtggaaagcctggggtctttctggtctggagaactaaaagatgggatctgggctaaccacagcttccagaaagtgaaggagacgtctcagaagggataaacgaggacctggagaaagaggtccc

SEQ ID NO: 427402 - DNA, 6507 bp, Homo sapiens
ggcgcgggggctgtagggagggggaccagtggcagagggaccttaggtgatccttagaaataaaggctagcttctgttcgaccttggagtagggcgaagaggtgtagacaggcctggagaagcgaggtaaaagcctgagtaaaagcaagaagttggagaatatgagatacatctcatctctagtaaatacttaaatgacttcccctcctcccggagtcaagcacaattcggggatgcaatgacggacaactggtttgtggcctgtttgattcctgtcagaggtttgctgacccaagacagtatcgaaaatgcatattaagtcaattattctagagggattcaagtcctatgctcagaggaccgaagtcaatggttttgaccccctcttcaatgctatcactggcttaaatggtagtgggaaatccaacatattggactccatctgctttttgctgggcatctccaacctgtctcaggttcgggcttctaatttacaagatttagtttacaaaaatgggcaggctggtattaccaaagcctctgtgtcaatcacttttgataattctgacaaaaagcaaagtcctttaggatttgaggttcatgatgaaatcacagtaacaaggcaggtggttattggtggtagaaataaatatttaatcaatggagtcaatgccaacaacaccagagtacaggatctcttctgttctgttggccttaatgttaacaaccctcactttctcatcatgcagggccgaattacaaaagtattgaatatgaaacctccagagattttatccatgatagaagaagcagctggaaccaggatgtatgaatacaaaaaaatagctgcacagaaaactatagaaaaaaaggaggctaagctgaaagaaattaagacgatacttgaagaagagattactccaaccattcaaaaattaaaagaggaaagatcgtcctacttggagtaccaaaaagtaatgagagaaatagaacatttgagtcgtttatatattgcttatcagtttttgctggctgaagataccaaagtacgctcagctgaggaattaaaagaaatgcaagataaagttataaagcttcaggaagaattgtctgagaatgataaaaaaataaaagcacttaatcatgaaatagaagaattggaaaaaagaaaagataaggaaactggaggtatacttcgatctttagaagatgctcttgcagaggctcagcgagttaatactaaatctcaaagcgcatttgatctcaagaagaaaaatctggcatgtgaggaaagcaaacgcaaagagctggaaaaaaatatggttgaggactcaaaaactttagcagcaaaggaaaaagaggttaaaaagataacagatggactgcatgcccttcaagaagcaagtaataaagatgctgaagctctggcagctgcacagcagcacttcaatgctgtttccgctggcctgtccagtaatgaagatggagcagaagcaactcttgctggtcaaatgatggcctgtaaaaatgatataagtaaagctcagacagaagccaaacaggctcagatgaagttgaagcatgctcaacaggaattaaagaataaacaagctgaagttaagaagatggatagtggctacaggaaggatcaagaagctctagaagctgtaaaaagacttaaagaaaaacttgaagctgaaatgaaaaagctaaattatgaagaaaataaagaggaaagccttttggaaaagcgcaggcagctgtctcgtgatattggtagattgaaagaaacatatgaagctctattagccagatttcccaatcttcgatttgcatacaaggatccagagaagaactggaatagaaattgtgtgaaaggacttgtggcttctctgattagtgtgaaagacacttctgcaaccacagctttagaattagtggctggagaacgactctacaatgttgtagtagacacagaagttactggtaaaaagctactagaaaggggggaactgaaacgtcgatacactataattccactcaataaaatttcagccagatgtattgcaccagaaactctgagagttgctcagaatcttgttggccctgacaacgttcatgtggctctttccttggttgaatataaaccagaacttcagaaagcaatggagtttgtctttggaacaacatttgtttgtgacaatatggataatgccaaaaaagtggcctttgataagaggataatgactagaactgtaactctcggaggtgatgtgtttgatcctcatgggacattgagtggaggtgctcgatcccaggcagcttccattttaaccaagtttcaagaactcaaagatgttcaggatgaactgagaatcaaagagaatgagctgcgggctctagaagaggaattagcaggtcttaaaaacactgctgaaaagtatcgccaactaaaacagcagtgggagatgaaaactgaagaggcagatttattacaaaccaagctccagcaaagctcatatcacaagcaacaagaagaattagatgcccttaaaaaaaccattgaggaaagtgaggagactttgaaaaacactaaagaaatccaaagaaaagcagaagaaaaatatgaagtattggaaaataaaatgaaaaatgcagaagctgaaagagagcgagaactgaaagatgctcagaaaaaactggattgtgccaaaacaaaggcagatgcatctagcaagaagatgaaagaaaaacaacaggaagttgaagctatcactctggaactggaagagctcaagagagagcatacatcttacaaacaacagcttgaagctgtaaatgaagctatcaaatcctatgaaagtcagattgaagtaatggcagctgaggtggctaaaaataaggagtcagtaaataaagctcaagaagaggtgaccaagcaaaaagaggtgataacagcccaagacactgtaattaaagctaaatatgcagaagtggcaaaacacaaggagcaaaacaatgattctcagcttaaaattaaggaattagaccacaacatcagcaaacataaacgggaggctgaagatggtgctgcaaaggtatccaaaatgttgaaagattatgactggattaatgcagagagacacctctttggccaacccaatagtgcctatgatttcaaaactaacaaccctaaagaagctggtcagagacttcagaagttgcaagaaatgaaggagaaactaggaagaaatgtcaatatgagagctatgaatgtattgacagaagctgaagagcgatacaatgacttgatgaagaagaagagaattgtagaaaatgacaaatccaaaattcttacaactatagaagaccttgaccagaagaaaaaccaagccctaaatattgcatggcaaaaggtgaacaaggactttgggtctattttttctactcttttgcctggtgctaatgctatgcttgcaccaccagagggtcaaactgttttggatggtctggagttcaaggttgccttgggaaatacctggaaagaaaacctaactgaacttagtggtggtcagaggtctttagtggccttgtcattaatactgtccatgcttctcttcaaacctgctccaatttatatccttgatgaggtagatgcagccttggatctttctcatacccaaaacattggacagatgctgcgtactcatttcacacattctcagttcattgtggtgtcactaaaagaaggtatgttcaacaatgcaaacgttcttttcaaaaccaagtttgtggatggtgtttctacagtagccagatttactcaatgtcaaaatggaaagatttcaaaggaagcaaaatccaaggcaaaaccacccaaaggagcacatgtggaagtttaaactacaaagttatttcttcatcttgacctgtttttttaaatgtaaacttttaaggacttgagataactaatttgtttatatacaaaaattaatgttactgtgttacttaacccatgttttctctttatataatcacttatcgcttacaaatgagcatatattcctcatctcttaactagtctaattatggtccaattattgtggttgtgattttatgcatatcatcaaatgtttttttcttatgcgggtcttttatatattagggatcctgagatacccgattctatatgtaaaagctaatatacaaaaaagcagattaaattacatgataaatgtagctgatcatcagtgtttaattgatttaattcctaaggcaatattaatgtgttttctaaagtcattcaggtaaggaagaattataaatcaggtaactggaccaacaaagggaacacatataaagctattatgcatgcatggagccgtttgaggctagttttttaaggccacaactccagacccctgatttagactgagataggaaacagatcttgaaagaatccttattttaatgatacatgaatatcatgttcctatacgcttaataattggtctctacgttttaatgatacatgaatatcatgttcctatacgcttaataattggtctctacgactttaatgtttttgtttttttaagctgtgtaagtatttttaaatcaaagcttaggaggtgtgttgcgtggtactatctgctgcaaatttatctgaagtttgttaatattttccaagatttttgtcagccttttcataatccagtcattaacaacctattggtaaacaagaatgtaggtgccagtagactaaaccaaatttatttttccctgagtctgatatatatatgtataaatataaataactcaatccatctgttccaccaaaataactcaaaagttggatgattatttgtcttccgctttccagttcaaagggatgaaattcctttagaacttgaaagatgacactagcgaacaccatgagaatactgtctacagtttttggtacgtcatcactagaacagtgaccccaaactgaatcatgaaaggtctgacatgatgtaatctgatcttccatgtgttattttggccccacatctcttcttgattttttagtcttatttccttagtgttattatcatacttcccctgatatatggccgtacttcctggccctgggcttgacatttcccacccttcattctccatacatatgagatgtcagaaaacatgcagtaattgatattatgggacacattggaaaggattgaatctggaattagttctgtccactgtggaggggagaggaaataatgctgtaaatgttgagttacagaaagtccaatgtcaaatatagtttttttgtttcctttcaaatgtattacagactgtgccaaaacagttaccaattcacactgtcaatattaaagtataccatagtatacaaattagtcagtacttgctgttaattttaatatttctgatttaacagttagttattaagtggtacttcattgctgttttagccaacgttttaaaaataatttgggagtttgactattttggcttacgtactcatttccttttctctgctaaaaatgttttgcttgtgtgcgttcctgatttttgtcttgtataatcttgatctttgaaaaccctcaaacatgtattaaattgttgtaactttttttcattagagggaagacattaaggggattggggacatttgtttcacacatctgcagtaatatgagttaactaatatttaacaagctctttctttacattagctgctgttctcatttgtatgtattgtcatatttaatcctcagagtaacctagtgaggtaaatactgttgttgtcagcatggtgtaatcgaggaattgagtgagttgagcagaaaagttaggaaacttgctcagggtgataatacagttaggagtgtcagggcccatggacaaatcttgtcagtctccagaacctaagatatactacgtcactgacagcttgaacatttgtatttattgtacagaataaatttaagaaaaatacctgtatgagcagtatgtacaacgtgaatgttaccttaaagaagaacctcaaccatgtgaagagaggattcattgtggtggtggcggttttggcatttcaagtaagctcacagcaaatgcaaagcaaagacatgaaattttctcttccaatagggtggcataatctaaaggccaacattcccacagatgataaatatagattctgagcaaaatactagaaacaactacctgagagttcaggaaactgaagaaaaactagaaagattttggatgggagataaaatacggaggaagagacaggcacaagctaaggttaatgtttttaacctaagtaccagctatagtcatgatgcagctgtaggacagctaaggctgcagtggaaagcctggggtctttctggtctggagaactaaaagatgggatctgggctaaccacagcttccagaaagtgaaggagacgtctcagaagggataaacgaggacctggagaaagaggtccc

SEQ ID NO: 427403 - DNA, 6481 bp, Homo sapiens
ggcgccgaaattcaaaggaataaatagttccggcgcgggtgttgagagcggtgtggtaggtgttgtagccgctatggtgaagttcgctttgtagcggccccggctagagagttggcctgttccctgcctttgtgacccggaggagcttttggggtgcgtcaagcccctggcctgaggcagcgtacattccacttaggtggtggtatttctgtttcgtacagaactggtttgtggcctgtttgattcctgtcagaggtttgctgacccaagacagtatcgaaaatgcatattaagtcaattattctagagggattcaagtcctatgctcagaggaccgaagtcaatggttttgaccccctcttcaatgctatcactggcttaaatggtagtgggaaatccaacatattggactccatctgctttttgctgggcatctccaacctgtctcaggttcgggcttctaatttacaagatttagtttacaaaaatgggcaggctggtattaccaaagcctctgtgtcaatcacttttgataattctgacaaaaagcaaagtcctttaggatttgaggttcatgatgaaatcacagtaacaaggcaggtggttattggtggtagaaataaatatttaatcaatggagtcaatgccaacaacaccagagtacaggatctcttctgttctgttggccttaatgttaacaaccctcactttctcatcatgcagggccgaattacaaaagtattgaatatgaaacctccagagattttatccatgatagaagaagcagctggaaccaggatgtatgaatacaaaaaaatagctgcacagaaaactatagaaaaaaaggaggctaagctgaaagaaattaagacgatacttgaagaagagattactccaaccattcaaaaattaaaagaggaaagatcgtcctacttggagtaccaaaaagtaatgagagaaatagaacatttgagtcgtttatatattgcttatcagtttttgctggctgaagataccaaagtacgctcagctgaggaattaaaagaaatgcaagataaagttataaagcttcaggaagaattgtctgagaatgataaaaaaataaaagcacttaatcatgaaatagaagaattggaaaaaagaaaagataaggaaactggaggtatacttcgatctttagaagatgctcttgcagaggctcagcgagttaatactaaatctcaaagcgcatttgatctcaagaagaaaaatctggcatgtgaggaaagcaaacgcaaagagctggaaaaaaatatggttgaggactcaaaaactttagcagcaaaggaaaaagaggttaaaaagataacagatggactgcatgcccttcaagaagcaagtaataaagatgctgaagctctggcagctgcacagcagcacttcaatgctgtttccgctggcctgtccagtaatgaagatggagcagaagcaactcttgctggtcaaatgatggcctgtaaaaatgatataagtaaagctcagacagaagccaaacaggctcagatgaagttgaagcatgctcaacaggaattaaagaataaacaagctgaagttaagaagatggatagtggctacaggaaggatcaagaagctctagaagctgtaaaaagacttaaagaaaaacttgaagctgaaatgaaaaagctaaattatgaagaaaataaagaggaaagccttttggaaaagcgcaggcagctgtctcgtgatattggtagattgaaagaaacatatgaagctctattagccagatttcccaatcttcgatttgcatacaaggatccagagaagaactggaatagaaattgtgtgaaaggacttgtggcttctctgattagtgtgaaagacacttctgcaaccacagctttagaattagtggctggagaacgactctacaatgttgtagtagacacagaagttactggtaaaaagctactagaaaggggggaactgaaacgtcgatacactataattccactcaataaaatttcagccagatgtattgcaccagaaactctgagagttgctcagaatcttgttggccctgacaacgttcatgtggctctttccttggttgaatataaaccagaacttcagaaagcaatggagtttgtctttggaacaacatttgtttgtgacaatatggataatgccaaaaaagtggcctttgataagaggataatgactagaactgtaactctcggaggtgatgtgtttgatcctcatgggacattgagtggaggtgctcgatcccaggcagcttccattttaaccaagtttcaagaactcaaagatgttcaggatgaactgagaatcaaagagaatgagctgcgggctctagaagaggaattagcaggtcttaaaaacactgctgaaaagtatcgccaactaaaacagcagtgggagatgaaaactgaagaggcagatttattacaaaccaagctccagcaaagctcatatcacaagcaacaagaagaattagatgcccttaaaaaaaccattgaggaaagtgaggagactttgaaaaacactaaagaaatccaaagaaaagcagaagaaaaatatgaagtattggaaaataaaatgaaaaatgcagaagctgaaagagagcgagaactgaaagatgctcagaaaaaactggattgtgccaaaacaaaggcagatgcatctagcaagaagatgaaagaaaaacaacaggaagttgaagctatcactctggaactggaagagctcaagagagagcatacatcttacaaacaacagcttgaagctgtaaatgaagctatcaaatcctatgaaagtcagattgaagtaatggcagctgaggtggctaaaaataaggagtcagtaaataaagctcaagaagaggtgaccaagcaaaaagaggtgataacagcccaagacactgtaattaaagctaaatatgcagaagtggcaaaacacaaggagcaaaacaatgattctcagcttaaaattaaggaattagaccacaacatcagcaaacataaacgggaggctgaagatggtgctgcaaaggtatccaaaatgttgaaagattatgactggattaatgcagagagacacctctttggccaacccaatagtgcctatgatttcaaaactaacaaccctaaagaagctggtcagagacttcagaagttgcaagaaatgaaggagaaactaggaagaaatgtcaatatgagagctatgaatgtattgacagaagctgaagagcgatacaatgacttgatgaagaagaagagaattgtagaaaatgacaaatccaaaattcttacaactatagaagaccttgaccagaagaaaaaccaagccctaaatattgcatggcaaaaggtgaacaaggactttgggtctattttttctactcttttgcctggtgctaatgctatgcttgcaccaccagagggtcaaactgttttggatggtctggagttcaaggttgccttgggaaatacctggaaagaaaacctaactgaacttagtggtggtcagaggtctttagtggccttgtcattaatactgtccatgcttctcttcaaacctgctccaatttatatccttgatgaggtagatgcagccttggatctttctcatacccaaaacattggacagatgctgcgtactcatttcacacattctcagttcattgtggtgtcactaaaagaaggtatgttcaacaatgcaaacgttcttttcaaaaccaagtttgtggatggtgtttctacagtagccagatttactcaatgtcaaaatggaaagatttcaaaggaagcaaaatccaaggcaaaaccacccaaaggagcacatgtggaagtttaaactacaaagttatttcttcatcttgacctgtttttttaaatgtaaacttttaaggacttgagataactaatttgtttatatacaaaaattaatgttactgtgttacttaacccatgttttctctttatataatcacttatcgcttacaaatgagcatatattcctcatctcttaactagtctaattatggtccaattattgtggttgtgattttatgcatatcatcaaatgtttttttcttatgcgggtcttttatatattagggatcctgagatacccgattctatatgtaaaagctaatatacaaaaaagcagattaaattacatgataaatgtagctgatcatcagtgtttaattgatttaattcctaaggcaatattaatgtgttttctaaagtcattcaggtaaggaagaattataaatcaggtaactggaccaacaaagggaacacatataaagctattatgcatgcatggagccgtttgaggctagttttttaaggccacaactccagacccctgatttagactgagataggaaacagatcttgaaagaatccttattttaatgatacatgaatatcatgttcctatacgcttaataattggtctctacgttttaatgatacatgaatatcatgttcctatacgcttaataattggtctctacgactttaatgtttttgtttttttaagctgtgtaagtatttttaaatcaaagcttaggaggtgtgttgcgtggtactatctgctgcaaatttatctgaagtttgttaatattttccaagatttttgtcagccttttcataatccagtcattaacaacctattggtaaacaagaatgtaggtgccagtagactaaaccaaatttatttttccctgagtctgatatatatatgtataaatataaataactcaatccatctgttccaccaaaataactcaaaagttggatgattatttgtcttccgctttccagttcaaagggatgaaattcctttagaacttgaaagatgacactagcgaacaccatgagaatactgtctacagtttttggtacgtcatcactagaacagtgaccccaaactgaatcatgaaaggtctgacatgatgtaatctgatcttccatgtgttattttggccccacatctcttcttgattttttagtcttatttccttagtgttattatcatacttcccctgatatatggccgtacttcctggccctgggcttgacatttcccacccttcattctccatacatatgagatgtcagaaaacatgcagtaattgatattatgggacacattggaaaggattgaatctggaattagttctgtccactgtggaggggagaggaaataatgctgtaaatgttgagttacagaaagtccaatgtcaaatatagtttttttgtttcctttcaaatgtattacagactgtgccaaaacagttaccaattcacactgtcaatattaaagtataccatagtatacaaattagtcagtacttgctgttaattttaatatttctgatttaacagttagttattaagtggtacttcattgctgttttagccaacgttttaaaaataatttgggagtttgactattttggcttacgtactcatttccttttctctgctaaaaatgttttgcttgtgtgcgttcctgatttttgtcttgtataatcttgatctttgaaaaccctcaaacatgtattaaattgttgtaactttttttcattagagggaagacattaaggggattggggacatttgtttcacacatctgcagtaatatgagttaactaatatttaacaagctctttctttacattagctgctgttctcatttgtatgtattgtcatatttaatcctcagagtaacctagtgaggtaaatactgttgttgtcagcatggtgtaatcgaggaattgagtgagttgagcagaaaagttaggaaacttgctcagggtgataatacagttaggagtgtcagggcccatggacaaatcttgtcagtctccagaacctaagatatactacgtcactgacagcttgaacatttgtatttattgtacagaataaatttaagaaaaatacctgtatgagcagtatgtacaacgtgaatgttaccttaaagaagaacctcaaccatgtgaagagaggattcattgtggtggtggcggttttggcatttcaagtaagctcacagcaaatgcaaagcaaagacatgaaattttctcttccaatagggtggcataatctaaaggccaacattcccacagatgataaatatagattctgagcaaaatactagaaacaactacctgagagttcaggaaactgaagaaaaactagaaagattttggatgggagataaaatacggaggaagagacaggcacaagctaaggttaatgtttttaacctaagtaccagctatagtcatgatgcagctgtaggacagctaaggctgcagtggaaagcctggggtctttctggtctggagaactaaaagatgggatctgggctaaccacagcttccagaaagtgaaggagacgtctcagaagggataaacgaggacctggagaaagaggtccc

SEQ ID NO: 427404 - DNA, 6292 bp, Homo sapiens
ggcgccgaaattcaaaggaataaatagttccggcgcgggtgttgagagcggtgtggtaggtgttgtagccgctatggtgaagttcgctttgtagcggccccggctagagagttggcctgttccctgcctttgtgacccggaggagcttttggggtgcgtcaagcccctggcctgaggcagcgaactggtttgtggcctgtttgattcctgtcagaggtttgctgacccaagacagtatcgaaaatgcatattaagtcaattattctagagggattcaagtcctatgctcagaggaccgaagtcaatggttttgaccccctcttcaatgctatcactggcttaaatggtagtgggaaatccaacatattggactccatctgctttttgctgggcatctccaacctgtctcaggtggttattggtggtagaaataaatatttaatcaatggagtcaatgccaacaacaccagagtacaggatctcttctgttctgttggccttaatgttaacaaccctcactttctcatcatgcagggccgaattacaaaagtattgaatatgaaacctccagagattttatccatgatagaagaagcagctggaaccaggatgtatgaatacaaaaaaatagctgcacagaaaactatagaaaaaaaggaggctaagctgaaagaaattaagacgatacttgaagaagagattactccaaccattcaaaaattaaaagaggaaagatcgtcctacttggagtaccaaaaagtaatgagagaaatagaacatttgagtcgtttatatattgcttatcagtttttgctggctgaagataccaaagtacgctcagctgaggaattaaaagaaatgcaagataaagttataaagcttcaggaagaattgtctgagaatgataaaaaaataaaagcacttaatcatgaaatagaagaattggaaaaaagaaaagataaggaaactggaggtatacttcgatctttagaagatgctcttgcagaggctcagcgagttaatactaaatctcaaagcgcatttgatctcaagaagaaaaatctggcatgtgaggaaagcaaacgcaaagagctggaaaaaaatatggttgaggactcaaaaactttagcagcaaaggaaaaagaggttaaaaagataacagatggactgcatgcccttcaagaagcaagtaataaagatgctgaagctctggcagctgcacagcagcacttcaatgctgtttccgctggcctgtccagtaatgaagatggagcagaagcaactcttgctggtcaaatgatggcctgtaaaaatgatataagtaaagctcagacagaagccaaacaggctcagatgaagttgaagcatgctcaacaggaattaaagaataaacaagctgaagttaagaagatggatagtggctacaggaaggatcaagaagctctagaagctgtaaaaagacttaaagaaaaacttgaagctgaaatgaaaaagctaaattatgaagaaaataaagaggaaagccttttggaaaagcgcaggcagctgtctcgtgatattggtagattgaaagaaacatatgaagctctattagccagatttcccaatcttcgatttgcatacaaggatccagagaagaactggaatagaaattgtgtgaaaggacttgtggcttctctgattagtgtgaaagacacttctgcaaccacagctttagaattagtggctggagaacgactctacaatgttgtagtagacacagaagttactggtaaaaagctactagaaaggggggaactgaaacgtcgatacactataattccactcaataaaatttcagccagatgtattgcaccagaaactctgagagttgctcagaatcttgttggccctgacaacgttcatgtggctctttccttggttgaatataaaccagaacttcagaaagcaatggagtttgtctttggaacaacatttgtttgtgacaatatggataatgccaaaaaagtggcctttgataagaggataatgactagaactgtaactctcggaggtgatgtgtttgatcctcatgggacattgagtggaggtgctcgatcccaggcagcttccattttaaccaagtttcaagaactcaaagatgttcaggatgaactgagaatcaaagagaatgagctgcgggctctagaagaggaattagcaggtcttaaaaacactgctgaaaagtatcgccaactaaaacagcagtgggagatgaaaactgaagaggcagatttattacaaaccaagctccagcaaagctcatatcacaagcaacaagaagaattagatgcccttaaaaaaaccattgaggaaagtgaggagactttgaaaaacactaaagaaatccaaagaaaagcagaagaaaaatatgaagtattggaaaataaaatgaaaaatgcagaagctgaaagagagcgagaactgaaagatgctcagaaaaaactggattgtgccaaaacaaaggcagatgcatctagcaagaagatgaaagaaaaacaacaggaagttgaagctatcactctggaactggaagagctcaagagagagcatacatcttacaaacaacagcttgaagctgtaaatgaagctatcaaatcctatgaaagtcagattgaagtaatggcagctgaggtggctaaaaataaggagtcagtaaataaagctcaagaagaggtgaccaagcaaaaagaggtgataacagcccaagacactgtaattaaagctaaatatgcagaagtggcaaaacacaaggagcaaaacaatgattctcagcttaaaattaaggaattagaccacaacatcagcaaacataaacgggaggctgaagatggtgctgcaaaggtatccaaaatgttgaaagattatgactggattaatgcagagagacacctctttggccaacccaatagtgcctatgatttcaaaactaacaaccctaaagaagctggtcagagacttcagaagttgcaagaaatgaaggagaaactaggaagaaatgtcaatatgagagctatgaatgtattgacagaagctgaagagcgatacaatgacttgatgaagaagaagagaattgtagaaaatgacaaatccaaaattcttacaactatagaagaccttgaccagaagaaaaaccaagccctaaatattgcatggcaaaaggtgaacaaggactttgggtctattttttctactcttttgcctggtgctaatgctatgcttgcaccaccagagggtcaaactgttttggatggtctggagttcaaggttgccttgggaaatacctggaaagaaaacctaactgaacttagtggtggtcagaggtctttagtggccttgtcattaatactgtccatgcttctcttcaaacctgctccaatttatatccttgatgaggtagatgcagccttggatctttctcatacccaaaacattggacagatgctgcgtactcatttcacacattctcagttcattgtggtgtcactaaaagaaggtatgttcaacaatgcaaacgttcttttcaaaaccaagtttgtggatggtgtttctacagtagccagatttactcaatgtcaaaatggaaagatttcaaaggaagcaaaatccaaggcaaaaccacccaaaggagcacatgtggaagtttaaactacaaagttatttcttcatcttgacctgtttttttaaatgtaaacttttaaggacttgagataactaatttgtttatatacaaaaattaatgttactgtgttacttaacccatgttttctctttatataatcacttatcgcttacaaatgagcatatattcctcatctcttaactagtctaattatggtccaattattgtggttgtgattttatgcatatcatcaaatgtttttttcttatgcgggtcttttatatattagggatcctgagatacccgattctatatgtaaaagctaatatacaaaaaagcagattaaattacatgataaatgtagctgatcatcagtgtttaattgatttaattcctaaggcaatattaatgtgttttctaaagtcattcaggtaaggaagaattataaatcaggtaactggaccaacaaagggaacacatataaagctattatgcatgcatggagccgtttgaggctagttttttaaggccacaactccagacccctgatttagactgagataggaaacagatcttgaaagaatccttattttaatgatacatgaatatcatgttcctatacgcttaataattggtctctacgttttaatgatacatgaatatcatgttcctatacgcttaataattggtctctacgactttaatgtttttgtttttttaagctgtgtaagtatttttaaatcaaagcttaggaggtgtgttgcgtggtactatctgctgcaaatttatctgaagtttgttaatattttccaagatttttgtcagccttttcataatccagtcattaacaacctattggtaaacaagaatgtaggtgccagtagactaaaccaaatttatttttccctgagtctgatatatatatgtataaatataaataactcaatccatctgttccaccaaaataactcaaaagttggatgattatttgtcttccgctttccagttcaaagggatgaaattcctttagaacttgaaagatgacactagcgaacaccatgagaatactgtctacagtttttggtacgtcatcactagaacagtgaccccaaactgaatcatgaaaggtctgacatgatgtaatctgatcttccatgtgttattttggccccacatctcttcttgattttttagtcttatttccttagtgttattatcatacttcccctgatatatggccgtacttcctggccctgggcttgacatttcccacccttcattctccatacatatgagatgtcagaaaacatgcagtaattgatattatgggacacattggaaaggattgaatctggaattagttctgtccactgtggaggggagaggaaataatgctgtaaatgttgagttacagaaagtccaatgtcaaatatagtttttttgtttcctttcaaatgtattacagactgtgccaaaacagttaccaattcacactgtcaatattaaagtataccatagtatacaaattagtcagtacttgctgttaattttaatatttctgatttaacagttagttattaagtggtacttcattgctgttttagccaacgttttaaaaataatttgggagtttgactattttggcttacgtactcatttccttttctctgctaaaaatgttttgcttgtgtgcgttcctgatttttgtcttgtataatcttgatctttgaaaaccctcaaacatgtattaaattgttgtaactttttttcattagagggaagacattaaggggattggggacatttgtttcacacatctgcagtaatatgagttaactaatatttaacaagctctttctttacattagctgctgttctcatttgtatgtattgtcatatttaatcctcagagtaacctagtgaggtaaatactgttgttgtcagcatggtgtaatcgaggaattgagtgagttgagcagaaaagttaggaaacttgctcagggtgataatacagttaggagtgtcagggcccatggacaaatcttgtcagtctccagaacctaagatatactacgtcactgacagcttgaacatttgtatttattgtacagaataaatttaagaaaaatacctgtatgagcagtatgtacaacgtgaatgttaccttaaagaagaacctcaaccatgtgaagagaggattcattgtggtggtggcggttttggcatttcaagtaagctcacagcaaatgcaaagcaaagacatgaaattttctcttccaatagggtggcataatctaaaggccaacattcccacagatgataaatatagattctgagcaaaatactagaaacaactacctgagagttcaggaaactgaagaaaaactagaaagattttggatgggagataaaatacggaggaagagacaggcacaagctaaggttaatgtttttaacctaagtaccagctatagtcatgatgcagctgtaggacagctaaggctgcagtggaaagcctggggtctttctggtctggagaactaaaagatgggatctgggctaaccacagcttccagaaagtgaaggagacgtctcagaagggataaacgaggacctggagaaagaggtccc

SEQ ID NO: 427405 - DNA, 6331 bp, Homo sapiens
ggcgccgaaattcaaaggaataaatagttccggcgcgggtgttgagagcggtgtggtaggtgttgtagccgctatggtgaagttcgctttgtagcggccccggctagagagttggcctgttccctgcctttgtgacccggaggagcttttggggtgcgtcaagcccctggcctgaggcagcgtacattccacttaggtggtggtatttctgtttcgtacagaactggtttgtggcctgtttgattcctgtcagaggtttgctgacccaagacagtatcgaaaatgcatattaagtcaattattctagagggattcaagtcctatgctcagaggaccgaagtcaatggttttgaccccctcttcaatgctatcactggcttaaatggtagtgggaaatccaacatattggactccatctgctttttgctgggcatctccaacctgtctcaggtggttattggtggtagaaataaatatttaatcaatggagtcaatgccaacaacaccagagtacaggatctcttctgttctgttggccttaatgttaacaaccctcactttctcatcatgcagggccgaattacaaaagtattgaatatgaaacctccagagattttatccatgatagaagaagcagctggaaccaggatgtatgaatacaaaaaaatagctgcacagaaaactatagaaaaaaaggaggctaagctgaaagaaattaagacgatacttgaagaagagattactccaaccattcaaaaattaaaagaggaaagatcgtcctacttggagtaccaaaaagtaatgagagaaatagaacatttgagtcgtttatatattgcttatcagtttttgctggctgaagataccaaagtacgctcagctgaggaattaaaagaaatgcaagataaagttataaagcttcaggaagaattgtctgagaatgataaaaaaataaaagcacttaatcatgaaatagaagaattggaaaaaagaaaagataaggaaactggaggtatacttcgatctttagaagatgctcttgcagaggctcagcgagttaatactaaatctcaaagcgcatttgatctcaagaagaaaaatctggcatgtgaggaaagcaaacgcaaagagctggaaaaaaatatggttgaggactcaaaaactttagcagcaaaggaaaaagaggttaaaaagataacagatggactgcatgcccttcaagaagcaagtaataaagatgctgaagctctggcagctgcacagcagcacttcaatgctgtttccgctggcctgtccagtaatgaagatggagcagaagcaactcttgctggtcaaatgatggcctgtaaaaatgatataagtaaagctcagacagaagccaaacaggctcagatgaagttgaagcatgctcaacaggaattaaagaataaacaagctgaagttaagaagatggatagtggctacaggaaggatcaagaagctctagaagctgtaaaaagacttaaagaaaaacttgaagctgaaatgaaaaagctaaattatgaagaaaataaagaggaaagccttttggaaaagcgcaggcagctgtctcgtgatattggtagattgaaagaaacatatgaagctctattagccagatttcccaatcttcgatttgcatacaaggatccagagaagaactggaatagaaattgtgtgaaaggacttgtggcttctctgattagtgtgaaagacacttctgcaaccacagctttagaattagtggctggagaacgactctacaatgttgtagtagacacagaagttactggtaaaaagctactagaaaggggggaactgaaacgtcgatacactataattccactcaataaaatttcagccagatgtattgcaccagaaactctgagagttgctcagaatcttgttggccctgacaacgttcatgtggctctttccttggttgaatataaaccagaacttcagaaagcaatggagtttgtctttggaacaacatttgtttgtgacaatatggataatgccaaaaaagtggcctttgataagaggataatgactagaactgtaactctcggaggtgatgtgtttgatcctcatgggacattgagtggaggtgctcgatcccaggcagcttccattttaaccaagtttcaagaactcaaagatgttcaggatgaactgagaatcaaagagaatgagctgcgggctctagaagaggaattagcaggtcttaaaaacactgctgaaaagtatcgccaactaaaacagcagtgggagatgaaaactgaagaggcagatttattacaaaccaagctccagcaaagctcatatcacaagcaacaagaagaattagatgcccttaaaaaaaccattgaggaaagtgaggagactttgaaaaacactaaagaaatccaaagaaaagcagaagaaaaatatgaagtattggaaaataaaatgaaaaatgcagaagctgaaagagagcgagaactgaaagatgctcagaaaaaactggattgtgccaaaacaaaggcagatgcatctagcaagaagatgaaagaaaaacaacaggaagttgaagctatcactctggaactggaagagctcaagagagagcatacatcttacaaacaacagcttgaagctgtaaatgaagctatcaaatcctatgaaagtcagattgaagtaatggcagctgaggtggctaaaaataaggagtcagtaaataaagctcaagaagaggtgaccaagcaaaaagaggtgataacagcccaagacactgtaattaaagctaaatatgcagaagtggcaaaacacaaggagcaaaacaatgattctcagcttaaaattaaggaattagaccacaacatcagcaaacataaacgggaggctgaagatggtgctgcaaaggtatccaaaatgttgaaagattatgactggattaatgcagagagacacctctttggccaacccaatagtgcctatgatttcaaaactaacaaccctaaagaagctggtcagagacttcagaagttgcaagaaatgaaggagaaactaggaagaaatgtcaatatgagagctatgaatgtattgacagaagctgaagagcgatacaatgacttgatgaagaagaagagaattgtagaaaatgacaaatccaaaattcttacaactatagaagaccttgaccagaagaaaaaccaagccctaaatattgcatggcaaaaggtgaacaaggactttgggtctattttttctactcttttgcctggtgctaatgctatgcttgcaccaccagagggtcaaactgttttggatggtctggagttcaaggttgccttgggaaatacctggaaagaaaacctaactgaacttagtggtggtcagaggtctttagtggccttgtcattaatactgtccatgcttctcttcaaacctgctccaatttatatccttgatgaggtagatgcagccttggatctttctcatacccaaaacattggacagatgctgcgtactcatttcacacattctcagttcattgtggtgtcactaaaagaaggtatgttcaacaatgcaaacgttcttttcaaaaccaagtttgtggatggtgtttctacagtagccagatttactcaatgtcaaaatggaaagatttcaaaggaagcaaaatccaaggcaaaaccacccaaaggagcacatgtggaagtttaaactacaaagttatttcttcatcttgacctgtttttttaaatgtaaacttttaaggacttgagataactaatttgtttatatacaaaaattaatgttactgtgttacttaacccatgttttctctttatataatcacttatcgcttacaaatgagcatatattcctcatctcttaactagtctaattatggtccaattattgtggttgtgattttatgcatatcatcaaatgtttttttcttatgcgggtcttttatatattagggatcctgagatacccgattctatatgtaaaagctaatatacaaaaaagcagattaaattacatgataaatgtagctgatcatcagtgtttaattgatttaattcctaaggcaatattaatgtgttttctaaagtcattcaggtaaggaagaattataaatcaggtaactggaccaacaaagggaacacatataaagctattatgcatgcatggagccgtttgaggctagttttttaaggccacaactccagacccctgatttagactgagataggaaacagatcttgaaagaatccttattttaatgatacatgaatatcatgttcctatacgcttaataattggtctctacgttttaatgatacatgaatatcatgttcctatacgcttaataattggtctctacgactttaatgtttttgtttttttaagctgtgtaagtatttttaaatcaaagcttaggaggtgtgttgcgtggtactatctgctgcaaatttatctgaagtttgttaatattttccaagatttttgtcagccttttcataatccagtcattaacaacctattggtaaacaagaatgtaggtgccagtagactaaaccaaatttatttttccctgagtctgatatatatatgtataaatataaataactcaatccatctgttccaccaaaataactcaaaagttggatgattatttgtcttccgctttccagttcaaagggatgaaattcctttagaacttgaaagatgacactagcgaacaccatgagaatactgtctacagtttttggtacgtcatcactagaacagtgaccccaaactgaatcatgaaaggtctgacatgatgtaatctgatcttccatgtgttattttggccccacatctcttcttgattttttagtcttatttccttagtgttattatcatacttcccctgatatatggccgtacttcctggccctgggcttgacatttcccacccttcattctccatacatatgagatgtcagaaaacatgcagtaattgatattatgggacacattggaaaggattgaatctggaattagttctgtccactgtggaggggagaggaaataatgctgtaaatgttgagttacagaaagtccaatgtcaaatatagtttttttgtttcctttcaaatgtattacagactgtgccaaaacagttaccaattcacactgtcaatattaaagtataccatagtatacaaattagtcagtacttgctgttaattttaatatttctgatttaacagttagttattaagtggtacttcattgctgttttagccaacgttttaaaaataatttgggagtttgactattttggcttacgtactcatttccttttctctgctaaaaatgttttgcttgtgtgcgttcctgatttttgtcttgtataatcttgatctttgaaaaccctcaaacatgtattaaattgttgtaactttttttcattagagggaagacattaaggggattggggacatttgtttcacacatctgcagtaatatgagttaactaatatttaacaagctctttctttacattagctgctgttctcatttgtatgtattgtcatatttaatcctcagagtaacctagtgaggtaaatactgttgttgtcagcatggtgtaatcgaggaattgagtgagttgagcagaaaagttaggaaacttgctcagggtgataatacagttaggagtgtcagggcccatggacaaatcttgtcagtctccagaacctaagatatactacgtcactgacagcttgaacatttgtatttattgtacagaataaatttaagaaaaatacctgtatgagcagtatgtacaacgtgaatgttaccttaaagaagaacctcaaccatgtgaagagaggattcattgtggtggtggcggttttggcatttcaagtaagctcacagcaaatgcaaagcaaagacatgaaattttctcttccaatagggtggcataatctaaaggccaacattcccacagatgataaatatagattctgagcaaaatactagaaacaactacctgagagttcaggaaactgaagaaaaactagaaagattttggatgggagataaaatacggaggaagagacaggcacaagctaaggttaatgtttttaacctaagtaccagctatagtcatgatgcagctgtaggacagctaaggctgcagtggaaagcctggggtctttctggtctggagaactaaaagatgggatctgggctaaccacagcttccagaaagtgaaggagacgtctcagaagggataaacgaggacctggagaaagaggtccc

SEQ ID NO: 427406 - DNA, 6267 bp, Homo sapiens
ggcgcgggggctgtagggagggggaccagtggcagagggaccttaggtgatccttagaaataaaggctagcttctgttcgaccttggagtagggcgaagaggtgtagacaggcctggagaagcgaggtaaaagcctgagtaaaagcaagaagttggagaatatgagatacatctcatctctagtaaatacttaaatgacttcccctcctcccggagtcaagcacaattcggggatgcaatgacggacgtaggtgaagacactgcgggaacttacagacaaaactggtttgtggcctgtttgattcctgtcagaggtttgctgacccaagacagtatcgaaaatgcatattaagtcaattattctagagggattcaagtcctatgctcagaggaccgaagtcaatggttttgaccccctcttcaatgctatcactggcttaaatggtagtgggaaatccaacatattggactccatctgctttttgctgggcatctccaacctgtctcagggccgaattacaaaagtattgaatatgaaacctccagagattttatccatgatagaagaagcagctggaaccaggatgtatgaatacaaaaaaatagctgcacagaaaactatagaaaaaaaggaggctaagctgaaagaaattaagacgatacttgaagaagagattactccaaccattcaaaaattaaaagaggaaagatcgtcctacttggagtaccaaaaagtaatgagagaaatagaacatttgagtcgtttatatattgcttatcagtttttgctggctgaagataccaaagtacgctcagctgaggaattaaaagaaatgcaagataaagttataaagcttcaggaagaattgtctgagaatgataaaaaaataaaagcacttaatcatgaaatagaagaattggaaaaaagaaaagataaggaaactggaggtatacttcgatctttagaagatgctcttgcagaggctcagcgagttaatactaaatctcaaagcgcatttgatctcaagaagaaaaatctggcatgtgaggaaagcaaacgcaaagagctggaaaaaaatatggttgaggactcaaaaactttagcagcaaaggaaaaagaggttaaaaagataacagatggactgcatgcccttcaagaagcaagtaataaagatgctgaagctctggcagctgcacagcagcacttcaatgctgtttccgctggcctgtccagtaatgaagatggagcagaagcaactcttgctggtcaaatgatggcctgtaaaaatgatataagtaaagctcagacagaagccaaacaggctcagatgaagttgaagcatgctcaacaggaattaaagaataaacaagctgaagttaagaagatggatagtggctacaggaaggatcaagaagctctagaagctgtaaaaagacttaaagaaaaacttgaagctgaaatgaaaaagctaaattatgaagaaaataaagaggaaagccttttggaaaagcgcaggcagctgtctcgtgatattggtagattgaaagaaacatatgaagctctattagccagatttcccaatcttcgatttgcatacaaggatccagagaagaactggaatagaaattgtgtgaaaggacttgtggcttctctgattagtgtgaaagacacttctgcaaccacagctttagaattagtggctggagaacgactctacaatgttgtagtagacacagaagttactggtaaaaagctactagaaaggggggaactgaaacgtcgatacactataattccactcaataaaatttcagccagatgtattgcaccagaaactctgagagttgctcagaatcttgttggccctgacaacgttcatgtggctctttccttggttgaatataaaccagaacttcagaaagcaatggagtttgtctttggaacaacatttgtttgtgacaatatggataatgccaaaaaagtggcctttgataagaggataatgactagaactgtaactctcggaggtgatgtgtttgatcctcatgggacattgagtggaggtgctcgatcccaggcagcttccattttaaccaagtttcaagaactcaaagatgttcaggatgaactgagaatcaaagagaatgagctgcgggctctagaagaggaattagcaggtcttaaaaacactgctgaaaagtatcgccaactaaaacagcagtgggagatgaaaactgaagaggcagatttattacaaaccaagctccagcaaagctcatatcacaagcaacaagaagaattagatgcccttaaaaaaaccattgaggaaagtgaggagactttgaaaaacactaaagaaatccaaagaaaagcagaagaaaaatatgaagtattggaaaataaaatgaaaaatgcagaagctgaaagagagcgagaactgaaagatgctcagaaaaaactggattgtgccaaaacaaaggcagatgcatctagcaagaagatgaaagaaaaacaacaggaagttgaagctatcactctggaactggaagagctcaagagagagcatacatcttacaaacaacagcttgaagctgtaaatgaagctatcaaatcctatgaaagtcagattgaagtaatggcagctgaggtggctaaaaataaggagtcagtaaataaagctcaagaagaggtgaccaagcaaaaagaggtgataacagcccaagacactgtaattaaagctaaatatgcagaagtggcaaaacacaaggagcaaaacaatgattctcagcttaaaattaaggaattagaccacaacatcagcaaacataaacgggaggctgaagatggtgctgcaaaggtatccaaaatgttgaaagattatgactggattaatgcagagagacacctctttggccaacccaatagtgcctatgatttcaaaactaacaaccctaaagaagctggtcagagacttcagaagttgcaagaaatgaaggagaaactaggaagaaatgtcaatatgagagctatgaatgtattgacagaagctgaagagcgatacaatgacttgatgaagaagaagagaattgtagaaaatgacaaatccaaaattcttacaactatagaagaccttgaccagaagaaaaaccaagccctaaatattgcatggcaaaaggtgaacaaggactttgggtctattttttctactcttttgcctggtgctaatgctatgcttgcaccaccagagggtcaaactgttttggatggtctggagttcaaggttgccttgggaaatacctggaaagaaaacctaactgaacttagtggtggtcagaggtctttagtggccttgtcattaatactgtccatgcttctcttcaaacctgctccaatttatatccttgatgaggtagatgcagccttggatctttctcatacccaaaacattggacagatgctgcgtactcatttcacacattctcagttcattgtggtgtcactaaaagaaggtatgttcaacaatgcaaacgttcttttcaaaaccaagtttgtggatggtgtttctacagtagccagatttactcaatgtcaaaatggaaagatttcaaaggaagcaaaatccaaggcaaaaccacccaaaggagcacatgtggaagtttaaactacaaagttatttcttcatcttgacctgtttttttaaatgtaaacttttaaggacttgagataactaatttgtttatatacaaaaattaatgttactgtgttacttaacccatgttttctctttatataatcacttatcgcttacaaatgagcatatattcctcatctcttaactagtctaattatggtccaattattgtggttgtgattttatgcatatcatcaaatgtttttttcttatgcgggtcttttatatattagggatcctgagatacccgattctatatgtaaaagctaatatacaaaaaagcagattaaattacatgataaatgtagctgatcatcagtgtttaattgatttaattcctaaggcaatattaatgtgttttctaaagtcattcaggtaaggaagaattataaatcaggtaactggaccaacaaagggaacacatataaagctattatgcatgcatggagccgtttgaggctagttttttaaggccacaactccagacccctgatttagactgagataggaaacagatcttgaaagaatccttattttaatgatacatgaatatcatgttcctatacgcttaataattggtctctacgttttaatgatacatgaatatcatgttcctatacgcttaataattggtctctacgactttaatgtttttgtttttttaagctgtgtaagtatttttaaatcaaagcttaggaggtgtgttgcgtggtactatctgctgcaaatttatctgaagtttgttaatattttccaagatttttgtcagccttttcataatccagtcattaacaacctattggtaaacaagaatgtaggtgccagtagactaaaccaaatttatttttccctgagtctgatatatatatgtataaatataaataactcaatccatctgttccaccaaaataactcaaaagttggatgattatttgtcttccgctttccagttcaaagggatgaaattcctttagaacttgaaagatgacactagcgaacaccatgagaatactgtctacagtttttggtacgtcatcactagaacagtgaccccaaactgaatcatgaaaggtctgacatgatgtaatctgatcttccatgtgttattttggccccacatctcttcttgattttttagtcttatttccttagtgttattatcatacttcccctgatatatggccgtacttcctggccctgggcttgacatttcccacccttcattctccatacatatgagatgtcagaaaacatgcagtaattgatattatgggacacattggaaaggattgaatctggaattagttctgtccactgtggaggggagaggaaataatgctgtaaatgttgagttacagaaagtccaatgtcaaatatagtttttttgtttcctttcaaatgtattacagactgtgccaaaacagttaccaattcacactgtcaatattaaagtataccatagtatacaaattagtcagtacttgctgttaattttaatatttctgatttaacagttagttattaagtggtacttcattgctgttttagccaacgttttaaaaataatttgggagtttgactattttggcttacgtactcatttccttttctctgctaaaaatgttttgcttgtgtgcgttcctgatttttgtcttgtataatcttgatctttgaaaaccctcaaacatgtattaaattgttgtaactttttttcattagagggaagacattaaggggattggggacatttgtttcacacatctgcagtaatatgagttaactaatatttaacaagctctttctttacattagctgctgttctcatttgtatgtattgtcatatttaatcctcagagtaacctagtgaggtaaatactgttgttgtcagcatggtgtaatcgaggaattgagtgagttgagcagaaaagttaggaaacttgctcagggtgataatacagttaggagtgtcagggcccatggacaaatcttgtcagtctccagaacctaagatatactacgtcactgacagcttgaacatttgtatttattgtacagaataaatttaagaaaaatacctgtatgagcagtatgtacaacgtgaatgttaccttaaagaagaacctcaaccatgtgaagagaggattcattgtggtggtggcggttttggcatttcaagtaagctcacagcaaatgcaaagcaaagacatgaaattttctcttccaatagggtggcataatctaaaggccaacattcccacagatgataaatatagattctgagcaaaatactagaaacaactacctgagagttcaggaaactgaagaaaaactagaaagattttggatgggagataaaatacggaggaagagacaggcacaagctaaggttaatgtttttaacctaagtaccagctatagtcatgatgcagctgtaggacagctaaggctgcagtggaaagcctggggtctttctggtctggagaactaaaagatgggatctgggctaaccacagcttccagaaagtgaaggagacgtctcagaagggataaacgaggacctggagaaagaggtccc

SEQ ID NO: 427407 - DNA, 5682 bp, Homo sapiens
agaggttaaaaagataacagatggactgcatgcccttcaagaagcaagtaataaagatgctgaagctctggccgcgcacagcagcacttcaatgctgtttccgctggcctgtccagtaatgaagatggagcagaagcaactcttgctggtcaaatgatggcctgtaaaaatgatataagtaaagctcagacagaagccaaacaggctcagatgaagttgaagcatgctcagctgaggaattaaaagaaatgcaagataaagttataaagcttcaggaagaattgtctgagaatgataaaaaaataaaagcacttaatcatgaaatagaagaattggaaaaaagaaaagataaggaaactggaggtatacttcgatctttagaagatgctcttgcagaggctcagcgagttaatactaaatctcaaagcgcatttgatctcaagaagaaaaatctggcatgtgaggaaagcaaacgcaaagagctggaaaaaaatatggttgaggactcaaaaactttagcagcaaaggaaaaagaggttaaaaagataacagatggactgcatgcccttcaagaagcaagtaataaagatgctgaagctctggcagctgcacagcagcacttcaatgctgtttccgctggcctgtccagtaatgaagatggagcagaagcaactcttgctggtcaaatgatggcctgtaaaaatgatataagtaaagctcagacagaagccaaacaggctcagatgaagttgaagcatgctcaacaggaattaaagaataaacaagctgaagttaagaagatggatagtggctacaggaaggatcaagaagctctagaagctgtaaaaagacttaaagaaaaacttgaagctgaaatgaaaaagctaaattatgaagaaaataaagaggaaagccttttggaaaagcgcaggcagctgtctcgtgatattggtagattgaaagaaacatatgaagctctattagccagatttcccaatcttcgatttgcatacaaggatccagagaagaactggaatagaaattgtgtgaaaggacttgtggcttctctgattagtgtgaaagacacttctgcaaccacagctttagaattagtggctggagaacgactctacaatgttgtagtagacacagaagttactggtaaaaagctactagaaaggggggaactgaaacgtcgatacactataattccactcaataaaatttcagccagatgtattgcaccagaaactctgagagttgctcagaatcttgttggccctgacaacgttcatgtggctctttccttggttgaatataaaccagaacttcagaaagcaatggagtttgtctttggaacaacatttgtttgtgacaatatggataatgccaaaaaagtggcctttgataagaggataatgactagaactgtaactctcggaggtgatgtgtttgatcctcatgggacattgagtggaggtgctcgatcccaggcagcttccattttaaccaagtttcaagaactcaaagatgttcaggatgaactgagaatcaaagagaatgagctgcgggctctagaagaggaattagcaggtcttaaaaacactgctgaaaagtatcgccaactaaaacagcagtgggagatgaaaactgaagaggcagatttattacaaaccaagctccagcaaagctcatatcacaagcaacaagaagaattagatgcccttaaaaaaaccattgaggaaagtgaggagactttgaaaaacactaaagaaatccaaagaaaagcagaagaaaaatatgaagtattggaaaataaaatgaaaaatgcagaagctgaaagagagcgagaactgaaagatgctcagaaaaaactggattgtgccaaaacaaaggcagatgcatctagcaagaagatgaaagaaaaacaacaggaagttgaagctatcactctggaactggaagagctcaagagagagcatacatcttacaaacaacagcttgaagctgtaaatgaagctatcaaatcctatgaaagtcagattgaagtaatggcagctgaggtggctaaaaataaggagtcagtaaataaagctcaagaagaggtgaccaagcaaaaagaggtgataacagcccaagacactgtaattaaagctaaatatgcagaagtggcaaaacacaaggagcaaaacaatgattctcagcttaaaattaaggaattagaccacaacatcagcaaacataaacgggaggctgaagatggtgctgcaaaggtatccaaaatgttgaaagattatgactggattaatgcagagagacacctctttggccaacccaatagtgcctatgatttcaaaactaacaaccctaaagaagctggtcagagacttcagaagttgcaagaaatgaaggagaaactaggaagaaatgtcaatatgagagctatgaatgtattgacagaagctgaagagcgatacaatgacttgatgaagaagaagagaattgtagaaaatgacaaatccaaaattcttacaactatagaagaccttgaccagaagaaaaaccaagccctaaatattgcatggcaaaaggtgaacaaggactttgggtctattttttctactcttttgcctggtgctaatgctatgcttgcaccaccagagggtcaaactgttttggatggtctggagttcaaggttgccttgggaaatacctggaaagaaaacctaactgaacttagtggtggtcagaggtctttagtggccttgtcattaatactgtccatgcttctcttcaaacctgctccaatttatatccttgatgaggtagatgcagccttggatctttctcatacccaaaacattggacagatgctgcgtactcatttcacacattctcagttcattgtggtgtcactaaaagaaggtatgttcaacaatgcaaacgttcttttcaaaaccaagtttgtggatggtgtttctacagtagccagatttactcaatgtcaaaatggaaagatttcaaaggaagcaaaatccaaggcaaaaccacccaaaggagcacatgtggaagtttaaactacaaagttatttcttcatcttgacctgtttttttaaatgtaaacttttaaggacttgagataactaatttgtttatatacaaaaattaatgttactgtgttacttaacccatgttttctctttatataatcacttatcgcttacaaatgagcatatattcctcatctcttaactagtctaattatggtccaattattgtggttgtgattttatgcatatcatcaaatgtttttttcttatgcgggtcttttatatattagggatcctgagatacccgattctatatgtaaaagctaatatacaaaaaagcagattaaattacatgataaatgtagctgatcatcagtgtttaattgatttaattcctaaggcaatattaatgtgttttctaaagtcattcaggtaaggaagaattataaatcaggtaactggaccaacaaagggaacacatataaagctattatgcatgcatggagccgtttgaggctagttttttaaggccacaactccagacccctgatttagactgagataggaaacagatcttgaaagaatccttattttaatgatacatgaatatcatgttcctatacgcttaataattggtctctacgttttaatgatacatgaatatcatgttcctatacgcttaataattggtctctacgactttaatgtttttgtttttttaagctgtgtaagtatttttaaatcaaagcttaggaggtgtgttgcgtggtactatctgctgcaaatttatctgaagtttgttaatattttccaagatttttgtcagccttttcataatccagtcattaacaacctattggtaaacaagaatgtaggtgccagtagactaaaccaaatttatttttccctgagtctgatatatatatgtataaatataaataactcaatccatctgttccaccaaaataactcaaaagttggatgattatttgtcttccgctttccagttcaaagggatgaaattcctttagaacttgaaagatgacactagcgaacaccatgagaatactgtctacagtttttggtacgtcatcactagaacagtgaccccaaactgaatcatgaaaggtctgacatgatgtaatctgatcttccatgtgttattttggccccacatctcttcttgattttttagtcttatttccttagtgttattatcatacttcccctgatatatggccgtacttcctggccctgggcttgacatttcccacccttcattctccatacatatgagatgtcagaaaacatgcagtaattgatattatgggacacattggaaaggattgaatctggaattagttctgtccactgtggaggggagaggaaataatgctgtaaatgttgagttacagaaagtccaatgtcaaatatagtttttttgtttcctttcaaatgtattacagactgtgccaaaacagttaccaattcacactgtcaatattaaagtataccatagtatacaaattagtcagtacttgctgttaattttaatatttctgatttaacagttagttattaagtggtacttcattgctgttttagccaacgttttaaaaataatttgggagtttgactattttggcttacgtactcatttccttttctctgctaaaaatgttttgcttgtgtgcgttcctgatttttgtcttgtataatcttgatctttgaaaaccctcaaacatgtattaaattgttgtaactttttttcattagagggaagacattaaggggattggggacatttgtttcacacatctgcagtaatatgagttaactaatatttaacaagctctttctttacattagctgctgttctcatttgtatgtattgtcatatttaatcctcagagtaacctagtgaggtaaatactgttgttgtcagcatggtgtaatcgaggaattgagtgagttgagcagaaaagttaggaaacttgctcagggtgataatacagttaggagtgtcagggcccatggacaaatcttgtcagtctccagaacctaagatatactacgtcactgacagcttgaacatttgtatttattgtacagaataaatttaagaaaaatacctgtatgagcagtatgtacaacgtgaatgttaccttaaagaagaacctcaaccatgtgaagagaggattcattgtggtggtggcggttttggcatttcaagtaagctcacagcaaatgcaaagcaaagacatgaaattttctcttccaatagggtggcataatctaaaggccaacattcccacagatgataaatatagattctgagcaaaatactagaaacaactacctgagagttcaggaaactgaagaaaaactagaaagattttggatgggagataaaatacggaggaagagacaggcacaagctaaggttaatgtttttaacctaagtaccagctatagtcatgatgcagctgtaggacagctaaggctgcagtggaaagcctggggtctttctggtctggagaactaaaagatgggatctgggctaaccacagcttccagaaagtgaaggagacgtctcagaagggataaacgaggacctggagaaagaggtccc

SEQ ID NO: 427408 - DNA, 1113 bp, Homo sapiens
ggcgccgaaattcaaaggaataaatagttccggcgcgggtgttgagagcggtgtggtaggtgttgtagccgctatggtgaagttcgctttgtagcggccccggctagagagttggcctgttccctgcctttgtgacccggaggagcttttggggtgcgtcaagcccctggcctgaggcagcgaactggtttgtggcctgtttgattcctgtcagaggtttgctgacccaagacagtatcgaaaatgcatattaagtcaattattctagagggattcaagtcctatgctcagaggaccgaagtcaatggttttgaccccctcttcaatgctatcactggcttaaatggtagtgggaaatccaacatattggactccatctgctttttgctgggcatctccaacctgtctcaggttcgggcttctaatttacaagatttagtttacaaaaatgggcaggctggtattaccaaagcctctgtgtcaatcacttttgataattctgacaaaaagcaaagtcctttaggatttgaggttcatgatgaaatcacagtaacaaggcaggtggttattggtggtagaaataaatatttaatcaatggagtcaatgccaacaacaccagagtacaggatctcttctgttctgttggccttaatgttaacaaccctcactttctcatcatgcagggccgaattacaaaagtattgaatatgaaacctccagagattttatccatgatagaagaagcagctggaaccaggatgtatgaatacaaaaaaatagctgcacagaaaactatagaaaaaaaggaggctaagctgaaagaaattaagacgatacttgaagaagagattactccaaccattcaaaaattaaaagaggaaagatcgtcctacttggagtaccaaaaagtaatgagagaaatagaacatttgagtcgtttatatattgcttatcagtttttgctggctgaagataccaaagtacgctcagctgaggaattaaaagaaatgcaagataaagttataaagcttcaggaagaattgtctgagaatgataaaaaaataaaagcacttaatcatgaaatagaagaattggaaaaaagaaaagataag

SEQ ID NO: 427409 - DNA, 487 bp, Homo sapiens
tgatgttttaacttttttattttttaaatccaggtgaacaaggactttgggtctattttttctactcttttgcctggtgctaatgctatgcttgcaccaccagagggtcaaactgttttggatggtctggagttcaaggttgccttgggaaatacctggaaagaaaacctaactgaacttagtggtggtcagaggtgaggaatcactttgctatattataattttcattcctctttattataattcatctccttaccttaaaactgtatttgtgttttaactacctttgcatgtagaatttaaggagtctaatatataagactaaacaatttggttaaaacatttgattaaaataggtgacaaaggaggaataagcaaatagaaaattagacaaaacatgtttttaaaaaatctattttcaaatattagaaaatgaatagtccaggacaagatgaaacagaaatgctgagccctatgttcaccctgg

SEQ ID NO: 427410 - DNA, 613 bp, Homo sapiens
gcaaaaggaaaatgataccagatggaaccttggatctacataaaggaaagaagagtgttggaaactaacatggatttggagttcagggaagtttctcctgaccttacacagtgattcagaaaatcagcatagtgatagaaacctaaaaggtcatatgtccttacaccttacctaccaatagccaattaattaaaacctcctgaaagaaggttgtcaacattcacataattgaaattcgtgattcatttagtaattggtttttttctcctgcatggtatataatccataggccttgaattattgttctctgtcctgtaattccatcatgtaacccttttttatgtacttagaaaatattgacacctgttaatgttccttatgaccccctttatcatttttatgagtagaaatatattttatttatatttttataaaatttgtaaataagaatcaaaaatacagctcctgctgcctgttcataaaaattggattccacagtttagttcccaatatctttagctatatttgccgaagccctagaaaatgttttgaggaaaatagaaaatgtatgcttctcttcttactgggacctataaattatttccataattaa

SEQ ID NO: 427411 - DNA, 1707 bp, Homo sapiens
ctacgggcaccgtggccacacctgcctgcacagccagggccaggaggaggagatgccatgaccctcattctcacaagcctgctcttctttgggctgagcctgggccccaggacccgggtgcaggcagaaaacctacccaaacccatcctgtgggccgagccaggtcccgtgatcacctggcataaccccgtgaccatctggtgtcagggcaccctggaggcccaggggtaccgtctggataaagagggaaactcaatgtcgaggcacatattaaaaacactggagtctgaaaacaaggtcaaactctccatcccatccatgatgtgggaacatgcagggcgatatcactgttactatcagagccctgcaggctggtcagagcccagcgaccccctggagctggtggtgacagcctacagcagacccaccctgtccgccctgccaagccctgtggtaacctcaggagtgaacgtgaccctccggtgtgcctcacggctgggactgggcaggttcactctgattgaggaaggagaccacaggctctcctggaccctgaactcacaccaacacaaccatggaaagttccaggccctgttccccatgggccccctgaccttcagcaacaggggtacattcagatgctacggctatgaaaacaacaccccatacgtgtggtcggaacccagtgaccccctgcagctactggtgtcaggcgtgtctaggaagccctccctcctgaccctgcagggccctgtcgtgacccccggagagaatctgaccctccagtgtggctctgatgtcggctacatcagatacactctgtacaaggagggggccgatggcctcccccagcgccctggccggcagccccaggctgggctctcccaggccaacttcaccctgagccctgtgagccgctcctacgggggccagtacagatgctacggcgcacacaacgtctcctccgagtggtcggcccccagtgaccccctggacatcctgatcgcaggacagatctctgacagaccctccctctcagtgcagccgggccccacggtgacctcaggagagaaggtgaccctgctgtgtcagtcatgggacccgatgttcactttccttctgaccaaggagggggcagcccatcccccgttgcgtctgagatcaatgtacggagctcataagtaccaggctgaattccccatgagtcctgtgacctcagcccacgcggggacctacaggtgctacggctcacgcagctccaacccctacctgctgtctcaccccagtgagcccctggagctcgtggtctcaggagcaactgagaccctcaatccagcacaaaagaagtcagattccaagactgccccacacctccaggattacacagtggagaatctcatccgcatgggtgtggctggcttggtcctgctgttcctcgggattctgttatttgaggctcagcacagccagagaagccccccaaggtgcagccaggaggcaaacagcagaaaggacaatgcacccttcagagtggtggagccttgggaacagatctgatgatctgaggaggttctggaagactggggcagcagttggggaagtgtctgctgagaatatcaaggggaagaagcatgggtcaggtgcaggaagatgtctgggtgtctgtagaagatgcttcctccattaaactgtggtgctttcctcctc

SEQ ID NO: 427412 - DNA, 2102 bp, Homo sapiens
ctacgggcaccgtggccacacctgcctgcacagccagggccaggaggaggagatgccatgaccctcattctcacaagcctgctcttctttggtgagatcttaagagggggaggagagaccctagtctaggagagagaccccaatccatagccatgccttagtcaattagggcatcccaggggctcaaggaaaagaagaagacctgctcaggcttcggaggcaaatctctcacagggaactctcttccagggctgagcctgggccccaggacccgggtgcaggcagaaaacctacccaaacccatcctgtgggccgagccaggtcccgtgatcacctggcataaccccgtgaccatctggtgtcagggcaccctggaggcccaggggtaccgtctggataaagagggaaactcaatgtcgaggcacatattaaaaacactggagtctgaaaacaaggtcaaactctccatcccatccatgatgtgggaacatgcagggcgatatcactgttactatcagagccctgcaggctggtcagagcccagcgaccccctggagctggtggtgacagcctacagcagacccaccctgtccgccctgccaagccctgtggtaacctcaggagtgaacgtgaccctccggtgtgcctcacggctgggactgggcaggttcactctgattgaggaaggagaccacaggctctcctggaccctgaactcacaccaacacaaccatggaaagttccaggccctgttccccatgggccccctgaccttcagcaacaggggtacattcagatgctacggctatgaaaacaacaccccatacgtgtggtcggaacccagtgaccccctgcagctactggtgtcaggcgtgtctaggaagccctccctcctgaccctgcagggccctgtcgtgacccccggagagaatctgaccctccagtgtggctctgatgtcggctacatcagatacactctgtacaaggagggggccgatggcctcccccagcgccctggccggcagccccaggctgggctctcccaggccaacttcaccctgagccctgtgagccgctcctacgggggccagtacagatgctacggcgcacacaacgtctcctccgagtggtcggcccccagtgaccccctggacatcctgatcgcaggacagatctctgacagaccctccctctcagtgcagccgggccccacggtgacctcaggagagaaggtgaccctgctgtgtcagtcatgggacccgatgttcactttccttctgaccaaggagggggcagcccatcccccgttgcgtctgagatcaatgtacggagctcataagtaccaggctgaattccccatgagtcctgtgacctcagcccacgcggggacctacaggtgctacggctcacgcagctccaacccctacctgctgtctcaccccagtgagcccctggagctcgtggtctcaggagcaactgagaccctcaatccagcacaaaagaagtcagattccaagactgccccacacctccaggattacacagtggagaatctcatccgcatgggtgtggctggcttggtcctgctgttcctcgggattctgttatttgaggctcagcacagccagagaagccccccaaggtgcagccaggaggcaaacagcagaaaggacaatgcacccttcagagtggtggagccttgggaacagatctgatgatctgaggaggttctggaagactggggcagcagttggggaagtgtctgctgagaatatcaaggggaagaagcatgggtcaggtgcaggaagatgtctgggtgtctgtagaagatgcttcctccattaaactgtggtgctttcctcctcattgtcgactctccttgactgccccttccttcgtttttcttccctatgatgtaaggcttcacccctatggtgggtttgggtccgcccctctgtgacctcatgctctgctccactttcaggtaatacacctttctttatttctaactactgcattttctaatgtgtattactgggactatctcttcagctcataacatggaatttgcttttgataattaaatccatgggcaaaaatca

SEQ ID NO: 427413 - DNA, 1944 bp, Homo sapiens
ctacgggcaccgtggccacacctgcctgcacagccagggccaggaggaggagatgccatgaccctcattctcacaagcctgctcttctttgggctgagcctgggccccaggacccgggtgcaggcagaaaacctacccaaacccatcctgtgggccgagccaggtcccgtgatcacctggcataaccccgtgaccatctggtgtcagggcaccctggaggcccaggggtaccgtctggataaagagggaaactcaatgtcgaggcacatattaaaaacactggagtctgaaaacaaggtcaaactctccatcccatccatgatgtgggaacatgcagggcgatatcactgttactatcagagccctgcaggctggtcagagcccagcgaccccctggagctggtggtgacagcctacagcagacccaccctgtccgccctgccaagccctgtggtaacctcaggagtgaacgtgaccctccggtgtgcctcacggctgggactgggcaggttcactctgattgaggaaggagaccacaggctctcctggaccctgaactcacaccaacacaaccatggaaagttccaggccctgttccccatgggccccctgaccttcagcaacaggggtacattcagatgctacggctatgaaaacaacaccccatacgtgtggtcggaacccagtgaccccctgcagctactggtgtcaggcgtgtctaggaagccctccctcctgaccctgcagggccctgtcgtgacccccggagagaatctgaccctccagtgtggctctgatgtcggctacatcagatacactctgtacaaggagggggccgatggcctcccccagcgccctggccggcagccccaggctgggctctcccaggccaacttcaccctgagccctgtgagccgctcctacgggggccagtacagatgctacggcgcacacaacgtctcctccgagtggtcggcccccagtgaccccctggacatcctgatcgcaggacagatctctgacagaccctccctctcagtgcagccgggccccacggtgacctcaggagagaaggtgaccctgctgtgtcagtcatgggacccgatgttcactttccttctgaccaaggagggggcagcccatcccccgttgcgtctgagatcaatgtacggagctcataagtaccaggctgaattccccatgagtcctgtgacctcagcccacgcggggacctacaggtgctacggctcacgcagctccaacccctacctgctgtctcaccccagtgagcccctggagctcgtggtctcaggagcaactgagaccctcaatccagcacaaaagaagtcagattccaagactgccccacacctccaggattacacagtggagaatctcatccgcatgggtgtggctggcttggtcctgctgttcctcgggattctgttatttgaggctcagcacagccagagaagccccccaaggtgcagccaggaggcaaacagcagaaaggacaatgcacccttcagagtggtggagccttgggaacagatctgatgatctgaggaggttctggaagactggggcagcagttggggaagtgtctgctgagaatatcaaggggaagaagcatgggtcaggtgcaggaagatgtctgggtgtctgtagaagatgcttcctccattaaactgtggtgctttcctcctcattgtcgactctccttgactgccccttccttcgtttttcttccctatgatgtaaggcttcacccctatggtgggtttgggtccgcccctctgtgacctcatgctctgctccactttcaggtaatacacctttctttatttctaactactgcattttctaatgtgtattactgggactatctcttcagctcataacatggaatttgcttttgataattaaatccatgggcaaaaatca

SEQ ID NO: 427414 - DNA, 1380 bp, Homo sapiens
ctacgggcaccgtggccacacctgcctgcacagccagggccaggaggaggagatgccatgaccctcattctcacaagcctgctcttctttgggctgagcctgggccccaggacccgggtgcaggcagaaaacctacccaaacccatcctgtgggccgagccaggtcccgtgatcacctggcataaccccgtgaccatctggtgtcagggcaccctggaggcccaggggtaccgtctggataaagagggaaactcaatgtcgaggcacatattaaaaacactggagtctgaaaacaaggtcaaactctccatcccatccatgatgtgggaacatgcagggcgatatcactgttactatcagagccctgcaggctggtcagagcccagcgaccccctggagctggtggtgacagcctacagcagacccaccctgtccgccctgccaagccctgtggtaacctcaggagtgaacgtgaccctccggtgtgcctcacggctgggactgggcaggttcactctgattgaggaaggagaccacaggctctcctggaccctgaactcacaccaacacaaccatggaaagttccaggccctgttccccatgggccccctgaccttcagcaacaggggtacattcagatgctacggctatgaaaacaacaccccatacgtgtggtcggaacccagtgaccccctgcagctactggtgtcaggcgtgtctaggaagccctccctcctgaccctgcagggccctgtcgtgacccccggagagaatctgaccctccagtgtggctctgatgtcggctacatcagatacactctgtacaaggagggggccgatggcctcccccagcgccctggccggcagccccaggctgggctctcccaggccaacttcaccctgagccctgtgagccgctcctacgggggccagtacagatgctacggcgcacacaacgtctcctccgagtggtcggcccccagtgaccccctggacatcctgatcgcaggacagatctctgacagaccctccctctcagtgcagccgggccccacggtgacctcaggagagaaggtgaccctgctgtgtcagtcatgggacccgatgttcactttccttctgaccaaggagggggcagcccatcccccgttgcgtctgagatcaatgtacggagctcataagtaccaggctgaattccccatgagtcctgtgacctcagcccacgcggggacctacaggtgctacggctcacgcagctccaacccctacctgctgtctcaccccagtgagcccctggagctcgtggtctcaggtgagggcgctgaccctgtccactctgagctcaaaggggttcttggaaatgaaaaaggagagcttcca

SEQ ID NO: 427415 - DNA, 2654 bp, Homo sapiens
  misc_feature (1289)..(1289): n is a, c, g, or t
  misc_feature (1291)..(1295): n is a, c, g, or t
ccacaatgctctattttctcacctagtttgacaaatgttaattcctagctcaaactgtgaatagtaaggattgtaaagtatgtaatgctaagggctgtgttgtcttttcttacgattttaagttttaaaggctgttaaattacagagatgttgcccaaggatacatggggattctcaaaagtaagagatttttacctttttcataatctgccaagctggttcctaatatattgttaaattggtagaaaaatatctttaaattggtgtctgctcaagaattgcttttctagatttgatggagggagggggagagtcacatcatttggattctaccaatctgcaggctctatctttggcaacatgtaaataattagactatacatctgtttctcaagtatggcaagaccaatagtttgaatttaattatcaatgctatggtatactttctggtcatattttagttatgtcagttttaaggtaagttttttcatttattaaagcccttaaatgagattttagactgccaaagagaagaggcagtccaattgacctaactgaaatgagatgaccagtatatagagcctagatggactgtagcagctctacccctttgttttacaaggtaaatcattttaaaaattaccttttttgatcagtgggtaaaagttaaagggatctttaatttttgatatattcaagttaattttctaaatgtgaatcagtccttggactgcaactatatattcacctacaaaatcccaatcaaaaaattacatgagcctgtcaagcagatctttagttttccacttcacataagatcgttaatgttctaaattaatctattcatttagatgatttttgtcagttcttaaatggggatataataaatttaggcattttcatcttaacaaggcaaaagagttaaaaaacaaaacaaaacactactccaagccaaatacattctagctggttaattccagacttgtcccaagtggttccccaacctcttttccactggtaatttcttttcatgcaggcagaatataggggtgcgagcgctgtgagttttacatatgagcttggataggggaactgaagcgagtcaggagccctgctggaaaaggggtttgccattggattgtctgtggcctggtttctttccagtagtacagtaatagggtagattgaaaacaagtatttacttctgattctgcctgcatttagtgtgaaatgctcttaaggtattgcttctaaaaagcaaattaagcagttaagtataaagtccctgnannnnnatttcaaaataaggcttttatgagatttttattaaaaattgcaatagccatcacaaatctgagtttttctaggggtgagagaaaactgtattgtgatgagctagattagttgtagttccagaataagaacaaaaattcagagttgtgtggtgcccatcattgagtaaatgaaccctaaaaatgaataagctaatgaactagttcatggaattatttctgatggtcttttgacctgatgctgccatactgcagtgttaccagctccccctagaaaacggaactgtttaaaaacacagcaagttacagaaaccattttattctacagccattggggtacttcagtttatgggatgtttttggaaacttctgctttgggagggatgaagatcattgataaatgttatttgctttctgagttttggggtcatttcattgcttatcaatgaagggcagacagaggagagaatatctcaagtcttttctgataaaaggcttgcttgagggagcttataacttgcacctagagggtttacccactttgtggatttgatttatccaccaaccacagcaaccaataatgtcaagattctaggagtttatgaaagaggctagtatgttttcattttgagtcagacattcttttctcattctcaaatctgttttaaatgctccaattttaaaaatgccaatgaaaattttataatgcttctgtagtaaccatatgcagtttactttgaatttaggaaaacagttttgtatgatgaaatattgtgcagaatctgtaaataaggtagcttaaaaaaaaaaaaaaagtctaattagaatatgattaatccttgaaatgtagaaactagagattgtgttgagtcagaactgttatgtttgtatccaggtttctattcaccacatataccatcttagaatacacacatatctgtgagttataatttaaagtggtcatccagggaaatgatcatggagtgctactacagatgtacagttttacactactgatgtgttcttgccatacccaagtagggaatcacttccaggaaaacaagtcctcaagcactcaatgactttgtaaacccatgactgaaacaagactcatctgaggcagtaggactggtgggattctactgacttcttagtatcacatggcaccatcacaaatgcattgttagagcagcaacatccagagttcttaagcttgtaccctaacacacaaatttgacttctaaccctgaaatatcctatatatatttctaaaactgtttgtagttttcttgagaaaaagcactttataatttactcagttttcagtaataaaattaacactgacttgaatgtatttaaaaa

SEQ ID NO: 427416 - DNA, 4115 bp, Homo sapiens
  misc_feature (2750)..(2750): n is a, c, g, or t
  misc_feature (2752)..(2756): n is a, c, g, or t
gccttttttttctacgttatgcaaaatgcccagggatttaatgcacaggtgtactttaatgtttagggtcagtttgtagtattcttgagaaaaagataaagggttataatttgaatgtgaactgatccagaaataagtgctgtacctttccactgcacttgaagttcaacttaatggtgtatgtgaaaaacaaaaactactttggttgtgtatgtccaaagtcctatggttttattcatttatggttttacaggctttgaagtactcagatttgatttttgctttcttggaaagactcactttaccaagcatataaaggaaaaatgatttcaaacattgacaagatagatgagtgttaacaaagctttcttttttcgtgtcctccttatttaaaaaggtatacttacaatgtgaagtaacttatgaataaaaggaaaagtttatcccatattcaaataattcctaaggtcagcctccctttttgtaagtggcaaatatctgattaaatcatttctcagtttattaatccttggaaacaatgatatagcagttactcacagcttgtaaattacaacagaaaggttcctttcaaatagtagagctgcacctaaagaggaaattgggtttataagaaaatggaggcaaagaacttaagttttaagaaaaagcacttcaaaacagaagggcaaatggaaaaggggaatataaaacaaaccaataaaaataccatctgagggtgttactgtccaaaagtaaagaataagatgcatcactaagccctttgcactcgttatgacctcgtaagtaaaaattatcacttagaataaggggtgcacactacattccctctgtcttctagactttttttttgtagaagaatcagaaaacaatttactaacctccctgtttgatattaaaaataggaagaattttaatattttctgttagtacaagttgaacttgattgtgccaactgaaaccccagaggtttgtatatcagtagaatgcaagaacattgttaaaggtgcttacgatcttttttgttttcctttccactccattgtatcaattttttgagtaacttttaaatggctagaaaatggtctttttgctttgcccttttaaagctgaaataaccagctccattcttttcatgaatagtaagttgatatatttatttatcaggtatcttgcagttgtcaccaaatactgtagttttcttatgttgtatggaaattatagttcaattattttaatgtgatggagtgcaacaagtcattgtagaacttttcacctgttaatgttgaagttatacctctgaatttctgctgtggatatcaaggaaataataaagcagaaaccccaagaaatttgcaacttaacagtttgagactgtctcttatcctagtatttgggaagagaaggaataaatttgtcaaaactaggtgagaaaatagagcattgtgggaaaaactgagtccaactagattagcaaatgttaattcctagctcaaactgtgaatagtaaggattgtaaagtatgtaatgctaagggctgtgttgtcttttcttacgattttaagttttaaaggctgttaaattacagagatgttgcccaaggatacatggggattctcaaaagtaagagatttttacctttttcataatctgccaagctggttcctaatatattgttaaattggtagaaaaatatctttaaattggtgtctgctcaagaattgcttttctagatttgatggagggagggggagagtcacatcatttggattctaccaatctgcaggctctatctttggcaacatgtaaataattagactatacatctgtttctcaagtatggcaagaccaatagtttgaatttaattatcaatgctatggtatactttctggtcatattttagttatgtcagttttaaggtaagttttttcatttattaaagcccttaaatgagattttagactgccaaagagaagaggcagtccaattgacctaactgaaatgagatgaccagtatatagagcctagatggactgtagcagctctacccctttgttttacaaggtaaatcattttaaaaattaccttttttgatcagtgggtaaaagttaaagggatctttaatttttgatatattcaagttaattttctaaatgtgaatcagtccttggactgcaactatatattcacctacaaaatcccaatcaaaaaattacatgagcctgtcaagcagatctttagttttccacttcacataagatcgttaatgttctaaattaatctattcatttagatgatttttgtcagttcttaaatggggatataataaatttaggcattttcatcttaacaaggcaaaagagttaaaaaacaaaacaaaacactactccaagccaaatacattctagctggttaattccagacttgtcccaagtggttccccaacctcttttccactggtaatttcttttcatgcaggcagaatataggggtgcgagcgctgtgagttttacatatgagcttggataggggaactgaagcgagtcaggagccctgctggaaaaggggtttgccattggattgtctgtggcctggtttctttccagtagtacagtaatagggtagattgaaaacaagtatttacttctgattctgcctgcatttagtgtgaaatgctcttaaggtattgcttctaaaaagcaaattaagcagttaagtataaagtccctgnannnnnatttcaaaataaggcttttatgagatttttattaaaaattgcaatagccatcacaaatctgagtttttctaggggtgagagaaaactgtattgtgatgagctagattagttgtagttccagaataagaacaaaaattcagagttgtgtggtgcccatcattgagtaaatgaaccctaaaaatgaataagctaatgaactagttcatggaattatttctgatggtcttttgacctgatgctgccatactgcagtgttaccagctccccctagaaaacggaactgtttaaaaacacagcaagttacagaaaccattttattctacagccattggggtacttcagtttatgggatgtttttggaaacttctgctttgggagggatgaagatcattgataaatgttatttgctttctgagttttggggtcatttcattgcttatcaatgaagggcagacagaggagagaatatctcaagtcttttctgataaaaggcttgcttgagggagcttataacttgcacctagagggtttacccactttgtggatttgatttatccaccaaccacagcaaccaataatgtcaagattctaggagtttatgaaagaggctagtatgttttcattttgagtcagacattcttttctcattctcaaatctgttttaaatgctccaattttaaaaatgccaatgaaaattttataatgcttctgtagtaaccatatgcagtttactttgaatttaggaaaacagttttgtatgatgaaatattgtgcagaatctgtaaataaggtagcttaaaaaaaaaaaaaaagtctaattagaatatgattaatccttgaaatgtagaaactagagattgtgttgagtcagaactgttatgtttgtatccaggtttctattcaccacatataccatcttagaatacacacatatctgtgagttataatttaaagtggtcatccagggaaatgatcatggagtgctactacagatgtacagttttacactactgatgtgttcttgccatacccaagtagggaatcacttccaggaaaacaagtcctcaagcactcaatgactttgtaaacccatgactgaaacaagactcatctgaggcagtaggactggtgggattctactgacttcttagtatcacatggcaccatcacaaatgcattgttagagcagcaacatccagagttcttaagcttgtaccctaacacacaaatttgacttctaaccctgaaatatcctatatatatttctaaaactgtttgtagttttcttgagaaaaagcactttataatttactcagttttcagtaataaaattaacactgacttgaatgtatttaaaaa

SEQ ID NO: 427417 - DNA, 4061 bp, Homo sapiens
  misc_feature (2750)..(2750): n is a, c, g, or t
  misc_feature (2752)..(2756): n is a, c, g, or t
gccttttttttctacgttatgcaaaatgcccagggatttaatgcacaggtgtactttaatgtttagggtcagtttgtagtattcttgagaaaaagataaagggttataatttgaatgtgaactgatccagaaataagtgctgtacctttccactgcacttgaagttcaacttaatggtgtatgtgaaaaacaaaaactactttggttgtgtatgtccaaagtcctatggttttattcatttatggttttacaggctttgaagtactcagatttgatttttgctttcttggaaagactcactttaccaagcatataaaggaaaaatgatttcaaacattgacaagatagatgagtgttaacaaagctttcttttttcgtgtcctccttatttaaaaaggtatacttacaatgtgaagtaacttatgaataaaaggaaaagtttatcccatattcaaataattcctaaggtcagcctccctttttgtaagtggcaaatatctgattaaatcatttctcagtttattaatccttggaaacaatgatatagcagttactcacagcttgtaaattacaacagaaaggttcctttcaaatagtagagctgcacctaaagaggaaattgggtttataagaaaatggaggcaaagaacttaagttttaagaaaaagcacttcaaaacagaagggcaaatggaaaaggggaatataaaacaaaccaataaaaataccatctgagggtgttactgtccaaaagtaaagaataagatgcatcactaagccctttgcactcgttatgacctcgtaagtaaaaattatcacttagaataaggggtgcacactacattccctctgtcttctagactttttttttgtagaagaatcagaaaacaatttactaacctccctgtttgatattaaaaataggaagaattttaatattttctgttagtacaagttgaacttgattgtgccaactgaaaccccagaggtttgtatatcagtagaatgcaagaacattgttaaaggtgcttacgatcttttttgttttcctttccactccattgtatcaattttttgagtaacttttaaatggctagaaaatggtctttttgctttgcccttttaaagctgaaataaccagctccattcttttcatgaatagtaagttgatatatttatttatcaggtatcttgcagttgtcaccaaatactgtagttttcttatgttgtatggaaattatagttcaattattttaatgtgatggagtgcaacaagtcattgtagaacttttcacctgttaatgttgaagttatacctctgaatttctgctgtggatatcaaggaaataataaagcagaaaccccaagaaatttgcaacttaacagtttgagactgtctcttatcctagtatttgggaagagaaggaataaatttgtcaaaactaggtgagaaaatagagcattgtgggaaaaactgagtccaactagattagcaaatgttaattcctagctcaaactgtgaatagtaaggattgtaaagtatgtaatgctaagggctgtgttgtcttttcttacgattttaagttttaaaggctgttaaattacagagatgttgcccaaggatacatggggattctcaaaagtaagagatttttacctttttcataatctgccaagctggttcctaatatattgttaaattggtagaaaaatatctttaaattggtgtctgctcaagaattgcttttctagatttgatggagggagggggagagtcacatcatttggattctaccaatctgcaggctctatctttggcaacatgtaaataattagactatacatctgtttctcaagtatggcaagaccaatagtttgaatttaattatcaatgctatggtatactttctggtcatattttagttatgtcagttttaaggtaagttttttcatttattaaagcccttaaatgagattttagactgccaaagagaagaggcagtccaattgacctaactgaaatgagatgaccagtatatagagcctagatggactgtagcagctctacccctttgttttacaaggtaaatcattttaaaaattaccttttttgatcagtgggtaaaagttaaagggatctttaatttttgatatattcaagttaattttctaaatgtgaatcagtccttggactgcaactatatattcacctacaaaatcccaatcaaaaaattacatgagcctgtcaagcagatctttagttttccacttcacataagatcgttaatgttctaaattaatctattcatttagatgatttttgtcagttcttaaatggggatataataaatttaggcattttcatcttaacaaggcaaaagagttaaaaaacaaaacaaaacactactccaagccaaatacattctagctggttaattccagacttgtcccaagtggttccccaacctcttttccactggtaatttcttttcatgcaggcagaatataggggtgcgagcgctgtgagttttacatatgagcttggataggggaactgaagcgagtcaggagccctgctggaaaaggggtttgccattggattgtctgtggcctggtttctttccagtagtacagtaatagggtagattgaaaacaagtatttacttctgattctgcctgcatttagtgtgaaatgctcttaaggtattgcttctaaaaagcaaattaagcagttaagtataaagtccctgnannnnnatttcaaaataaggcttttatgagatttttattaaaaattgcaatagccatcacaaatctgagtttttctaggggtgagagaaaactgtattgtgatgagctagattagttgtagttccagaataagaacaaaaattcagagttgtgtggtgcccatcattgagtaaatgaaccctaaaaatgaataagctaatgaactagttcatggaattatttctgatggtcttttgacctgatgctgccatactgcagtgttaccagctccccctagaaaacggaactgtttaaaaacacagcaagttacagaaaccattttattctacagccattggggtacttcagtttatgggatgtttttggaaacttctgctttgggagggatgaagatcattgataaatgttatttgctttctgagttttggggtcatttcattgcttatcaatgaagggcagacagaggagagaatatctcaagtcttttctgatgtggatttgatttatccaccaaccacagcaaccaataatgtcaagattctaggagtttatgaaagaggctagtatgttttcattttgagtcagacattcttttctcattctcaaatctgttttaaatgctccaattttaaaaatgccaatgaaaattttataatgcttctgtagtaaccatatgcagtttactttgaatttaggaaaacagttttgtatgatgaaatattgtgcagaatctgtaaataaggtagcttaaaaaaaaaaaaaaagtctaattagaatatgattaatccttgaaatgtagaaactagagattgtgttgagtcagaactgttatgtttgtatccaggtttctattcaccacatataccatcttagaatacacacatatctgtgagttataatttaaagtggtcatccagggaaatgatcatggagtgctactacagatgtacagttttacactactgatgtgttcttgccatacccaagtagggaatcacttccaggaaaacaagtcctcaagcactcaatgactttgtaaacccatgactgaaacaagactcatctgaggcagtaggactggtgggattctactgacttcttagtatcacatggcaccatcacaaatgcattgttagagcagcaacatccagagttcttaagcttgtaccctaacacacaaatttgacttctaaccctgaaatatcctatatatatttctaaaactgtttgtagttttcttgagaaaaagcactttataatttactcagttttcagtaataaaattaacactgacttgaatgtatttaaaaa

SEQ ID NO: 427418 - DNA, 620 bp, Homo sapiens
agcggaagttcttgggagcgccagttccgtctgtgtgttcgagtggacaaaatggcgaagatcgccaagactcacgaagatattgaagcacagattcgagaaattcaaggcaagaaggcagctcttgatgaagctcaaggagtgggcctcgattctacaggttattatgaccaggaaatttatggtggaagtgacagcagatttgctggatacgtgacatcaattgctgcaactgaacttgaagatgatgacgatgactattcatcatctacgagtttgcttggtcagaagaagccaggatatcatgcccctgtggcattgcttaatgatataccacagtcaacagaacagtatgatccatttgctgagcacagacctccaaagattgcagaccgggaagatgaatacaaaaagcataggcggaccatgataatttccccagagcgtcttgatccttttgcagatggcttctattctgctgcttgaagtcagaactgctgatggagacaaaggcacgaaagtgtacgtattccggattagcaacccaggaacccatcacttctgaagactctaaactgtgctgtcattttgtttttatatgcattaaaatatttgtttta

SEQ ID NO: 427419 - DNA, 1525 bp, Homo sapiens
agcggaagttcttgggagcgccagttccgtctgtgtgttcgagtggacaaaatggcgaagatcgccaagactcacgaagatattgaagcacagattcgagaaattcaaggcaagaaggcagctcttgatgaagctcaaggagtgggcctcgattctacaggttattatgaccaggaaatttatggtggaagtgacagcagatttgctggatacgtgacatcaattgctgcaactgaacttgaagatgatgacgatgactattcatcatctacgagtttgcttggtcagaagaagccaggatatcatgcccctgtggcattgcttaatgatataccacagtcaacagaacagtatgatccatttgctgagcacagacctccaaagattgcagaccgggaagatgaatacaaaaagcataggcggaccatgataatttccccagagcgtcttgatccttttgcagatggagggaagacccctgatcctaaaatgaatgctaggacttacatggatgtaatgcgagaacaacacttgactaaagaagaacgagaaattaggcaacagctagcagaaaaagctaaagctggagaactaaaagtcgtcaatggagcagcagcgtcccagcctccatcaaaacgaaaacggcgttgggatcaaacagctgatcagactcctggtgccactcccaaaaaactatcaagttgggatcaggcagagacccctgggcatactccttccttaagatgggatgagacaccaggtcgtgcaaagggaagcgagactcctggagcaaccccaggctcaaaaatatgggatcctacacctagccacacaccagcgggagctgctactcctggacgaggtgatacaccaggccatgcgacaccaggccatggaggcgcaacttccagtgctcgtaaaaacagatgggatgaaacccccaaaacagagagagatactcctgggcatggaagtggatgggctgagactcctcgaacagatcgaggtggagattctattggtgaaacaccgactcctggagccagtaaaagaaaatcacggtgggatgaaacaccagctagtcagatgggtggaagcactccagttctgacccctggaaagacaccaattggcacaccagccatgaacatggctacccctactccaggtcacataatgagtatgactcctgaacagcttcaggcttggcggtgggaaagagaaattgatgagagaaatcgcccactttctgatgaggaattagatgctatgttcccagaaggatataaggtacttcctcctccagctggttatgttcctattcgaactccagctcgaaagctgacagctactccaacacctttgggtggtatgactggtttccacatgcaaactgaagatcgaactatgaaaagtgttaatgaccagccatctggaaatcttccatttttaaaacctgatgatattcaatactttgataaactattggttgatgttgatgaatcaacacttagtccagaagagc

SEQ ID NO: 427420 - DNA, 2289 bp, Homo sapiens
caccagaatgcttgagttgtttttttcttctgtaaaatcaccttggacccaaccaggacaccaggtccaggaatctgagttgttgagttttacatgatttaagtttgtaatgaaaatttctttcatctagtaaaggtaattactattcaatattattatgtccagaagtgtatatatgctgagtttcattctagctaagaatagaaagtagaataaaaggagactaggtttttatttgacctttgaacaaagacagtagatccctgatactgagtgactctttaagagtggccactcatcaacacctatgggctgattcagagaaacaggaaggtagaaattaagaagagattctttacctgaaatcttgccagagatggcagtcccgctactgttctgtgccttctgctgaaaagggcatggaaagattgctgccactcttactctatagtcattacaggaaagccatcctttctaccagagagatgactttttctatttgagtttcaccttgggagttgcacattatttgcaaggaagtatttcaaatcttatcttgttctaatgtataaacaggaaaaaaaaaaaagaatgtaagagaaaaaaaaaaacaggaggaggatgagcagaatgatggcggtggtatttatcaaacttggccctgaaggatgccgctagcgtctcccatccagcaccatgaagtcaccaggggtgtggctccctccatggctctcagagatggcgtatgcagaatcccactttctgccgagtttacagctcagtgcactgattcccaggctcctcaaatgaagagagctcccagatgctgctgtcttgcagtagtggctcaatgtcctcatcactgccccgttctggggtgttggtcaggctgccgctgctgctgttactgtgtttttgaactccactggctttactgtattcaggaatgaataaggcaaccagaaaagacataaggactatacatgccccaaataaaaacggcgggcctgggatgacagctccctgttgaatgtggaaaacaagtggagacaaagaatacagttagtcttttaactcaaaattattcctagattacccaaaaaaaacacaccaccaaaaagtgaatcatattctcataagcaaatgtttcattaaatgtcaaggcaaactccactagagcttggtgtttggaatatgacaaagggcaactaattaactgctttttgtaccacttccaaatagcttaagcaaaactgtaagcttgtaagcaacagctgtttacctataatcccatcctatgacttcagatcatgcacctttgtacatgaacattaattccagctttgtatagatatggcttagagggaacaagggaagaaatttcaaataaatagtacaaaaagtaccctacctcaatttttagctggatttttaggtcatttcaaattttaactagcctgggcttatccagagaatagtgtagtgattgtgtaggtgaaaacagaatctgaacaaagtttaagacatatcttttacataagatattaaatcactaaaatgacccctccctgatcccgagaagcaatgaacacaatacttattgctgccaaataaaatatagtaacatacaagaaagaatgctctccaaatttaaggtcacaagattttgctataatcatacataattgttgttacaaaactagacttatgaccaaattacctgcaggggaacgttgttagaattcaatttcgggcccaactcagtcagttccacatggaacatgtagaatgttgcaatattgtttacagggtctgtttcacccagcccggaaagtcagagatgtatattggaaaatttacaactccatctacattggttcccaggacgctctcatagcacattacccaagaatctacaacgatgataagaacacctatattcgttatgaacttgactatatcttataattttattgtttattttgtgtttaatgcacagctacttcacaccttaaacttgctttgatttggtgatgtaaacttttaaacattgcagatcagtgtagaactggtcatagaggaagagctagaaatccagtagcatgatttttaaataacctgtctttgtttttgatgttaaacagtaaatgccagtagtgaccaagaacacagtgattatatacactatactggagggatttcatttttaattcatctttatgaagatttagaactcattccttgtgtttaaagggaatgtttaattgagaaataaacatttgtgtacaa

SEQ ID NO: 427421 - DNA, 890 bp, Homo sapiens
  misc_feature (890)..(890): n is a, c, g, or t
tgtagatccccatgttatccccaacaccaggttcagctgcctgtgaagtcatttgtttcgtgttcatttcctagttactggtatttttttaatcattaaaaatgtttttaaattattgatagtaattgtacgtatttgtagggtgcatgtgtgcagtgggtgatgatcagatcggggtgcatgtgtgcagtgggtgatgatcagattggggttaatggcagagccacctcacagttactgttttgtgttgggcgataacattatccccaacacagaggaaagggtttggctgctttcttgaaggctattgggtatcttattcctcttatggatgcagaatatgccaactactatactagagaagtgatgttaatccttattcgagaattccagtctcctgatgaggaaatgaaaaaaattgtgctgaaggtggtaaaacagtgttgtgggacagatggtgtagaagcaaactacattaaaacagagattcttcctcccttttttaaacacttctggcagcacaggatggctttggatagaagaaattaccgacagttagttgatactactgtggagttggcaaacaaagtaggtgcagcagaaattatatccaggattgtggatgatctgaaagatgaagccgaacagtacagaaaaatggtgatgggcgataaatcacgtgatgttatcgcccaacaccaagaacaagcgatgtttgcttttaactgagggcaaagtaacttgcccactcgtgcagagagagccaggggtgggaccctaggccggtctggctctaaagctggtaccttccttgttgtggccgttagtcataaatgtgaacaggtgagaacagctaaccgcaatcttggtcatactgtgttggggagtan

SEQ ID NO: 427422 - DNA, 606 bp, Homo sapiens
  misc_feature (462)..(462): n is a, c, g, or t
  misc_feature (475)..(475): n is a, c, g, or t
tcagtcggtaccgatgtttcgctcaaacgtggtgaagcaagtttgagcctccctcttgtgggcggttccttggctgggatgatgattactggtctgtggaccccttggacagggccatggctgagctggctgcctgaggaggggcagggcccacccatgtcaccggtcagtgccttttggaactgtccttccctcaaagaggccttagagcgagcagagcagctctgctatgagtgtggggagtgttagaggatccccgtgatgttatcgcccaacacagaggaaagggtttggctgctttcttgaaggctattgggtatcttattcctcttatggatgcagaatatgccaactactatactagagaagtgatgttaatccttattcgagaattccagtctcctgatgaggaaatgaaaaaaattgtgctgaaggtggtaaaacagtgttggggatagtgtnggggataacatantatttatccccaacacgcacattgaaaacaaacaaaatgtcagttttacttttcacttaatatcttggatgaaacagcaaaaaaaattttttttattaagtgtggggcgataacatcacggggatcctcta

SEQ ID NO: 427423 - DNA, 510 bp, Homo sapiens
taggaatattctattttagaacttgatagttttgagtataactgtttgagaataaagaatattattttaacagtgattaaaattgtggttttactcactctttctttttaaagatactcctgggcatggaagtggatgggctgagactcctcgaacagatcgaggtggagattctattggtgaaacaccgactcctggagccagtaaaagaaaatcacggtgggatgaaacaccagctagtcagatgggtggaagcactccagttctgacccctggaaagacaccaattggcacaccagccatgaacatggctacccctactccaggtcacataatgagtatgactcctgaacagcttcaggcttggcggtgggaaagagaaattgatgagagaaatcgcccactttctgatgaggaattagatgctatgttcccagaaggatataaggtagtacatcaaatttgaatgaggtggtatttaggatatacatttattttaaatagtgaaaa

SEQ ID NO: 427424 - DNA, 475 bp, Homo sapiens
atacataatcaaaaattgttaataaaagttaaaaacgattctgagtctggtcagaatctggggctttctctttccctaggcagctgtaagtttatatttatacatagtcatatatgacattgctaagtaaaaggaaagtgaacaaaagttgcaattcaaatgttgatagtttattgacttctattaaataggtatgcataagatgactccaccaattaaagatctgctgcctagactcacccccatcttaaagaacagacatgaaaaagtacaagagaattgtattgatcttgttggtcgtattgctgacaggggagctgaatatgtatctgcaagagagtggatgaggatttgctttgagcttttagagctcttaaaagcccacaaaaaggctattcgtagagccacagtcaacacatttggttatattgcaaaggccattgggtgagtgttatttacttccattaaaaaaaaa

SEQ ID NO: 427425 - DNA, 325 bp, Homo sapiens
  misc_feature (37)..(38): n is a, c, g, or t
gcggccgcctactactactaaattcgcggccgcgtcnnccgcccactttctgatgaggaattagatgctatgttcccagaaggatataaggtacttcctcctccagctggttatgttcctattcgaactccagctcgaaagctgacagctactccaacacctttgggtggtatgactggtttccacatgcaaactgaagatcgaactatgaaaagtgttaatgaccagccatctggaaatcttccatttttaaaacctgatgatattcaatactttgataaactattggttgatgttgatgaatcaacacttagtccagaagagc

SEQ ID NO: 427426 - DNA, 546 bp, Homo sapiens
aaagcaaatactgaaactttaaccaagagactgacacatctctttgtacaccacgttgcttctgtgtgcatcataataactggtagaagtaatatatttaaagtaatatgtttccagttttaatttatgctttctaagaaataaaaatatgttttctgggtcaacaaaacttaaagcatgaagccctttttagtaacgtgacatcagaataagattataggtatatttttaaaatcagattttctaaactacaattgttttagaacactgtatgaagaacttatctagtcatagttatttgtagtcaggattttaacagcttgcaacaggtaatgttttgaatataaatatctttccaaagtgttactaatggtaaagagataattttctaggcttctattctgctgcttgaagtcagaactgctgatggagacaaaggcacgaaagtgtacgtattccggattagcaacccaggaacccatcacttctgaagactctaaactgtgctgtcattttgtttttatatgcattaaaatatttgtttta

SEQ ID NO: 427427 - DNA, 5123 bp, Homo sapiens
aaagcaaatactgaaactttaaccaagagactgacacatctctttgtacaccacgttgcttctgtgtgcatcataataactggtagaagtaatatatttaaagtaatatgtttccagttttaatttatgctttctaagaaataaaaatatgttttctgggtcaacaaaacttaaagcatgaagccctttttagtaacgtgacatcagaataagattataggtatatttttaaaatcagattttctaaactacaattgttttagaacactgtatgaagaacttatctagtcatagttatttgtagtcaggattttaacagcttgcaacaggtaatgttttgaatataaatatctttccaaagtgttactaatggtaaagagataattttctaggcttctattctgctgcttgaagtcagaactgctgatggagacaaaggcacgaaagtgtacgtattccggattagcaacccaggaacccatcacttctgaagactctaaactgtgctgtcattttgtttttatatgcattaaaatatttgttttaaactgctgtagatgtttgtgttcaaacaggttaaattgatcagcaaactcaataaaaagtaagatgtataattattaaagttttccatcaaaaaataatttaaatgattatggaataacataatatttagagcagggcagataaatcagttgaacctgcttattttttatttattgtactctttttcctgttgctgttcttttctgcaggagagggaagacccctgatcctaaaatgaatgctaggacttacatggatgtaatgcgagaacaacacttgactaaagaagaacgagaaattaggcaacagctagcagaaaaagctaaagctggagaactaaaagtcgtcaatggagcagcagcgtcccagcctccatcaaaacgaaaacggcgttgggatcaaacagctgatcagactcctggtgccactcccaaaaaactatcaagttgggatcaggcagagacccctgggcatactccttccttaagatgggatgagacaccaggtcgtgcaaagggaagcgagactcctggagcaaccccaggctcaaaaatatgggatcctacacctagccacacaccagcgggagctgctactcctggacgaggtgatacaccaggccatgcgacaccaggccatggaggcgcaacttccagtgctcgtaaaaacagatgggatgaaacccccaaaacagagagagatactcctgggcatggaagtggatgggctgagactcctcgaacagatcgaggtggagattctattggtgaaacaccgactcctggagccagtaaaagaaaatcacggtgggatgaaacaccagctagtcagatgggtggaagcactccagttctgacccctggaaagacaccaattggcacaccagccatgaacatggctacccctactccaggtcacataatgagtatgactcctgaacagcttcaggcttggcggtgggaaagagaaattgatgagagaaatcgcccactttctgatgaggaattagatgctatgttcccagaaggatataaggtacttcctcctccagctggttatgttcctattcgaactccagctcgaaagctgacagctactccaacacctttgggtggtatgactggtttccacatgcaaactgaagatcgaactatgaaaagtgttaatgaccagccatctggaaatcttccatttttaaaacctgatgatattcaatactttgataaactattggttgatgttgatgaatcaacacttagtccagaagagcaaaaagagagaaaaataatgaagttgcttttaaaaattaagaatggaacaccaccaatgagaaaggctgcattgcgtcagattactgataaagctcgtgaatttggagctggtcctttgtttaatcagattcttcctctgctgatgtctcctacacttgaggatcaagagcgtcatttacttgtgaaagttattgataggatactgtacaaacttgatgacttagttcgtccatatgtgcataagatcctcgtggtcattgaaccgctattgattgatgaagattactatgctagagtggaaggccgagagatcatttctaatttggcaaaggctgctggtctggctactatgatctctaccatgagacctgatatagataacatggatgagtatgtccgtaacacaacagctagagcttttgctgttgtagcctctgccctgggcattccttctttattgcccttcttaaaagctgtgtgcaaaagcaagaagtcctggcaagcgagacacactggtattaagattgtacaacagatagctattcttatgggctgtgccatcttgccacatcttagaagtttagttgaaatcattgaacatggtcttgtggatgagcagcagaaagttcggaccatcagtgctttggccattgctgccttggctgaagcagcaactccttatggtatcgaatcttttgattctgtgttaaagcctttatggaagggtatccgccaacacagaggaaagggtttggctgctttcttgaaggctattgggtatcttattcctcttatggatgcagaatatgccaactactatactagagaagtgatgttaatccttattcgagaattccagtctcctgatgaggaaatgaaaaaaattgtgctgaaggtggtaaaacagtgttgtgggacagatggtgtagaagcaaactacattaaaacagagattcttcctcccttttttaaacacttctggcagcacaggatggctttggatagaagaaattaccgacagttagttgatactactgtggagttggcaaacaaagtaggtgcagcagaaattatatccaggattgtggatgatctgaaagatgaagccgaacagtacagaaaaatggtgatggagacaattgagaaaattatgggcaatttgggagcagcagatattgatcataaacttgaagaacaactgattgatggtattctttatgctttccaagaacagactacagaggactcagtaatgttgaacggctttggcacagtggttaatgctcttggcaaacgagtcaaaccatacttgcctcagatctgtggtacagttttgtggcgtttaaataacaaatctgctaaagttaggcaacaggcagctgacttgatttctcgaactgctgttgtcatgaagacttgtcaagaggaaaaattgatgggacacttgggtgttgtattgtatgagtatttgggtgaagagtaccctgaagtattgggcagcattcttggagcactgaaggccattgtaaatgtcataggtatgcataagatgactccaccaattaaagatctgctgcctagactcacccccatcttaaagaacagacatgaaaaagtacaagagaattgtattgatcttgttggtcgtattgctgacaggggagctgaatatgtatctgcaagagagtggatgaggatttgctttgagcttttagagctcttaaaagcccacaaaaaggctattcgtagagccacagtcaacacatttggttatattgcaaaggccattggccctcatgatgtattggctacacttctgaacaacctcaaagttcaagaaaggcagaacagagtttgtaccactgtagcaatagctattgttgcagaaacatgttcaccctttacagtactccctgccttaatgaatgaatacagagttcctgaactgaatgttcaaaatggagtgttaaaatcgctttccttcttgtttgaatatattggtgaaatgggaaaagactacatttatgccgtaacaccgttacttgaagatgctttaatggatagagaccttgtacacagacagacggctagtgcagtggtacagcacatgtcacttggggtttatggatttggttgtgaagattcgctgaatcacttgttgaactatgtatggcccaatgtgtttgagacatctcctcatgtaattcaggcagttatgggagccctagagggcctgagagttgctattggaccatgtagaatgttgcaatattgtttacagggtctgtttcacccagcccggaaagtcagagatgtatattggaaaatttacaactccatctacattggttcccaggacgctctcatagcacattacccaagaatctacaacgatgataagaacacctatattcgttatgaacttgactatatcttataattttattgtttattttgtgtttaatgcacagctacttcacaccttaaacttgctttgatttggtgatgtaaacttttaaacattgcagatcagtgtagaactggtcatagaggaagagctagaaatccagtagcatgatttttaaataacctgtctttgtttttgatgttaaacagtaaatgccagtagtgaccaagaacacagtgattatatacactatactggagggatttcatttttaattcatctttatgaagatttagaactcattccttgtgtttaaagggaatgtttaattgagaaataaacatttgtgtacaaaatgctaaaaaaaccagacgaactgttagcaaaccaagcaacaccactcaacaaatataacccgtctacctcccttgaacatcatgctcacaagaagcccccccatcaaccctcacccacacacgccgtcccaaaccacgacccccccccgagcccggcccacacaccccccccccccgcgccccctccaccccccccccaacgcggcaagaccgcactccagcacaaactagcgaaccagcaaaaccacacccccccggcggcaccacaaacgcgccgaatcgaccgccacagccaacgcccctcagctcccgcacaccccatcgtgcgacagctcacacaccaacccacccccacgtccccacacgatgcgccacgcatacactttagacgatgatcactgaccgcgcacaacgcctccgcacgacccccaccactcatacacacccaccgcgcactaccccccacccacaccatcccaccacagaccccccagcgccaccccacccgcgcacacaccacccccaccccacactaccaccacc

SEQ ID NO: 427428 - DNA, 4652 bp, Homo sapiens
agcggaagttcttgggagcgccagttccgtctgtgtgttcgagtggacaaaatggcgaagatcgccaagactcacgaagatattgaagcacagattcgagaaattcaaggcaagaaggcagctcttgatgaagctcaaggagtgggcctcgattctacaggttattatgaccaggaaatttatggtggaagtgacagcagatttgctggatacgtgacatcaattgctgcaactgaacttgaagatgatgacgatgactattcatcatctacgagtttgcttggtcagaagaagccaggatatcatgcccctgtggcattgcttaatgatataccacagtcaacagaacagtatgatccatttgctgagcacagacctccaaagattgcagaccgggaagatgaatacaaaaagcataggcggaccatgataatttccccagagcgtcttgatccttttgcagatggcttctattctgctgcttgaagtcagaactgctgatggagacaaaggcacgaaagtgtacgtattccggattagcaacccaggaacccatcacttctgaagactctaaactgtgctgtcattttgtttttatatgcattaaaatatttgttttaaactgctgtagatgtttgtgttcaaacaggttaaattgatcagcaaactcaataaaaagtaagatgtataattattaaagttttccatcaaaaaataatttaaatgattatggaataacataatatttagagcagggcagataaatcagttgaacctgcttattttttatttattgtactctttttcctgttgctgttcttttctgcaggagagggaagacccctgatcctaaaatgaatgctaggacttacatggatgtaatgcgagaacaacacttgactaaagaagaacgagaaattaggcaacagctagcagaaaaagctaaagctggagaactaaaagtcgtcaatggagcagcagcgtcccagcctccatcaaaacgaaaacggcgttgggatcaaacagctgatcagactcctggtgccactcccaaaaaactatcaagttgggatcaggcagagacccctgggcatactccttccttaagatgggatgagacaccaggtcgtgcaaagggaagcgagactcctggagcaaccccaggctcaaaaatatgggatcctacacctagccacacaccagcgggagctgctactcctggacgaggtgatacaccaggccatgcgacaccaggccatggaggcgcaacttccagtgctcgtaaaaacagatgggatgaaacccccaaaacagagagagatactcctgggcatggaagtggatgggctgagactcctcgaacagatcgaggtggagattctattggtgaaacaccgactcctggagccagtaaaagaaaatcacggtgggatgaaacaccagctagtcagatgggtggaagcactccagttctgacccctggaaagacaccaattggcacaccagccatgaacatggctacccctactccaggtcacataatgagtatgactcctgaacagcttcaggcttggcggtgggaaagagaaattgatgagagaaatcgcccactttctgatgaggaattagatgctatgttcccagaaggatataaggtacttcctcctccagctggttatgttcctattcgaactccagctcgaaagctgacagctactccaacacctttgggtggtatgactggtttccacatgcaaactgaagatcgaactatgaaaagtgttaatgaccagccatctggaaatcttccatttttaaaacctgatgatattcaatactttgataaactattggttgatgttgatgaatcaacacttagtccagaagagcaaaaagagagaaaaataatgaagttgcttttaaaaattaagaatggaacaccaccaatgagaaaggctgcattgcgtcagattactgataaagctcgtgaatttggagctggtcctttgtttaatcagattcttcctctgctgatgtctcctacacttgaggatcaagagcgtcatttacttgtgaaagttattgataggatactgtacaaacttgatgacttagttcgtccatatgtgcataagatcctcgtggtcattgaaccgctattgattgatgaagattactatgctagagtggaaggccgagagatcatttctaatttggcaaaggctgctggtctggctactatgatctctaccatgagacctgatatagataacatggatgagtatgtccgtaacacaacagctagagcttttgctgttgtagcctctgccctgggcattccttctttattgcccttcttaaaagctgtgtgcaaaagcaagaagtcctggcaagcgagacacactggtattaagattgtacaacagatagctattcttatgggctgtgccatcttgccacatcttagaagtttagttgaaatcattgaacatggtcttgtggatgagcagcagaaagttcggaccatcagtgctttggccattgctgccttggctgaagcagcaactccttatggtatcgaatcttttgattctgtgttaaagcctttatggaagggtatccgccaacacagaggaaagggtttggctgctttcttgaaggctattgggtatcttattcctcttatggatgcagaatatgccaactactatactagagaagtgatgttaatccttattcgagaattccagtctcctgatgaggaaatgaaaaaaattgtgctgaaggtggtaaaacagtgttgtgggacagatggtgtagaagcaaactacattaaaacagagattcttcctcccttttttaaacacttctggcagcacaggatggctttggatagaagaaattaccgacagttagttgatactactgtggagttggcaaacaaagtaggtgcagcagaaattatatccaggattgtggatgatctgaaagatgaagccgaacagtacagaaaaatggtgatggagacaattgagaaaattatgggcaatttgggagcagcagatattgatcataaacttgaagaacaactgattgatggtattctttatgctttccaagaacagactacagaggactcagtaatgttgaacggctttggcacagtggttaatgctcttggcaaacgagtcaaaccatacttgcctcagatctgtggtacagttttgtggcgtttaaataacaaatctgctaaagttaggcaacaggcagctgacttgatttctcgaactgctgttgtcatgaagacttgtcaagaggaaaaattgatgggacacttgggtgttgtattgtatgagtatttgggtgaagagtaccctgaagtattgggcagcattcttggagcactgaaggccattgtaaatgtcataggtatgcataagatgactccaccaattaaagatctgctgcctagactcacccccatcttaaagaacagacatgaaaaagtacaagagaattgtattgatcttgttggtcgtattgctgacaggggagctgaatatgtatctgcaagagagtggatgaggatttgctttgagcttttagagctcttaaaagcccacaaaaaggctattcgtagagccacagtcaacacatttggttatattgcaaaggccattggccctcatgatgtattggctacacttctgaacaacctcaaagttcaagaaaggcagaacagagtttgtaccactgtagcaatagctattgttgcagaaacatgttcaccctttacagtactccctgccttaatgaatgaatacagagttcctgaactgaatgttcaaaatggagtgttaaaatcgctttccttcttgtttgaatatattggtgaaatgggaaaagactacatttatgccgtaacaccgttacttgaagatgctttaatggatagagaccttgtacacagacagacggctagtgcagtggtacagcacatgtcacttggggtttatggatttggttgtgaagattcgctgaatcacttgttgaactatgtatggcccaatgtgtttgagacatctcctcatgtaattcaggcagttatgggagccctagagggcctgagagttgctattggaccatgtagaatgttgcaatattgtttacagggtctgtttcacccagcccggaaagtcagagatgtatattggaaaatttacaactccatctacattggttcccaggacgctctcatagcacattacccaagaatctacaacgatgataagaacacctatattcgttatgaacttgactatatcttataattttattgtttattttgtgtttaatgcacagctacttcacaccttaaacttgctttgatttggtgatgtaaacttttaaacattgcagatcagtgtagaactggtcatagaggaagagctagaaatccagtagcatgatttttaaataacctgtctttgtttttgatgttaaacagtaaatgccagtagtgaccaagaacacagtgattatatacactatactggagggatttcatttttaattcatctttatgaagatttagaactcattccttgtgtttaaagggaatgtttaattgagaaataaacatttgtgtacaa

SEQ ID NO: 427429 - DNA, 3809 bp, Homo sapiens
gaggttgatctagaggatcccgtccactgttcgatacggtgggatgaaacaccagctagtcagatgggtggaagcactccagttctgacccctggaaagacaccaattggcacaccagccatgaacatggctacccctactccaggtcacataatgagtatgactcctgaacagcttcaggcttggcggtgggaaagagaaattgatgagagaaatcgcccactttctgatgaggaattagatgctatgttcccagaaggatataaggtacttcctcctccagctggttatgttcctattcgaactccagctcgaaagctgacagctactccaacacctttgggtggtatgactggtttccacatgcaaactgaagatcgaactatgaaaagtgttaatgaccagccatctggaaatcttccatttttaaaacctgatgatattcaatactttgataaactattggttgatgttgatgaatcaacacttagtccagaagagcaaaaagagagaaaaataatgaagttgcttttaaaaattaagaatggaacaccaccaatgagaaaggctgcattgcgtcagattactgataaagctcgtgaatttggagctggtcctttgtttaatcagattcttcctctgctgatgtctcctacacttgaggatcaagagcgtcatttacttgtgaaagttattgataggatactgtacaaacttgatgacttagttcgtccatatgtgcataagatcctcgtggtcattgaaccgctattgattgatgaagattactatgctagagtggaaggccgagagatcatttctaatttggcaaaggctgctggtctggctactatgatctctaccatgagacctgatatagataacatggatgagtatgtccgtaacacaacagctagagcttttgctgttgtagcctctgccctgggcattccttctttattgcccttcttaaaagctgtgtgcaaaagcaagaagtcctggcaagcgagacacactggtattaagattgtacaacagatagctattcttatgggctgtgccatcttgccacatcttagaagtttagttgaaatcattgaacatggtcttgtggatgagcagcagaaagttcggaccatcagtgctttggccattgctgccttggctgaagcagcaactccttatggtatcgaatcttttgattctgtgttaaagcctttatggaagggtatccgccaacacagaggaaagggtttggctgctttcttgaaggctattgggtatcttattcctcttatggatgcagaatatgccaactactatactagagaagtgatgttaatccttattcgagaattccagtctcctgatgaggaaatgaaaaaaattgtgctgaaggtggtaaaacagtgttgtgggacagatggtgtagaagcaaactacattaaaacagagattcttcctcccttttttaaacacttctggcagcacaggatggctttggatagaagaaattaccgacagttagttgatactactgtggagttggcaaacaaagtaggtgcagcagaaattatatccaggattgtggatgatctgaaagatgaagccgaacagtacagaaaaatggtgatggagacaattgagaaaattatgggcaatttgggagcagcagatattgatcataaacttgaagaacaactgattgatggtattctttatgctttccaagaacagactacagaggactcagtaatgttgaacggctttggcacagtggttaatgctcttggcaaacgagtcaaaccatacttgcctcagatctgtggtacagttttgtggcgtttaaataacaaatctgctaaagttaggcaacaggcagctgacttgatttctcgaactgctgttgtcatgaagacttgtcaagaggaaaaattgatgggacacttgggtgttgtattgtatgagtatttgggtgaagagtaccctgaagtattgggcagcattcttggagcactgaaggccattgtaaatgtcataggtatgcataagatgactccaccaattaaagatctgctgcctagactcacccccatcttaaagaacagacatgaaaaagtacaagagaattgtattgatcttgttggtcgtattgctgacaggggagctgaatatgtatctgcaagagagtggatgaggatttgctttgagcttttagagctcttaaaagcccacaaaaaggctattcgtagagccacagtcaacacatttggttatattgcaaaggccattggccctcatgatgtattggctacacttctgaacaacctcaaagttcaagaaaggcagaacagagtttgtaccactgtagcaatagctattgttgcagaaacatgttcaccctttacagtactccctgccttaatgaatgaatacagagttcctgaactgaatgttcaaaatggagtgttaaaatcgctttccttcttgtttgaatatattggtgaaatgggaaaagactacatttatgccgtaacaccgttacttgaagatgctttaatggatagagaccttgtacacagacagacggctagtgcagtggtacagcacatgtcacttggggtttatggatttggttgtgaagattcgctgaatcacttgttgaactatgtatggcccaatgtgtttgagacatctcctcatgtaattcaggcagttatgggagccctagagggcctgagagttgctattggaccatgtagaatgttgcaatattgtttacagggtctgtttcacccagcccggaaagtcagagatgtatattggaaaatttacaactccatctacattggttcccaggacgctctcatagcacattacccaagaatctacaacgatgataagaacacctatattcgttatgaacttgactatatcttataattttattgtttattttgtgtttaatgcacagctacttcacaccttaaacttgctttgatttggtgatgtaaacttttaaacattgcagatcagtgtagaactggtcatagaggaagagctagaaatccagtagcatgatttttaaataacctgtctttgtttttgatgttaaacagtaaatgccagtagtgaccaagaacacagtgattatatacactatactggagggatttcatttttaattcatctttatgaagatttagaactcattccttgtgtttaaagggaatgtttaattgagaaataaacatttgtgtacaaaatgctaaaaaaaccagacgaactgttagcaaaccaagcaacaccactcaacaaatataacccgtctacctcccttgaacatcatgctcacaagaagcccccccatcaaccctcacccacacacgccgtcccaaaccacgacccccccccgagcccggcccacacaccccccccccccgcgccccctccaccccccccccaacgcggcaagaccgcactccagcacaaactagcgaaccagcaaaaccacacccccccggcggcaccacaaacgcgccgaatcgaccgccacagccaacgcccctcagctcccgcacaccccatcgtgcgacagctcacacaccaacccacccccacgtccccacacgatgcgccacgcatacactttagacgatgatcactgaccgcgcacaacgcctccgcacgacccccaccactcatacacacccaccgcgcactaccccccacccacaccatcccaccacagaccccccagcgccaccccacccgcgcacacaccacccccaccccacactaccaccacc

SEQ ID NO: 427430 - DNA, 2845 bp, Homo sapiens
tcagtcggtaccgatgtttcgctcaaacgtggtgaagcaagtttgagcctccctcttgtgggcggttccttggctgggatgatgattactggtctgtggaccccttggacagggccatggctgagctggctgcctgaggaggggcagggcccacccatgtcaccggtcagtgccttttggaactgtccttccctcaaagaggccttagagcgagcagagcagctctgctatgagtgtggggagtgttagaggatccccgtgatgttatcgcccaacacagaggaaagggtttggctgctttcttgaaggctattgggtatcttattcctcttatggatgcagaatatgccaactactatactagagaagtgatgttaatccttattcgagaattccagtctcctgatgaggaaatgaaaaaaattgtgctgaaggtggtaaaacagtgttgtgggacagatggtgtagaagcaaactacattaaaacagagattcttcctcccttttttaaacacttctggcagcacaggatggctttggatagaagaaattaccgacagttagttgatactactgtggagttggcaaacaaagtaggtgcagcagaaattatatccaggattgtggatgatctgaaagatgaagccgaacagtacagaaaaatggtgatggagacaattgagaaaattatgggcaatttgggagcagcagatattgatcataaacttgaagaacaactgattgatggtattctttatgctttccaagaacagactacagaggactcagtaatgttgaacggctttggcacagtggttaatgctcttggcaaacgagtcaaaccatacttgcctcagatctgtggtacagttttgtggcgtttaaataacaaatctgctaaagttaggcaacaggcagctgacttgatttctcgaactgctgttgtcatgaagacttgtcaagaggaaaaattgatgggacacttgggtgttgtattgtatgagtatttgggtgaagagtaccctgaagtattgggcagcattcttggagcactgaaggccattgtaaatgtcataggtatgcataagatgactccaccaattaaagatctgctgcctagactcacccccatcttaaagaacagacatgaaaaagtacaagagaattgtattgatcttgttggtcgtattgctgacaggggagctgaatatgtatctgcaagagagtggatgaggatttgctttgagcttttagagctcttaaaagcccacaaaaaggctattcgtagagccacagtcaacacatttggttatattgcaaaggccattggccctcatgatgtattggctacacttctgaacaacctcaaagttcaagaaaggcagaacagagtttgtaccactgtagcaatagctattgttgcagaaacatgttcaccctttacagtactccctgccttaatgaatgaatacagagttcctgaactgaatgttcaaaatggagtgttaaaatcgctttccttcttgtttgaatatattggtgaaatgggaaaagactacatttatgccgtaacaccgttacttgaagatgctttaatggatagagaccttgtacacagacagacggctagtgcagtggtacagcacatgtcacttggggtttatggatttggttgtgaagattcgctgaatcacttgttgaactatgtatggcccaatgtgtttgagacatctcctcatgtaattcaggcagttatgggagccctagagggcctgagagttgctattggaccatgtagaatgttgcaatattgtttacagggtctgtttcacccagcccggaaagtcagagatgtatattggaaaatttacaactccatctacattggttcccaggacgctctcatagcacattacccaagaatctacaacgatgataagaacacctatattcgttatgaacttgactatatcttataattttattgtttattttgtgtttaatgcacagctacttcacaccttaaacttgctttgatttggtgatgtaaacttttaaacattgcagatcagtgtagaactggtcatagaggaagagctagaaatccagtagcatgatttttaaataacctgtctttgtttttgatgttaaacagtaaatgccagtagtgaccaagaacacagtgattatatacactatactggagggatttcatttttaattcatctttatgaagatttagaactcattccttgtgtttaaagggaatgtttaattgagaaataaacatttgtgtacaaaatgctaaaaaaaccagacgaactgttagcaaaccaagcaacaccactcaacaaatataacccgtctacctcccttgaacatcatgctcacaagaagcccccccatcaaccctcacccacacacgccgtcccaaaccacgacccccccccgagcccggcccacacaccccccccccccgcgccccctccaccccccccccaacgcggcaagaccgcactccagcacaaactagcgaaccagcaaaaccacacccccccggcggcaccacaaacgcgccgaatcgaccgccacagccaacgcccctcagctcccgcacaccccatcgtgcgacagctcacacaccaacccacccccacgtccccacacgatgcgccacgcatacactttagacgatgatcactgaccgcgcacaacgcctccgcacgacccccaccactcatacacacccaccgcgcactaccccccacccacaccatcccaccacagaccccccagcgccaccccacccgcgcacacaccacccccaccccacactaccaccacc

SEQ ID NO: 427431 - DNA, 2840 bp, Homo sapiens
tgtagatccccatgttatccccaacaccaggttcagctgcctgtgaagtcatttgtttcgtgttcatttcctagttactggtatttttttaatcattaaaaatgtttttaaattattgatagtaattgtacgtatttgtagggtgcatgtgtgcagtgggtgatgatcagatcggggtgcatgtgtgcagtgggtgatgatcagattggggttaatggcagagccacctcacagttactgttttgtgttgggcgataacattatccccaacacagaggaaagggtttggctgctttcttgaaggctattgggtatcttattcctcttatggatgcagaatatgccaactactatactagagaagtgatgttaatccttattcgagaattccagtctcctgatgaggaaatgaaaaaaattgtgctgaaggtggtaaaacagtgttgtgggacagatggtgtagaagcaaactacattaaaacagagattcttcctcccttttttaaacacttctggcagcacaggatggctttggatagaagaaattaccgacagttagttgatactactgtggagttggcaaacaaagtaggtgcagcagaaattatatccaggattgtggatgatctgaaagatgaagccgaacagtacagaaaaatggtgatggagacaattgagaaaattatgggcaatttgggagcagcagatattgatcataaacttgaagaacaactgattgatggtattctttatgctttccaagaacagactacagaggactcagtaatgttgaacggctttggcacagtggttaatgctcttggcaaacgagtcaaaccatacttgcctcagatctgtggtacagttttgtggcgtttaaataacaaatctgctaaagttaggcaacaggcagctgacttgatttctcgaactgctgttgtcatgaagacttgtcaagaggaaaaattgatgggacacttgggtgttgtattgtatgagtatttgggtgaagagtaccctgaagtattgggcagcattcttggagcactgaaggccattgtaaatgtcataggtatgcataagatgactccaccaattaaagatctgctgcctagactcacccccatcttaaagaacagacatgaaaaagtacaagagaattgtattgatcttgttggtcgtattgctgacaggggagctgaatatgtatctgcaagagagtggatgaggatttgctttgagcttttagagctcttaaaagcccacaaaaaggctattcgtagagccacagtcaacacatttggttatattgcaaaggccattggccctcatgatgtattggctacacttctgaacaacctcaaagttcaagaaaggcagaacagagtttgtaccactgtagcaatagctattgttgcagaaacatgttcaccctttacagtactccctgccttaatgaatgaatacagagttcctgaactgaatgttcaaaatggagtgttaaaatcgctttccttcttgtttgaatatattggtgaaatgggaaaagactacatttatgccgtaacaccgttacttgaagatgctttaatggatagagaccttgtacacagacagacggctagtgcagtggtacagcacatgtcacttggggtttatggatttggttgtgaagattcgctgaatcacttgttgaactatgtatggcccaatgtgtttgagacatctcctcatgtaattcaggcagttatgggagccctagagggcctgagagttgctattggaccatgtagaatgttgcaatattgtttacagggtctgtttcacccagcccggaaagtcagagatgtatattggaaaatttacaactccatctacattggttcccaggacgctctcatagcacattacccaagaatctacaacgatgataagaacacctatattcgttatgaacttgactatatcttataattttattgtttattttgtgtttaatgcacagctacttcacaccttaaacttgctttgatttggtgatgtaaacttttaaacattgcagatcagtgtagaactggtcatagaggaagagctagaaatccagtagcatgatttttaaataacctgtctttgtttttgatgttaaacagtaaatgccagtagtgaccaagaacacagtgattatatacactatactggagggatttcatttttaattcatctttatgaagatttagaactcattccttgtgtttaaagggaatgtttaattgagaaataaacatttgtgtacaaaatgctaaaaaaaccagacgaactgttagcaaaccaagcaacaccactcaacaaatataacccgtctacctcccttgaacatcatgctcacaagaagcccccccatcaaccctcacccacacacgccgtcccaaaccacgacccccccccgagcccggcccacacaccccccccccccgcgccccctccaccccccccccaacgcggcaagaccgcactccagcacaaactagcgaaccagcaaaaccacacccccccggcggcaccacaaacgcgccgaatcgaccgccacagccaacgcccctcagctcccgcacaccccatcgtgcgacagctcacacaccaacccacccccacgtccccacacgatgcgccacgcatacactttagacgatgatcactgaccgcgcacaacgcctccgcacgacccccaccactcatacacacccaccgcgcactaccccccacccacaccatcccaccacagaccccccagcgccaccccacccgcgcacacaccacccccaccccacactaccaccacc

SEQ ID NO: 427432 - DNA, 1802 bp, Homo sapiens
gagactggagatctgtttgttttgcagttaaagggtatgcataagatgactccaccaattaaagatctgctgcctagactcacccccatcttaaagaacagacatgaaaaagtacaagagaattgtattgatcttgttggtcgtattgctgacaggggagctgaatatgtatctgcaagagagtggatgaggatttgctttgagcttttagagctcttaaaagcccacaaaaaggctattcgtagagccacagtcaacacatttggttatattgcaaaggccattggccctcatgatgtattggctacacttctgaacaacctcaaagttcaagaaaggcagaacagagtttgtaccactgtagcaatagctattgttgcagaaacatgttcaccctttacagtactccctgccttaatgaatgaatacagagttcctgaactgaatgttcaaaatggagtgttaaaatcgctttccttcttgtttgaatatattggtgaaatgggaaaagactacatttatgccgtaacaccgttacttgaagatgctttaatggatagagaccttgtacacagacagacggctagtgcagtggtacagcacatgtcacttggggtttatggatttggttgtgaagattcgctgaatcacttgttgaactatgtatggcccaatgtgtttgagacatctcctcatgtaattcaggcagttatgggagccctagagggcctgagagttgctattggaccatgtagaatgttgcaatattgtttacagggtctgtttcacccagcccggaaagtcagagatgtatattggaaaatttacaactccatctacattggttcccaggacgctctcatagcacattacccaagaatctacaacgatgataagaacacctatattcgttatgaacttgactatatcttataattttattgtttattttgtgtttaatgcacagctacttcacaccttaaacttgctttgatttggtgatgtaaacttttaaacattgcagatcagtgtagaactggtcatagaggaagagctagaaatccagtagcatgatttttaaataacctgtctttgtttttgatgttaaacagtaaatgccagtagtgaccaagaacacagtgattatatacactatactggagggatttcatttttaattcatctttatgaagatttagaactcattccttgtgtttaaagggaatgtttaattgagaaataaacatttgtgtacaaaatgctaaaaaaaccagacgaactgttagcaaaccaagcaacaccactcaacaaatataacccgtctacctcccttgaacatcatgctcacaagaagcccccccatcaaccctcacccacacacgccgtcccaaaccacgacccccccccgagcccggcccacacaccccccccccccgcgccccctccaccccccccccaacgcggcaagaccgcactccagcacaaactagcgaaccagcaaaaccacacccccccggcggcaccacaaacgcgccgaatcgaccgccacagccaacgcccctcagctcccgcacaccccatcgtgcgacagctcacacaccaacccacccccacgtccccacacgatgcgccacgcatacactttagacgatgatcactgaccgcgcacaacgcctccgcacgacccccaccactcatacacacccaccgcgcactaccccccacccacaccatcccaccacagaccccccagcgccaccccacccgcgcacacaccacccccaccccacactaccaccacc

SEQ ID NO: 427433 - DNA, 5143 bp, Homo sapiens
agcggaagttcttgggagcgccagttccgtctgtgtgttcgagtggacaaaatggcgaagatcgccaagactcacgaagatattgaagcacagattcgagaaattcaaggcaagaaggcagctcttgatgaagctcaaggagtgggcctcgattctacaggttattatgaccaggaaatttatggtggaagtgacagcagatttgctggatacgtgacatcaattgctgcaactgaacttgaagatgatgacgatgactattcatcatctacgagtttgcttggtcagaagaagccaggatatcatgcccctgtggcattgcttaatgatataccacagtcaacagaacagtatgatccatttgctgagcacagacctccaaagattgcagaccgggaagatgaatacaaaaagcataggcggaccatgataatttccccagagcgtcttgatccttttgcagatggcttctattctgctgcttgaagtcagaactgctgatggagacaaaggcacgaaagtgtacgtattccggattagcaacccaggaacccatcacttctgaagactctaaactgtgctgtcattttgtttttatatgcattaaaatatttgttttaaactgctgtagatgtttgtgttcaaacaggttaaattgatcagcaaactcaataaaaagtaagatgtataattattaaagttttccatcaaaaaataatttaaatgattatggaataacataatatttagagcagggcagataaatcagttgaacctgcttattttttatttattgtactctttttcctgttgctgttcttttctgcaggagagggaagacccctgatcctaaaatgaatgctaggacttacatggatgtaatgcgagaacaacacttgactaaagaagaacgagaaattaggcaacagctagcagaaaaagctaaagctggagaactaaaagtcgtcaatggagcagcagcgtcccagcctccatcaaaacgaaaacggcgttgggatcaaacagctgatcagactcctggtgccactcccaaaaaactatcaagttgggatcaggcagagacccctgggcatactccttccttaagatgggatgagacaccaggtcgtgcaaagggaagcgagactcctggagcaaccccaggctcaaaaatatgggatcctacacctagccacacaccagcgggagctgctactcctggacgaggtgatacaccaggccatgcgacaccaggccatggaggcgcaacttccagtgctcgtaaaaacagatgggatgaaacccccaaaacagagagagatactcctgggcatggaagtggatgggctgagactcctcgaacagatcgaggtggagattctattggtgaaacaccgactcctggagccagtaaaagaaaatcacggtgggatgaaacaccagctagtcagatgggtggaagcactccagttctgacccctggaaagacaccaattggcacaccagccatgaacatggctacccctactccaggtcacataatgagtatgactcctgaacagcttcaggcttggcggtgggaaagagaaattgatgagagaaatcgcccactttctgatgaggaattagatgctatgttcccagaaggatataaggtacttcctcctccagctggttatgttcctattcgaactccagctcgaaagctgacagctactccaacacctttgggtggtatgactggtttccacatgcaaactgaagatcgaactatgaaaagtgttaatgaccagccatctggaaatcttccatttttaaaacctgatgatattcaatactttgataaactattggttgatgttgatgaatcaacacttagtccagaagagcaaaaagagagaaaaataatgaagttgcttttaaaaattaagaatggaacaccaccaatgagaaaggctgcattgcgtcagattactgataaagctcgtgaatttggagctggtcctttgtttaatcagattcttcctctgctgatgtctcctacacttgaggatcaagagcgtcatttacttgtgaaagttattgataggatactgtacaaacttgatgacttagttcgtccatatgtgcataagatcctcgtggtcattgaaccgctattgattgatgaagattactatgctagagtggaaggccgagagatcatttctaatttggcaaaggctgctggtctggctactatgatctctaccatgagacctgatatagataacatggatgagtatgtccgtaacacaacagctagagcttttgctgttgtagcctctgccctgggcattccttctttattgcccttcttaaaagctgtgtgcaaaagcaagaagtcctggcaagcgagacacactggtattaagattgtacaacagatagctattcttatgggctgtgccatcttgccacatcttagaagtttagttgaaatcattgaacatggtcttgtggatgagcagcagaaagttcggaccatcagtgctttggccattgctgccttggctgaagcagcaactccttatggtatcgaatcttttgattctgtgttaaagcctttatggaagggtatccgccaacacagaggaaagggtttggctgctttcttgaaggctattgggtatcttattcctcttatggatgcagaatatgccaactactatactagagaagtgatgttaatccttattcgagaattccagtctcctgatgaggaaatgaaaaaaattgtgctgaaggtggtaaaacagtgttgtgggacagatggtgtagaagcaaactacattaaaacagagattcttcctcccttttttaaacacttctggcagcacaggatggctttggatagaagaaattaccgacagttagttgatactactgtggagttggcaaacaaagtaggtgcagcagaaattatatccaggattgtggatgatctgaaagatgaagccgaacagtacagaaaaatggtgatggagacaattgagaaaattatgggcaatttgggagcagcagatattgatcataaacttgaagaacaactgattgatggtattctttatgctttccaagaacagactacagaggactcagtaatgttgaacggctttggcacagtggttaatgctcttggcaaacgagtcaaaccatacttgcctcagatctgtggtacagttttgtggcgtttaaataacaaatctgctaaagttaggcaacaggcagctgacttgatttctcgaactgctgttgtcatgaagacttgtcaagaggaaaaattgatgggacacttgggtgttgtattgtatgagtatttgggtgaagagtaccctgaagtattgggcagcattcttggagcactgaaggccattgtaaatgtcataggtatgcataagatgactccaccaattaaagatctgctgcctagactcacccccatcttaaagaacagacatgaaaaagtacaagagaattgtattgatcttgttggtcgtattgctgacaggggagctgaatatgtatctgcaagagagtggatgaggatttgctttgagcttttagagctcttaaaagcccacaaaaaggctattcgtagagccacagtcaacacatttggttatattgcaaaggccattggccctcatgatgtattggctacacttctgaacaacctcaaagttcaagaaaggcagaacagagtttgtaccactgtagcaatagctattgttgcagaaacatgttcaccctttacagtactccctgccttaatgaatgaatacagagttcctgaactgaatgttcaaaatggagtgttaaaatcgctttccttcttgtttgaatatattggtgaaatgggaaaagactacatttatgccgtaacaccgttacttgaagatgctttaatggatagagaccttgtacacagacagacggctagtgcagtggtacagcacatgtcacttggggtttatggatttggttgtgaagattcgctgaatcacttgttgaactatgtatggcccaatgtgtttgagacatctcctcatgtaattcaggcagttatgggagccctagagggcctgagagttgctattggaccatgtagaatgttgcaatattgtttacagggtctgtttcacccagcccggaaagtcagagatgtatattggccaagaatctacaacgatgataagaacacctatattcgttatgaacttgactatatcttataattttattgtttattttgtgtttaatgcacagctacttcacaccttaaacttgctttgatttggtgatgtaaacttttaaacattgcagatcagtgtagaactggtcatagaggaagagctagaaatccagtagcatgatttttaaataacctgtctttgtttttgatgttaaacagtaaatgccagtagtgaccaagaacacagtgattatatacactatactggagggatttcatttttaattcatctttatgaagatttagaactcattccttgtgtttaaagggaatgtttaattgagaaataaacatttgtgtacaaaatgctaaaaaaaccagacgaactgttagcaaaccaagcaacaccactcaacaaatataacccgtctacctcccttgaacatcatgctcacaagaagcccccccatcaaccctcacccacacacgccgtcccaaaccacgacccccccccgagcccggcccacacaccccccccccccgcgccccctccaccccccccccaacgcggcaagaccgcactccagcacaaactagcgaaccagcaaaaccacacccccccggcggcaccacaaacgcgccgaatcgaccgccacagccaacgcccctcagctcccgcacaccccatcgtgcgacagctcacacaccaacccacccccacgtccccacacgatgcgccacgcatacactttagacgatgatcactgaccgcgcacaacgcctccgcacgacccccaccactcatacacacccaccgcgcactaccccccacccacaccatcccaccacagaccccccagcgccaccccacccgcgcacacaccacccccaccccacactaccaccacc

SEQ ID NO: 427434 - DNA, 1701 bp, Homo sapiens
attgatcataaacttgaagaacaactgattgatcttgtggtcgtatgctgacaggggagctgaatatgtatctgcaagagagtggatgaggatttgctttgagcttttagagctcttaaaagcccacaaaaaggctattcgtagagccacagtcaacacatttggttatattgcaaaggccattggccctcatgatgtattggctacacttctgaacaacctcaaagttcaagaaaggcagaacagagtttgtaccactgtagcaatagctattgttgcagaaacatgttcaccctttacagtactccctgccttaatgaatgaatacagagttcctgaactgaatgttcaaaatggagtgttaaaatcgctttccttcttgtttgaatatattggtgaaatgggaaaagactacatttatgccgtaacaccgttacttgaagatgctttaatggatagagaccttgtacacagacagacggctagtgcagtggtacagcacatgtcacttggggtttatggatttggttgtgaagattcgctgaatcacttgttgaactatgtatggcccaatgtgtttgagacatctcctcatgtaattcaggcagttatgggagccctagagggcctgagagttgctattggaccatgtagaatgttgcaatattgtttacagggtctgtttcacccagcccggaaagtcagagatgtatattggaaaatttacaactccatctacattggttcccaggacgctctcatagcacattacccaagaatctacaacgatgataagaacacctatattcgttatgaacttgactatatcttataattttattgtttattttgtgtttaatgcacagctacttcacaccttaaacttgctttgatttggtgatgtaaacttttaaacattgcagatcagtgtagaactggtcatagaggaagagctagaaatccagtagcatgatttttaaataacctgtctttgtttttgatgttaaacagtaaatgccagtagtgaccaagaacacagtgattatatacactatactggagggatttcatttttaattcatctttatgaagatttagaactcattccttgtgtttaaagggaatgtttaattgagaaataaacatttgtgtacaaaatgctaaaaaaaccagacgaactgttagcaaaccaagcaacaccactcaacaaatataacccgtctacctcccttgaacatcatgctcacaagaagcccccccatcaaccctcacccacacacgccgtcccaaaccacgacccccccccgagcccggcccacacaccccccccccccgcgccccctccaccccccccccaacgcggcaagaccgcactccagcacaaactagcgaaccagcaaaaccacacccccccggcggcaccacaaacgcgccgaatcgaccgccacagccaacgcccctcagctcccgcacaccccatcgtgcgacagctcacacaccaacccacccccacgtccccacacgatgcgccacgcatacactttagacgatgatcactgaccgcgcacaacgcctccgcacgacccccaccactcatacacacccaccgcgcactaccccccacccacaccatcccaccacagaccccccagcgccaccccacccgcgcacacaccacccccaccccacactaccaccacc

SEQ ID NO: 427435 - DNA, 4343 bp, Homo sapiens
agcggaagttcttgggagcgccagttccgtctgtgtgttcgagtggacaaaatggcgaagatcgccaagactcacgaagatattgaagcacagattcgagaaattcaaggcaagaaggcagctcttgatgaagctcaaggagtgggcctcgattctacaggttattatgaccaggaaatttatggtggaagtgacagcagatttgctggatacgtgacatcaattgctgcaactgaacttgaagatgatgacgatgactattcatcatctacgagtttgcttggtcagaagaagccaggatatcatgcccctgtggcattgcttaatgatataccacagtcaacagaacagtatgatccatttgctgagcacagacctccaaagattgcagaccgggaagatgaatacaaaaagcataggcggaccatgataatttccccagagcgtcttgatccttttgcagatggcttctattctgctgcttgaagtcagaactgctgatggagacaaaggcacgaaagtgtacgtattccggattagcaacccaggaacccatcacttctgaagactctaaactgtgctgtcattttgtttttatatgcattaaaatatttgttttaaactgctgtagatgtttgtgttcaaacaggttaaattgatcagcaaactcaataaaaagtaagatgtataattattaaagttttccatcaaaaaataatttaaatgattatggaataacataatatttagagcagggcagataaatcagttgaacctgcttattttttatttattgtactctttttcctgttgctgttcttttctgcaggagagggaagacccctgatcctaaaatgaatgctaggacttacatggatgtaatgcgagaacaacacttgactaaagaagaacgagaaattaggcaacagctagcagaaaaagctaaagctggagaactaaaagtcgtcaatggagcagcagcgtcccagcctccatcaaaacgaaaacggcgttgggatcaaacagctgatcagactcctggtgccactcccaaaaaactatcaagttgggatcaggcagagacccctgggcatactccttccttaagatgggatgagacaccaggtcgtgcaaagggaagcgagactcctggagcaaccccaggctcaaaaatatgggatcctacacctagccacacaccagcgggagctgctactcctggacgaggtgatacaccaggccatgcgacaccaggccatggaggcgcaacttccagtgctcgtaaaaacagatgggatgaaacccccaaaacagagagagatactcctgggcatggaagtggatgggctgagactcctcgaacagatcgaggtggagattctattggtgaaacaccgactcctggagccagtaaaagaaaatcacggtgggatgaaacaccagctagtcagatgggtggaagcactccagttctgacccctggaaagacaccaattggcacaccagccatgaacatggctacccctactccaggtcacataatgagtatgactcctgaacagcttcaggcttggcggtgggaaagagaaattgatgagagaaatcgcccactttctgatgaggaattagatgctatgttcccagaaggatataaggtacttcctcctccagctggttatgttcctattcgaactccagctcgaaagctgacagctactccaacacctttgggtggtatgactggtttccacatgcaaactgaagatcgaactatgaaaagtgttaatgaccagccatctggaaatcttccatttttaaaacctgatgatattcaatactttgataaactattggttgatgttgatgaatcaacacttagtccagaagagcaaaaagagagaaaaataatgaagttgcttttaaaaattaagaatggaacaccaccaatgagaaaggctgcattgcgtcagattactgataaagctcgtgaatttggagctggtcctttgtttaatcagattcttcctctgctgatgtctcctacacttgaggatcaagagcgtcatttacttgtgaaagttattgataggatactgtacaaacttgatgacttagttcgtccatatgtgcataagatcctcgtggtcattgaaccgctattgattgatgaagattactatgctagagtggaaggccgagagatcatttctaatttggcaaaggctgctggtctggctactatgatctctaccatgagacctgatatagataacatggatgagtatgtccgtaacacaacagctagagcttttgctgttgtagcctctgccctgggcattccttctttattgcccttcttaaaagctgtgtgcaaaagcaagaagtcctggcaagcgagacacactggtattaagattgtacaacagatagctattcttatgggctgtgccatcttgccacatcttagaagtttagttgaaatcattgaacatggtcttgtggatgagcagcagaaagttcggaccatcagtgctttggccattgctgccttggctgaagcagcaactccttatggtatcgaatcttttgattctgtgttaaagcctttatggaagggtatccgccaacacagaggaaagggtttggctgctttcttgaaggctattgggtatcttattcctcttatggatgcagaatatgccaactactatactagagaagtgatgttaatccttattcgagaattccagtctcctgatgaggaaatgaaaaaaattgtgctgaaggtggtaaaacagtgttgtgggacagatggtgtagaagcaaactacattaaaacagagattcttcctcccttttttaaacacttctggcagcacaggatggctttggatagaagaaattaccgacagttagttgatactactgtggagttggcaaacaaagtaggtgcagcagaaattatatccaggattgtggatgatctgaaagatgaagccgaacagtacagaaaaatggtgatggagacaattgagaaaattatgggcaatttgggagcagcagatattgatcataaacttgaagaacaactgattgatggtattctttatgctttccaagaacagactacagaggactcagtaatgttgaacggctttggcacagtggttaatgctcttggcaaacgagtcaaaccatacttgcctcagatctgtggtacagttttgtggcgtttaaataacaaatctgctaaagttaggcaacaggcagctgacttgatttctcgaactgctgttgtcatgaagacttgtcaagaggaaaaattgatgggacacttgggtgttgtattgtatgagtatttgggtgaagagtaccctgaagtattgggcagcattcttggagcactgaaggccattgtaaatgtcataggtatgcataagatgactccaccaattaaagatctgctgcctagactcacccccatcttaaagaacagacatgaaaaagtacaagagaattgtattgatcttgttggtcgtattgctgacaggggagctgaatatgtatctgcaagagagtggatgaggatttgctttgagcttttagagctcttaaaagcccacaaaaaggctattcgtagagccacagtcaacacatttggttatattgcaaaggccattggccctcatgatgtattggctacacttctgaacaacctcaaagttcaagaaaggcagaacagagtttgtaccactgtagcaatagctattgttgcagaaacatgttcaccctttacagtactccctgccttaatgaatgaatacagagttcctgaactgaatgttcaaaatggagtgttaaaatcgctttccttcttgtttgaatatattggtgaaatgggaaaagactacatttatgccgtaacaccgttacttgaaaatgctaatttgtgtgtgttttttgaacatgacttgtaaaatgcggaactttgataaagtattggtttatgtggaataagtggcttaatttcattttctgtcacatggtttatagaaagtagttagctgaataaaaactatataaagtgatggcatctttgtcaaaattccattgttgtgttaataatgacagcaagaagagtagcctcaggggatgttcccctcaaactagcacaaccattccatcatcgtagaaaagtagcacttttgctaaactgtcttgaatattttgtacttacatagcgcctttcatctcttgatttctcaaaatgctttatgaacacatttaaagaaagtggtttaagtcttgtccaacacttgacaggtctgctgtgtttagcaagt

SEQ ID NO: 427436 - DNA, 3247 bp, Homo sapiens
  misc_feature (3247)..(3247): n is a, c, g, or t
agcggaagttcttgggagcgccagttccgtctgtgtgttcgagtggacaaaatggcgaagatcgccaagactcacgaagatattgaagcacagattcgagaaattcaaggcaagaaggcagctcttgatgaagctcaaggagtgggcctcgattctacaggttattatgaccaggaaatttatggtggaagtgacagcagatttgctggatacgtgacatcaattgctgcaactgaacttgaagatgatgacgatgactattcatcatctacgagtttgcttggtcagaagaagccaggatatcatgcccctgtggcattgcttaatgatataccacagtcaacagaacagtatgatccatttgctgagcacagacctccaaagattgcagaccgggaagatgaatacaaaaagcataggcggaccatgataatttccccagagcgtcttgatccttttgcagatggcttctattctgctgcttgaagtcagaactgctgatggagacaaaggcacgaaagtgtacgtattccggattagcaacccaggaacccatcacttctgaagactctaaactgtgctgtcattttgtttttatatgcattaaaatatttgttttaaactgctgtagatgtttgtgttcaaacaggttaaattgatcagcaaactcaataaaaagtaagatgtataattattaaagttttccatcaaaaaataatttaaatgattatggaataacataatatttagagcagggcagataaatcagttgaacctgcttattttttatttattgtactctttttcctgttgctgttcttttctgcaggagagggaagacccctgatcctaaaatgaatgctaggacttacatggatgtaatgcgagaacaacacttgactaaagaagaacgagaaattaggcaacagctagcagaaaaagctaaagctggagaactaaaagtcgtcaatggagcagcagcgtcccagcctccatcaaaacgaaaacggcgttgggatcaaacagctgatcagactcctggtgccactcccaaaaaactatcaagttgggatcaggcagagacccctgggcatactccttccttaagatgggatgagacaccaggtcgtgcaaagggaagcgagactcctggagcaaccccaggctcaaaaatatgggatcctacacctagccacacaccagcgggagctgctactcctggacgaggtgatacaccaggccatgcgacaccaggccatggaggcgcaacttccagtgctcgtaaaaacagatgggatgaaacccccaaaacagagagagatactcctgggcatggaagtggatgggctgagactcctcgaacagatcgaggtggagattctattggtgaaacaccgactcctggagccagtaaaagaaaatcacggtgggatgaaacaccagctagtcagatgggtggaagcactccagttctgacccctggaaagacaccaattggcacaccagccatgaacatggctacccctactccaggtcacataatgagtatgactcctgaacagcttcaggcttggcggtgggaaagagaaattgatgagagaaatcgcccactttctgatgaggaattagatgctatgttcccagaaggatataaggtacttcctcctccagctggttatgttcctattcgaactccagctcgaaagctgacagctactccaacacctttgggtggtatgactggtttccacatgcaaactgaagatcgaactatgaaaagtgttaatgaccagccatctggaaatcttccatttttaaaacctgatgatattcaatactttgataaactattggttgatgttgatgaatcaacacttagtccagaagagcaaaaagagagaaaaataatgaagttgcttttaaaaattaagaatggaacaccaccaatgagaaaggctgcattgcgtcagattactgataaagctcgtgaatttggagctggtcctttgtttaatcagattcttcctctgctgatgtctcctacacttgaggatcaagagcgtcatttacttgtgaaagttattgataggatactgtacaaacttgatgacttagttcgtccatatgtgcataagatcctcgtggtcattgaaccgctattgattgatgaagattactatgctagagtggaaggccgagagatcatttctaatttggcaaaggctgctggtctggctactatgatctctaccatgagacctgatatagataacatggatgagtatgtccgtaacacaacagctagagcttttgctgttgtagcctctgccctgggcattccttctttattgcccttcttaaaagctgtgtgcaaaagcaagaagtcctggcaagcgagacacactggtattaagattgtacaacagatagctattcttatgggctgtgccatcttgccacatcttagaagtttagttgaaatcattgaacatggtcttgtggatgagcagcagaaagttcggaccatcagtgctttggccattgctgccttggctgaagcagcaactccttatggtatcgaatcttttgattctgtgttaaagcctttatggaagggtatccgccaacacagaggaaagggtttggctgctttcttgaaggctattgggtatcttattcctcttatggatgcagaatatgccaactactatactagagaagtgatgttaatccttattcgagaattccagtctcctgatgaggaaatgaaaaaaattgtgctgaaggtggtaaaacagtgttgtgggacagatggtgtagaagcaaactacattaaaacagagattcttcctcccttttttaaacacttctggcagcacaggatggctttggatagaagaaattaccgacagttagttgatactactgtggagttggcaaacaaagtaggtgcagcagaaattatatccaggattgtggatgatctgaaagatgaagccgaacagtacagaaaaatggtgatgggcgataaatcacgtgatgttatcgcccaacaccaagaacaagcgatgtttgcttttaactgagggcaaagtaacttgcccactcgtgcagagagagccaggggtgggaccctaggccggtctggctctaaagctggtaccttccttgttgtggccgttagtcataaatgtgaacaggtgagaacagctaaccgcaatcttggtcatactgtgttggggagtan

SEQ ID NO: 427437 - DNA, 3014 bp, Homo sapiens
agcggaagttcttgggagcgccagttccgtctgtgtgttcgagtggacaaaatggcgaagatcgccaagactcacgaagatattgaagcacagattcgagaaattcaaggcaagaaggcagctcttgatgaagctcaaggagtgggcctcgattctacaggttattatgaccaggaaatttatggtggaagtgacagcagatttgctggatacgtgacatcaattgctgcaactgaacttgaagatgatgacgatgactattcatcatctacgagtttgcttggtcagaagaagccaggatatcatgcccctgtggcattgcttaatgatataccacagtcaacagaacagtatgatccatttgctgagcacagacctccaaagattgcagaccgggaagatgaatacaaaaagcataggcggaccatgataatttccccagagcgtcttgatccttttgcagatggcttctattctgctgcttgaagtcagaactgctgatggagacaaaggcacgaaagtgtacgtattccggattagcaacccaggaacccatcacttctgaagactctaaactgtgctgtcattttgtttttatatgcattaaaatatttgttttaaactgctgtagatgtttgtgttcaaacaggttaaattgatcagcaaactcaataaaaagtaagatgtataattattaaagttttccatcaaaaaataatttaaatgattatggaataacataatatttagagcagggcagataaatcagttgaacctgcttattttttatttattgtactctttttcctgttgctgttcttttctgcaggagagggaagacccctgatcctaaaatgaatgctaggacttacatggatgtaatgcgagaacaacacttgactaaagaagaacgagaaattaggcaacagctagcagaaaaagctaaagctggagaactaaaagtcgtcaatggagcagcagcgtcccagcctccatcaaaacgaaaacggcgttgggatcaaacagctgatcagactcctggtgccactcccaaaaaactatcaagttgggatcaggcagagacccctgggcatactccttccttaagatgggatgagacaccaggtcgtgcaaagggaagcgagactcctggagcaaccccaggctcaaaaatatgggatcctacacctagccacacaccagcgggagctgctactcctggacgaggtgatacaccaggccatgcgacaccaggccatggaggcgcaacttccagtgctcgtaaaaacagatgggatgaaacccccaaaacagagagagatactcctgggcatggaagtggatgggctgagactcctcgaacagatcgaggtggagattctattggtgaaacaccgactcctggagccagtaaaagaaaatcacggtgggatgaaacaccagctagtcagatgggtggaagcactccagttctgacccctggaaagacaccaattggcacaccagccatgaacatggctacccctactccaggtcacataatgagtatgactcctgaacagcttcaggcttggcggtgggaaagagaaattgatgagagaaatcgcccactttctgatgaggaattagatgctatgttcccagaaggatataaggtacttcctcctccagctggttatgttcctattcgaactccagctcgaaagctgacagctactccaacacctttgggtggtatgactggtttccacatgcaaactgaagatcgaactatgaaaagtgttaatgaccagccatctggaaatcttccatttttaaaacctgatgatattcaatactttgataaactattggttgatgttgatgaatcaacacttagtccagaagagcaaaaagagagaaaaataatgaagttgcttttaaaaattaagaatggaacaccaccaatgagaaaggctgcattgcgtcagattactgataaagctcgtgaatttggagctggtcctttgtttaatcagattcttcctctgctgatgtctcctacacttgaggatcaagagcgtcatttacttgtgaaagttattgataggatactgtacaaacttgatgacttagttcgtccatatgtgcataagatcctcgtggtcattgaaccgctattgattgatgaagattactatgctagagtggaaggccgagagatcatttctaatttggcaaaggctgctggtctggctactatgatctctaccatgagacctgatatagataacatggatgagtatgtccgtaacacaacagctagagcttttgctgttgtagcctctgccctgggcattccttctttattgcccttcttaaaagctgtgtgcaaaagcaagaagtcctggcaagcgagacacactggtattaagattgtacaacagatagctattcttatgggctgtgccatcttgccacatcttagaagtttagttgaaatcattgaacatggtcttgtggatgagcagcagaaagttcggaccatcagtgctttggccattgctgccttggctgaagcagcaactccttatggtatcgaatcttttgattctgtgttaaagcctttatggaagggtatccgccaacacagaggaaagggtttggctgctttcttgaaggctattgggtatcttattcctcttatggatgcagaatatgccaactactatactagagaagtgatgttaatccttattcgagaattccagtctcctgatgaggaaatgaaaaaaattgtgctgaaggtacgaagatgagggaggatgaagacaaaggtcctccctgtggcccagtgaactgcaatgaaaagatcgtggtccttctgcagcgcttgaagcctgagatcaaggatgtcattgagcagctcaacctggtcaccacctgcttgcagctgcagatacctcggattgaggatgtaactattttagagtggctgatgggtgcagactccggtaactctagatcacctcacc

SEQ ID NO: 427438 - DNA, 1852 bp, Homo sapiens
  misc_feature (8)..(9): n is a, c, g, or t
  misc_feature (16)..(16): n is a, c, g, or t
cattgaanntcccttntctacggacgcgcgccattgtgttggtactcgggaactcggccattatggccggctattctaaaggatatattagatatatgaaatgttagatgacttcacatctattcagtgcactgaattagtaatttagtttctaatgggccggtgaatatttcctgtaaaactaagactgtatctttaaggatttttccccctttcttataagaccgcatcttaaaggacttttttcccttccgttgtagagaccttgtacacagacagacggctagtgcagtggtacagcacatgtcacttggggtttatggatttggttgtgaagattcgctgaatcacttgttgaactatgtatggcccaatgtgtttgagacatctcctcatgtaattcaggcagttatgggagccctagagggcctgagagttgctattggaccatgtagaatgttgcaatattgtttacaggtaagttaaagattttttttttaatcggtgattttttttttttaaataatactttaagttctgggatacttgtgctgaacgtgcaggtttgttacataggtatatatgtgccatggtggtttgctgcacctatcaacctgtcatctaggttttaagccctgcatgcattaggtatttgtcctaatgctctccctcccctttccccccactgcctgtaagttaaagatttttaaaagattacttagcaagaaaagtagtgtattggaatcatatctttatgttttcttaattttgttaaggttatgtatgttcttaaaaattgaaataatgtaaccgttcaattattttagggtctgtttcacccagcccggaaagtcagagatgtatattggaaaatttacaactccatctacattggttcccaggacgctctcatagcacattacccaagaatctacaacgatgataagaacacctatattcgttatgaacttgactatatcttataattttattgtttattttgtgtttaatgcacagctacttcacaccttaaacttgctttgatttggtgatgtaaacttttaaacattgcagatcagtgtagaactggtcatagaggaagagctagaaatccagtagcatgatttttaaataacctgtctttgtttttgatgttaaacagtaaatgccagtagtgaccaagaacacagtgattatatacactatactggagggatttcatttttaattcatctttatgaagatttagaactcattccttgtgtttaaagggaatgtttaattgagaaataaacatttgtgtacaaaatgctaaaaaaaccagacgaactgttagcaaaccaagcaacaccactcaacaaatataacccgtctacctcccttgaacatcatgctcacaagaagcccccccatcaaccctcacccacacacgccgtcccaaaccacgacccccccccgagcccggcccacacaccccccccccccgcgccccctccaccccccccccaacgcggcaagaccgcactccagcacaaactagcgaaccagcaaaaccacacccccccggcggcaccacaaacgcgccgaatcgaccgccacagccaacgcccctcagctcccgcacaccccatcgtgcgacagctcacacaccaacccacccccacgtccccacacgatgcgccacgcatacactttagacgatgatcactgaccgcgcacaacgcctccgcacgacccccaccactcatacacacccaccgcgcactaccccccacccacaccatcccaccacagaccccccagcgccaccccacccgcgcacacaccacccccaccccacactaccaccacc

SEQ ID NO: 427439 - DNA, 673 bp, Homo sapiens
agcggaagttcttgggagcgccagttccgtctgtgtgttcgagtggacaaaatggcgaagatcgccaagactcacgaagatattgaagcacagattcgagaaattcaaggcaagaaggcagctcttgatgaagctcaaggagtgggcctcgattctacaggttattatgaccaggaaatttatggtggaagtgacagcagatttgctggatacgtgacatcaattgctgcaactgaacttgaagatgatgacgatgactattcatcatctacgagtttgcttggtcagaagaagccaggatatcatgcccctgtggcattgcttaatgatataccacagtcaacagaacagtatgatccatttgctgagcacagacctccaaagattgcagaccgggaagatgaatacaaaaagcataggcggaccatgataatttccccagagcgtcttgatccttttgcagatggcttctattctgctgcttgaagtcagaactgctgatggagacaaaggcacgaaagtgagggaagacccctgatcctaaaatgaatgctaggacttacatggatgtaatgcgagaacaacacttgactaaagaagaagtatgtaaacctgtctcctgttttaatggttgtgaaagaatataaatacagttgtgattgagagactgtta

SEQ ID NO: 427440 - DNA, 4832 bp, Homo sapiens
agcggaagttcttgggagcgccagttccgtctgtgtgttcgagtggacaaaatggcgaagatcgccaagactcacgaagatattgaagcacagattcgagaaattcaaggcaagaaggcagctcttgatgaagctcaaggagtgggcctcgattctacaggttattatgaccaggaaatttatggtggaagtgacagcagatttgctggatacgtgacatcaattgctgcaactgaacttgaagatgatgacgatgactattcatcatctacgagtttgcttggtcagaagaagccaggatatcatgcccctgtggcattgcttaatgatataccacagtcaacagaacagtatgatccatttgctgagcacagacctccaaagattgcagaccgggaagatgaatacaaaaagcataggcggaccatgataatttccccagagcgtcttgatccttttgcagatggagggaagacccctgatcctaaaatgaatgctaggacttacatggatgtaatgcgagaacaacacttgactaaagaagaacgagaaattaggcaacagctagcagaaaaagctaaagctggagaactaaaagtcgtcaatggagcagcagcgtcccagcctccatcaaaacgaaaacggcgttgggatcaaacagctgatcagactcctggtgccactcccaaaaaactatcaagttgggatcaggcagagacccctgggcatactccttccttaagatgggatgagacaccaggtcgtgcaaagggaagcgagactcctggagcaaccccaggctcaaaaatatgggatcctacacctagccacacaccagcgggagctgctactcctggacgaggtgatacaccaggccatgcgacaccaggccatggaggcgcaacttccagtgctcgtaaaaacagatgggatgaaacccccaaaacagagagagatactcctgggcatggaagtggatgggctgagactcctcgaacagatcgaggtggagattctattggtgaaacaccgactcctggagccagtaaaagaaaatcacggtgggatgaaacaccagctagtcagatgggtggaagcactccagttctgacccctggaaagacaccaattggcacaccagccatgaacatggctacccctactccaggtcacataatgagtatgactcctgaacagcttcaggcttggcggtgggaaagagaaattgatgagagaaatcgcccactttctgatgaggaattagatgctatgttcccagaaggatataaggtacttcctcctccagctggttatgttcctattcgaactccagctcgaaagctgacagctactccaacacctttgggtggtatgactggtttccacatgcaaactgaagatcgaactatgaaaagtgttaatgaccagccatctggaaatcttccatttttaaaacctgatgatattcaatactttgataaactattggttgatgttgatgaatcaacacttagtccagaagagcaaaaagagagaaaaataatgaagttgcttttaaaaattaagaatggaacaccaccaatgagaaaggctgcattgcgtcagattactgataaagctcgtgaatttggagctggtcctttgtttaatcagattcttcctctgctgatgtctcctacacttgaggatcaagagcgtcatttacttgtgaaagttattgataggatactgtacaaacttgatgacttagttcgtccatatgtgcataagatcctcgtggtcattgaaccgctattgattgatgaagattactatgctagagtggaaggccgagagatcatttctaatttggcaaaggctgctggtctggctactatgatctctaccatgagacctgatatagataacatggatgagtatgtccgtaacacaacagctagagcttttgctgttgtagcctctgccctgggcattccttctttattgcccttcttaaaagctgtgtgcaaaagcaagaagtcctggcaagcgagacacactggtattaagattgtacaacagatagctattcttatgggctgtgccatcttgccacatcttagaagtttagttgaaatcattgaacatggtcttgtggatgagcagcagaaagttcggaccatcagtgctttggccattgctgccttggctgaagcagcaactccttatggtatcgaatcttttgattctgtgttaaagcctttatggaagggtatccgccaacacagaggaaagggtttggctgctttcttgaaggctattgggtatcttattcctcttatggatgcagaatatgccaactactatactagagaagtgatgttaatccttattcgagaattccagtctcctgatgaggaaatgaaaaaaattgtgctgaaggtggtaaaacagtgttgtgggacagatggtgtagaagcaaactacattaaaacagagattcttcctcccttttttaaacacttctggcagcacaggatggctttggatagaagaaattaccgacagttagttgatactactgtggagttggcaaacaaagtaggtgcagcagaaattatatccaggattgtggatgatctgaaagatgaagccgaacagtacagaaaaatggtgatggagacaattgagaaaattatgggcaatttgggagcagcagatattgatcataaacttgaagaacaactgattgatggtattctttatgctttccaagaacagactacagaggactcagtaatgttgaacggctttggcacagtggttaatgctcttggcaaacgagtcaaaccatacttgcctcagatctgtggtacagttttgtggcgtttaaataacaaatctgctaaagttaggcaacaggcagctgacttgatttctcgaactgctgttgtcatgaagacttgtcaagaggaaaaattgatgggacacttgggtgttgtattgtatgagtatttgggtgaagagtaccctgaagtattgggcagcattcttggagcactgaaggccattgtaaatgtcataggtatgcataagatgactccaccaattaaagatctgctgcctagactcacccccatcttaaagaacagacatgaaaaagtacaagagaattgtattgatcttgttggtcgtattgctgacaggggagctgaatatgtatctgcaagagagtggatgaggatttgctttgagcttttagagctcttaaaagcccacaaaaaggctattcgtagagccacagtcaacacatttggttatattgcaaaggccattggccctcatgatgtattggctacacttctgaacaacctcaaagttcaagaaaggcagaacagagtttgtaccactgtagcaatagctattgttgcagaaacatgttcaccctttacagtactccctgccttaatgaatgaatacagagttcctgaactgaatgttcaaaatggagtgttaaaatcgctttccttcttgtttgaatatattggtgaaatgggaaaagactacatttatgccgtaacaccgttacttgaagatgctttaatggatagagaccttgtacacagacagacggctagtgcagtggtacagcacatgtcacttggggtttatggatttggttgtgaagattcgctgaatcacttgttgaactatgtatggcccaatgtgtttgagacatctcctcatgtaattcaggcagttatgggagccctagagggcctgagagttgctattggaccatgtagaatgttgcaatattgtttacagggtctgtttcacccagcccggaaagtcagagatgtatattggaaaatttacaactccatctacattggttcccaggacgctctcatagcacattacccaagaatctacaacgatgataagaacacctatattcgttatgaacttgactatatcttataattttattgtttattttgtgtttaatgcacagctacttcacaccttaaacttgctttgatttggtgatgtaaacttttaaacattgcagatcagtgtagaactggtcatagaggaagagctagaaatccagtagcatgatttttaaataacctgtctttgtttttgatgttaaacagtaaatgccagtagtgaccaagaacacagtgattatatacactatactggagggatttcatttttaattcatctttatgaagatttagaactcattccttgtgtttaaagggaatgtttaattgagaaataaacatttgtgtacaaaatgctaaaaaaaccagacgaactgttagcaaaccaagcaacaccactcaacaaatataacccgtctacctcccttgaacatcatgctcacaagaagcccccccatcaaccctcacccacacacgccgtcccaaaccacgacccccccccgagcccggcccacacaccccccccccccgcgccccctccaccccccccccaacgcggcaagaccgcactccagcacaaactagcgaaccagcaaaaccacacccccccggcggcaccacaaacgcgccgaatcgaccgccacagccaacgcccctcagctcccgcacaccccatcgtgcgacagctcacacaccaacccacccccacgtccccacacgatgcgccacgcatacactttagacgatgatcactgaccgcgcacaacgcctccgcacgacccccaccactcatacacacccaccgcgcactaccccccacccacaccatcccaccacagaccccccagcgccaccccacccgcgcacacaccacccccaccccacactaccaccacc

SEQ ID NO: 427441 - DNA, 608 bp, Homo sapiens
agcggaagttcttgggagcgccagttccgtctgtgtgttcgagtggacaaaatggcgaagatcgccaagactcacgaagatattgaagcacagattcgagaaattcaaggcaagaaggcagctcttgatgaagctcaaggagtgggcctcgattctacaggttattatgaccaggaaatttatggtggaagtgacagcagatttgctggatacgtgacatcaattgctgcaactgaacttgaagatgatgacgatgactattcatcatctacgagtttgcttggtcagaagaagccaggatatcatgcccctgtggcattgcttaatgatataccacagtcaacagaacagtatgatccatttgctgagcacagacctccaaagattgcagaccgggaagatgaatacaaaaagcataggcggaccatgataatttccccagagcgtcttgatccttttgcagatggtaattctttcccacttttctataagtattcagaaatttatttgtattaagttgtctttagccctttgattttttttggcatgcttctgaatttgcttttctttttaaaaatcccccttactatagatttgtatagatgtgg

SEQ ID NO: 427442 - DNA, 5197 bp, Homo sapiens
agcggaagttcttgggagcgccagttccgtctgtgtgttcgagtggacaaaatggcgaagatcgccaagactcacgaagatattgaagcacagattcgagaaattcaaggcaagaaggcagctcttgatgaagctcaaggagtgggcctcgattctacaggttattatgaccaggaaatttatggtggaagtgacagcagatttgctggatacgtgacatcaattgctgcaactgaacttgaagatgatgacgatgactattcatcatctacgagtttgcttggtcagaagaagccaggatatcatgcccctgtggcattgcttaatgatataccacagtcaacagaacagtatgatccatttgctgagcacagacctccaaagattgcagaccgggaagatgaatacaaaaagcataggcggaccatgataatttccccagagcgtcttgatccttttgcagatggcttctattctgctgcttgaagtcagaactgctgatggagacaaaggcacgaaagtgtacgtattccggattagcaacccaggaacccatcacttctgaagactctaaactgtgctgtcattttgtttttatatgcattaaaatatttgttttaaactgctgtagatgtttgtgttcaaacaggttaaattgatcagcaaactcaataaaaagtaagatgtataattattaaagttttccatcaaaaaataatttaaatgattatggaataacataatatttagagcagggcagataaatcagttgaacctgcttattttttatttattgtactctttttcctgttgctgttcttttctgcaggagagggaagacccctgatcctaaaatgaatgctaggacttacatggatgtaatgcgagaacaacacttgactaaagaagaacgagaaattaggcaacagctagcagaaaaagctaaagctggagaactaaaagtcgtcaatggagcagcagcgtcccagcctccatcaaaacgaaaacggcgttgggatcaaacagctgatcagactcctggtgccactcccaaaaaactatcaagttgggatcaggcagagacccctgggcatactccttccttaagatgggatgagacaccaggtcgtgcaaagggaagcgagactcctggagcaaccccaggctcaaaaatatgggatcctacacctagccacacaccagcgggagctgctactcctggacgaggtgatacaccaggccatgcgacaccaggccatggaggcgcaacttccagtgctcgtaaaaacagatgggatgaaacccccaaaacagagagagatactcctgggcatggaagtggatgggctgagactcctcgaacagatcgaggtggagattctattggtgaaacaccgactcctggagccagtaaaagaaaatcacggtgggatgaaacaccagctagtcagatgggtggaagcactccagttctgacccctggaaagacaccaattggcacaccagccatgaacatggctacccctactccaggtcacataatgagtatgactcctgaacagcttcaggcttggcggtgggaaagagaaattgatgagagaaatcgcccactttctgatgaggaattagatgctatgttcccagaaggatataaggtacttcctcctccagctggttatgttcctattcgaactccagctcgaaagctgacagctactccaacacctttgggtggtatgactggtttccacatgcaaactgaagatcgaactatgaaaagtgttaatgaccagccatctggaaatcttccatttttaaaacctgatgatattcaatactttgataaactattggttgatgttgatgaatcaacacttagtccagaagagcaaaaagagagaaaaataatgaagttgcttttaaaaattaagaatggaacaccaccaatgagaaaggctgcattgcgtcagattactgataaagctcgtgaatttggagctggtcctttgtttaatcagattcttcctctgctgatgtctcctacacttgaggatcaagagcgtcatttacttgtgaaagttattgataggatactgtacaaacttgatgacttagttcgtccatatgtgcataagatcctcgtggtcattgaaccgctattgattgatgaagattactatgctagagtggaaggccgagagatcatttctaatttggcaaaggctgctggtctggctactatgatctctaccatgagacctgatatagataacatggatgagtatgtccgtaacacaacagctagagcttttgctgttgtagcctctgccctgggcattccttctttattgcccttcttaaaagctgtgtgcaaaagcaagaagtcctggcaagcgagacacactggtattaagattgtacaacagatagctattcttatgggctgtgccatcttgccacatcttagaagtttagttgaaatcattgaacatggtcttgtggatgagcagcagaaagttcggaccatcagtgctttggccattgctgccttggctgaagcagcaactccttatggtatcgaatcttttgattctgtgttaaagcctttatggaagggtatccgccaacacagaggaaagggtttggctgctttcttgaaggctattgggtatcttattcctcttatggatgcagaatatgccaactactatactagagaagtgatgttaatccttattcgagaattccagtctcctgatgaggaaatgaaaaaaattgtgctgaaggtggtaaaacagtgttgtgggacagatggtgtagaagcaaactacattaaaacagagattcttcctcccttttttaaacacttctggcagcacaggatggctttggatagaagaaattaccgacagttagttgatactactgtggagttggcaaacaaagtaggtgcagcagaaattatatccaggattgtggatgatctgaaagatgaagccgaacagtacagaaaaatggtgatggagacaattgagaaaattatgggcaatttgggagcagcagatattgatcataaacttgaagaacaactgattgatggtattctttatgctttccaagaacagactacagaggactcagtaatgttgaacggctttggcacagtggttaatgctcttggcaaacgagtcaaaccatacttgcctcagatctgtggtacagttttgtggcgtttaaataacaaatctgctaaagttaggcaacaggcagctgacttgatttctcgaactgctgttgtcatgaagacttgtcaagaggaaaaattgatgggacacttgggtgttgtattgtatgagtatttgggtgaagagtaccctgaagtattgggcagcattcttggagcactgaaggccattgtaaatgtcataggtatgcataagatgactccaccaattaaagatctgctgcctagactcacccccatcttaaagaacagacatgaaaaagtacaagagaattgtattgatcttgttggtcgtattgctgacaggggagctgaatatgtatctgcaagagagtggatgaggatttgctttgagcttttagagctcttaaaagcccacaaaaaggctattcgtagagccacagtcaacacatttggttatattgcaaaggccattggccctcatgatgtattggctacacttctgaacaacctcaaagttcaagaaaggcagaacagagtttgtaccactgtagcaatagctattgttgcagaaacatgttcaccctttacagtactccctgccttaatgaatgaatacagagttcctgaactgaatgttcaaaatggagtgttaaaatcgctttccttcttgtttgaatatattggtgaaatgggaaaagactacatttatgccgtaacaccgttacttgaagatgctttaatggatagagaccttgtacacagacagacggctagtgcagtggtacagcacatgtcacttggggtttatggatttggttgtgaagattcgctgaatcacttgttgaactatgtatggcccaatgtgtttgagacatctcctcatgtaattcaggcagttatgggagccctagagggcctgagagttgctattggaccatgtagaatgttgcaatattgtttacagggtctgtttcacccagcccggaaagtcagagatgtatattggaaaatttacaactccatctacattggttcccaggacgctctcatagcacattacccaagaatctacaacgatgataagaacacctatattcgttatgaacttgactatatcttataattttattgtttattttgtgtttaatgcacagctacttcacaccttaaacttgctttgatttggtgatgtaaacttttaaacattgcagatcagtgtagaactggtcatagaggaagagctagaaatccagtagcatgatttttaaataacctgtctttgtttttgatgttaaacagtaaatgccagtagtgaccaagaacacagtgattatatacactatactggagggatttcatttttaattcatctttatgaagatttagaactcattccttgtgtttaaagggaatgtttaattgagaaataaacatttgtgtacaaaatgctaaaaaaaccagacgaactgttagcaaaccaagcaacaccactcaacaaatataacccgtctacctcccttgaacatcatgctcacaagaagcccccccatcaaccctcacccacacacgccgtcccaaaccacgacccccccccgagcccggcccacacaccccccccccccgcgccccctccaccccccccccaacgcggcaagaccgcactccagcacaaactagcgaaccagcaaaaccacacccccccggcggcaccacaaacgcgccgaatcgaccgccacagccaacgcccctcagctcccgcacaccccatcgtgcgacagctcacacaccaacccacccccacgtccccacacgatgcgccacgcatacactttagacgatgatcactgaccgcgcacaacgcctccgcacgacccccaccactcatacacacccaccgcgcactaccccccacccacaccatcccaccacagaccccccagcgccaccccacccgcgcacacaccacccccaccccacactaccaccacc

SEQ ID NO: 427443 - DNA, 4405 bp, Homo sapiens
  misc_feature (37)..(38): n is a, c, g, or t
gcggccgcctactactactaaattcgcggccgcgtcnncgagggaagacccctgatcctaaaatgaatgctaggacttacatggatgtaatgcgagaacaacacttgactaaagaagaacgagaaattaggcaacagctagcagaaaaagctaaagctggagaactaaaagtcgtcaatggagcagcagcgtcccagcctccatcaaaacgaaaacggcgttgggatcaaacagctgatcagactcctggtgccactcccaaaaaactatcaagttgggatcaggcagagacccctgggcatactccttccttaagatgggatgagacaccaggtcgtgcaaagggaagcgagactcctggagcaaccccaggctcaaaaatatgggatcctacacctagccacacaccagcgggagctgctactcctggacgaggtgatacaccaggccatgcgacaccaggccatggaggcgcaacttccagtgctcgtaaaaacagatgggatgaaacccccaaaacagagagagatactcctgggcatggaagtggatgggctgagactcctcgaacagatcgaggtggagattctattggtgaaacaccgactcctggagccagtaaaagaaaatcacggtgggatgaaacaccagctagtcagatgggtggaagcactccagttctgacccctggaaagacaccaattggcacaccagccatgaacatggctacccctactccaggtcacataatgagtatgactcctgaacagcttcaggcttggcggtgggaaagagaaattgatgagagaaatcgcccactttctgatgaggaattagatgctatgttcccagaaggatataaggtacttcctcctccagctggttatgttcctattcgaactccagctcgaaagctgacagctactccaacacctttgggtggtatgactggtttccacatgcaaactgaagatcgaactatgaaaagtgttaatgaccagccatctggaaatcttccatttttaaaacctgatgatattcaatactttgataaactattggttgatgttgatgaatcaacacttagtccagaagagcaaaaagagagaaaaataatgaagttgcttttaaaaattaagaatggaacaccaccaatgagaaaggctgcattgcgtcagattactgataaagctcgtgaatttggagctggtcctttgtttaatcagattcttcctctgctgatgtctcctacacttgaggatcaagagcgtcatttacttgtgaaagttattgataggatactgtacaaacttgatgacttagttcgtccatatgtgcataagatcctcgtggtcattgaaccgctattgattgatgaagattactatgctagagtggaaggccgagagatcatttctaatttggcaaaggctgctggtctggctactatgatctctaccatgagacctgatatagataacatggatgagtatgtccgtaacacaacagctagagcttttgctgttgtagcctctgccctgggcattccttctttattgcccttcttaaaagctgtgtgcaaaagcaagaagtcctggcaagcgagacacactggtattaagattgtacaacagatagctattcttatgggctgtgccatcttgccacatcttagaagtttagttgaaatcattgaacatggtcttgtggatgagcagcagaaagttcggaccatcagtgctttggccattgctgccttggctgaagcagcaactccttatggtatcgaatcttttgattctgtgttaaagcctttatggaagggtatccgccaacacagaggaaagggtttggctgctttcttgaaggctattgggtatcttattcctcttatggatgcagaatatgccaactactatactagagaagtgatgttaatccttattcgagaattccagtctcctgatgaggaaatgaaaaaaattgtgctgaaggtggtaaaacagtgttgtgggacagatggtgtagaagcaaactacattaaaacagagattcttcctcccttttttaaacacttctggcagcacaggatggctttggatagaagaaattaccgacagttagttgatactactgtggagttggcaaacaaagtaggtgcagcagaaattatatccaggattgtggatgatctgaaagatgaagccgaacagtacagaaaaatggtgatggagacaattgagaaaattatgggcaatttgggagcagcagatattgatcataaacttgaagaacaactgattgatggtattctttatgctttccaagaacagactacagaggactcagtaatgttgaacggctttggcacagtggttaatgctcttggcaaacgagtcaaaccatacttgcctcagatctgtggtacagttttgtggcgtttaaataacaaatctgctaaagttaggcaacaggcagctgacttgatttctcgaactgctgttgtcatgaagacttgtcaagaggaaaaattgatgggacacttgggtgttgtattgtatgagtatttgggtgaagagtaccctgaagtattgggcagcattcttggagcactgaaggccattgtaaatgtcataggtatgcataagatgactccaccaattaaagatctgctgcctagactcacccccatcttaaagaacagacatgaaaaagtacaagagaattgtattgatcttgttggtcgtattgctgacaggggagctgaatatgtatctgcaagagagtggatgaggatttgctttgagcttttagagctcttaaaagcccacaaaaaggctattcgtagagccacagtcaacacatttggttatattgcaaaggccattggccctcatgatgtattggctacacttctgaacaacctcaaagttcaagaaaggcagaacagagtttgtaccactgtagcaatagctattgttgcagaaacatgttcaccctttacagtactccctgccttaatgaatgaatacagagttcctgaactgaatgttcaaaatggagtgttaaaatcgctttccttcttgtttgaatatattggtgaaatgggaaaagactacatttatgccgtaacaccgttacttgaagatgctttaatggatagagaccttgtacacagacagacggctagtgcagtggtacagcacatgtcacttggggtttatggatttggttgtgaagattcgctgaatcacttgttgaactatgtatggcccaatgtgtttgagacatctcctcatgtaattcaggcagttatgggagccctagagggcctgagagttgctattggaccatgtagaatgttgcaatattgtttacagggtctgtttcacccagcccggaaagtcagagatgtatattggaaaatttacaactccatctacattggttcccaggacgctctcatagcacattacccaagaatctacaacgatgataagaacacctatattcgttatgaacttgactatatcttataattttattgtttattttgtgtttaatgcacagctacttcacaccttaaacttgctttgatttggtgatgtaaacttttaaacattgcagatcagtgtagaactggtcatagaggaagagctagaaatccagtagcatgatttttaaataacctgtctttgtttttgatgttaaacagtaaatgccagtagtgaccaagaacacagtgattatatacactatactggagggatttcatttttaattcatctttatgaagatttagaactcattccttgtgtttaaagggaatgtttaattgagaaataaacatttgtgtacaaaatgctaaaaaaaccagacgaactgttagcaaaccaagcaacaccactcaacaaatataacccgtctacctcccttgaacatcatgctcacaagaagcccccccatcaaccctcacccacacacgccgtcccaaaccacgacccccccccgagcccggcccacacaccccccccccccgcgccccctccaccccccccccaacgcggcaagaccgcactccagcacaaactagcgaaccagcaaaaccacacccccccggcggcaccacaaacgcgccgaatcgaccgccacagccaacgcccctcagctcccgcacaccccatcgtgcgacagctcacacaccaacccacccccacgtccccacacgatgcgccacgcatacactttagacgatgatcactgaccgcgcacaacgcctccgcacgacccccaccactcatacacacccaccgcgcactaccccccacccacaccatcccaccacagaccccccagcgccaccccacccgcgcacacaccacccccaccccacactaccaccacc

SEQ ID NO: 427444 - DNA, 5057 bp, Homo sapiens
agcggaagttcttgggagcgccagttccgtctgtgtgttcgagtggacaaaatggcgaagatcgccaagactcacgaagatattgaagcacagattcgagaaattcaaggcaagaaggcagctcttgatgaagctcaaggagtgggcctcgattctacaggttattatgaccaggaaatttatggtggaagtgacagcagatttgctggatacgtgacatcaattgctgcaactgaacttgaagatgatgacgatgactattcatcatctacgagtttgcttggtcagaagaagccaggatatcatgcccctgtggcattgcttaatgatataccacagtcaacagaacagtatgatccatttgctgagcacagacctccaaagattgcagaccgggaagatgaatacaaaaagcataggcggaccatgataatttccccagagcgtcttgatccttttgcagatggcttctattctgctgcttgaagtcagaactgctgatggagacaaaggcacgaaagtgtacgtattccggattagcaacccaggaacccatcacttctgaagactctaaactgtgctgtcattttgtttttatatgcattaaaatatttgttttaaactgctgtagatgtttgtgttcaaacaggttaaattgatcagcaaactcaataaaaagtaagatgtataattattaaagttttccatcaaaaaataatttaaatgattatggaataacataatatttagagcagggcagataaatcagttgaacctgcttattttttatttattgtactctttttcctgttgctgttcttttctgcaggagagggaagacccctgatcctaaaatgaatgctaggacttacatggatgtaatgcgagaacaacacttgactaaagaagaacgagaaattaggcaacagctagcagaaaaagctaaagctggagaactaaaagtcgtcaatggagcagcagcgtcccagcctccatcaaaacgaaaacggcgttgggatcaaacagctgatcagactcctggtgccactcccaaaaaactatcaagttgggatcaggcagagacccctgggcatactccttccttaagatgggatgagacaccaggtcgtgcaaagggaagcgagactcctggagcaaccccaggctcaaaaatatgggatcctacacctagccacacaccagcgggagctgctactcctggacgaggtgatacaccaggccatgcgacaccaggccatggaggcgcaacttccagtgctcgtaaaaacagatgggatgaaacccccaaaacagagagagatactcctgggcatggaagtggatgggctgagactcctcgaacagatcgaggtggagattctattggtgaaacaccgactcctggagccagtaaaagaaaatcacggtgggatgaaacaccagctagtcagatgggtggaagcactccagttctgacccctggaaagacaccaattggcacaccagccatgaacatggctacccctactccaggtcacataatgagtatgactcctgaacagcttcaggcttggcggtgggaaagagaaattgatgagagaaatcgcccactttctgatgaggaattagatgctatgttcccagaaggatataaggtacttcctcctccagctggttatgttcctattcgaactccagctcgaaagctgacagctactccaacacctttgggtggtatgactggtttccacatgcaaactgaagatcgaactatgaaaagtgttaatgaccagccatctggaaatcttccatttttaaaacctgatgatattcaatactttgataaactattggttgatgttgatgaatcaacacttagtccagaagagcaaaaagagagaaaaataatgaagttgcttttaaaaattaagaatggaacaccaccaatgagaaaggctgcattgcgtcagattactgataaagctcgtgaatttggagctggtcctttgtttaatcagattcttcctctgctgatgtctcctacacttgaggatcaagagcgtcatttacttgtgaaagttattgataggatactgtacaaacttgatgacttagttcgtccatatgtgcataagatcctcgtggtcattgaaccgctattgattgatgaagattactatgctagagtggaaggccgagagatcatttctaatttggcaaaggctgctggtctggctactatgatctctaccatgagacctgatatagataacatggatgagtatgtccgtaacacaacagctagagcttttgctgttgtagcctctgccctgggcattccttctttattgcccttcttaaaagctgtgtgcaaaagcaagaagtcctggcaagcgagacacactggtattaagattgtacaacagatagctattcttatgggctgtgccatcttgccacatcttagaagtttagttgaaatcattgaacatggtcttgtggatgagcagcagaaagttcggaccatcagtgctttggccattgctgccttggctgaagcagcaactccttatggtatcgaatcttttgattctgtgttaaagcctttatggaagggtatccgccaacacagaggaaagggtttggctgctttcttgaaggctattgggtatcttattcctcttatggatgcagaatatgccaactactatactagagaagtgatgttaatccttattcgagaattccagtctcctgatgaggaaatgaaaaaaattgtgctgaaggtggtaaaacagtgttgtgggacagatggtgtagaagcaaactacattaaaacagagattcttcctcccttttttaaacacttctggcagcacaggatggctttggatagaagaaattaccgacagttagttgatactactgtggagttggcaaacaaagtaggtgcagcagaaattatatccaggattgtggatgatctgaaagatgaagccgaacagtacagaaaaatggtgatggagacaattgagaaaattatgggcaatttgggagcagcagatattgatcataaacttgaagaacaactgattgatggtattctttatgctttccaagaacagactacagaggactcagtaatgttgaacggctttggcacagtggttaatgctcttggcaaacgagtcaaaccatacttgcctcagatctgtggtacagttttgtggcgtttaaataacaaatctgctaaagttaggcaacaggcagctgacttgatttctcgaactgctgttgtcatgaagacttgtcaagaggaaaaattgatgggacacttgggtgttgtattgtatgagtatttgggtgaagagtaccctgaagtattgggcagcattcttggagcactgaaggccattgtaaatgtcataggtatgcataagatgactccaccaattaaagatctgctgcctagactcacccccatcttaaagaacagacatgaaaaagtacaagagaattgtattgatcttgttggtcgtattgctgacaggggagctgaatatgtatctgcaagagagtggatgaggatttgctttgagcttttagagctcttaaaagcccacaaaaaggctattcgtagagccacagtcaacacatttggttatattgcaaaggccattggccctcatgatgtattggctacacttctgaacaacctcaaagttcaagaaaggcagaacagagtttgtaccactgtagcaatagctattgttgcagaaacatgttcaccctttacagtactccctgccttaatgaatgaatacagagttcctgaactgaatgttcaaaatggagtgttaaaatcgctttccttcttgtttgaatatattggtgaaatgggaaaagactacatttatgccgtaacaccgttacttgaagatgctttaatggatagagaccttgtacacagacagacggctagtgcagtggtacagcacatgtcacttggggtttatggatttggttgtgaagattcgctgaatcacttgttgaactatgtatggcccaatgtgtttgagacatctcctcatgtaattcaggcagttatgggagccctagagggcctgagagttgctattggaccatgtagaatgttgcaatattgtttacagggtctgtttcacccagcccggaaagtcagagatgtatattggaaaatttacaactccatctacattggttcccaggacgctctcatagcacattacccaagaatctacaacgatgataagaacacctatattcgttatgaacttgactatatcttataattttattgtttattttgtgtttaatgcacagctacttcacaccttaaacttgctttgatttggtgatgtaaacttttaaacattgcagatcagtgtagaactggtcatagaggaagagctagaaatccagtagcatgatttttaaataacctgtctttgtttttgatgttaaacagtaaatgccagtagtgaccaagaacacagtgattatatacactatactggagggatttcatttttaattcatctttatgaagatttagaactcattccttgtgtttaaagggaatgtttaattgagaaataaacatttgtgtacaaaatgctaatttgtgtgtgttttttgaacatgacttgtaaaatgcggaactttgataaagtattggtttatgtggaataagtggcttaatttcattttctgtcacatggtttatagaaagtagttagctgaataaaaactatataaagtgatggcatctttgtcaaaattccattgttgtgttaataatgacagcaagaagagtagcctcaggggatgttcccctcaaactagcacaaccattccatcatcgtagaaaagtagcacttttgctaaactgtcttgaatattttgtacttacatagcgcctttcatctcttgatttctcaaaatgctttatgaacacatttaaagaaagtggtttaagtcttgtccaacacttgacaggtctgctgtgtttagcaagt

SEQ ID NO: 427445 - DNA, 5063 bp, Homo sapiens
agcggaagttcttgggagcgccagttccgtctgtgtgttcgagtggacaaaatggcgaagatcgccaagactcacgaagatattgaagcacagattcgagaaattcaaggcaagaaggcagctcttgatgaagctcaaggagtgggcctcgattctacaggttattatgaccaggaaatttatggtggaagtgacagcagatttgctggatacgtgacatcaattgctgcaactgaacttgaagatgatgacgatgactattcatcatctacgagtttgcttggtcagaagaagccaggatatcatgcccctgtggcattgcttaatgatataccacagtcaacagaacagtatgatccatttgctgagcacagacctccaaagattgcagaccgggaagatgaatacaaaaagcataggcggaccatgataatttccccagagcgtcttgatccttttgcagatggcttctattctgctgcttgaagtcagaactgctgatggagacaaaggcacgaaagtgtacgtattccggattagcaacccaggaacccatcacttctgaagactctaaactgtgctgtcattttgtttttatatgcattaaaatatttgttttaaactgctgtagatgtttgtgttcaaacaggttaaattgatcagcaaactcaataaaaagtaagatgtataattattaaagttttccatcaaaaaataatttaaatgattatggaataacataatatttagagcagggcagataaatcagttgaacctgcttattttttatttattgtactctttttcctgttgctgttcttttctgcaggagagggaagacccctgatcctaaaatgaatgctaggacttacatggatgtaatgcgagaacaacacttgactaaagaagaacgagaaattaggcaacagctagcagaaaaagctaaagctggagaactaaaagtcgtcaatggagcagcagcgtcccagcctccatcaaaacgaaaacggcgttgggatcaaacagctgatcagactcctggtgccactcccaaaaaactatcaagttgggatcaggcagagacccctgggcatactccttccttaagatgggatgagacaccaggtcgtgcaaagggaagcgagactcctggagcaaccccaggctcaaaaatatgggatcctacacctagccacacaccagcgggagctgctactcctggacgaggtgatacaccaggccatgcgacaccaggccatggaggcgcaacttccagtgctcgtaaaaacagatgggatgaaacccccaaaacagagagagatactcctgggcatggaagtggatgggctgagactcctcgaacagatcgaggtggagattctattggtgaaacaccgactcctggagccagtaaaagaaaatcacggtgggatgaaacaccagctagtcagatgggtggaagcactccagttctgacccctggaaagacaccaattggcacaccagccatgaacatggctacccctactccaggtcacataatgagtatgactcctgaacagcttcaggcttggcggtgggaaagagaaattgatgagagaaatcgcccactttctgatgaggaattagatgctatgttcccagaaggatataaggtacttcctcctccagctggttatgttcctattcgaactccagctcgaaagctgacagctactccaacacctttgggtggtatgactggtttccacatgcaaactgaagatcgaactatgaaaagtgttaatgaccagccatctggaaatcttccatttttaaaacctgatgatattcaatactttgataaactattggttgatgttgatgaatcaacacttagtccagaagagcaaaaagagagaaaaataatgaagttgcttttaaaaattaagaatggaacaccaccaatgagaaaggctgcattgcgtcagattactgataaagctcgtgaatttggagctggtcctttgtttaatcagattcttcctctgctgatgtctcctacacttgaggatcaagagcgtcatttacttgtgaaagttattgataggatactgtacaaacttgatgacttagttcgtccatatgtgcataagatcctcgtggtcattgaaccgctattgattgatgaagattactatgctagagtggaaggccgagagatcatttctaatttggcaaaggctgctggtctggctactatgatctctaccatgagacctgatatagataacatggatgagtatgtccgtaacacaacagctagagcttttgctgttgtagcctctgccctgggcattccttctttattgcccttcttaaaagctgtgtgcaaaagcaagaagtcctggcaagcgagacacactggtattaagattgtacaacagatagctattcttatgggctgtgccatcttgccacatcttagaagtttagttgaaatcattgaacatggtcttgtggatgagcagcagaaagttcggaccatcagtgctttggccattgctgccttggctgaagcagcaactccttatggtatcgaatcttttgattctgtgttaaagcctttatggaagggtatccgccaacacagaggaaagggtttggctgctttcttgaaggctattgggtatcttattcctcttatggatgcagaatatgccaactactatactagagaagtgatgttaatccttattcgagaattccagtctcctgatgaggaaatgaaaaaaattgtgctgaaggtggtaaaacagtgttgtgggacagatggtgtagaagcaaactacattaaaacagagattcttcctcccttttttaaacacttctggcagcacaggatggctttggatagaagaaattaccgacagttagttgatactactgtggagttggcaaacaaagtaggtgcagcagaaattatatccaggattgtggatgatctgaaagatgaagccgaacagtacagaaaaatggtgatggagacaattgagaaaattatgggcaatttgggagcagcagatattgatcataaacttgaagaacaactgattgatggtattctttatgctttccaagaacagactacagaggactcagtaatgttgaacggctttggcacagtggttaatgctcttggcaaacgagtcaaaccatacttgcctcagatctgtggtacagttttgtggcgtttaaataacaaatctgctaaagttaggcaacaggcagctgacttgatttctcgaactgctgttgtcatgaagacttgtcaagaggaaaaattgatgggacacttgggtgttgtattgtatgagtatttgggtgaagagtaccctgaagtattgggcagcattcttggagcactgaaggccattgtaaatgtcataggtatgcataagatgactccaccaattaaagatctgctgcctagactcacccccatcttaaagaacagacatgaaaaagtacaagagaattgtattgatcttgttggtcgtattgctgacaggggagctgaatatgtatctgcaagagagtggatgaggatttgctttgagcttttagagctcttaaaagcccacaaaaaggctattcgtagagccacagtcaacacatttggttatattgcaaaggccattggccctcatgatgtattggctacacttctgaacaacctcaaagttcaagaaaggcagaacagagtttgtaccactgtagcaatagctattgttgcagaaacatgttcaccctttacagtactccctgccttaatgaatgaatacagagttcctgaactgaatgttcaaaatggagtgttaaaatcgctttccttcttgtttgaatatattggtgaaatgggaaaagactacatttatgccgtaacaccgttacttgaagatgctttaatggatagagaccttgtacacagacagacggctagtgcagtggtacagcacatgtcacttggggtttatggatttggttgtgaagattcgctgaatcacttgttgaactatgtatggcccaatgtgtttgagacatctcctcatgtaattcaggcagttatgggagccctagagggcctgagagttgctattggaccatgtagaatgttgcaatattgtttacagggtctgtttcacccagcccggaaagtcagagatgtatattggaaaatttacaactccatctacattggttcccaggacgctctcatagcacattacccaagaatctacaacgatgataagaacacctatattcgttatgaacttgactatatcttataattttattgtttattttgtgtttaatgcacagctacttcacaccttaaacttgctttgatttggtgatgtaaacttttaaacattgcagatcagtgtagaactggtcatagaggaagagctagaaatccagtagcatgatttttaaataacctgtctttgtttttgatgttaaacagtaaatgccagtagtgaccaagaacacagtgattatatacactatactggagggatttcatttttaattcatctttatgaagatttagaactcattccttgtgtttaaagggaatgtttaattgagaaataaacatttgtgtacaaaatgaaaaaaaaaaaaaaaaaaaaaaaaaaaaaaaaaaaaaaaaaaaaaaaaaacaaaaaaaaaataaacaaacaaaaaaaaccaaaaaaaaaaaaaacaaaaaaaaaaaagagggggggggacacgacaagtaccacagagggatagaaacaagatgagcacagaagaaacagagacgctaccacacacgcgcatacaacagacagacgcacgcggggagacgaaaaaaaaaaaagaacgaaggaaaacaggcaaacgtaagagcgcacaatagaaagagagaaccagaatgaaggggaggaagaagcaagagcaggacacacaacaacagcaacgatagcgcaccatgaccgaaacaccaaaagagaagcaggacaatgaaaggtccaaagagaagcgaacacaccaac

SEQ ID NO: 427446 - DNA, 2405 bp, Homo sapiens
aaaaaagggaggaagaatctctgttttaatgtagtttgcttctacaccatctgtcccacaacactgttttaccacttctggcagcacaggatggctttggatagaagaaattaccgacagttagttgatactactgtggagttggcaaacaaagtaggtgcagcagaaattatatccaggattgtggatgatctgaaagatgaagccgaacagtacagaaaaatggtgatggagacaattgagaaaattatgggcaatttgggagcagcagatattgatcataaacttgaagaacaactgattgatggtattctttatgctttccaagaacagactacagaggactcagtaatgttgaacggctttggcacagtggttaatgctcttggcaaacgagtcaaaccatacttgcctcagatctgtggtacagttttgtggcgtttaaataacaaatctgctaaagttaggcaacaggcagctgacttgatttctcgaactgctgttgtcatgaagacttgtcaagaggaaaaattgatgggacacttgggtgttgtattgtatgagtatttgggtgaagagtaccctgaagtattgggcagcattcttggagcactgaaggccattgtaaatgtcataggtatgcataagatgactccaccaattaaagatctgctgcctagactcacccccatcttaaagaacagacatgaaaaagtacaagagaattgtattgatcttgttggtcgtattgctgacaggggagctgaatatgtatctgcaagagagtggatgaggatttgctttgagcttttagagctcttaaaagcccacaaaaaggctattcgtagagccacagtcaacacatttggttatattgcaaaggccattggccctcatgatgtattggctacacttctgaacaacctcaaagttcaagaaaggcagaacagagtttgtaccactgtagcaatagctattgttgcagaaacatgttcaccctttacagtactccctgccttaatgaatgaatacagagttcctgaactgaatgttcaaaatggagtgttaaaatcgctttccttcttgtttgaatatattggtgaaatgggaaaagactacatttatgccgtaacaccgttacttgaagatgctttaatggatagagaccttgtacacagacagacggctagtgcagtggtacagcacatgtcacttggggtttatggatttggttgtgaagattcgctgaatcacttgttgaactatgtatggcccaatgtgtttgagacatctcctcatgtaattcaggcagttatgggagccctagagggcctgagagttgctattggaccatgtagaatgttgcaatattgtttacagggtctgtttcacccagcccggaaagtcagagatgtatattggaaaatttacaactccatctacattggttcccaggacgctctcatagcacattacccaagaatctacaacgatgataagaacacctatattcgttatgaacttgactatatcttataattttattgtttattttgtgtttaatgcacagctacttcacaccttaaacttgctttgatttggtgatgtaaacttttaaacattgcagatcagtgtagaactggtcatagaggaagagctagaaatccagtagcatgatttttaaataacctgtctttgtttttgatgttaaacagtaaatgccagtagtgaccaagaacacagtgattatatacactatactggagggatttcatttttaattcatctttatgaagatttagaactcattccttgtgtttaaagggaatgtttaattgagaaataaacatttgtgtacaaaatgctaaaaaaaccagacgaactgttagcaaaccaagcaacaccactcaacaaatataacccgtctacctcccttgaacatcatgctcacaagaagcccccccatcaaccctcacccacacacgccgtcccaaaccacgacccccccccgagcccggcccacacaccccccccccccgcgccccctccaccccccccccaacgcggcaagaccgcactccagcacaaactagcgaaccagcaaaaccacacccccccggcggcaccacaaacgcgccgaatcgaccgccacagccaacgcccctcagctcccgcacaccccatcgtgcgacagctcacacaccaacccacccccacgtccccacacgatgcgccacgcatacactttagacgatgatcactgaccgcgcacaacgcctccgcacgacccccaccactcatacacacccaccgcgcactaccccccacccacaccatcccaccacagaccccccagcgccaccccacccgcgcacacaccacccccaccccacactaccaccacc

SEQ ID NO: 427447 - DNA, 4598 bp, Homo sapiens
agcggaagttcttgggagcgccagttccgtctgtgtgttcgagtggacaaaatggcgaagatcgccaagactcacgaagatattgaagcacagattcgagaaattcaaggcaagaaggcagctcttgatgaagctcaaggagtgggcctcgattctacaggttattatgaccaggaaatttatggtggaagtgacagcagatttgctggatacgtgacatcaattgctgcaactgaacttgaagatgatgacgatgactattcatcatctacgagtttgcttggtcagaagaagccaggatatcatgcccctgtggcattgcttaatgatataccacagtcaacagaacagtatgatccatttgctgagcacagacctccaaagattgcagaccgggaagatgaatacaaaaagcataggcggaccatgataatttccccagagcgtcttgatccttttgcagatggcttctattctgctgcttgaagtcagaactgctgatggagacaaaggcacgaaagtgtacgtattccggattagcaacccaggaacccatcacttctgaagactctaaactgtgctgtcattttgtttttatatgcattaaaatatttgttttaaactgctgtagatgtttgtgttcaaacaggttaaattgatcagcaaactcaataaaaagtaagatgtataattattaaagttttccatcaaaaaataatttaaatgattatggaataacataatatttagagcagggcagataaatcagttgaacctgcttattttttatttattgtactctttttcctgttgctgttcttttctgcaggagagggaagacccctgatcctaaaatgaatgctaggacttacatggatgtaatgcgagaacaacacttgactaaagaagaacgagaaattaggcaacagctagcagaaaaagctaaagctggagaactaaaagtcgtcaatggagcagcagcgtcccagcctccatcaaaacgaaaacggcgttgggatcaaacagctgatcagactcctggtgccactcccaaaaaactatcaagttgggatcaggcagagacccctgggcatactccttccttaagatgggatgagacaccaggtcgtgcaaagggaagcgagactcctggagcaaccccaggctcaaaaatatgggatcctacacctagccacacaccagcgggagctgctactcctggacgaggtgatacaccaggccatgcgacaccaggccatggaggcgcaacttccagtgctcgtaaaaacagatgggatgaaacccccaaaacagagagagatactcctgggcatggaagtggatgggctgagactcctcgaacagatcgaggtggagattctattggtgaaacaccgactcctggagccagtaaaagaaaatcacggtgggatgaaacaccagctagtcagatgggtggaagcactccagttctgacccctggaaagacaccaattggcacaccagccatgaacatggctacccctactccaggtcacataatgagtatgactcctgaacagcttcaggcttggcggtgggaaagagaaattgatgagagaaatcgcccactttctgatgaggaattagatgctatgttcccagaaggatataaggtacttcctcctccagctggttatgttcctattcgaactccagctcgaaagctgacagctactccaacacctttgggtggtatgactggtttccacatgcaaactgaagatcgaactatgaaaagtgttaatgaccagccatctggaaatcttccatttttaaaacctgatgatattcaatactttgataaactattggttgatgttgatgaatcaacacttagtccagaagagcaaaaagagagaaaaataatgaagttgcttttaaaaattaagaatggaacaccaccaatgagaaaggctgcattgcgtcagattactgataaagctcgtgaatttggagctggtcctttgtttaatcagattcttcctctgctgatgtctcctacacttgaggatcaagagcgtcatttacttgtgaaagttattgataggatactgtacaaacttgatgacttagttcgtccatatgtgcataagatcctcgtggtcattgaaccgctattgattgatgaagattactatgctagagtggaaggccgagagatcatttctaatttggcaaaggctgctggtctggctactatgatctctaccatgagacctgatatagataacatggatgagtatgtccgtaacacaacagctagagcttttgctgttgtagcctctgccctgggcattccttctttattgcccttcttaaaagctgtgtgcaaaagcaagaagtcctggcaagcgagacacactggtattaagattgtacaacagatagctattcttatgggctgtgccatcttgccacatcttagaagtttagttgaaatcattgaacatggtcttgtggatgagcagcagaaagttcggaccatcagtgctttggccattgctgccttggctgaagcagcaactccttatggtatcgaatcttttgattctgtgttaaagcctttatggaagggtatccgccaacacagaggaaagggtttggctgctttcttgaaggctattgggtatcttattcctcttatggatgcagaatatgccaactactatactagagaagtgatgttaatccttattcgagaattccagtctcctgatgaggaaatgaaaaaaattgtgctgaaggtggtaaaacagtgttgtgggacagatggtgtagaagcaaactacattaaaacagagattcttcctcccttttttaaacacttctggcagcacaggatggctttggatagaagaaattaccgacagttagttgatactactgtggagttggcaaacaaagtaggtgcagcagaaattatatccaggattgtggatgatctgaaagatgaagccgaacagtacagaaaaatggtgatggagacaattgagaaaattatgggcaatttgggagcagcagatattgatcataaacttgaagaacaactgattgatggtattctttatgctttccaagaacagactacagaggactcagtaatgttgaacggctttggcacagtggttaatgctcttggcaaacgagtcaaaccatacttgcctcagatctgtggtacagttttgtggcgtttaaataacaaatctgctaaagttaggcaacaggcagctgacttgatttctcgaactgctgttgtcatgaagacttgtcaagaggaaaaattgatgggacacttgggtgttgtattgtatgagtatttgggtgaagagtaccctgaagtattgggcagcattcttggagcactgaaggccattgtaaatgtcataggtatgcataagatgactccaccaattaaagatctgctgcctagactcacccccatcttaaagaacagacatgaaaaagtacaagagaattgtattgatcttgttggtcgtattgctgacaggggagctgaatatgtatctgcaagagagtggatgaggatttgctttgagcttttagagctcttaaaagcccacaaaaaggctattcgtagagccacagtcaacacatttggttatattgcaaaggccattggccctcatgatgtattggctacacttctgaacaacctcaaagttcaagaaaggcagaacagagtttgtaccactgtagcaatagctattgttgcagaaacatgttcaccctttacagtactccctgccttaatgaatgaatacagagttcctgaactgaatgttcaaaatggagtgttaaaatcgctttccttcttgtttgaatatattggtgaaatgggaaaagactacatttatgccgtaacaccgttacttgaagatgctttaatggatagagaccttgtacacagacagacggctagtgcagtggtacagcacatgtcacttggggtttatggatttggttgtgaagattcgctgaatcacttgttgaactatgtatggcccaatgtgtttgagacatctcctcatgtaattcaggcagttatgggagccctagagggcctgagagttgctattggaccatgtagaatgttgcaatattgtttacagggtctgtttcacccagcccggaaagtcagagatgtatattggccaagaatctacaacgatgataagaacacctatattcgttatgaacttgactatatcttataattttattgtttattttgtgtttaatgcacagctacttcacaccttaaacttgctttgatttggtgatgtaaacttttaaacattgcagatcagtgtagaactggtcatagaggaagagctagaaatccagtagcatgatttttaaataacctgtctttgtttttgatgttaaacagtaaatgccagtagtgaccaagaacacagtgattatatacactatactggagggatttcatttttaattcatctttatgaagatttagaactcattccttgtgtttaaagggaatgtttaattgagaaataaacatttgtgtacaa

SEQ ID NO: 427448 - DNA, 1567 bp, Homo sapiens
ccgatccttatgagacagagtgtgcacattcggttatattgcaaaggcatggccctcatgatgtattggctacacttctgaacaacctcaaagttcaagaaaggcagaacagagtttgtaccactgtagcaatagctattgttgcagaaacatgttcaccctttacagtactccctgccttaatgaatgaatacagagttcctgaactgaatgttcaaaatggagtgttaaaatcgctttccttcttgtttgaatatattggtgaaatgggaaaagactacatttatgccgtaacaccgttacttgaagatgctttaatggatagagaccttgtacacagacagacggctagtgcagtggtacagcacatgtcacttggggtttatggatttggttgtgaagattcgctgaatcacttgttgaactatgtatggcccaatgtgtttgagacatctcctcatgtaattcaggcagttatgggagccctagagggcctgagagttgctattggaccatgtagaatgttgcaatattgtttacagggtctgtttcacccagcccggaaagtcagagatgtatattggaaaatttacaactccatctacattggttcccaggacgctctcatagcacattacccaagaatctacaacgatgataagaacacctatattcgttatgaacttgactatatcttataattttattgtttattttgtgtttaatgcacagctacttcacaccttaaacttgctttgatttggtgatgtaaacttttaaacattgcagatcagtgtagaactggtcatagaggaagagctagaaatccagtagcatgatttttaaataacctgtctttgtttttgatgttaaacagtaaatgccagtagtgaccaagaacacagtgattatatacactatactggagggatttcatttttaattcatctttatgaagatttagaactcattccttgtgtttaaagggaatgtttaattgagaaataaacatttgtgtacaaaatgctaaaaaaaccagacgaactgttagcaaaccaagcaacaccactcaacaaatataacccgtctacctcccttgaacatcatgctcacaagaagcccccccatcaaccctcacccacacacgccgtcccaaaccacgacccccccccgagcccggcccacacaccccccccccccgcgccccctccaccccccccccaacgcggcaagaccgcactccagcacaaactagcgaaccagcaaaaccacacccccccggcggcaccacaaacgcgccgaatcgaccgccacagccaacgcccctcagctcccgcacaccccatcgtgcgacagctcacacaccaacccacccccacgtccccacacgatgcgccacgcatacactttagacgatgatcactgaccgcgcacaacgcctccgcacgacccccaccactcatacacacccaccgcgcactaccccccacccacaccatcccaccacagaccccccagcgccaccccacccgcgcacacaccacccccaccccacactaccaccacc

SEQ ID NO: 427449 - DNA, 4080 bp, Homo sapiens
agcggaagttcttgggagcgccagttccgtctgtgtgttcgagtggacaaaatggcgaagatcgccaagactcacgaagatattgaagcacagattcgagaaattcaaggcaagaaggcagctcttgatgaagctcaaggagtgggcctcgattctacaggttattatgaccaggaaatttatggtggaagtgacagcagatttgctggatacgtgacatcaattgctgcaactgaacttgaagatgatgacgatgactattcatcatctacgagtttgcttggtcagaagaagccaggatatcatgcccctgtggcattgcttaatgatataccacagtcaacagaacagtatgatccatttgctgagcacagacctccaaagattgcagaccgggaagatgaatacaaaaagcataggcggaccatgataatttccccagagcgtcttgatccttttgcagatggcttctattctgctgcttgaagtcagaactgctgatggagacaaaggcacgaaagtgtacgtattccggattagcaacccaggaacccatcacttctgaagactctaaactgtgctgtcattttgtttttatatgcattaaaatatttgttttaaactgctgtagatgtttgtgttcaaacaggttaaattgatcagcaaactcaataaaaagtaagatgtataattattaaagttttccatcaaaaaataatttaaatgattatggaataacataatatttagagcagggcagataaatcagttgaacctgcttattttttatttattgtactctttttcctgttgctgttcttttctgcaggagagggaagacccctgatcctaaaatgaatgctaggacttacatggatgtaatgcgagaacaacacttgactaaagaagaacgagaaattaggcaacagctagcagaaaaagctaaagctggagaactaaaagtcgtcaatggagcagcagcgtcccagcctccatcaaaacgaaaacggcgttgggatcaaacagctgatcagactcctggtgccactcccaaaaaactatcaagttgggatcaggcagagacccctgggcatactccttccttaagatgggatgagacaccaggtcgtgcaaagggaagcgagactcctggagcaaccccaggctcaaaaatatgggatcctacacctagccacacaccagcgggagctgctactcctggacgaggtgatacaccaggccatgcgacaccaggccatggaggcgcaacttccagtgctcgtaaaaacagatgggatgaaacccccaaaacagagagagatactcctgggcatggaagtggatgggctgagactcctcgaacagatcgaggtggagattctattggtgaaacaccgactcctggagccagtaaaagaaaatcacggtgggatgaaacaccagctagtcagatgggtggaagcactccagttctgacccctggaaagacaccaattggcacaccagccatgaacatggctacccctactccaggtcacataatgagtatgactcctgaacagcttcaggcttggcggtgggaaagagaaattgatgagagaaatcgcccactttctgatgaggaattagatgctatgttcccagaaggatataaggtacttcctcctccagctggttatgttcctattcgaactccagctcgaaagctgacagctactccaacacctttgggtggtatgactggtttccacatgcaaactgaagatcgaactatgaaaagtgttaatgaccagccatctggaaatcttccatttttaaaacctgatgatattcaatactttgataaactattggttgatgttgatgaatcaacacttagtccagaagagcaaaaagagagaaaaataatgaagttgcttttaaaaattaagaatggaacaccaccaatgagaaaggctgcattgcgtcagattactgataaagctcgtgaatttggagctggtcctttgtttaatcagattcttcctctgctgatgtctcctacacttgaggatcaagagcgtcatttacttgtgaaagttattgataggatactgtacaaacttgatgacttagttcgtccatatgtgcataagatcctcgtggtcattgaaccgctattgattgatgaagattactatgctagagtggaaggccgagagatcatttctaatttggcaaaggctgctggtctggctactatgatctctaccatgagacctgatatagataacatggatgagtatgtccgtaacacaacagctagagcttttgctgttgtagcctctgccctgggcattccttctttattgcccttcttaaaagctgtgtgcaaaagcaagaagtcctggcaagcgagacacactggtattaagattgtacaacagatagctattcttatgggctgtgccatcttgccacatcttagaagtttagttgaaatcattgaacatggtcttgtggatgagcagcagaaagttcggaccatcagtgctttggccattgctgccttggctgaagcagcaactccttatggtatcgaatcttttgattctgtgttaaagcctttatggaagggtatccgccaacacagaggaaagggtttggctgctttcttgaaggctattgggtatcttattcctcttatggatgcagaatatgccaactactatactagagaagtgatgttaatccttattcgagaattccagtctcctgatgaggaaatgaaaaaaattgtgctgaaggtggtaaaacagtgttgtgggacagatggtgtagaagcaaactacattaaaacagagattcttcctcccttttttaaacacttctggcagcacaggatggctttggatagaagaaattaccgacagttagttgatactactgtggagttggcaaacaaagtaggtgcagcagaaattatatccaggattgtggatgatctgaaagatgaagccgaacagtacagaaaaatggtgatggagacaattgagaaaattatgggcaatttgggagcagcagatattgatcataaacttgaagaacaactgattgatggtattctttatgctttccaagaacagactacagaggactcagtaatgttgaacggctttggcacagtggttaatgctcttggcaaacgagtcaaaccatacttgcctcagatctgtggtacagttttgtggcgtttaaataacaaatctgctaaagttaggcaacaggcagctgacttgatttctcgaactgctgttgtcatgaagacttgtcaagaggaaaaattgatgggacacttgggtgttgtattgtatgagtatttgggtgaagagtaccctgaagtattgggcagcattcttggagcactgaaggccattgtaaatgtcataggtatggaatttgctggttacataagactttttcttgttttaactttctttttcttttttttttcgtaagtaaaatcttatttaggagttgggaggtttttgttagctttttaaaagcacttcaagattgtagttaagtcgggggatgtcacaaaagtcttgtttcccaaaacccatttatattttactttaaagagaaaaaaagggtaagtttaggacctacatgagaggtgggagtagtcacagctcaaaaagctttgaagtcatggaatacaggaccctagtagaaatagtgtgtcaggtgaaatatattctgccatgttctgctgcggggtgaaaaggcaatcctaaagttttaatttagttttagaacaatatatatatatttaaaccttgaattagcgattatgacaggttttttgcttgtgatcagtttcaaggaatataatcagagaaaagtgaactgatcaaattattgtctttatttacatacccaagttttaaatactgtccattcagttttctaacccgtaatacagctatattacaaatggtcttggatatggagagcaaagtttttattccattagggcagtatgaagaaaacaaatggtttcttatatttaatcttttttttaaattgattataact

SEQ ID NO: 427450 - DNA, 1717 bp, Homo sapiens
agcggaagttcttgggagcgccagttccgtctgtgtgttcgagtggacaaaatggcgaagatcgccaagactcacgaagatattgaagcacagattcgagaaattcaaggcaagaaggcagctcttgatgaagctcaaggagtgggcctcgattctacaggttattatgaccaggaaatttatggtggaagtgacagcagatttgctggatacgtgacatcaattgctgcaactgaacttgaagatgatgacgatgactattcatcatctacgagtttgcttggtcagaagaagccaggatatcatgcccctgtggcattgcttaatgatataccacagtcaacagaacagtatgatccatttgctgagcacagacctccaaagattgcagaccgggaagatgaatacaaaaagcataggcggaccatgataatttccccagagcgtcttgatccttttgcagatggcttctattctgctgcttgaagtcagaactgctgatggagacaaaggcacgaaagtgtacgtattccggattagcaacccaggaacccatcacttctgaagactctaaactgtgctgtcattttgtttttatatgcattaaaatatttgttttaaactgctgtagatgtttgtgttcaaacaggttaaattgatcagcaaactcaataaaaagtaagatgtataattattaaagttttccatcaaaaaataatttaaatgattatggaataacataatatttagagcagggcagataaatcagttgaacctgcttattttttatttattgtactctttttcctgttgctgttcttttctgcaggagagggaagacccctgatcctaaaatgaatgctaggacttacatggatgtaatgcgagaacaacacttgactaaagaagaacgagaaattaggcaacagctagcagaaaaagctaaagctggagaactaaaagtcgtcaatggagcagcagcgtcccagcctccatcaaaacgaaaacggcgttgggatcaaacagctgatcagactcctggtgccactcccaaaaaactatcaagttgggatcaggcagagacccctgggcatactccttccttaagatgggatgagacaccaggtcgtgcaaagggaagcgagactcctggagcaaccccaggctcaaaaatatgggatcctacacctagccacacaccagcgggagctgctactcctggacgaggtgatacaccaggccatgcgacaccaggccatggaggcgcaacttccagtgctcgtaaaaacagatgggatgaaacccccaaaacagagagagatactcctgggcatggaagtggatgggctgagactcctcgaacagatcgaggtggagattctattggtgaaacaccgactcctggagccagtaaaagaaaatcacggtgggatgaaacaccagctagtcagatgggtggaagcactccagttctgacccctggaaagacaccaattggcacaccagccatgaacatggctacccctactccaggtcacataatgagtatgactcctgaacagcttcaggcttggcggtgggaaagagaaattgatgagagaaatcgcccactttctgatgaggaattagatgctatgttcccagaaggatataaggtagtacatcaaatttgaatgaggtggtatttaggatatacatttattttaaatagtgaaaa

SEQ ID NO: 427451 - DNA, 622 bp, Homo sapiens
atgggctgagactcctcgaacagatcgaggtggagattctattggtgaaacaccgactcctggagccagtaaaagaaaatcacggtgggatgaaacaccagctagtcagatgggtggaagcactccagttctgacccctggaaagacaccaattggcacaccagccatgaacatggctacccctactccaggtagaactgtctcattggacataattgtttttttctccataaattatttaattttttcctttgtggtattctgtgtactattaatgtcaacttctagtaagaataaggagatatacaaatttaagtcttggtttgcgtttataatataaaagcaaataataggattgatcttaactgtcttttatctcaatgtatgtaataatacagtcttgtactatagattatataaaaatttgcttttcttggtaggtcacataatgagtatgactcctgaacagcttcaggcttggcggtgggaaagagaaattgatgagagaaatcgcccactttctgatgaggaattagatgctatgttcccagaaggatataaggtagtacatcaaatttgaatgaggtggtatttaggatatacatttattttaaatagtgaa

SEQ ID NO: 427452 - DNA, 4769 bp, Homo sapiens
ctgccgccgccgccccccagaggcgccggagcccggaatcccgctcggagccagccagccgtcccgagctaccagcaggtttcattgaaaacagatcctgcaaaagttccaggtgcccacactggaaacttggagatcctgcttcccagaccacagctgtggggaacttggggtggagcagagaagtttctgtattcagctgcccaggcagaggagaatggggtctccacagcctgaagaatgaagacacgacagaataaagactcgatgtcaatgaggagtggacggaagaaagaggcccctgggccccgggaagaactgagatcgaggggccgggcctcccctggaggggtcagcacgtccagcagtgatggcaaagctgagaagtccaggcagacagccaagaaggcccgagtagaggaagcctccaccccaaaggtcaacaagcagggtcggagtgaggagatctcagagagtgaaagtgaggagaccaatgcaccaaaaaagaccaaaactgagcaggaactccctcggccacagtctccctccgatctggatagcttggacgggcggagccttaatgatgatggcagcagcgaccctagggatatcgaccaggacaaccgaagcacgtcccccagtatctacagccctggaagtgtggagaatgactctgactcatcttctggcctgtcccagggcccagcccgcccctaccacccacctccactctttcctccttcccctcaaccgccagacagcacccctcgacagccagaggctagctttgaaccccatccttctgtgacacccactggatatcatgctcccatggagccccccacatctcgaatgttccaggctcctcctggggcccctccccctcacccacagctctatcctgggggcactggtggagttttgtctggacccccaatgggtcccaaggggggaggggctgcctcatcagtggggggccctaatgggggtaagcagcaccccccacccactactcccatttcagtatcaagctctggggctagtggtgctcccccaacaaagccgcctaccactccagtgggtggtgggaacctaccttctgctccaccaccagccaacttcccccatgtgacaccgaacctgcctcccccacctgccctgagacccctcaacaatgcatcagcctctccccctggcctgggggcccaaccactacctggtcatctgccctctccccacgccatgggacagggtatgggtggacttcctcctggcccagagaagggcccaactctggctccttcaccccactctctgcctcctgcttcctcttctgctccagcgccccccatgaggtttccttattcatcctctagtagtagctctgcagcagcctcctcttccagttcttcctcctcttcctctgcctcccccttcccagcttcccaggcattgcccagctacccccactctttccctcccccaacaagcctctctgtctccaatcagccccccaagtatactcagccttctctcccatcccaggctgtgtggagccagggtcccccaccacctcctccctatggccgcctcttagccaacagcaatgcccatccaggccccttccctccctctactggggcccagtccaccgcccacccaccagtctcaacacatcaccatcaccaccagcaacagcaacagcagcagcagcagcagcagcagcagcagcagcagcagcagcatcacggaaactctgggccccctcctcctggagcatttccccacccactggagggcggtagctcccaccacgcacacccttacgccatgtctccctccctggggtctctgaggccctacccaccagggccagcacacctgcccccacctcacagccaggtgtcctacagccaagcaggccccaatggccctccagtctcttcctcttccaactcttcctcttccacttctcaagggtcctacccatgttcacacccctccccttcccagggccctcaaggggcgccctaccctttcccaccggtgcctacggtcaccacctcttcggctaccctttccacggtcattgccaccgtggcttcctcgccagcaggctacaaaacggcctccccacctgggcccccaccgtacggaaagagagccccgtccccgggggcctacaagacagccaccccacccggatacaaacccgggtcgcctccctccttccgaacggggaccccaccgggctatcgaggaacctcgccacctgcaggcccagggaccttcaagccgggctcgcccaccgtgggacctgggcccctgccacctgcggggccctcaggcctgccatcgctgccaccaccacctgcggcccctgcctcagggccgcccctgagcgccacgcagatcaaacaggagccggctgaggagtatgagacccccgagagcccggtgcccccagcccgcagcccctcgccccctcccaaggtggtagatgtacccagccatgccagtcagtctgccaggttcaacaaacacctggatcgcggcttcaactcgtgcgcgcgcagcgacctgtacttcgtgccactggagggctccaagctggccaagaagcgggccgacctggtggagaaggtgcggcgcgaggccgagcagcgcgcgcgcgaagaaaaggagcgcgagcgcgagcgggaacgcgagaaagagcgcgagcgcgagaaggagcgcgagcttgaacgcagcgtgaagttggctcaggagggccgtgctccggtggaatgcccatctctgggcccagtgccccatcgccctccatttgaaccgggcagtgcggtggctacagtgcccccctacctgggtcctgacactccagccttgcgcactctcagtgaatatgcccggcctcatgtcatgtctcctggcaatcgcaaccatccattctacgtgcccctgggggcagtggacccggggctcctgggttacaatgtcccggccctgtacagcagtgatccagctgcccgggagagggaacgggaagcccgtgaacgagacctccgtgaccgcctcaagcctggctttgaggtgaagcctagtgagctggaacccctacatggggtccctgggccgggcttggatccctttccccgacatgggggcctggctctgcagcctggcccacctggcctgcaccctttcccctttcatccgagcctggggcccctggagcgagaacgtctagcgctggcagctgggccagccctgcggcctgacatgtcctatgctgagcggctggcagctgagaggcagcacgcagaaagggtggcggccctgggcaatgacccactggcccggctgcagatgctcaatgtgactccccatcaccaccagcactcccacatccactcgcacctgcacctgcaccagcaagatgctatccatgcagcctctgcctcggtgcaccctctcattgaccccctggcctcagggtctcaccttacccggatcccctacccagctggaactctccctaaccccctgcttcctcaccctctgcacgagaacgaagttcttcgtcaccagctctttgctgccccttaccgggacctgccggcctccctttctgccccgatgtcagcagctcatcagctgcaggccatgcacgcacagtcagctgagctgcagcgcttggcgctggaacagcagcagtggctgcatgcccatcacccgctgcacagtgtgccgctgcctgcccaggaggactactacagtcacctgaagaaggaaagcgacaagccactgtagaacctgcgatcaagagagcaccatggctcctacattggaccttggagcacccccaccctccccccaccgtgcccttggcctgccacccagagccaagagggtgctgctcagttgcagggcctccgcagctggacagagagtgggggagggagggacagacagaaggccaaggcccgatgtggtgtgcagaggtggggaggtggcgaggatggggacagaaagcgcacagaatcttggaccaggtctctcttccttgtcccccctgcttttctcctcccccatgcccaacccctgtggccgccgcccctcccctgccccgttggtgtgattatttcatctgttagatgtggctgttttgcgtagcatcgtgtgccacccctgcccctccccgatccctgtgtgcgcgccccctctgcaatgtatgccccttgccccttccccacactaataatttatatatataaatatctatatgacgctcttaaaaaaacatcccaaccaaaaccaaccaaacaaaaacatcctcacaactccccaggaaaaaaaaaaaaaactcgaggttaaagcagcagtgccaataatgagacccagctgggaaggactcggtgatacccactgggatcttttatcctttgttgcaaaagtgtggacacttttgacagcttggcagattttaactccagaagcactttatgaaatggtacactgactaatccagaagacatttccaacagtttgccagtggttcctcactacactggtactgaaagtgtaatttcttagagccaaaaaactggagaaacaaatatcctgccacctctaacaagtacatgagtacttgatttttatggtatagagcagagccttttcttcctcttcttgatagatgaggccatggtgtaaatggaagtttcagagaggacaaaataaaacggaattccatttttctctcactgtaa

SEQ ID NO: 427453 - DNA, 4766 bp, Homo sapiens
gacgccatactggacgccaagtgggaggaacttcaaggctgtcccctgcgggcctcccgctctgcttctgcgaaggtttcattgaaaacagatcctgcaaaagttccaggtgcccacactggaaacttggagatcctgcttcccagaccacagctgtggggaacttggggtggagcagagaagtttctgtattcagctgcccaggcagaggagaatggggtctccacagcctgaagaatgaagacacgacagaataaagactcgatgtcaatgaggagtggacggaagaaagaggcccctgggccccgggaagaactgagatcgaggggccgggcctcccctggaggggtcagcacgtccagcagtgatggcaaagctgagaagtccaggcagacagccaagaaggcccgagtagaggaagcctccaccccaaaggtcaacaagcagggtcggagtgaggagatctcagagagtgaaagtgaggagaccaatgcaccaaaaaagaccaaaactgagcaggaactccctcggccacagtctccctccgatctggatagcttggacgggcggagccttaatgatgatggcagcagcgaccctagggatatcgaccaggacaaccgaagcacgtcccccagtatctacagccctggaagtgtggagaatgactctgactcatcttctggcctgtcccagggcccagcccgcccctaccacccacctccactctttcctccttcccctcaaccgccagacagcacccctcgacagccagaggctagctttgaaccccatccttctgtgacacccactggatatcatgctcccatggagccccccacatctcgaatgttccaggctcctcctggggcccctccccctcacccacagctctatcctgggggcactggtggagttttgtctggacccccaatgggtcccaaggggggaggggctgcctcatcagtggggggccctaatgggggtaagcagcaccccccacccactactcccatttcagtatcaagctctggggctagtggtgctcccccaacaaagccgcctaccactccagtgggtggtgggaacctaccttctgctccaccaccagccaacttcccccatgtgacaccgaacctgcctcccccacctgccctgagacccctcaacaatgcatcagcctctccccctggcctgggggcccaaccactacctggtcatctgccctctccccacgccatgggacagggtatgggtggacttcctcctggcccagagaagggcccaactctggctccttcaccccactctctgcctcctgcttcctcttctgctccagcgccccccatgaggtttccttattcatcctctagtagtagctctgcagcagcctcctcttccagttcttcctcctcttcctctgcctcccccttcccagcttcccaggcattgcccagctacccccactctttccctcccccaacaagcctctctgtctccaatcagccccccaagtatactcagccttctctcccatcccaggctgtgtggagccagggtcccccaccacctcctccctatggccgcctcttagccaacagcaatgcccatccaggccccttccctccctctactggggcccagtccaccgcccacccaccagtctcaacacatcaccatcaccaccagcaacagcaacagcagcagcagcagcagcagcagcagcagcagcagcagcagcatcacggaaactctgggccccctcctcctggagcatttccccacccactggagggcggtagctcccaccacgcacacccttacgccatgtctccctccctggggtctctgaggccctacccaccagggccagcacacctgcccccacctcacagccaggtgtcctacagccaagcaggccccaatggccctccagtctcttcctcttccaactcttcctcttccacttctcaagggtcctacccatgttcacacccctccccttcccagggccctcaaggggcgccctaccctttcccaccggtgcctacggtcaccacctcttcggctaccctttccacggtcattgccaccgtggcttcctcgccagcaggctacaaaacggcctccccacctgggcccccaccgtacggaaagagagccccgtccccgggggcctacaagacagccaccccacccggatacaaacccgggtcgcctccctccttccgaacggggaccccaccgggctatcgaggaacctcgccacctgcaggcccagggaccttcaagccgggctcgcccaccgtgggacctgggcccctgccacctgcggggccctcaggcctgccatcgctgccaccaccacctgcggcccctgcctcagggccgcccctgagcgccacgcagatcaaacaggagccggctgaggagtatgagacccccgagagcccggtgcccccagcccgcagcccctcgccccctcccaaggtggtagatgtacccagccatgccagtcagtctgccaggttcaacaaacacctggatcgcggcttcaactcgtgcgcgcgcagcgacctgtacttcgtgccactggagggctccaagctggccaagaagcgggccgacctggtggagaaggtgcggcgcgaggccgagcagcgcgcgcgcgaagaaaaggagcgcgagcgcgagcgggaacgcgagaaagagcgcgagcgcgagaaggagcgcgagcttgaacgcagcgtgaagttggctcaggagggccgtgctccggtggaatgcccatctctgggcccagtgccccatcgccctccatttgaaccgggcagtgcggtggctacagtgcccccctacctgggtcctgacactccagccttgcgcactctcagtgaatatgcccggcctcatgtcatgtctcctggcaatcgcaaccatccattctacgtgcccctgggggcagtggacccggggctcctgggttacaatgtcccggccctgtacagcagtgatccagctgcccgggagagggaacgggaagcccgtgaacgagacctccgtgaccgcctcaagcctggctttgaggtgaagcctagtgagctggaacccctacatggggtccctgggccgggcttggatccctttccccgacatgggggcctggctctgcagcctggcccacctggcctgcaccctttcccctttcatccgagcctggggcccctggagcgagaacgtctagcgctggcagctgggccagccctgcggcctgacatgtcctatgctgagcggctggcagctgagaggcagcacgcagaaagggtggcggccctgggcaatgacccactggcccggctgcagatgctcaatgtgactccccatcaccaccagcactcccacatccactcgcacctgcacctgcaccagcaagatgctatccatgcagcctctgcctcggtgcaccctctcattgaccccctggcctcagggtctcaccttacccggatcccctacccagctggaactctccctaaccccctgcttcctcaccctctgcacgagaacgaagttcttcgtcaccagctctttgctgccccttaccgggacctgccggcctccctttctgccccgatgtcagcagctcatcagctgcaggccatgcacgcacagtcagctgagctgcagcgcttggcgctggaacagcagcagtggctgcatgcccatcacccgctgcacagtgtgccgctgcctgcccaggaggactactacagtcacctgaagaaggaaagcgacaagccactgtagaacctgcgatcaagagagcaccatggctcctacattggaccttggagcacccccaccctccccccaccgtgcccttggcctgccacccagagccaagagggtgctgctcagttgcagggcctccgcagctggacagagagtgggggagggagggacagacagaaggccaaggcccgatgtggtgtgcagaggtggggaggtggcgaggatggggacagaaagcgcacagaatcttggaccaggtctctcttccttgtcccccctgcttttctcctcccccatgcccaacccctgtggccgccgcccctcccctgccccgttggtgtgattatttcatctgttagatgtggctgttttgcgtagcatcgtgtgccacccctgcccctccccgatccctgtgtgcgcgccccctctgcaatgtatgccccttgccccttccccacactaataatttatatatataaatatctatatgacgctcttaaaaaaacatcccaaccaaaaccaaccaaacaaaaacatcctcacaactccccaggaaaaaaaaaaaaaactcgaggttaaagcagcagtgccaataatgagacccagctgggaaggactcggtgatacccactgggatcttttatcctttgttgcaaaagtgtggacacttttgacagcttggcagattttaactccagaagcactttatgaaatggtacactgactaatccagaagacatttccaacagtttgccagtggttcctcactacactggtactgaaagtgtaatttcttagagccaaaaaactggagaaacaaatatcctgccacctctaacaagtacatgagtacttgatttttatggtatagagcagagccttttcttcctcttcttgatagatgaggccatggtgtaaatggaagtttcagagaggacaaaataaaacggaattccatttttctctcactgtaa

SEQ ID NO: 427454 - DNA, 5052 bp, Homo sapiens
ctgccgccgccgccccccagaggcgccggagcccggaatcccgctcggagccagccagccgtcccgagctaccagcaggtttcattgaaaacagatcctgcaaaagttccaggtgcccacactggaaacttggagatcctgcttcccagaccacagctgtggggaacttggggtggagcagagaagtttctgtattcagctgcccaggcagaggagaatggggtctccacagcctgaagaatgaagacacgacagaataaagactcgatgtcaatgaggagtggacggaagaaagaggcccctgggccccgggaagaactgagatcgaggggccgggcctcccctggaggggtcagcacgtccagcagtgatggcaaagctgagaagtccaggcagacagccaagaaggcccgagtagaggaagcctccaccccaaaggtcaacaagcagggtcggagtgaggagatctcagagagtgaaagtgaggagaccaatgcaccaaaaaagaccaaaactgagcaggaactccctcggccacagtctccctccgatctggatagcttggacgggcggagccttaatgatgatggcagcagcgaccctagggatatcgaccaggacaaccgaagcacgtcccccagtatctacagccctggaagtgtggagaatgactctgactcatcttctggcctgtcccagggcccagcccgcccctaccacccacctccactctttcctccttcccctcaaccgccagacagcacccctcgacagccagaggctagctttgaaccccatccttctgtgacacccactggatatcatgctcccatggagccccccacatctcgaatgttccaggctcctcctggggcccctccccctcacccacagctctatcctgggggcactggtggagttttgtctggacccccaatgggtcccaaggggggaggggctgcctcatcagtggggggccctaatgggggtaagcagcaccccccacccactactcccatttcagtatcaagctctggggctagtggtgctcccccaacaaagccgcctaccactccagtgggtggtgggaacctaccttctgctccaccaccagccaacttcccccatgtgacaccgaacctgcctcccccacctgccctgagacccctcaacaatgcatcagcctctccccctggcctgggggcccaaccactacctggtcatctgccctctccccacgccatgggacagggtatgggtggacttcctcctggcccagagaagggcccaactctggctccttcaccccactctctgcctcctgcttcctcttctgctccagcgccccccatgaggtttccttattcatcctctagtagtagctctgcagcagcctcctcttccagttcttcctcctcttcctctgcctcccccttcccagcttcccaggcattgcccagctacccccactctttccctcccccaacaagcctctctgtctccaatcagccccccaagtatactcagccttctctcccatcccaggctgtgtggagccagggtcccccaccacctcctccctatggccgcctcttagccaacagcaatgcccatccaggccccttccctccctctactggggcccagtccaccgcccacccaccagtctcaacacatcaccatcaccaccagcaacagcaacagcagcagcagcagcagcagcagcagcagcagcagcagcagcatcacggaaactctgggccccctcctcctggagcatttccccacccactggagggcggtagctcccaccacgcacacccttacgccatgtctccctccctggggtctctgaggccctacccaccagggccagcacacctgcccccacctcacagccaggtgtcctacagccaagcaggccccaatggccctccagtctcttcctcttccaactcttcctcttccacttctcaagggtcctacccatgttcacacccctccccttcccagggccctcaaggggcgccctaccctttcccaccggtgcctacggtcaccacctcttcggctaccctttccacggtcattgccaccgtggcttcctcgccagcaggctacaaaacggcctccccacctgggcccccaccgtacggaaagagagccccgtccccgggggcctacaagacagccaccccacccggatacaaacccgggtcgcctccctccttccgaacggggaccccaccgggctatcgaggaacctcgccacctgcaggcccagggaccttcaagccgggctcgcccaccgtgggacctgggcccctgccacctgcggggccctcaggcctgccatcgctgccaccaccacctgcggcccctgcctcagggccgcccctgagcgccacgcagatcaaacaggagccggctgaggagtatgagacccccgagagcccggtgcccccagcccgcagcccctcgccccctcccaaggtggtagatgtacccagccatgccagtcagtctgccaggtgagcggccaggtggggcggaggtgggcctggaaaggggacgacgacaaggcggcgacgagagagggagtagcagggaggggccttgcgctggtgtagtgttttagaaaagcacgcccctctcctccgtccaggcctagtggccagtgaggcccgcagcagctcacagcctgcaggggtggttttgaggcgggggctacaagcactcgccggggccgcggcgctgcgggctccatcgggcagctcgcaccgcctgagcgcccgctgcttccacgcccggcaggttcaacaaacacctggatcgcggcttcaactcgtgcgcgcgcagcgacctgtacttcgtgccactggagggctccaagctggccaagaagcgggccgacctggtggagaaggtgcggcgcgaggccgagcagcgcgcgcgcgaagaaaaggagcgcgagcgcgagcgggaacgcgagaaagagcgcgagcgcgagaaggagcgcgagcttgaacgcagcgtgaagttggctcaggagggccgtgctccggtggaatgcccatctctgggcccagtgccccatcgccctccatttgaaccgggcagtgcggtggctacagtgcccccctacctgggtcctgacactccagccttgcgcactctcagtgaatatgcccggcctcatgtcatgtctcctggcaatcgcaaccatccattctacgtgcccctgggggcagtggacccggggctcctgggttacaatgtcccggccctgtacagcagtgatccagctgcccgggagagggaacgggaagcccgtgaacgagacctccgtgaccgcctcaagcctggctttgaggtgaagcctagtgagctggaacccctacatggggtccctgggccgggcttggatccctttccccgacatgggggcctggctctgcagcctggcccacctggcctgcaccctttcccctttcatccgagcctggggcccctggagcgagaacgtctagcgctggcagctgggccagccctgcggcctgacatgtcctatgctgagcggctggcagctgagaggcagcacgcagaaagggtggcggccctgggcaatgacccactggcccggctgcagatgctcaatgtgactccccatcaccaccagcactcccacatccactcgcacctgcacctgcaccagcaagatgctatccatgcagcctctgcctcggtgcaccctctcattgaccccctggcctcagggtctcaccttacccggatcccctacccagctggaactctccctaaccccctgcttcctcaccctctgcacgagaacgaagttcttcgtcaccagctctttgctgccccttaccgggacctgccggcctccctttctgccccgatgtcagcagctcatcagctgcaggccatgcacgcacagtcagctgagctgcagcgcttggcgctggaacagcagcagtggctgcatgcccatcacccgctgcacagtgtgccgctgcctgcccaggaggactactacagtcacctgaagaaggaaagcgacaagccactgtagaacctgcgatcaagagagcaccatggctcctacattggaccttggagcacccccaccctccccccaccgtgcccttggcctgccacccagagccaagagggtgctgctcagttgcagggcctccgcagctggacagagagtgggggagggagggacagacagaaggccaaggcccgatgtggtgtgcagaggtggggaggtggcgaggatggggacagaaagcgcacagaatcttggaccaggtctctcttccttgtcccccctgcttttctcctcccccatgcccaacccctgtggccgccgcccctcccctgccccgttggtgtgattatttcatctgttagatgtggctgttttgcgtagcatcgtgtgccacccctgcccctccccgatccctgtgtgcgcgccccctctgcaatgtatgccccttgccccttccccacactaataatttatatatataaatatctatatgacgctcttaaaaaaacatcccaaccaaaaccaaccaaacaaaaacatcctcacaactccccaggaaaaaaaaaaaaaactcgaggttaaagcagcagtgccaataatgagacccagctgggaaggactcggtgatacccactgggatcttttatcctttgttgcaaaagtgtggacacttttgacagcttggcagattttaactccagaagcactttatgaaatggtacactgactaatccagaagacatttccaacagtttgccagtggttcctcactacactggtactgaaagtgtaatttcttagagccaaaaaactggagaaacaaatatcctgccacctctaacaagtacatgagtacttgatttttatggtatagagcagagccttttcttcctcttcttgatagatgaggccatggtgtaaatggaagtttcagagaggacaaaataaaacggaattccatttttctctcactgtaa

SEQ ID NO: 427455 - DNA, 5034 bp, Homo sapiens
ctgccgccgccgccccccagaggcgccggagcccggaatcccgctcggagccagccagccgtcccgagctaccagcaggtttcattgaaaacagatcctgcaaaagttccaggtgcccacactggaaacttggagatcctgcttcccagaccacagctgtggggaacttggggtggagcagagaagtttctgtattcagctgcccaggcagaggagaatggggtctccacagcctgaagaatgaagacacgacagaataaagactcgatgtcaatgaggagtggacggaagaaagaggcccctgggccccgggaagaactgagatcgaggggccgggcctcccctggaggggtcagcacgtccagcagtgatggcaaagctgagaagtccaggcagacagccaagaaggcccgagtagaggaagcctccaccccaaaggtcaacaagcagggtcggagtgaggagatctcagagagtgaaagtgaggagaccaatgcaccaaaaaagaccaaaactgagcaggaactccctcggccacagtctccctccgatctggatagcttggacgggcggagccttaatgatgatggcagcagcgaccctagggatatcgaccaggacaaccgaagcacgtcccccagtatctacagccctggaagtgtggagaatgactctgactcatcttctggcctgtcccagggcccagcccgcccctaccacccacctccactctttcctccttcccctcaaccgccagacagcacccctcgacagccagaggctagctttgaaccccatccttctgtgacacccactggatatcatgctcccatggagccccccacatctcgaatgttccaggctcctcctggggcccctccccctcacccacagctctatcctgggggcactggtggagttttgtctggacccccaatgggtcccaaggggggaggggctgcctcatcagtggggggccctaatgggggtaagcagcaccccccacccactactcccatttcagtatcaagctctggggctagtggtgctcccccaacaaagccgcctaccactccagtgggtggtgggaacctaccttctgctccaccaccagccaacttcccccatgtgacaccgaacctgcctcccccacctgccctgagacccctcaacaatgcatcagcctctccccctggcctgggggcccaaccactacctggtcatctgccctctccccacgccatgggacagggtatgggtggacttcctcctggcccagagaagggcccaactctggctccttcaccccactctctgcctcctgcttcctcttctgctccagcgccccccatgaggtttccttattcatcctctagtagtagctctgcagcagcctcctcttccagttcttcctcctcttcctctgcctcccccttcccagcttcccaggcattgcccagctacccccactctttccctcccccaacaagcctctctgtctccaatcagccccccaagtatactcagccttctctcccatcccaggctgtgtggagccagggtcccccaccacctcctccctatggccgcctcttagccaacagcaatgcccatccaggccccttccctccctctactggggcccagtccaccgcccacccaccagtctcaacacatcaccatcaccaccagcaacagcaacagcagcagcagcagcagcagcagcatcacggaaactctgggccccctcctcctggagcatttccccacccactggagggcggtagctcccaccacgcacacccttacgccatgtctccctccctggggtctctgaggccctacccaccagggccagcacacctgcccccacctcacagccaggtgtcctacagccaagcaggccccaatggccctccagtctcttcctcttccaactcttcctcttccacttctcaagggtcctacccatgttcacacccctccccttcccagggccctcaaggggcgccctaccctttcccaccggtgcctacggtcaccacctcttcggctaccctttccacggtcattgccaccgtggcttcctcgccagcaggctacaaaacggcctccccacctgggcccccaccgtacggaaagagagccccgtccccgggggcctacaagacagccaccccacccggatacaaacccgggtcgcctccctccttccgaacggggaccccaccgggctatcgaggaacctcgccacctgcaggcccagggaccttcaagccgggctcgcccaccgtgggacctgggcccctgccacctgcggggccctcaggcctgccatcgctgccaccaccacctgcggcccctgcctcagggccgcccctgagcgccacgcagatcaaacaggagccggctgaggagtatgagacccccgagagcccggtgcccccagcccgcagcccctcgccccctcccaaggtggtagatgtacccagccatgccagtcagtctgccaggtgagcggccaggtggggcggaggtgggcctggaaaggggacgacgacaaggcggcgacgagagagggagtagcagggaggggccttgcgctggtgtagtgttttagaaaagcacgcccctctcctccgtccaggcctagtggccagtgaggcccgcagcagctcacagcctgcaggggtggttttgaggcgggggctacaagcactcgccggggccgcggcgctgcgggctccatcgggcagctcgcaccgcctgagcgcccgctgcttccacgcccggcaggttcaacaaacacctggatcgcggcttcaactcgtgcgcgcgcagcgacctgtacttcgtgccactggagggctccaagctggccaagaagcgggccgacctggtggagaaggtgcggcgcgaggccgagcagcgcgcgcgcgaagaaaaggagcgcgagcgcgagcgggaacgcgagaaagagcgcgagcgcgagaaggagcgcgagcttgaacgcagcgtgaagttggctcaggagggccgtgctccggtggaatgcccatctctgggcccagtgccccatcgccctccatttgaaccgggcagtgcggtggctacagtgcccccctacctgggtcctgacactccagccttgcgcactctcagtgaatatgcccggcctcatgtcatgtctcctggcaatcgcaaccatccattctacgtgcccctgggggcagtggacccggggctcctgggttacaatgtcccggccctgtacagcagtgatccagctgcccgggagagggaacgggaagcccgtgaacgagacctccgtgaccgcctcaagcctggctttgaggtgaagcctagtgagctggaacccctacatggggtccctgggccgggcttggatccctttccccgacatgggggcctggctctgcagcctggcccacctggcctgcaccctttcccctttcatccgagcctggggcccctggagcgagaacgtctagcgctggcagctgggccagccctgcggcctgacatgtcctatgctgagcggctggcagctgagaggcagcacgcagaaagggtggcggccctgggcaatgacccactggcccggctgcagatgctcaatgtgactccccatcaccaccagcactcccacatccactcgcacctgcacctgcaccagcaagatgctatccatgcagcctctgcctcggtgcaccctctcattgaccccctggcctcagggtctcaccttacccggatcccctacccagctggaactctccctaaccccctgcttcctcaccctctgcacgagaacgaagttcttcgtcaccagctctttgctgccccttaccgggacctgccggcctccctttctgccccgatgtcagcagctcatcagctgcaggccatgcacgcacagtcagctgagctgcagcgcttggcgctggaacagcagcagtggctgcatgcccatcacccgctgcacagtgtgccgctgcctgcccaggaggactactacagtcacctgaagaaggaaagcgacaagccactgtagaacctgcgatcaagagagcaccatggctcctacattggaccttggagcacccccaccctccccccaccgtgcccttggcctgccacccagagccaagagggtgctgctcagttgcagggcctccgcagctggacagagagtgggggagggagggacagacagaaggccaaggcccgatgtggtgtgcagaggtggggaggtggcgaggatggggacagaaagcgcacagaatcttggaccaggtctctcttccttgtcccccctgcttttctcctcccccatgcccaacccctgtggccgccgcccctcccctgccccgttggtgtgattatttcatctgttagatgtggctgttttgcgtagcatcgtgtgccacccctgcccctccccgatccctgtgtgcgcgccccctctgcaatgtatgccccttgccccttccccacactaataatttatatatataaatatctatatgacgctcttaaaaaaacatcccaaccaaaaccaaccaaacaaaaacatcctcacaactccccaggaaaaaaaaaaaaaactcgaggttaaagcagcagtgccaataatgagacccagctgggaaggactcggtgatacccactgggatcttttatcctttgttgcaaaagtgtggacacttttgacagcttggcagattttaactccagaagcactttatgaaatggtacactgactaatccagaagacatttccaacagtttgccagtggttcctcactacactggtactgaaagtgtaatttcttagagccaaaaaactggagaaacaaatatcctgccacctctaacaagtacatgagtacttgatttttatggtatagagcagagccttttcttcctcttcttgatagatgaggccatggtgtaaatggaagtttcagagaggacaaaataaaacggaattccatttttctctcactgtaa

SEQ ID NO: 427456 - DNA, 4773 bp, Homo sapiens
tccttgaggaaggaatagggttttacaggcgggaaacaagactggctgctagggagcagccaagaatgtgaggaaagtgagaaatccccagatggtaagaggtgggcttgagcaagagtactcaccacatcacagtacaacagtgtgctgtgaggggaaatgattttatgcaagagaggccccaaatctcagggaagcaggaaaggaaaagagaaaaaatgagtcttcccttttctacagcaggaactccctcggccacagtctccctccgatctggatagcttggacgggcggagccttaatgatgatggcagcagcgaccctagggatatcgaccaggacaaccgaagcacgtcccccagtatctacagccctggaagtgtggagaatgactctgactcatcttctggcctgtcccagggcccagcccgcccctaccacccacctccactctttcctccttcccctcaaccgccagacagcacccctcgacagccagaggctagctttgaaccccatccttctgtgacacccactggatatcatgctcccatggagccccccacatctcgaatgttccaggctcctcctggggcccctccccctcacccacagctctatcctgggggcactggtggagttttgtctggacccccaatgggtcccaaggggggaggggctgcctcatcagtggggggccctaatgggggtaagcagcaccccccacccactactcccatttcagtatcaagctctggggctagtggtgctcccccaacaaagccgcctaccactccagtgggtggtgggaacctaccttctgctccaccaccagccaacttcccccatgtgacaccgaacctgcctcccccacctgccctgagacccctcaacaatgcatcagcctctccccctggcctgggggcccaaccactacctggtcatctgccctctccccacgccatgggacagggtatgggtggacttcctcctggcccagagaagggcccaactctggctccttcaccccactctctgcctcctgcttcctcttctgctccagcgccccccatgaggtttccttattcatcctctagtagtagctctgcagcagcctcctcttccagttcttcctcctcttcctctgcctcccccttcccagcttcccaggcattgcccagctacccccactctttccctcccccaacaagcctctctgtctccaatcagccccccaagtatactcagccttctctcccatcccaggctgtgtggagccagggtcccccaccacctcctccctatggccgcctcttagccaacagcaatgcccatccaggccccttccctccctctactggggcccagtccaccgcccacccaccagtctcaacacatcaccatcaccaccagcaacagcaacagcagcagcagcagcagcagcagcagcagcagcagcagcagcatcacggaaactctgggccccctcctcctggagcatttccccacccactggagggcggtagctcccaccacgcacacccttacgccatgtctccctccctggggtctctgaggccctacccaccagggccagcacacctgcccccacctcacagccaggtgtcctacagccaagcaggccccaatggccctccagtctcttcctcttccaactcttcctcttccacttctcaagggtcctacccatgttcacacccctccccttcccagggccctcaaggggcgccctaccctttcccaccggtgcctacggtcaccacctcttcggctaccctttccacggtcattgccaccgtggcttcctcgccagcaggctacaaaacggcctccccacctgggcccccaccgtacggaaagagagccccgtccccgggggcctacaagacagccaccccacccggatacaaacccgggtcgcctccctccttccgaacggggaccccaccgggctatcgaggaacctcgccacctgcaggcccagggaccttcaagccgggctcgcccaccgtgggacctgggcccctgccacctgcggggccctcaggcctgccatcgctgccaccaccacctgcggcccctgcctcagggccgcccctgagcgccacgcagatcaaacaggagccggctgaggagtatgagacccccgagagcccggtgcccccagcccgcagcccctcgccccctcccaaggtggtagatgtacccagccatgccagtcagtctgccaggtgagcggccaggtggggcggaggtgggcctggaaaggggacgacgacaaggcggcgacgagagagggagtagcagggaggggccttgcgctggtgtagtgttttagaaaagcacgcccctctcctccgtccaggcctagtggccagtgaggcccgcagcagctcacagcctgcaggggtggttttgaggcgggggctacaagcactcgccggggccgcggcgctgcgggctccatcgggcagctcgcaccgcctgagcgcccgctgcttccacgcccggcaggttcaacaaacacctggatcgcggcttcaactcgtgcgcgcgcagcgacctgtacttcgtgccactggagggctccaagctggccaagaagcgggccgacctggtggagaaggtgcggcgcgaggccgagcagcgcgcgcgcgaagaaaaggagcgcgagcgcgagcgggaacgcgagaaagagcgcgagcgcgagaaggagcgcgagcttgaacgcagcgtgaagttggctcaggagggccgtgctccggtggaatgcccatctctgggcccagtgccccatcgccctccatttgaaccgggcagtgcggtggctacagtgcccccctacctgggtcctgacactccagccttgcgcactctcagtgaatatgcccggcctcatgtcatgtctcctggcaatcgcaaccatccattctacgtgcccctgggggcagtggacccggggctcctgggttacaatgtcccggccctgtacagcagtgatccagctgcccgggagagggaacgggaagcccgtgaacgagacctccgtgaccgcctcaagcctggctttgaggtgaagcctagtgagctggaacccctacatggggtccctgggccgggcttggatccctttccccgacatgggggcctggctctgcagcctggcccacctggcctgcaccctttcccctttcatccgagcctggggcccctggagcgagaacgtctagcgctggcagctgggccagccctgcggcctgacatgtcctatgctgagcggctggcagctgagaggcagcacgcagaaagggtggcggccctgggcaatgacccactggcccggctgcagatgctcaatgtgactccccatcaccaccagcactcccacatccactcgcacctgcacctgcaccagcaagatgctatccatgcagcctctgcctcggtgcaccctctcattgaccccctggcctcagggtctcaccttacccggatcccctacccagctggaactctccctaaccccctgcttcctcaccctctgcacgagaacgaagttcttcgtcaccagctctttgctgccccttaccgggacctgccggcctccctttctgccccgatgtcagcagctcatcagctgcaggccatgcacgcacagtcagctgagctgcagcgcttggcgctggaacagcagcagtggctgcatgcccatcacccgctgcacagtgtgccgctgcctgcccaggaggactactacagtcacctgaagaaggaaagcgacaagccactgtagaacctgcgatcaagagagcaccatggctcctacattggaccttggagcacccccaccctccccccaccgtgcccttggcctgccacccagagccaagagggtgctgctcagttgcagggcctccgcagctggacagagagtgggggagggagggacagacagaaggccaaggcccgatgtggtgtgcagaggtggggaggtggcgaggatggggacagaaagcgcacagaatcttggaccaggtctctcttccttgtcccccctgcttttctcctcccccatgcccaacccctgtggccgccgcccctcccctgccccgttggtgtgattatttcatctgttagatgtggctgttttgcgtagcatcgtgtgccacccctgcccctccccgatccctgtgtgcgcgccccctctgcaatgtatgccccttgccccttccccacactaataatttatatatataaatatctatatgacgctcttaaaaaaacatcccaaccaaaaccaaccaaacaaaaacatcctcacaactccccaggaaaaaaaaaaaaaactcgaggttaaagcagcagtgccaataatgagacccagctgggaaggactcggtgatacccactgggatcttttatcctttgttgcaaaagtgtggacacttttgacagcttggcagattttaactccagaagcactttatgaaatggtacactgactaatccagaagacatttccaacagtttgccagtggttcctcactacactggtactgaaagtgtaatttcttagagccaaaaaactggagaaacaaatatcctgccacctctaacaagtacatgagtacttgatttttatggtatagagcagagccttttcttcctcttcttgatagatgaggccatggtgtaaatggaagtttcagagaggacaaaataaaacggaattccatttttctctcactgtaa

SEQ ID NO: 427457 - DNA, 4896 bp, Homo sapiens
ctgccgccgccgccccccagaggcgccggagcccggaatcccgctcggagccagccagccgtcccgagctaccagcaggtttcattgaaaacagatcctgcaaaagttccaggtgcccacactggaaacttggagatcctgcttcccagaccacagctgtggggaacttggggtggagcagagaagtttctgtattcagctgcccaggcagaggagaatggggtctccacagcctgaagaatgaagacacgacagaataaagactcgatgtcaatgaggagtggacggaagaaagaggcccctgggccccgggaagaactgagatcgaggggccgggcctcccctggaggggtcagcacgtccagcagtgatggcaaagctgagaagtccaggcagacagccaagaaggcccgagtagaggaagcctccaccccaaaggtcaacaagcagggtcggagtgaggagatctcagagagtgaaagtgaggagaccaatgcaccaaaaaagaccaaaactgagcaggaactccctcggccacagtctccctccgatctggatagcttggacgggcggagccttaatgatgatggcagcagcgaccctagggatatcgaccaggacaaccgaagcacgtcccccagtatctacagccctggaagtgtggagaatgactctgactcatcttctggcctgtcccagggcccagcccgcccctaccacccacctccactctttcctccttcccctcaaccgccagacagcacccctcgacagccagaggctagctttgaaccccatccttctgtgacacccactggatatcatgctcccggtaagcagcaccccccacccactactcccatttcagtatcaagctctggggctagtggtgctcccccaacaaagccgcctaccactccagtgggtggtgggaacctaccttctgctccaccaccagccaacttcccccatgtgacaccgaacctgcctcccccacctgccctgagacccctcaacaatgcatcagcctctccccctggcctgggggcccaaccactacctggtcatctgccctctccccacgccatgggacagggtatgggtggacttcctcctggcccagagaagggcccaactctggctccttcaccccactctctgcctcctgcttcctcttctgctccagcgccccccatgaggtttccttattcatcctctagtagtagctctgcagcagcctcctcttccagttcttcctcctcttcctctgcctcccccttcccagcttcccaggcattgcccagctacccccactctttccctcccccaacaagcctctctgtctccaatcagccccccaagtatactcagccttctctcccatcccaggctgtgtggagccagggtcccccaccacctcctccctatggccgcctcttagccaacagcaatgcccatccaggccccttccctccctctactggggcccagtccaccgcccacccaccagtctcaacacatcaccatcaccaccagcaacagcaacagcagcagcagcagcagcagcagcagcagcagcagcagcagcatcacggaaactctgggccccctcctcctggagcatttccccacccactggagggcggtagctcccaccacgcacacccttacgccatgtctccctccctggggtctctgaggccctacccaccagggccagcacacctgcccccacctcacagccaggtgtcctacagccaagcaggccccaatggccctccagtctcttcctcttccaactcttcctcttccacttctcaagggtcctacccatgttcacacccctccccttcccagggccctcaaggggcgccctaccctttcccaccggtgcctacggtcaccacctcttcggctaccctttccacggtcattgccaccgtggcttcctcgccagcaggctacaaaacggcctccccacctgggcccccaccgtacggaaagagagccccgtccccgggggcctacaagacagccaccccacccggatacaaacccgggtcgcctccctccttccgaacggggaccccaccgggctatcgaggaacctcgccacctgcaggcccagggaccttcaagccgggctcgcccaccgtgggacctgggcccctgccacctgcggggccctcaggcctgccatcgctgccaccaccacctgcggcccctgcctcagggccgcccctgagcgccacgcagatcaaacaggagccggctgaggagtatgagacccccgagagcccggtgcccccagcccgcagcccctcgccccctcccaaggtggtagatgtacccagccatgccagtcagtctgccaggtgagcggccaggtggggcggaggtgggcctggaaaggggacgacgacaaggcggcgacgagagagggagtagcagggaggggccttgcgctggtgtagtgttttagaaaagcacgcccctctcctccgtccaggcctagtggccagtgaggcccgcagcagctcacagcctgcaggggtggttttgaggcgggggctacaagcactcgccggggccgcggcgctgcgggctccatcgggcagctcgcaccgcctgagcgcccgctgcttccacgcccggcaggttcaacaaacacctggatcgcggcttcaactcgtgcgcgcgcagcgacctgtacttcgtgccactggagggctccaagctggccaagaagcgggccgacctggtggagaaggtgcggcgcgaggccgagcagcgcgcgcgcgaagaaaaggagcgcgagcgcgagcgggaacgcgagaaagagcgcgagcgcgagaaggagcgcgagcttgaacgcagcgtgaagttggctcaggagggccgtgctccggtggaatgcccatctctgggcccagtgccccatcgccctccatttgaaccgggcagtgcggtggctacagtgcccccctacctgggtcctgacactccagccttgcgcactctcagtgaatatgcccggcctcatgtcatgtctcctggcaatcgcaaccatccattctacgtgcccctgggggcagtggacccggggctcctgggttacaatgtcccggccctgtacagcagtgatccagctgcccgggagagggaacgggaagcccgtgaacgagacctccgtgaccgcctcaagcctggctttgaggtgaagcctagtgagctggaacccctacatggggtccctgggccgggcttggatccctttccccgacatgggggcctggctctgcagcctggcccacctggcctgcaccctttcccctttcatccgagcctggggcccctggagcgagaacgtctagcgctggcagctgggccagccctgcggcctgacatgtcctatgctgagcggctggcagctgagaggcagcacgcagaaagggtggcggccctgggcaatgacccactggcccggctgcagatgctcaatgtgactccccatcaccaccagcactcccacatccactcgcacctgcacctgcaccagcaagatgctatccatgcagcctctgcctcggtgcaccctctcattgaccccctggcctcagggtctcaccttacccggatcccctacccagctggaactctccctaaccccctgcttcctcaccctctgcacgagaacgaagttcttcgtcaccagctctttgctgccccttaccgggacctgccggcctccctttctgccccgatgtcagcagctcatcagctgcaggccatgcacgcacagtcagctgagctgcagcgcttggcgctggaacagcagcagtggctgcatgcccatcacccgctgcacagtgtgccgctgcctgcccaggaggactactacagtcacctgaagaaggaaagcgacaagccactgtagaacctgcgatcaagagagcaccatggctcctacattggaccttggagcacccccaccctccccccaccgtgcccttggcctgccacccagagccaagagggtgctgctcagttgcagggcctccgcagctggacagagagtgggggagggagggacagacagaaggccaaggcccgatgtggtgtgcagaggtggggaggtggcgaggatggggacagaaagcgcacagaatcttggaccaggtctctcttccttgtcccccctgcttttctcctcccccatgcccaacccctgtggccgccgcccctcccctgccccgttggtgtgattatttcatctgttagatgtggctgttttgcgtagcatcgtgtgccacccctgcccctccccgatccctgtgtgcgcgccccctctgcaatgtatgccccttgccccttccccacactaataatttatatatataaatatctatatgacgctcttaaaaaaacatcccaaccaaaaccaaccaaacaaaaacatcctcacaactccccaggaaaaaaaaaaaaaactcgaggttaaagcagcagtgccaataatgagacccagctgggaaggactcggtgatacccactgggatcttttatcctttgttgcaaaagtgtggacacttttgacagcttggcagattttaactccagaagcactttatgaaatggtacactgactaatccagaagacatttccaacagtttgccagtggttcctcactacactggtactgaaagtgtaatttcttagagccaaaaaactggagaaacaaatatcctgccacctctaacaagtacatgagtacttgatttttatggtatagagcagagccttttcttcctcttcttgatagatgaggccatggtgtaaatggaagtttcagagaggacaaaataaaacggaattccatttttctctcactgtaa

SEQ ID NO: 427458 - DNA, 3353 bp, Homo sapiens
tctagaggatccctgtggagaggggttcaccacgctggccagtgggtctcaaactcctgaccccaagtgattcgcccacctcggcctcccaaagtgctggggattgcagtcaccacgcacacccttacgccatgtctccctccctggggtctctgaggccctacccaccagggccagcacacctgcccccacctcacagccaggtgtcctacagccaagcaggccccaatggccctccagtctcttcctcttccaactcttcctcttccacttctcaagggtcctacccatgttcacacccctccccttcccagggccctcaaggggcgccctaccctttcccaccggtgcctacggtcaccacctcttcggctaccctttccacggtcattgccaccgtggcttcctcgccagcaggctacaaaacggcctccccacctgggcccccaccgtacggaaagagagccccgtccccgggggcctacaagacagccaccccacccggatacaaacccgggtcgcctccctccttccgaacggggaccccaccgggctatcgaggaacctcgccacctgcaggcccagggaccttcaagccgggctcgcccaccgtgggacctgggcccctgccacctgcggggccctcaggcctgccatcgctgccaccaccacctgcggcccctgcctcagggccgcccctgagcgccacgcagatcaaacaggagccggctgaggagtatgagacccccgagagcccggtgcccccagcccgcagcccctcgccccctcccaaggtggtagatgtacccagccatgccagtcagtctgccaggtgagcggccaggtggggcggaggtgggcctggaaaggggacgacgacaaggcggcgacgagagagggagtagcagggaggggccttgcgctggtgtagtgttttagaaaagcacgcccctctcctccgtccaggcctagtggccagtgaggcccgcagcagctcacagcctgcaggggtggttttgaggcgggggctacaagcactcgccggggccgcggcgctgcgggctccatcgggcagctcgcaccgcctgagcgcccgctgcttccacgcccggcaggttcaacaaacacctggatcgcggcttcaactcgtgcgcgcgcagcgacctgtacttcgtgccactggagggctccaagctggccaagaagcgggccgacctggtggagaaggtgcggcgcgaggccgagcagcgcgcgcgcgaagaaaaggagcgcgagcgcgagcgggaacgcgagaaagagcgcgagcgcgagaaggagcgcgagcttgaacgcagcgtgaagttggctcaggagggccgtgctccggtggaatgcccatctctgggcccagtgccccatcgccctccatttgaaccgggcagtgcggtggctacagtgcccccctacctgggtcctgacactccagccttgcgcactctcagtgaatatgcccggcctcatgtcatgtctcctggcaatcgcaaccatccattctacgtgcccctgggggcagtggacccggggctcctgggttacaatgtcccggccctgtacagcagtgatccagctgcccgggagagggaacgggaagcccgtgaacgagacctccgtgaccgcctcaagcctggctttgaggtgaagcctagtgagctggaacccctacatggggtccctgggccgggcttggatccctttccccgacatgggggcctggctctgcagcctggcccacctggcctgcaccctttcccctttcatccgagcctggggcccctggagcgagaacgtctagcgctggcagctgggccagccctgcggcctgacatgtcctatgctgagcggctggcagctgagaggcagcacgcagaaagggtggcggccctgggcaatgacccactggcccggctgcagatgctcaatgtgactccccatcaccaccagcactcccacatccactcgcacctgcacctgcaccagcaagatgctatccatgcagcctctgcctcggtgcaccctctcattgaccccctggcctcagggtctcaccttacccggatcccctacccagctggaactctccctaaccccctgcttcctcaccctctgcacgagaacgaagttcttcgtcaccagctctttgctgccccttaccgggacctgccggcctccctttctgccccgatgtcagcagctcatcagctgcaggccatgcacgcacagtcagctgagctgcagcgcttggcgctggaacagcagcagtggctgcatgcccatcacccgctgcacagtgtgccgctgcctgcccaggaggactactacagtcacctgaagaaggaaagcgacaagccactgtagaacctgcgatcaagagagcaccatggctcctacattggaccttggagcacccccaccctccccccaccgtgcccttggcctgccacccagagccaagagggtgctgctcagttgcagggcctccgcagctggacagagagtgggggagggagggacagacagaaggccaaggcccgatgtggtgtgcagaggtggggaggtggcgaggatggggacagaaagcgcacagaatcttggaccaggtctctcttccttgtcccccctgcttttctcctcccccatgcccaacccctgtggccgccgcccctcccctgccccgttggtgtgattatttcatctgttagatgtggctgttttgcgtagcatcgtgtgccacccctgcccctccccgatccctgtgtgcgcgccccctctgcaatgtatgccccttgccccttccccacactaataatttatatatataaatatctatatgacgctcttaaaaaaacatcccaaccaaaaccaaccaaacaaaaacatcctcacaactccccaggaaaaaaaaaaaaaactcgaggttaaagcagcagtgccaataatgagacccagctgggaaggactcggtgatacccactgggatcttttatcctttgttgcaaaagtgtggacacttttgacagcttggcagattttaactccagaagcactttatgaaatggtacactgactaatccagaagacatttccaacagtttgccagtggttcctcactacactggtactgaaagtgtaatttcttagagccaaaaaactggagaaacaaatatcctgccacctctaacaagtacatgagtacttgatttttatggtatagagcagagccttttcttcctcttcttgatagatgaggccatggtgtaaatggaagtttcagagaggacaaaataaaacggaattccatttttctctcactgtaa

SEQ ID NO: 427459 - DNA, 4981 bp, Homo sapiens
ctgccgccgccgccccccagaggcgccggagcccggaatcccgctcggagccagccagccgtcccgagctaccagcaggtttcattgaaaacagatcctgcaaaagttccaggtgcccacactggaaacttggagatcctgcttcccagaccacagctgtggggaacttggggtggagcagagaagtttctgtattcagctgcccaggcagaggagaatggggtctccacagcctgaagaatgaagacacgacagaataaagactcgatgtcaatgaggagtggacggaagaaagaggcccctgggccccgggaagaactgagatcgaggggccgggcctcccctggaggggtcagcacgtccagcagtgatggcaaagctgagaagtccaggcagacagccaagaaggcccgagtagaggaagcctccaccccaaaggtcaacaagcagggtcggagtgaggagatctcagagagtgaaagtgaggagaccaatgcaccaaaaaagaccaaaactgagcaggaactccctcggccacagtctccctccgatctggatagcttggacgggcggagccttaatgatgatggcagcagcgaccctagggatatcgaccaggacaaccgaagcacgtcccccagtatctacagccctggaagtgtggagaatgactctgactcatcttctggcctgtcccagggcccagcccgcccctaccacccacctccactctttcctccttcccctcaaccgccagacagcacccctcgacagccagaggctagctttgaaccccatccttctgtgacacccactggatatcatgctcccatggagccccccacatctcgaatgttccaggctcctcctggggcccctccccctcacccacagctctatcctgggggcactggtggagttttgtctggacccccaatgggtcccaaggggggaggggctgcctcatcagtggggggccctaatgggggtaagcagcaccccccacccactactcccatttcagtatcaagctctggggctagtggtgctcccccaacaaagccgcctaccactccagtgggtggtgggaacctaccttctgctccaccaccagccaacttcccccatgtgacaccgaacctgcctcccccacctgccctgagacccctcaacaatgcatcagcctctccccctggcctgggggcccaaccactacctggtcatctgccctctccccacgccatgggacagggtatgggtggacttcctcctggcccagagaagggcccaactctggctccttcaccccactctctgcctcctgcttcctcttctgctccagcgccccccatgaggtttccttattcatcctctagtagtagctctgcagcagcctcctcttccagttcttcctcctcttcctctgcctcccccttcccagcttcccaggcattgcccagctacccccactctttccctcccccaacaagcctctctgtctccaatcagccccccaagtatactcagccttctctcccatcccaggctgtgtggagccagggtcccccaccacctcctccctatggccgcctcttagccaacagcaatgcccatccaggccccttccctccctctactggggcccagtccaccgcccacccaccagtctcaacacatcaccatcaccaccagcaacagcaacagcagcagcagcagcagcagcagcagcagcagcagcagcagcatcacggaaactctgggccccctcctcctggagcatttccccacccactggagggcggtagctcccaccacgcacacccttacgccatgtctccctccctggggtctctgaggccctacccaccagggccagcacacctgcccccacctcacagccaggtgtcctacagccaagcaggccccaatggccctccagtctcttcctcttccaactcttcctcttccacttctcaagggtcctacccatgttcacacccctccccttcccagggccctcaaggggcgccctaccctttcccaccggtgcctacggtcaccacctcttcggctaccctttccacggtcattgccaccgtggcttcctcgccagcaggctacaaaacggcctccccacctgggcccccaccgtacggaaagagagccccgtccccgggggcctacaagacagccaccccacccggatacaaacccgggtcgcctccctccttccgaacggggaccccaccgggctatcgaggaacctcgccacctgcaggcccagggaccttcaagccgggctcgcccaccgtgggacctgggcccctgccacctgcggggccctcaggcctgccatcgctgccaccaccacctgcggcccctgcctcagggccgcccctgagcgccacgcagatcaaacaggagccggctgaggagtatgagacccccgagagcccggtgcccccagcccgcagcccctcgccccctcccaaggtggtagatgtacccagccatgccagtcagtctgccaggtgagcggccaggtggggcggaggtgggcctggaaaggggacgacgacaaggcggcgacgagagagggagtagcagggaggggccttgcgctggtgtagtgttttagaaaagcacgcccctctcctccgtccaggcctagtggccagtgaggcccgcagcagctcacagcctgcaggggtggttttgaggcgggggctacaagcactcgccggggccgcggcgctgcgggctccatcgggcagctcgcaccgcctgagcgcccgctgcttccacgcccggcaggttcaacaaacacctggatcgcggcttcaactcgtgcgcgcgcagcgacctgtacttcgtgccactggagggctccaagctggccaagaagcgggccgacctggtggagaaggtgcggcgcgaggccgagcagcgcgcgcgcgaagaaaaggagcgcgagcgcgagcgggaacgcgagaaagagcgcgagcgcgagaaggagcgcgagcttgaacgcagcgtgaagttggctcaggagggccgtgctccggtggaatgcccatctctgggcccagtgccccatcgccctccatttgaaccgggcagtgcggtggctacagtgcccccctacctgggtcctgacactccagccttgcgcactctcagtgaatatgcccggcctcatgtcatgtctcctggcaatcgcaaccatccattctacgtgcccctgggggcagtggacccggggctcctgggttacaatgtcccggccctgtacagcagtgatccagctgcccgggagagggaacgggaagcccgtgaacgagacctccgtgaccgcctcaagcctggctttgaggtgaagcctagtgagctggaacccctacatggggtccctgggccgggcttggatccctttccccgacatgggggcctggctctgcagcctggcccacctggcctgcaccctttcccctttcatccgagcctggggcccctggagcgagaacgtctagcgctggcagctgggccagccctgcggcctgacatgtcctatgctgagcggctggcaggtgactccccatcaccaccagcactcccacatccactcgcacctgcacctgcaccagcaagatgctatccatgcagcctctgcctcggtgcaccctctcattgaccccctggcctcagggtctcaccttacccggatcccctacccagctggaactctccctaaccccctgcttcctcaccctctgcacgagaacgaagttcttcgtcaccagctctttgctgccccttaccgggacctgccggcctccctttctgccccgatgtcagcagctcatcagctgcaggccatgcacgcacagtcagctgagctgcagcgcttggcgctggaacagcagcagtggctgcatgcccatcacccgctgcacagtgtgccgctgcctgcccaggaggactactacagtcacctgaagaaggaaagcgacaagccactgtagaacctgcgatcaagagagcaccatggctcctacattggaccttggagcacccccaccctccccccaccgtgcccttggcctgccacccagagccaagagggtgctgctcagttgcagggcctccgcagctggacagagagtgggggagggagggacagacagaaggccaaggcccgatgtggtgtgcagaggtggggaggtggcgaggatggggacagaaagcgcacagaatcttggaccaggtctctcttccttgtcccccctgcttttctcctcccccatgcccaacccctgtggccgccgcccctcccctgccccgttggtgtgattatttcatctgttagatgtggctgttttgcgtagcatcgtgtgccacccctgcccctccccgatccctgtgtgcgcgccccctctgcaatgtatgccccttgccccttccccacactaataatttatatatataaatatctatatgacgctcttaaaaaaacatcccaaccaaaaccaaccaaacaaaaacatcctcacaactccccaggaaaaaaaaaaaaaactcgaggttaaagcagcagtgccaataatgagacccagctgggaaggactcggtgatacccactgggatcttttatcctttgttgcaaaagtgtggacacttttgacagcttggcagattttaactccagaagcactttatgaaatggtacactgactaatccagaagacatttccaacagtttgccagtggttcctcactacactggtactgaaagtgtaatttcttagagccaaaaaactggagaaacaaatatcctgccacctctaacaagtacatgagtacttgatttttatggtatagagcagagccttttcttcctcttcttgatagatgaggccatggtgtaaatggaagtttcagagaggacaaaataaaacggaattccatttttctctcactgtaa

SEQ ID NO: 427460 - DNA, 2334 bp, Homo sapiens
gaagttctagaggatcccaattcaacacttcttgccccctggctacaaaattgaggtgcaaaccaatgacatggtgaatgtgacaactccgtggcaggttcatcagattcccacccatggcatccagccacagcctcaaccaccaccccaacatccttcccagccttcagcccagtcagccccagctcctgcccagccagctcctcagcccccacctgccaaagtcagcaagccctcccaaccgcatcaccgcgagcgcgagcgggaacgcgagaaagagcgcgagcgcgagaaggagcgcgagcttgaacgcagcgtgaagttggctcaggagggccgtgctccggtggaatgcccatctctgggcccagtgccccatcgccctccatttgaaccgggcagtgcggtggctacagtgcccccctacctgggtcctgacactccagccttgcgcactctcagtgaatatgcccggcctcatgtcatgtctcctggcaatcgcaaccatccattctacgtgcccctgggggcagtggacccggggctcctgggttacaatgtcccggccctgtacagcagtgatccagctgcccgggagagggaacgggaagcccgtgaacgagacctccgtgaccgcctcaagcctggctttgaggtgaagcctagtgagctggaacccctacatggggtccctgggccgggcttggatccctttccccgacatgggggcctggctctgcagcctggcccacctggcctgcaccctttcccctttcatccgagcctggggcccctggagcgagaacgtctagcgctggcagctgggccagccctgcggcctgacatgtcctatgctgagcggctggcagctgagaggcagcacgcagaaagggtggcggccctgggcaatgacccactggcccggctgcagatgctcaatgtgactccccatcaccaccagcactcccacatccactcgcacctgcacctgcaccagcaagatgctatccatgcagcctctgcctcggtgcaccctctcattgaccccctggcctcagggtctcaccttacccggatcccctacccagctggaactctccctaaccccctgcttcctcaccctctgcacgagaacgaagttcttcgtcaccagctctttgctgccccttaccgggacctgccggcctccctttctgccccgatgtcagcagctcatcagctgcaggccatgcacgcacagtcagctgagctgcagcgcttggcgctggaacagcagcagtggctgcatgcccatcacccgctgcacagtgtgccgctgcctgcccaggaggactactacagtcacctgaagaaggaaagcgacaagccactgtagaacctgcgatcaagagagcaccatggctcctacattggaccttggagcacccccaccctccccccaccgtgcccttggcctgccacccagagccaagagggtgctgctcagttgcagggcctccgcagctggacagagagtgggggagggagggacagacagaaggccaaggcccgatgtggtgtgcagaggtggggaggtggcgaggatggggacagaaagcgcacagaatcttggaccaggtctctcttccttgtcccccctgcttttctcctcccccatgcccaacccctgtggccgccgcccctcccctgccccgttggtgtgattatttcatctgttagatgtggctgttttgcgtagcatcgtgtgccacccctgcccctccccgatccctgtgtgcgcgccccctctgcaatgtatgccccttgccccttccccacactaataatttatatatataaatatctatatgacgctcttaaaaaaacatcccaaccaaaaccaaccaaacaaaaacatcctcacaactccccaggaaaaaaaaaaaaaactcgaggttaaagcagcagtgccaataatgagacccagctgggaaggactcggtgatacccactgggatcttttatcctttgttgcaaaagtgtggacacttttgacagcttggcagattttaactccagaagcactttatgaaatggtacactgactaatccagaagacatttccaacagtttgccagtggttcctcactacactggtactgaaagtgtaatttcttagagccaaaaaactggagaaacaaatatcctgccacctctaacaagtacatgagtacttgatttttatggtatagagcagagccttttcttcctcttcttgatagatgaggccatggtgtaaatggaagtttcagagaggacaaaataaaacggaattccatttttctctcactgtaa

SEQ ID NO: 427461 - DNA, 4920 bp, Homo sapiens
ctgccgccgccgccccccagaggcgccggagcccggaatcccgctcggagccagccagccgtcccgagctaccagcaggtttcattgaaaacagatcctgcaaaagttccaggtgcccacactggaaacttggagatcctgcttcccagaccacagctgtggggaacttggggtggagcagagaagtttctgtattcagctgcccaggcagaggagaatggggtctccacagcctgaagaatgaagacacgacagaataaagactcgatgtcaatgaggagtggacggaagaaagaggcccctgggccccgggaagaactgagatcgaggggccgggcctcccctggaggggtcagcacgtccagcagtgatggcaaagctgagaagtccaggcagacagccaagaaggcccgagtagaggaagcctccaccccaaaggtcaacaagcagggtcggagtgaggagatctcagagagtgaaagtgaggagaccaatgcaccaaaaaagaccaaaactgagcaggaactccctcggccacagtctccctccgatctggatagcttggacgggcggagccttaatgatgatggcagcagcgaccctagggatatcgaccaggacaaccgaagcacgtcccccagtatctacagccctggaagtgtggagaatgactctgactcatcttctggcctgtcccagggcccagcccgcccctaccacccacctccactctttcctccttcccctcaaccgccagacagcacccctcgacagccagaggctagctttgaaccccatccttctgtgacacccactggatatcatgctcccatggagccccccacatctcgaatgttccaggctcctcctggggcccctccccctcacccacagctctatcctgggggcactggtggagttttgtctggacccccaatgggtcccaaggggggaggggctgcctcatcagtggggggccctaatgggggtaagcagcaccccccacccactactcccatttcagtatcaagctctggggctagtggtgctcccccaacaaagccgcctaccactccagtgggtggtgggaacctaccttctgctccaccaccagccaacttcccccatgtgacaccgaacctgcctcccccacctgccctgagacccctcaacaatgcatcagcctctccccctggcctgggggcccaaccactacctggtcatctgccctctccccacgccatgggacagggtatgggtggacttcctcctggcccagagaagggcccaactctggctccttcaccccactctctgcctcctgcttcctcttctgctccagcgccccccatgaggtttccttattcatcctctagtagtagctctgcagcagcctcctcttccagttcttcctcctcttcctctgcctcccccttcccagcttcccaggcattgcccagctacccccactctttccctcccccaacaagcctctctgtctccaatcagccccccaagtatactcagccttctctcccatcccaggctgtgtggagccagggtcccccaccacctcctccctatggccgcctcttagccaacagcaatgcccatccaggccccttccctccctctactggggcccagtccaccgcccacccaccagtctcaacacatcaccatcaccaccagcaacagcaacagcagcagcagcagcagcagcagcagcagcagcagcagcagcatcacggaaactctgggccccctcctcctggagcatttccccacccactggagggcggtagctcccaccacgcacacccttacgccatgtctccctccctggggtctctgaggccctacccaccagggccagcacacctgcccccacctcacagccaggtgtcctacagccaagcaggccccaatggccctccagtctcttcctcttccaactcttcctcttccacttctcaagggtcctacccatgttcacacccctccccttcccagggccctcaaggggcgccctaccctttcccaccggtgcctacggtcaccacctcttcggctaccctttccacggtcattgccaccgtggcttcctcgccagcaggctacaaaacggcctccccacctgggcccccaccgtacggaaagagagccccgtccccgggggcctacaagacagccaccccacccggatacaaacccgggtcgcctccctccttccgaacggggaccccaccgggctatcgaggaacctcgccacctgcaggcccagggaccttcaagccgggctcgcccaccgtgggacctgggcccctgccacctgcggggccctcaggcctgccatcgctgccaccaccacctgcggcccctgcctcagggccgcccctgagcgccacgcagatcaaacaggagccggctgaggagtatgagacccccgagagcccggtgcccccagcccgcagcccctcgccccctcccaaggtggtagatgtacccagccatgccagtcagtctgccaggtgagcggccaggtggggcggaggtgggcctggaaaggggacgacgacaaggcggcgacgagagagggagtagcagggaggggccttgcgctggtgtagtgttttagaaaagcacgcccctctcctccgtccaggcctagtggccagtgaggcccgcagcagctcacagcctgcaggggtggttttgaggcgggggctacaagcactcgccggggccgcggcgctgcgggctccatcgggcagctcgcaccgcctgagcgcccgctgcttccacgcccggcaggttcaacaaacacctggatcgcggcttcaactcgtgcgcgcgcagcgacctgtacttcgtgccactggagggctccaagctggccaagaagcgggccgacctggtggagaaggtgcggcgcgaggccgagcagcgcgcgcgcgaagaaaaggagcgcgagcgcgagcgggaacgcgagaaagagcgcgagcgcgagaaggagcgcgagcttgaacgcagcgtgaagttggctcaggagggccgtgctccggtggaatgcccatctctgggcccagtgccccatcgccctccatttgaaccgggcagtgcggtggctacagtgcccccctacctgggtcctgacactccagccttgcgcactctcagtgaatatgcccggcctcatgtcatgtctcctggcaatcgcaaccatccattctacgtgcccctgggggcagtggacccggggctcctgggttacaatgtcccggccctgtacagcagtgatccagctgcccgggagagggaacgggaagcccgtgaacgagacctccgtgaccgcctcaagcctggctttgaggtgaagcctagtgagctggaacccctacatggggtccctgggccgggcttggatccctttccccgacatgggggcctggctctgcagcctggcccacctggcctgcaccctttcccctttcatccgagcctggggcccctggagcgagaacgtctagcgctggcagctgggccagccctgcggcctgacatgtcctatgctgagcggctggcagctgagaggcagcacgcagaaagggtggcggccctgggcaatgacccactggcccggctgcagatgctcaatgtgactccccatcaccaccagcactcccacatccactcgcacctgcacctgcaccagcaagatgctatccatgcagcctctgcctcggtgcaccctctcattgaccccctggcctcagggtctcaccttacccggatcccctacccagctggaactctccctaaccccctgcttcctcaccctctgcacgagaacgaagttcttcgtcaccagctctttgctgccccttaccgggacctgccggcctccctttctgccccgatgtcagcagctcatcagctgcaggccatgcacgcacagtcagctgagctgcagcgcttggcgctggaacagcagcagtggctgcatgcccatcacccgctgcacagtgtgccgctgcctgcccaggaggactactacagtcacctgaagaaggaaagcgacaagccactgtagaacctgcgatcaagagagcaccatggctcctacattggaccttggagcacccccaccctccccccaccgtgcccttggcctgccacccagagccaagagggtgctgctcagttgcagggcctccgcagctggacagagagtgggggagggagggacagacagaaggccaaggccctcccctgccccgttggtgtgattatttcatctgttagatgtggctgttttgcgtagcatcgtgtgccacccctgcccctccccgatccctgtgtgcgcgccccctctgcaatgtatgccccttgccccttccccacactaataatttatatatataaatatctatatgacgctcttaaaaaaacatcccaaccaaaaccaaccaaacaaaaacatcctcacaactccccaggaaaaaaaaaaaaaactcgaggttaaagcagcagtgccaataatgagacccagctgggaaggactcggtgatacccactgggatcttttatcctttgttgcaaaagtgtggacacttttgacagcttggcagattttaactccagaagcactttatgaaatggtacactgactaatccagaagacatttccaacagtttgccagtggttcctcactacactggtactgaaagtgtaatttcttagagccaaaaaactggagaaacaaatatcctgccacctctaacaagtacatgagtacttgatttttatggtatagagcagagccttttcttcctcttcttgatagatgaggccatggtgtaaatggaagtttcagagaggacaaaataaaacggaattccatttttctctcactgtaa

SEQ ID NO: 427462 - DNA, 4900 bp, Homo sapiens
ctgccgccgccgccccccagaggcgccggagcccggaatcccgctcggagccagccagccgtcccgagctaccagcaggtttcattgaaaacagatcctgcaaaagttccaggtgcccacactggaaacttggagatcctgcttcccagaccacagctgtggggaacttggggtggagcagagaagtttctgtattcagctgcccaggcagaggagaatggggtctccacagcctgaagaatgaagacacgacagaataaagactcgatgtcaatgaggagtggacggaagaaagaggcccctgggccccgggaagaactgagatcgaggggccgggcctcccctggaggggtcagcacgtccagcagtgatggcaaagctgagaagtccaggcagacagccaagaaggcccgagtagaggaagcctccaccccaaaggtcaacaagcagggtcggagtgaggagatctcagagagtgaaagtgaggagaccaatgcaccaaaaaagaccaaaactgagcaggaactccctcggccacagtctccctccgatctggatagcttggacgggcggagccttaatgatgatggcagcagcgaccctagggatatcgaccaggacaaccgaagcacgtcccccagtatctacagccctggaagtgtggagaatgactctgactcatcttctggcctgtcccagggcccagcccgcccctaccacccacctccactctttcctccttcccctcaaccgccagacagcacccctcgacagccagaggctagctttgaaccccatccttctgtgacacccactggatatcatgctcccatggagccccccacatctcgaatgttccaggctcctcctggggcccctccccctcacccacagctctatcctgggggcactggtggagttttgtctggacccccaatgggtcccaaggggggaggggctgcctcatcagtggggggccctaatgggggtaagcagcaccccccacccactactcccatttcagtatcaagctctggggctagtggtgctcccccaacaaagccgcctaccactccagtgggtggtgggaacctaccttctgctccaccaccagccaacttcccccatgtgacaccgaacctgcctcccccacctgccctgagacccctcaacaatgcatcagcctctccccctggcctgggggcccaaccactacctggtcatctgccctctccccacgccatgggacagggtatgggtggacttcctcctggcccagagaagggcccaactctggctccttcaccccactctctgcctcctgcttcctcttctgctccagcgccccccatgaggtttccttattcatcctctagtagtagctctgcagcagcctcctcttccagttcttcctcctcttcctctgcctcccccttcccagcttcccaggcattgcccagctacccccactctttccctcccccaacaagcctctctgtctccaatcagccccccaagtatactcagccttctctcccatcccaggctgtgtggagccagggtcccccaccacctcctccctatggccgcctcttagccaacagcaatgcccatccaggccccttccctccctctactggggcccagtccaccgcccacccaccagtctcaacacatcaccatcaccaccagcaacagcaacagcagcagcagcagcagcagcagcagcagcagcagcagcagcatcacggaaactctgggccccctcctcctggagcatttccccacccactggagggcggtagctcccaccacgcacacccttacgccatgtctccctccctggggtctctgaggccctacccaccagggccagcacacctgcccccacctcacagccaggtgtcctacagccaagcaggccccaatggccctccagtctcttcctcttccaactcttcctcttccacttctcaagggtcctacccatgttcacacccctccccttcccagggccctcaaggggcgccctaccctttcccaccggtgcctacggtcaccacctcttcggctaccctttccacggtcattgccaccgtggcttcctcgccagcaggctacaaaacggcctccccacctgggcccccaccgtacggaaagagagccccgtccccgggggcctacaagacagccaccccacccggatacaaacccgggtcgcctccctccttccgaacggggaccccaccgggctatcgaggaacctcgccacctgcaggcccagggaccttcaagccgggctcgcccaccgtgggacctgggcccctgccacctgcggggccctcaggcctgccatcgctgccaccaccacctgcggcccctgcctcagggccgcccctgagcgccacgcagatcaaacaggagccggctgaggagtatgagacccccgagagcccggtgcccccagcccgcagcccctcgccccctcccaaggtggtagatgtacccagccatgccagtcagtctgccaggtgagcggccaggtggggcggaggtgggcctggaaaggggacgacgacaaggcggcgacgagagagggagtagcagggaggggccttgcgctggtgtagtgttttagaaaagcacgcccctctcctccgtccaggcctagtggccagtgaggcccgcagcagctcacagcctgcaggggtggttttgaggcgggggctacaagcactcgccggggccgcggcgctgcgggctccatcgggcagctcgcaccgcctgagcgcccgctgcttccacgcccggcaggttcaacaaacacctggatcgcggcttcaactcgtgcgcgcgcagcgacctgtacttcgtgccactggagggctccaagctggccaagaagcgggccgacctggtggagaaggtgcggcgcgaggccgagcagcgcgcgcgcgaagaaaaggagcgcgagcgcgagcgggaacgcgagaaagagcgcgagcgcgagaaggagcgcgagcttgaacgcagcgtgaagttggctcaggagggccgtgctccggtggaatgcccatctctgggcccagtgccccatcgccctccatttgaaccgggcagtgcggtggctacagtgcccccctacctgggtcctgacactccagccttgcgcactctcagtgaatatgcccggcctcatgtcatgtctcctggcaatcgcaaccatccattctacgtgcccctgggggcagtggacccggggctcctgggttacaatgtcccggccctgtacagcagtgatccagctgcccgggagagggaacgggaagcccgtgaacgagacctccgtgaccgcctcaagcctggctttgaggtgaagcctagtgagctggaacccctacatggggtccctgggccgggcttggatccctttccccgacatgggggcctggctctgcagcctggcccacctggcctgcaccctttcccctttcatccgagcctggggcccctggagcgagaacgtctagcgctggcagctgggccagccctgcggcctgacatgtcctatgctgagcggctggcagctgagaggcagcacgcagaaagggtggcggccctgggcaatgacccactggcccggctgcagatgctcaataactctccctaaccccctgcttcctcaccctctgcacgagaacgaagttcttcgtcaccagctctttgctgccccttaccgggacctgccggcctccctttctgccccgatgtcagcagctcatcagctgcaggccatgcacgcacagtcagctgagctgcagcgcttggcgctggaacagcagcagtggctgcatgcccatcacccgctgcacagtgtgccgctgcctgcccaggaggactactacagtcacctgaagaaggaaagcgacaagccactgtagaacctgcgatcaagagagcaccatggctcctacattggaccttggagcacccccaccctccccccaccgtgcccttggcctgccacccagagccaagagggtgctgctcagttgcagggcctccgcagctggacagagagtgggggagggagggacagacagaaggccaaggcccgatgtggtgtgcagaggtggggaggtggcgaggatggggacagaaagcgcacagaatcttggaccaggtctctcttccttgtcccccctgcttttctcctcccccatgcccaacccctgtggccgccgcccctcccctgccccgttggtgtgattatttcatctgttagatgtggctgttttgcgtagcatcgtgtgccacccctgcccctccccgatccctgtgtgcgcgccccctctgcaatgtatgccccttgccccttccccacactaataatttatatatataaatatctatatgacgctcttaaaaaaacatcccaaccaaaaccaaccaaacaaaaacatcctcacaactccccaggaaaaaaaaaaaaaactcgaggttaaagcagcagtgccaataatgagacccagctgggaaggactcggtgatacccactgggatcttttatcctttgttgcaaaagtgtggacacttttgacagcttggcagattttaactccagaagcactttatgaaatggtacactgactaatccagaagacatttccaacagtttgccagtggttcctcactacactggtactgaaagtgtaatttcttagagccaaaaaactggagaaacaaatatcctgccacctctaacaagtacatgagtacttgatttttatggtatagagcagagccttttcttcctcttcttgatagatgaggccatggtgtaaatggaagtttcagagaggacaaaataaaacggaattccatttttctctcactgtaa

SEQ ID NO: 427463 - DNA, 1843 bp, Homo sapiens
cacgagggctcgtgcggtgacatattggttctccgaggctctggtactgggaggtgaatccattgagctccgcggagactggataccgggtacgccccggatagcaagagagagtcgtctcgcggaccagccttgacatgcgcggagcttctgcagcgtggcatacgaagcctagtgagctggaacccctacatggggtccctgggccgggcttggatccctttccccgacatgggggcctggctctgcagcctggcccacctggcctgcaccctttcccctttcatccgagcctggggcccctggagcgagaacgtctagcgctggcagctgggccagccctgcggcctgacatgtcctatgctgagcggctggcagctgagaggcagcacgcagaaagggtggcggccctgggcaatgacccactggcccggctgcagatgctcaatgtgactccccatcaccaccagcactcccacatccactcgcacctgcacctgcaccagcaagatgctatccatgcagcctctgcctcggtgcaccctctcattgaccccctggcctcagggtctcaccttacccggatcccctacccagctggaactctccctaaccccctgcttcctcaccctctgcacgagaacgaagttcttcgtcaccagctctttgctgccccttaccgggacctgccggcctccctttctgccccgatgtcagcagctcatcagctgcaggccatgcacgcacagtcagctgagctgcagcgcttggcgctggaacagcagcagtggctgcatgcccatcacccgctgcacagtgtgccgctgcctgcccaggaggactactacagtcacctgaagaaggaaagcgacaagccactgtagaacctgcgatcaagagagcaccatggctcctacattggaccttggagcacccccaccctccccccaccgtgcccttggcctgccacccagagccaagagggtgctgctcagttgcagggcctccgcagctggacagagagtgggggagggagggacagacagaaggccaaggcccgatgtggtgtgcagaggtggggaggtggcgaggatggggacagaaagcgcacagaatcttggaccaggtctctcttccttgtcccccctgcttttctcctcccccatgcccaacccctgtggccgccgcccctcccctgccccgttggtgtgattatttcatctgttagatgtggctgttttgcgtagcatcgtgtgccacccctgcccctccccgatccctgtgtgcgcgccccctctgcaatgtatgccccttgccccttccccacactaataatttatatatataaatatctatatgacgctcttaaaaaaacatcccaaccaaaaccaaccaaacaaaaacatcctcacaactccccaggaaaaaaaaaaaaaactcgaggttaaagcagcagtgccaataatgagacccagctgggaaggactcggtgatacccactgggatcttttatcctttgttgcaaaagtgtggacacttttgacagcttggcagattttaactccagaagcactttatgaaatggtacactgactaatccagaagacatttccaacagtttgccagtggttcctcactacactggtactgaaagtgtaatttcttagagccaaaaaactggagaaacaaatatcctgccacctctaacaagtacatgagtacttgatttttatggtatagagcagagccttttcttcctcttcttgatagatgaggccatggtgtaaatggaagtttcagagaggacaaaataaaacggaattccatttttctctcactgtaa

SEQ ID NO: 427464 - DNA, 1602 bp, Homo sapiens
cggtgcactggagctccaggaggcaagggtgatgctggtgcccctggtgaacctggggcccctggagcgagaacgtctagcgctggcagctgggccagccctgcggcctgacatgtcctatgctgagcggctggcagctgagaggcagcacgcagaaagggtggcggccctgggcaatgacccactggcccggctgcagatgctcaatgtgactccccatcaccaccagcactcccacatccactcgcacctgcacctgcaccagcaagatgctatccatgcagcctctgcctcggtgcaccctctcattgaccccctggcctcagggtctcaccttacccggatcccctacccagctggaactctccctaaccccctgcttcctcaccctctgcacgagaacgaagttcttcgtcaccagctctttgctgccccttaccgggacctgccggcctccctttctgccccgatgtcagcagctcatcagctgcaggccatgcacgcacagtcagctgagctgcagcgcttggcgctggaacagcagcagtggctgcatgcccatcacccgctgcacagtgtgccgctgcctgcccaggaggactactacagtcacctgaagaaggaaagcgacaagccactgtagaacctgcgatcaagagagcaccatggctcctacattggaccttggagcacccccaccctccccccaccgtgcccttggcctgccacccagagccaagagggtgctgctcagttgcagggcctccgcagctggacagagagtgggggagggagggacagacagaaggccaaggcccgatgtggtgtgcagaggtggggaggtggcgaggatggggacagaaagcgcacagaatcttggaccaggtctctcttccttgtcccccctgcttttctcctcccccatgcccaacccctgtggccgccgcccctcccctgccccgttggtgtgattatttcatctgttagatgtggctgttttgcgtagcatcgtgtgccacccctgcccctccccgatccctgtgtgcgcgccccctctgcaatgtatgccccttgccccttccccacactaataatttatatatataaatatctatatgacgctcttaaaaaaacatcccaaccaaaaccaaccaaacaaaaacatcctcacaactccccaggaaaaaaaaaaaaaactcgaggttaaagcagcagtgccaataatgagacccagctgggaaggactcggtgatacccactgggatcttttatcctttgttgcaaaagtgtggacacttttgacagcttggcagattttaactccagaagcactttatgaaatggtacactgactaatccagaagacatttccaacagtttgccagtggttcctcactacactggtactgaaagtgtaatttcttagagccaaaaaactggagaaacaaatatcctgccacctctaacaagtacatgagtacttgatttttatggtatagagcagagccttttcttcctcttcttgatagatgaggccatggtgtaaatggaagtttcagagaggacaaaataaaacggaattccatttttctctcactgtaa

SEQ ID NO: 427465 - DNA, 1790 bp, Homo sapiens
gtgtggtgttctagaggatccctcataggttcgcaggagggaatggtggcacccacctgtagtcccagcaactggggaggctgagatgggaggatcgcttgaggctggaagttgtgtgctatgatcctgctactggatcttgctagagtgctatgatcctactactgcactctgcactccagcctgggcaacatagcaaaactgcatctaaaaaaaacaaaaacaaaaaccatggacaatttaaaatgtagaggcttcatctgctgaaggacacatcagaaaaagactgccctttacctcagtggaaaggaccttgtaggcactaactaacaaataacacagcaattgaactctagggtattgatccctgcgaacctatgatcataggttcgcagggtgactccccatcaccaccagcactcccacatccactcgcacctgcacctgcaccagcaagatgctatccatgcagcctctgcctcggtgcaccctctcattgaccccctggcctcagggtctcaccttacccggatcccctacccagctggaactctccctaaccccctgcttcctcaccctctgcacgagaacgaagttcttcgtcaccagctctttgctgccccttaccgggacctgccggcctccctttctgccccgatgtcagcagctcatcagctgcaggccatgcacgcacagtcagctgagctgcagcgcttggcgctggaacagcagcagtggctgcatgcccatcacccgctgcacagtgtgccgctgcctgcccaggaggactactacagtcacctgaagaaggaaagcgacaagccactgtagaacctgcgatcaagagagcaccatggctcctacattggaccttggagcacccccaccctccccccaccgtgcccttggcctgccacccagagccaagagggtgctgctcagttgcagggcctccgcagctggacagagagtgggggagggagggacagacagaaggccaaggcccgatgtggtgtgcagaggtggggaggtggcgaggatggggacagaaagcgcacagaatcttggaccaggtctctcttccttgtcccccctgcttttctcctcccccatgcccaacccctgtggccgccgcccctcccctgccccgttggtgtgattatttcatctgttagatgtggctgttttgcgtagcatcgtgtgccacccctgcccctccccgatccctgtgtgcgcgccccctctgcaatgtatgccccttgccccttccccacactaataatttatatatataaatatctatatgacgctcttaaaaaaacatcccaaccaaaaccaaccaaacaaaaacatcctcacaactccccaggaaaaaaaaaaaaaactcgaggttaaagcagcagtgccaataatgagacccagctgggaaggactcggtgatacccactgggatcttttatcctttgttgcaaaagtgtggacacttttgacagcttggcagattttaactccagaagcactttatgaaatggtacactgactaatccagaagacatttccaacagtttgccagtggttcctcactacactggtactgaaagtgtaatttcttagagccaaaaaactggagaaacaaatatcctgccacctctaacaagtacatgagtacttgatttttatggtatagagcagagccttttcttcctcttcttgatagatgaggccatggtgtaaatggaagtttcagagaggacaaaataaaacggaattccatttttctctcactgtaa

SEQ ID NO: 427466 - DNA, 1407 bp, Homo sapiens
tgtggcgtctctagaggttcccctccatagcatcacttcccgtcaatagcatcgctccccgtcaaagcttctcgcccccgccagtgctgcctctgcctcggtgcaccctctcattgaccccctggcctcagggtctcaccttacccggatcccctacccagctggaactctccctaaccccctgcttcctcaccctctgcacgagaacgaagttcttcgtcaccagctctttgctgccccttaccgggacctgccggcctccctttctgccccgatgtcagcagctcatcagctgcaggccatgcacgcacagtcagctgagctgcagcgcttggcgctggaacagcagcagtggctgcatgcccatcacccgctgcacagtgtgccgctgcctgcccaggaggactactacagtcacctgaagaaggaaagcgacaagccactgtagaacctgcgatcaagagagcaccatggctcctacattggaccttggagcacccccaccctccccccaccgtgcccttggcctgccacccagagccaagagggtgctgctcagttgcagggcctccgcagctggacagagagtgggggagggagggacagacagaaggccaaggcccgatgtggtgtgcagaggtggggaggtggcgaggatggggacagaaagcgcacagaatcttggaccaggtctctcttccttgtcccccctgcttttctcctcccccatgcccaacccctgtggccgccgcccctcccctgccccgttggtgtgattatttcatctgttagatgtggctgttttgcgtagcatcgtgtgccacccctgcccctccccgatccctgtgtgcgcgccccctctgcaatgtatgccccttgccccttccccacactaataatttatatatataaatatctatatgacgctcttaaaaaaacatcccaaccaaaaccaaccaaacaaaaacatcctcacaactccccaggaaaaaaaaaaaaaactcgaggttaaagcagcagtgccaataatgagacccagctgggaaggactcggtgatacccactgggatcttttatcctttgttgcaaaagtgtggacacttttgacagcttggcagattttaactccagaagcactttatgaaatggtacactgactaatccagaagacatttccaacagtttgccagtggttcctcactacactggtactgaaagtgtaatttcttagagccaaaaaactggagaaacaaatatcctgccacctctaacaagtacatgagtacttgatttttatggtatagagcagagccttttcttcctcttcttgatagatgaggccatggtgtaaatggaagtttcagagaggacaaaataaaacggaattccatttttctctcactgtaa

SEQ ID NO: 427467 - DNA, 4312 bp, Homo sapiens
ctgccgccgccgccccccagaggcgccggagcccggaatcccgctcggagccagccagccgtcccgagctaccagcaggtttcattgaaaacagatcctgcaaaagttccaggtgcccacactggaaacttggagatcctgcttcccagaccacagctgtggggaacttggggtggagcagagaagtttctgtattcagctgcccaggcagaggagaatggggtctccacagcctgaagaatgaagacacgacagaataaagactcgatgtcaatgaggagtggacggaagaaagaggcccctgggccccgggaagaactgagatcgaggggccgggcctcccctggaggggtcagcacgtccagcagtgatggcaaagctgagaagtccaggcagacagccaagaaggcccgagtagaggaagcctccaccccaaaggtcaacaagcagggtcggagtgaggagatctcagagagtgaaagtgaggagaccaatgcaccaaaaaagaccaaaactgagcaggaactccctcggccacagtctccctccgatctggatagcttggacgggcggagccttaatgatgatggcagcagcgaccctagggatatcgaccaggacaaccgaagcacgtcccccagtatctacagccctggaagtgtggagaatgactctgactcatcttctggcctgtcccagggcccagcccgcccctaccacccacctccactctttcctccttcccctcaaccgccagacagcacccctcgacagccagaggctagctttgaaccccatccttctgtgacacccactggatatcatgctcccatggagccccccacatctcgaatgttccaggctcctcctggggcccctccccctcacccacagctctatcctgggggcactggtggagttttgtctggacccccaatgggtcccaaggggggaggggctgcctcatcagtggggggccctaatgggggtaagcagcaccccccacccactactcccatttcagtatcaagctctggggctagtggtgctcccccaacaaagccgcctaccactccagtgggtggtgggaacctaccttctgctccaccaccagccaacttcccccatgtgacaccgaacctgcctcccccacctgccctgagacccctcaacaatgcatcagcctctccccctggcctgggggcccaaccactacctggtcatctgccctctccccacgccatgggacagggtatgggtggacttcctcctggcccagagaagggcccaactctggctccttcaccccactctctgcctcctgcttcctcttctgctccagcgccccccatgaggtttccttattcatcctctagtagtagctctgcagcagcctcctcttccagttcttcctcctcttcctctgcctcccccttcccagcttcccaggcattgcccagctacccccactctttccctcccccaacaagcctctctgtctccaatcagccccccaagtatactcagccttctctcccatcccaggctgtgtggagccagggtcccccaccacctcctccctatggccgcctcttagccaacagcaatgcccatccaggccccttccctccctctactggggcccagtccaccgcccacccaccagtctcaacacatcaccatcaccaccagcaacagcaacagcagcagcagcagcagcagcagcagcagcagcagcagcagcatcacggaaactctgggccccctcctcctggagcatttccccacccactggagggcggtagctcccaccacgcacacccttacgccatgtctccctccctggggtctctgaggccctacccaccagggccagcacacctgcccccacctcacagccaggtgtcctacagccaagcaggccccaatggccctccagtctcttcctcttccaactcttcctcttccacttctcaagggtcctacccatgttcacacccctccccttcccagggccctcaaggggcgccctaccctttcccaccggtgcctacggtcaccacctcttcggctaccctttccacggtcattgccaccgtggcttcctcgccagcaggctacaaaacggcctccccacctgggcccccaccgtacggaaagagagccccgtccccgggggcctacaagacagccaccccacccggatacaaacccgggtcgcctccctccttccgaacggggaccccaccgggctatcgaggaacctcgccacctgcaggcccagggaccttcaagccgggctcgcccaccgtgggacctgggcccctgccacctgcggggccctcaggcctgccatcgctgccaccaccacctgcggcccctgcctcagggccgcccctgagcgccacgcagatcaaacaggagccggctgaggagtatgagacccccgagagcccggtgcccccagcccgcagcccctcgccccctcccaaggtggtagatgtacccagccatgccagtcagtctgccaggtgagcggccaggtggggcggaggtgggcctggaaaggggacgacgacaaggcggcgacgagagagggagtagcagggaggggccttgcgctggtgtagtgttttagaaaagcacgcccctctcctccgtccaggcctagtggccagtgaggcccgcagcagctcacagcctgcaggggtggttttgaggcgggggctacaagcactcgccggggccgcggcgctgcgggctccatcgggcagctcgcaccgcctgagcgcccgctgcttccacgcccggcaggttcaacaaacacctggatcgcggcttcaactcgtgcgcgcgcagcgacctgtacttcgtgccactggagggctccaagctggccaagaagcgggccgacctggtggagaaggtgcggcgcgaggccgagcagcgcgcgcgcgaagaaaaggagcgcgagcgcgagcgggaacgcgagaaagagcgcgagcgcgagaaggagcgcgagcttgaacgcagcgtgaagttggctcaggagggccgtgctccggtggaatgcccatctctgggcccagtgccccatcgccctccatttgaaccgggcagtgcggtggctacagtgcccccctacctgggtcctgacactccagccttgcgcactctcagtgaatatgcccggcctcatgtcatgtctcctggcaatcgcaaccatccattctacgtgcccctgggggcagtggacccggggctcctgggttacaatgtcccggccctgtacagcagtgatccagctgcccgggagagggaacgggaagcccgtgaacgagacctccgtgaccgcctcaagcctggctttgaggtgaagcctagtgagctggaacccctacatggggtccctgggccgggcttggatccctttccccgacatgggggcctggctctgcagcctggcccacctggcctgcaccctttcccctttcatccgagcctggggcccctggagcgagaacgtctagcgctggcagctgggccagccctgcggcctgacatgtcctatgctgagcggctggcagctgagaggcagcacgcagaaagggtggcggccctgggcaatgacccactggcccggctgcagatgctcaatcctcccctgccccgttggtgtgattatttcatctgttagatgtggctgttttgcgtagcatcgtgtgccacccctgcccctccccgatccctgtgtgcgcgccccctctgcaatgtatgccccttgccccttccccacactaataatttatatatataaatatctatatgacgctcttaaaaaaacatcccaaccaaaaccaaccaaacaaaaacatcctcacaactccccaggaaaaaaaaaaaaaactcgaggttaaagcagcagtgccaataatgagacccagctgggaaggactcggtgatacccactgggatcttttatcctttgttgcaaaagtgtggacacttttgacagcttggcagattttaactccagaagcactttatgaaatggtacactgactaatccagaagacatttccaacagtttgccagtggttcctcactacactggtactgaaagtgtaatttcttagagccaaaaaactggagaaacaaatatcctgccacctctaacaagtacatgagtacttgatttttatggtatagagcagagccttttcttcctcttcttgatagatgaggccatggtgtaaatggaagtttcagagaggacaaaataaaacggaattccatttttctctcactgtaa

SEQ ID NO: 427468 - DNA, 1462 bp, Homo sapiens
tggggggatgggcctagttgggcttggggagggatgaggaggtgcctagaggagctgggcatgggaataggagagctggagctctgcccaagagaagcacgagttttagtgtcagcctaagaggttcgaatcccaattccaccctaccactggcaacttacagaactgggtgtgttacctcactttttagttcattacctttgtatgtaaaggagctggctatcccctggtccagagcaggtacttgttatccgttggtcatatgccccttgcccttcctgctcacagctgccccttaccgggacctgccggcctccctttctgccccgatgtcagcagctcatcagctgcaggccatgcacgcacagtcagctgagctgcagcgcttggcgctggaacagcagcagtggctgcatgcccatcacccgctgcacagtgtgccgctgcctgcccaggaggactactacagtcacctgaagaaggaaagcgacaagccactgtagaacctgcgatcaagagagcaccatggctcctacattggaccttggagcacccccaccctccccccaccgtgcccttggcctgccacccagagccaagagggtgctgctcagttgcagggcctccgcagctggacagagagtgggggagggagggacagacagaaggccaaggcccgatgtggtgtgcagaggtggggaggtggcgaggatggggacagaaagcgcacagaatcttggaccaggtctctcttccttgtcccccctgcttttctcctcccccatgcccaacccctgtggccgccgcccctcccctgccccgttggtgtgattatttcatctgttagatgtggctgttttgcgtagcatcgtgtgccacccctgcccctccccgatccctgtgtgcgcgccccctctgcaatgtatgccccttgccccttccccacactaataatttatatatataaatatctatatgacgctcttaaaaaaacatcccaaccaaaaccaaccaaacaaaaacatcctcacaactccccaggaaaaaaaaaaaaaactcgaggttaaagcagcagtgccaataatgagacccagctgggaaggactcggtgatacccactgggatcttttatcctttgttgcaaaagtgtggacacttttgacagcttggcagattttaactccagaagcactttatgaaatggtacactgactaatccagaagacatttccaacagtttgccagtggttcctcactacactggtactgaaagtgtaatttcttagagccaaaaaactggagaaacaaatatcctgccacctctaacaagtacatgagtacttgatttttatggtatagagcagagccttttcttcctcttcttgatagatgaggccatggtgtaaatggaagtttcagagaggacaaaataaaacggaattccatttttctctcactgtaa

SEQ ID NO: 427469 - DNA, 3019 bp, Homo sapiens
ctgccgccgccgccccccagaggcgccggagcccggaatcccgctcggagccagccagccgtcccgagctaccagcaggtttcattgaaaacagatcctgcaaaagttccaggtgcccacactggaaacttggagatcctgcttcccagaccacagctgtggggaacttggggtggagcagagaagtttctgtattcagctgcccaggcagaggagaatggggtctccacagcctgaagaatgaagacacgacagaataaagactcgatgtcaatgaggagtggacggaagaaagaggcccctgggccccgggaagaactgagatcgaggggccgggcctcccctggaggggtcagcacgtccagcagtgatggcaaagctgagaagtccaggcagacagccaagaaggcccgagtagaggaagcctccaccccaaaggtcaacaagcagggtcggagtgaggagatctcagagagtgaaagtgaggagaccaatgcaccaaaaaagaccaaaactgagcaggaactccctcggccacagtctccctccgatctggatagcttggacgggcggagccttaatgatgatggcagcagcgaccctagggatatcgaccaggacaaccgaagcacgtcccccagtatctacagccctggaagtgtggagaatgactctgactcatcttctggcctgtcccagggcccagcccgcccctaccacccacctccactctttcctccttcccctcaaccgccagacagcacccctcgacagccagaggctagctttgaaccccatccttctgtgacacccactggatatcatgctcccatggagccccccacatctcgaatgttccaggctcctcctggggcccctccccctcacccacagctctatcctgggggcactggtggagttttgtctggacccccaatgggtcccaaggggggaggggctgcctcatcagtggggggccctaatgggggtaagcagcaccccccacccactactcccatttcagtatcaagctctggggctagtggtgctcccccaacaaagccgcctaccactccagtgggtggtgggaacctaccttctgctccaccaccagccaacttcccccatgtgacaccgaacctgcctcccccacctgccctgagacccctcaacaatgcatcagcctctccccctggcctgggggcccaaccactacctggtcatctgccctctccccacgccatgggacagggtatgggtggacttcctcctggcccagagaagggcccaactctggctccttcaccccactctctgcctcctgcttcctcttctgctccagcgccccccatgaggtttccttattcatcctctagtagtagctctgcagcagcctcctcttccagttcttcctcctcttcctctgcctcccccttcccagcttcccaggcattgcccagctacccccactctttccctcccccaacaagcctctctgtctccaatcagccccccaagtatactcagccttctctcccatcccaggctgtgtggagccagggtcccccaccacctcctccctatggccgcctcttagccaacagcaatgcccatccaggccccttccctccctctactggggcccagtccaccgcccacccaccagtctcaacacatcaccatcaccaccagcaacagcaacagcagcagcagcagcagcagcagcagcagcagcagcagcagcatcacggaaactctgggccccctcctcctggagcatttccccacccactggagggcggtagctcccaccacgcacacccttacgccatgtctccctccctggggtctctgaggccctacccaccagggccagcacacctgcccccacctcacagccaggtgtcctacagccaagcaggccccaatggccctccagtctcttcctcttccaactcttcctcttccacttctcaagggtcctacccatgttcacacccctccccttcccagggccctcaaggggcgccctaccctttcccaccggtgcctacggtcaccacctcttcggctaccctttccacggtcattgccaccgtggcttcctcgccagcaggctacaaaacggcctccccacctgggcccccaccgtacggaaagagagccccgtccccgggggcctacaagacagccaccccacccggatacaaacccgggtcgcctccctccttccgaacggggaccccaccgggctatcgaggaacctcgccacctgcaggcccagggaccttcaagccgggctcgcccaccgtgggacctgggcccctgccacctgcggggccctcaggcctgccatcgctgccaccaccacctgcggcccctgcctcagggccgcccctgagcgccacgcagatcaaacaggagccggctgaggagtatgagacccccgagagcccggtgcccccagcccgcagcccctcgccccctcccaaggtggtagatgtacccagccatgccagtcagtctgccaggttcaacaaacacctggatcgcggcttcaactcgtgcgcgcgcagcgacctgtacttcgtgccactggagggctccaagctggccaagaagcgggccgacctggtggagaaggtgcggcgcgaggccgagcagcgcgcgcgcgaagaaaaggagcgcgagcgcgagcgggaacgcgagaaagagcgcgagcgcgagaaggagcgcgagcttgaacgcagcgtgaagttggctcaggagggccgtgctccggtggaatgcccatctctgggcccagtgccccatcgccctccatttgaaccgggcagtgcggtggctacagtgcccccctacctgggtcctgacactccagccttgcgcactctcagtgaatatgcccggcctcatgtcatgtctcctggcaatcgcaagtctgatcacgtctgtcctgggcagtgggtccctattgtcctcatcctgagtccatctccctagctgggcccccgtgctg

SEQ ID NO: 427470 - DNA, 2286 bp, Homo sapiens
ctgccgccgccgccccccagaggcgccggagcccggaatcccgctcggagccagccagccgtcccgagctaccagcaggtttcattgaaaacagatcctgcaaaagttccaggtgcccacactggaaacttggagatcctgcttcccagaccacagctgtggggaacttggggtggagcagagaagtttctgtattcagctgcccaggcagaggagaatggggtctccacagcctgaagaatgaagacacgacagaataaagactcgatgtcaatgaggagtggacggaagaaagaggcccctgggccccgggaagaactgagatcgaggggccgggcctcccctggaggggtcagcacgtccagcagtgatggcaaagctgagaagtccaggcagacagccaagaaggcccgagtagaggaagcctccaccccaaaggtcaacaagcagggtcggagtgaggagatctcagagagtgaaagtgaggagaccaatgcaccaaaaaagaccaaaactgagcaggaactccctcggccacagtctccctccgatctggatagcttggacgggcggagccttaatgatgatggcagcagcgaccctagggatatcgaccaggacaaccgaagcacgtcccccagtatctacagccctggaagtgtggagaatgactctgactcatcttctggcctgtcccagggcccagcccgcccctaccacccacctccactctttcctccttcccctcaaccgccagacagcacccctcgacagccagaggctagctttgaaccccatccttctgtgacacccactggatatcatgctcccatggagccccccacatctcgaatgttccaggctcctcctggggcccctccccctcacccacagctctatcctgggggcactggtggagttttgtctggacccccaatgggtcccaaggggggaggggctgcctcatcagtggggggccctaatgggggtaagcagcaccccccacccactactcccatttcagtatcaagctctggggctagtggtgctcccccaacaaagccgcctaccactccagtgggtggtgggaacctaccttctgctccaccaccagccaacttcccccatgtgacaccgaacctgcctcccccacctgccctgagacccctcaacaatgcatcagcctctccccctggcctgggggcccaaccactacctggtcatctgccctctccccacgccatgggacagggtatgggtggacttcctcctggcccagagaagggcccaactctggctccttcaccccactctctgcctcctgcttcctcttctgctccagcgccccccatgaggtttccttattcatcctctagtagtagctctgcagcagcctcctcttccagttcttcctcctcttcctctgcctcccccttcccagcttcccaggcattgcccagctacccccactctttccctcccccaacaagcctctctgtctccaatcagccccccaagtatactcagccttctctcccatcccaggctgtgtggagccagggtcccccaccacctcctccctatggccgcctcttagccaacagcaatgcccatccaggccccttccctccctctactggggcccagtccaccgcccacccaccagtctcaacacatcaccatcaccaccagcaacagcaacagcagcagcagcagcagcagcagcagcagcagcagcagcagcatcacggaaactctgggccccctcctcctggagcatttccccacccactggagggcggtagctcccaccacgcacacccttacgccatgtctccctccctggggtctctgaggccctacccaccagggccagcacacctgcccccacctcacagccaggtgtcctacagccaagcaggccccaatggccctccagtctcttcctcttccaactcttcctcttccacttctcaagggtcctacccatgttcacacccctccccttcccagggccctcaaggggcgccctaccctttcccaccggtgcctacggtcaccacctcttcggctaccctttccacggtcattgccaccgtggcttcctcgccagcaggctacaaaacggcctccccacctgggcccccaccgtacggaaagagagccccgtccccgggggcctacaagacagccaccccacagagagagcgtcgacgctctctctgtgggggggtgtggagtgagcaggagcagctgaaacaacgctgggcacggaggataactgct

SEQ ID NO: 427471 - DNA, 2150 bp, Homo sapiens
ctgccgccgccgccccccagaggcgccggagcccggaatcccgctcggagccagccagccgtcccgagctaccagcaggtttcattgaaaacagatcctgcaaaagttccaggtgcccacactggaaacttggagatcctgcttcccagaccacagctgtggggaacttggggtggagcagagaagtttctgtattcagctgcccaggcagaggagaatggggtctccacagcctgaagaatgaagacacgacagaataaagactcgatgtcaatgaggagtggacggaagaaagaggcccctgggccccgggaagaactgagatcgaggggccgggcctcccctggaggggtcagcacgtccagcagtgatggcaaagctgagaagtccaggcagacagccaagaaggcccgagtagaggaagcctccaccccaaaggtcaacaagcagggtcggagtgaggagatctcagagagtgaaagtgaggagaccaatgcaccaaaaaagaccaaaactgagcaggaactccctcggccacagtctccctccgatctggatagcttggacgggcggagccttaatgatgatggcagcagcgaccctagggatatcgaccaggacaaccgaagcacgtcccccagtatctacagccctggaagtgtggagaatgactctgactcatcttctggcctgtcccagggcccagcccgcccctaccacccacctccactctttcctccttcccctcaaccgccagacagcacccctcgacagccagaggctagctttgaaccccatccttctgtgacacccactggatatcatgctcccatggagccccccacatctcgaatgttccaggctcctcctggggcccctccccctcacccacagctctatcctgggggcactggtggagttttgtctggacccccaatgggtcccaaggggggaggggctgcctcatcagtggggggccctaatgggggtaagcagcaccccccacccactactcccatttcagtatcaagctctggggctagtggtgctcccccaacaaagccgcctaccactccagtgggtggtgggaacctaccttctgctccaccaccagccaacttcccccatgtgacaccgaacctgcctcccccacctgccctgagacccctcaacaatgcatcagcctctccccctggcctgggggcccaaccactacctggtcatctgccctctccccacgccatgggacagggtatgggtggacttcctcctggcccagagaagggcccaactctggctccttcaccccactctctgcctcctgcttcctcttctgctccagcgccccccatgaggtttccttattcatcctctagtagtagctctgcagcagcctcctcttccagttcttcctcctcttcctctgcctcccccttcccagcttcccaggcattgcccagctacccccactctttccctcccccaacaagcctctctgtctccaatcagccccccaagtatactcagccttctctcccatcccaggctgtgtggagccagggtcccccaccacctcctccctatggccgcctcttagccaacagcaatgcccatccaggccccttccctccctctactggggcccagtccaccgcccacccaccagtctcaacacatcaccatcaccaccagcaacagcaacagcagcagcagcagcagcagcagcagcagcagcagcagcagcatcacggaaactctgggccccctcctcctggagcatttccccacccactggagggcggtagctcccaccacgcacacccttacgccatgtctccctccctggggtctctgaggccctacccaccagggccagcacacctgcccccacctcacagccaggtgtcctacagccaagcaggccccaatggccctccagtctcttcctcttccaactcttcctcttccacttctcaagggtcctacccatgttcacacccctccccttcccagggccctcaaggggcgccctaccctttcccaccggtgcctacggtcaccacctcttcggctaccctttccacggtcattgccaccgtggcaagggtagccgaagaggtggtgaccgtagacacctggctgtgaggtgc

SEQ ID NO: 427472 - DNA, 2186 bp, Homo sapiens
ctgccgccgccgccccccagaggcgccggagcccggaatcccgctcggagccagccagccgtcccgagctaccagcaggtttcattgaaaacagatcctgcaaaagttccaggtgcccacactggaaacttggagatcctgcttcccagaccacagctgtggggaacttggggtggagcagagaagtttctgtattcagctgcccaggcagaggagaatggggtctccacagcctgaagaatgaagacacgacagaataaagactcgatgtcaatgaggagtggacggaagaaagaggcccctgggccccgggaagaactgagatcgaggggccgggcctcccctggaggggtcagcacgtccagcagtgatggcaaagctgagaagtccaggcagacagccaagaaggcccgagtagaggaagcctccaccccaaaggtcaacaagcagggtcggagtgaggagatctcagagagtgaaagtgaggagaccaatgcaccaaaaaagaccaaaactgagcaggaactccctcggccacagtctccctccgatctggatagcttggacgggcggagccttaatgatgatggcagcagcgaccctagggatatcgaccaggacaaccgaagcacgtcccccagtatctacagccctggaagtgtggagaatgactctgactcatcttctggcctgtcccagggcccagcccgcccctaccacccacctccactctttcctccttcccctcaaccgccagacagcacccctcgacagccagaggctagctttgaaccccatccttctgtgacacccactggatatcatgctcccatggagccccccacatctcgaatgttccaggctcctcctggggcccctccccctcacccacagctctatcctgggggcactggtggagttttgtctggacccccaatgggtcccaaggggggaggggctgcctcatcagtggggggccctaatgggggtaagcagcaccccccacccactactcccatttcagtatcaagctctggggctagtggtgctcccccaacaaagccgcctaccactccagtgggtggtgggaacctaccttctgctccaccaccagccaacttcccccatgtgacaccgaacctgcctcccccacctgccctgagacccctcaacaatgcatcagcctctccccctggcctgggggcccaaccactacctggtcatctgccctctccccacgccatgggacagggtatgggtggacttcctcctggcccagagaagggcccaactctggctccttcaccccactctctgcctcctgcttcctcttctgctccagcgccccccatgaggtttccttattcatcctctagtagtagctctgcagcagcctcctcttccagttcttcctcctcttcctctgcctcccccttcccagcttcccaggcattgcccagctacccccactctttccctcccccaacaagcctctctgtctccaatcagccccccaagtatactcagccttctctcccatcccaggctgtgtggagccagggtcccccaccacctcctccctatggccgcctcttagccaacagcaatgcccatccaggccccttccctccctctactggggcccagtccaccgcccacccaccagtctcaacacatcaccatcaccaccagcaacagcaacagcagcagcagcagcagcagcagcagcagcagcagcagcagcatcacggaaactctgggccccctcctcctggagcatttccccacccactggagggcggtagctcccaccacgcacacccttacgccatgtctccctccctggggtctctgaggccctacccaccagggccagcacacctgcccccacctcacagccaggtgtcctacagccaagcagcagcagcagcagcagcagcagcagcagcagcagcagcagcatcacggaaactctgggccccgccacatgcccatgcgcctgggcaagtccaagcttgtgtacgccgccaacccgcgagcgtgggaagcgggcccgagactcagggcctcaccccaccgcaaaccggacccacgcccccgccgtgtaagcggacacgacgggtgtgcggtccgccccctacgccccatgggggctggttcggtcagtggaaagcgggcccccctga

SEQ ID NO: 427473 - DNA, 1973 bp, Homo sapiens
ctgccgccgccgccccccagaggcgccggagcccggaatcccgctcggagccagccagccgtcccgagctaccagcaggtttcattgaaaacagatcctgcaaaagttccaggtgcccacactggaaacttggagatcctgcttcccagaccacagctgtggggaacttggggtggagcagagaagtttctgtattcagctgcccaggcagaggagaatggggtctccacagcctgaagaatgaagacacgacagaataaagactcgatgtcaatgaggagtggacggaagaaagaggcccctgggccccgggaagaactgagatcgaggggccgggcctcccctggaggggtcagcacgtccagcagtgatggcaaagctgagaagtccaggcagacagccaagaaggcccgagtagaggaagcctccaccccaaaggtcaacaagcagggtcggagtgaggagatctcagagagtgaaagtgaggagaccaatgcaccaaaaaagaccaaaactgagcaggaactccctcggccacagtctccctccgatctggatagcttggacgggcggagccttaatgatgatggcagcagcgaccctagggatatcgaccaggacaaccgaagcacgtcccccagtatctacagccctggaagtgtggagaatgactctgactcatcttctggcctgtcccagggcccagcccgcccctaccacccacctccactctttcctccttcccctcaaccgccagacagcacccctcgacagccagaggctagctttgaaccccatccttctgtgacacccactggatatcatgctcccatggagccccccacatctcgaatgttccaggctcctcctggggcccctccccctcacccacagctctatcctgggggcactggtggagttttgtctggacccccaatgggtcccaaggggggaggggctgcctcatcagtggggggccctaatgggggtaagcagcaccccccacccactactcccatttcagtatcaagctctggggctagtggtgctcccccaacaaagccgcctaccactccagtgggtggtgggaacctaccttctgctccaccaccagccaacttcccccatgtgacaccgaacctgcctcccccacctgccctgagacccctcaacaatgcatcagcctctccccctggcctgggggcccaaccactacctggtcatctgccctctccccacgccatgggacagggtatgggtggacttcctcctggcccagagaagggcccaactctggctccttcaccccactctctgcctcctgcttcctcttctgctccagcgccccccatgaggtttccttattcatcctctagtagtagctctgcagcagcctcctcttccagttcttcctcctcttcctctgcctcccccttcccagcttcccaggcattgcccagctacccccactctttccctcccccaacaagcctctctgtctccaatcagccccccaagtatactcagccttctctcccatcccaggctgtgtggagccagggtcccccaccacctcctccctatggccgcctcttagccaacagcaatgcccatccaggccccttccctccctctactggggcccagtccaccgcccacccaccagtctcaacacatcaccatcaccaccagcaacagcaacagcagcagcagcagcagcagcagcatcacggaaactctgggccccctcctcctggagcatttccccacccactggagggcggtagctcccaccacgcacacccttacgccatgtctccctccctggggtctctgaggccctacccaccagggccagcacacctgcccccacaatcctaggcctacccgccgcagtactgatcattctatttccccctctattgatccccacctccaaatatctcatcaacaaccgactaatcaccacccaa

SEQ ID NO: 427474 - DNA, 1990 bp, Homo sapiens
ctgccgccgccgccccccagaggcgccggagcccggaatcccgctcggagccagccagccgtcccgagctaccagcaggtttcattgaaaacagatcctgcaaaagttccaggtgcccacactggaaacttggagatcctgcttcccagaccacagctgtggggaacttggggtggagcagagaagtttctgtattcagctgcccaggcagaggagaatggggtctccacagcctgaagaatgaagacacgacagaataaagactcgatgtcaatgaggagtggacggaagaaagaggcccctgggccccgggaagaactgagatcgaggggccgggcctcccctggaggggtcagcacgtccagcagtgatggcaaagctgagaagtccaggcagacagccaagaaggcccgagtagaggaagcctccaccccaaaggtcaacaagcagggtcggagtgaggagatctcagagagtgaaagtgaggagaccaatgcaccaaaaaagaccaaaactgagcaggaactccctcggccacagtctccctccgatctggatagcttggacgggcggagccttaatgatgatggcagcagcgaccctagggatatcgaccaggacaaccgaagcacgtcccccagtatctacagccctggaagtgtggagaatgactctgactcatcttctggcctgtcccagggcccagcccgcccctaccacccacctccactctttcctccttcccctcaaccgccagacagcacccctcgacagccagaggctagctttgaaccccatccttctgtgacacccactggatatcatgctcccatggagccccccacatctcgaatgttccaggctcctcctggggcccctccccctcacccacagctctatcctgggggcactggtggagttttgtctggacccccaatgggtcccaaggggggaggggctgcctcatcagtggggggccctaatgggggtaagcagcaccccccacccactactcccatttcagtatcaagctctggggctagtggtgctcccccaacaaagccgcctaccactccagtgggtggtgggaacctaccttctgctccaccaccagccaacttcccccatgtgacaccgaacctgcctcccccacctgccctgagacccctcaacaatgcatcagcctctccccctggcctgggggcccaaccactacctggtcatctgccctctccccacgccatgggacagggtatgggtggacttcctcctggcccagagaagggcccaactctggctccttcaccccactctctgcctcctgcttcctcttctgctccagcgccccccatgaggtttccttattcatcctctagtagtagctctgcagcagcctcctcttccagttcttcctcctcttcctctgcctcccccttcccagcttcccaggcattgcccagctacccccactctttccctcccccaacaagcctctctgtctccaatcagccccccaagtatactcagccttctctcccatcccaggctgtgtggagccagggtcccccaccacctcctccctatggccgcctcttagccaacagcaatgcccatccaggccccttccctccctctactggggcccagtccaccgcccacccaccagtctcaacacatcaccatcaccaccagcaacagcaacagcagcagcagcagcagcagcagcagcagcagcagcagcagcagcagcagcagcagcagcagcatcacggaaactctgggccccgccacatgcccatgcgcctgggcaagtccaagcttgtgtacgccgccaacccgcgagcgtgggaagcgggcccgagactcagggcctcaccccaccgcaaaccggacccacgcccccgccgtgtaagcggacacgacgggtgtgcggtccgccccctacgccccatgggggctggttcggtcagtggaaagcgggcccccctga

SEQ ID NO: 427475 - DNA, 1570 bp, Homo sapiens
  misc_feature (1524)..(1524): n is a, c, g, or t
ctgccgccgccgccccccagaggcgccggagcccggaatcccgctcggagccagccagccgtcccgagctaccagcaggtttcattgaaaacagatcctgcaaaagttccaggtgcccacactggaaacttggagatcctgcttcccagaccacagctgtggggaacttggggtggagcagagaagtttctgtattcagctgcccaggcagaggagaatggggtctccacagcctgaagaatgaagacacgacagaataaagactcgatgtcaatgaggagtggacggaagaaagaggcccctgggccccgggaagaactgagatcgaggggccgggcctcccctggaggggtcagcacgtccagcagtgatggcaaagctgagaagtccaggcagacagccaagaaggcccgagtagaggaagcctccaccccaaaggtcaacaagcagggtcggagtgaggagatctcagagagtgaaagtgaggagaccaatgcaccaaaaaagaccaaaactgagcaggaactccctcggccacagtctccctccgatctggatagcttggacgggcggagccttaatgatgatggcagcagcgaccctagggatatcgaccaggacaaccgaagcacgtcccccagtatctacagccctggaagtgtggagaatgactctgactcatcttctggcctgtcccagggcccagcccgcccctaccacccacctccactctttcctccttcccctcaaccgccagacagcacccctcgacagccagaggctagctttgaaccccatccttctgtgacacccactggatatcatgctcccatggagccccccacatctcgaatgttccaggctcctcctggggcccctccccctcacccacagctctatcctgggggcactggtggagttttgtctggacccccaatgggtcccaaggggggaggggctgcctcatcagtggggggccctaatgggggtaagcagcaccccccacccactactcccatttcagtatcaagctctggggctagtggtgctcccccaacaaagccgcctaccactccagtgggtggtgggaacctaccttctgctccaccaccagccaacttcccccatgtgacaccgaacctgcctcccccacctgccctgagacccctcaacaatgcatcagcctctccccctggcctgggggcccaaccactacctggtcatctgccctctccccacgccatgggacagggtatgggtggacttcctcctggcccagagaagggcccaactctggctccttcaccccactctctgcctcctgcttcctcttctgctccagcgccccccatgaggtttccttattcatcctctagtagtagctctgcagcagcctcctcttccagttcttcctcctcttcctctgcctcccccttcccagcttcccaggcattgcccagctacccccactctttccctcccccaacaagcctctctgtctccaatcagcccccagcatcacangtgacacacccctcttcctgtcacaaatgcttcctcagtacccaca

SEQ ID NO: 427476 - DNA, 1578 bp, Homo sapiens
  misc_feature (1511)..(1511): n is a, c, g, or t
ctgccgccgccgccccccagaggcgccggagcccggaatcccgctcggagccagccagccgtcccgagctaccagcaggtttcattgaaaacagatcctgcaaaagttccaggtgcccacactggaaacttggagatcctgcttcccagaccacagctgtggggaacttggggtggagcagagaagtttctgtattcagctgcccaggcagaggagaatggggtctccacagcctgaagaatgaagacacgacagaataaagactcgatgtcaatgaggagtggacggaagaaagaggcccctgggccccgggaagaactgagatcgaggggccgggcctcccctggaggggtcagcacgtccagcagtgatggcaaagctgagaagtccaggcagacagccaagaaggcccgagtagaggaagcctccaccccaaaggtcaacaagcagggtcggagtgaggagatctcagagagtgaaagtgaggagaccaatgcaccaaaaaagaccaaaactgagcaggaactccctcggccacagtctccctccgatctggatagcttggacgggcggagccttaatgatgatggcagcagcgaccctagggatatcgaccaggacaaccgaagcacgtcccccagtatctacagccctggaagtgtggagaatgactctgactcatcttctggcctgtcccagggcccagcccgcccctaccacccacctccactctttcctccttcccctcaaccgccagacagcacccctcgacagccagaggctagctttgaaccccatccttctgtgacacccactggatatcatgctcccatggagccccccacatctcgaatgttccaggctcctcctggggcccctccccctcacccacagctctatcctgggggcactggtggagttttgtctggacccccaatgggtcccaaggggggaggggctgcctcatcagtggggggccctaatgggggtaagcagcaccccccacccactactcccatttcagtatcaagctctggggctagtggtgctcccccaacaaagccgcctaccactccagtgggtggtgggaacctaccttctgctccaccaccagccaacttcccccatgtgacaccgaacctgcctcccccacctgccctgagacccctcaacaatgcatcagcctctccccctggcctgggggcccaaccactacctggtcatctgccctctccccacgccatgggacagggtatgggtggacttcctcctggcccagagaagggcccaactctggctccttcaccccactctctgcctcctgcttcctcttctgctccagcgccccccatgaggtttccttattcatcctctagtagtagctctgcagcagcctcctcccgagttcaagtgattcttgtgtctgagcctcccaagtagctgggattacaggtgcaagccgaccacacccgagctattttcagtatgttgagcagatccgggcgttgccntcatgtcggccaggcgggccttgaactccgtagcctcaggtggccgcccaccttgcgtcccaaagtg

SEQ ID NO: 427477 - DNA, 774 bp, Homo sapiens
ggtgatgggcatgcagccactgctgctgttccagcgccaagcgctgcagctcagctgactgtgcgtgcatggcctgcagctgatgagctgctgacatcggggcagaaagggaggccggcacctcccctgccccgttggtgtgattatttcatctgttagatgtggctgttttgcgtagcatcgtgtgccacccctgcccctccccgatccctgtgtgcgcgccccctctgcaatgtatgccccttgccccttccccacactaataatttatatatataaatatctatatgacgctcttaaaaaaacatcccaaccaaaaccaaccaaacaaaaacatcctcacaactccccaggaaaaaaaaaaaaaactcgaggttaaagcagcagtgccaataatgagacccagctgggaaggactcggtgatacccactgggatcttttatcctttgttgcaaaagtgtggacacttttgacagcttggcagattttaactccagaagcactttatgaaatggtacactgactaatccagaagacatttccaacagtttgccagtggttcctcactacactggtactgaaagtgtaatttcttagagccaaaaaactggagaaacaaatatcctgccacctctaacaagtacatgagtacttgatttttatggtatagagcagagccttttcttcctcttcttgatagatgaggccatggtgtaaatggaagtttcagagaggacaaaataaaacggaattccatttttctctcactgtaa

SEQ ID NO: 427478 - DNA, 4873 bp, Homo sapiens
ggctcgagcggccgcccgggcaggttgagatcgtgtttcatttcaggaagatatatgcgtcaggaaaatttctatcttcttttgtattatcaaggagatatttggagcagagtcaaccctctcagttacataaaataaaaaatggcatattcttggcaaacggatccaaatcctaatgaatcacacgaaaagcagtatgaacaccaagaatttctctttgtaaatcaaccccattcttctagccaagtcagtctgggttttgatcagatagtagatgagatcagtggcaaaattccacactacgagagtgaaattgatgaaaacaccttttttgtgcccactgcaccaaaatgggactcaacagggcattcattaaatgaagcacaccaaatatccttgaatgaattcacttctaaaagccgtgaactctcctggcatcaagttagcaaagcaccagcaattggttttagtccttctgtgttaccaaaacctcaaaatacgaataaagaatgctcctggggaagccccataggaaaacatcatggtgctgatgattccagattcagtattttagctccatcattcacaagtttggataaaattaatctagagaaagaattagaaaatgaaaatcataactaccatataggatttgaaagtagcattcctccaacaaattcatccttctcaagtgacttcatgccgaaagaagagaataaaaggagtggacatgtgaacattgtggaaccatctttgatgcttttgaaaggctctcttcaacccggaatgtgggaaagtacatggcagaagaatatagagtcaataggttgttccattcagctagtggaagtacctcaaagcagcaatacgagtctggcctctttttgcaacaaagtaaaaaaaatcagagaaagatatcatgcagctgatgttaatttcaattctgggaagatctggagcactactacagcatttccgtatcagctcttttctaagaccaagtttaatatacatatttttattgataactcaacacaacctcttcattttatgccatgtgctaattatcttgtcaaagatctaattgcagaaattctgcatttttgcacaaatgaccagctactccccaaagatcatattctaagtgtatgtggctctgaagaatttttacaaaacgaccactgtttggggagccacaaaatgtttcaaaaagataaatctgttattcagctccacctgcagaaaagtagggaagctccaggaaagctatctcgaaagcatgaagaggaccacagtcagttttatctgaatcaacttctagaatttatgcatatttggaaagtatccagacaatgtctcttaacactcatcagaaaatatgacttccacctgaaatacctattgaaaacccaggaaaacgtgtataatattattgaagaagttaaaaaaatatgcagtgttctagggtgtgtggaaaccaaacaaattacagatgcagtaaatgaactaagtctaattcttcagagaaaaggagagaatttttatcaaagttcagagacttcagcaaaaggcttgatagagaaggtaacaactgaactatccacatccatctaccagctaatcaatgtctactgtaacagcttttatgcagattttcagcctgtaaatgtacctagatgcacttcctatctaaatcccgggcttccttcccacctcagcttcacagtgtatgcagcacacaacattccagaaacctgggtgcacaggatcaattttccccttgaaataaagtcacttccaagggaatccatgctcactgtaaaactgtttgggattgcctgtgcaaccaacaatgcaaatttactggcgtggacttgtcttccactgtttccaaaagaaaaatccattctcgggtctatgctgttcagcatgacattacagagtgagcctcccgtagaaatgataactccaggagtgtgggatgtaagtcagccatccccggtgaccctgcagattgattttccagctactgggtgggagtatatgaaacctgattctgaagagaatagaagtaatcttgaagagccactaaaggagtgtataaaacatattgccagactttcacagaaacagactcccctactactctctgaagaaaagaaaagatatttatggttttatcgcttctactgcaataatgaaaactgctcccttcctttagtcctgggtagtgcccctggatgggatgaaaggactgtttcagaaatgcataccattttgagaagatggacattttctcaacctttagaggctcttgggcttttgacttccagttttccagatcaagaaattcgtaaagtggcagttcaacaattagacaacctcttgaatgatgaactactggaatatctcccacagctagttcaggctgtcaagtttgaatggaaccttgagagtcctttagtgcaacttctactccaccgctccttgcagagcatccaggttgcccatcgtctttactggctgctaaaaaatgcagaaaatgaagcttattttaaaagctggtatcagaagctactagctgctctccaattctgtgcaggtaaagccttgaatgatgagttttccaaggagcagaaacttatcaaaattctgggagatattggggaaagagtcaagtctgccagtgaccatcaaagacaggaggtactgaagaaagaaattggcagactagaagagttctttcaagatgtaaatacttgtcatcttcctctgaaccctgccctatgtataaaagggattgatcacgatgcatgttcatattttacatctaatgctttgccattgaagattactttcatcaatgctaatctgatgggcaaaaacatcagcattatttttaaggctggagatgatcttcgtcaggatatgcttgttctgcagcttattcaagtgatggacaatatttggctgcaggaaggcttggatatgcaaatgatcatttatagatgtctatccacaggaaaagaccaacgattggtgcagatggtacctgatgctgtgaccctagcaaagattcatcgccattctggactgataggaccattgaaagaaaataccattaaaaagtggttcagtcagcacaaccacttaaaggcagattatgaaaaggccttgaggaactttttctactcctgtgctggctggtgtgtggtaacattcatcctgggagtatgtgaccgtcacaatgataatatcatgctgacaaagtcgggccacatgtttcatattgactttggaaaattcttaggtcatgcacaaacatttggagggataaaaagggaccgagctcctttcatttttacttcagagatggaatactttattacagagggtgggaaaaacccacagcattttcaagattttgtggaactttgctgtcgtgcttataatattatcagaaagcacagccaactgctcttgaacctgctggaaatgatgctgtatgcaggactgcctgagctaagtggaattcaagacctgaaatatgtgtataataatcttcgtccacaagacacagacctggaagcaacaagtcattttaccaagaaaataaaggaaagtctggagtgtttccctgttaaattgaataacttgatccacacacttgcacaaatgtcagccataagccctgccaaatctacttcacagacttttcctcaggaatcctgtttgctgagtacaactaggtcgattgaaagagcaacaattttagggttcagcaagaaatccagtaatctgtatctgatccaggtgacacacagcaacaacgaaacaagcctgacagaaaaatcatttgagcagttttcaaaacttcacagccaacttcagaagcagtttgcatcactgactctcccagagtttcctcattggtggcacctaccttttacaaattcagatcacagaagattcagagatctaaatcattacatggaacagatattaaatgtatcacatgaagttacaaacagtgattgtgtacttagctttttcctctctgaggctgtgcaacaaacagttgaatcatcacctgtgtacctaggtgagaagaagtttccagacaagaagcctaaggtgcagttagtcatatcctacgaggatgtgaagctgaccatactagtgaaacacatgaaaaacattcatctcccagatggctctgcgcccagtgcacatgttgaattttatcttttaccatatcccagtgaagttcgtaggaggaaaacaaaatctgttccaaaatgtacggaccccacttacaatgaaattgtagtatatgatgaagtcacagagctccaaggacatgtcttaatgcttattgtgaagagtaaaactgtatttgtgggagcaattaacatccgactctgtagtgtcccactcgataaagaaaaatggtatccattaggaaacagtataatttgaccattgctatgaacatatgcattattcattaactacttgtatttttttcacttccgggcctctgaatcacataagtaaggcatctttgttgtcaaagacagcacagggtattaaggacacagaaaaaaaatcagaattagtcttttgtgttgtttattttctacctgtgctttcattgttttttcataatcttttctccttcagtggagtactgattgcatgaaatttgatgtgtaaaataataaaagacctttattaaatcattttaatatattttaaattaaacataggtttacatttgttttaattgtgtgcctacagttaaaagcagtatttttaatgtattttataagaaagacaatcaaataaacctcatcaattaattcaagatcta

SEQ ID NO: 427479 - DNA, 4208 bp, Homo sapiens
ggctcgagcggccgcccgggcaggttgagatcgtgtttcatttcaggaagatatatgcgtcaggaaaatttctatcttcttttgtattatcaaggagatatttggagcagagtcaaccctctcagttacataaaataaaaaatggcatattcttggcaaacggatccaaatcctaatgaatcacacgaaaagcagtatgaacaccaagaatttctctttgtaaatcaaccccattcttctagccaagtcagtctgggttttgatcagatagtagatgagatcagtggcaaaattccacactacgagagtgaaattgatgaaaacaccttttttgtgcccactgcaccaaaatgggactcaacagggcattcattaaatgaagcacaccaaatatccttgaatgaattcacttctaaaagccgtgaactctcctggcatcaagttagcaaagcaccagcaattggttttagtccttctgtgttaccaaaacctcaaaatacgaataaagaatgctcctggggaagccccataggaaaacatcatggtgctgatgattccagattcagtattttagctccatcattcacaagtttggataaaattaatctagagaaagaattagaaaatgaaaatcataactaccatataggatttgaaagtagcattcctccaacaaattcatccttctcaagtgacttcatgccgaaagaagagaataaaaggagtggacatgtgaacattgtggaaccatctttgatgcttttgaaaggctctcttcaacccggaatgtgggaaagtacatggcagaagaatatagagtcaataggttgttccattcagctagtggaagtacctcaaagcagcaatacgagtctggcctctttttgcaacaaagtaaaaaaaatcagagaaagatatcatgcagctgatgttaatttcaattctgggaagatctggagcactactacagcatttccgtatcagctcttttctaagaccaagtttaatatacatatttttattgataactcaacacaacctcttcattttatgccatgtgctaattatcttgtcaaagatctaattgcagaaattctgcatttttgcacaaatgaccagctactccccaaagatcatattctaagtgtatgtggctctgaagaatttttacaaaacgaccactgtttggggagccacaaaatgtttcaaaaagataaatctgttattcagctccacctgcagaaaagtagggaagctccaggaaagctatctcgaaagcatgaagaggaccacagtcagttttatctgaatcaacttctagaatttatgcatatttggaaagtatccagacaatgtctcttaacactcatcagaaaatatgacttccacctgaaatacctattgaaaacccaggaaaacgtgtataatattattgaagaagttaaaaaaatatgcagtgttctagggtgtgtggaaaccaaacaaattacagatgcagtaaatgaactaagtctaattcttcagagaaaaggagagaatttttatcaaagttcagagacttcagcaaaaggcttgatagagaaggtaacaactgaactatccacatccatctaccagctaatcaatgtctactgtaacagcttttatgcagattttcagcctgtaaatgtacctagatgcacttcctatctaaatcccgggcttccttcccacctcagcttcacagtgtatgcagcacacaacattccagaaacctgggtgcacagctacaaagcgttttcttttacctgttggcttacatatgctggaaagaagctgtgccaagtgagaaactacagaaatattccagacaagaaattattttttttcttggtcaactggaatgaaacgatcaattttccccttgaaataaagtcacttccaagggaatccatgctcactgtaaaactgtttgggattgcctgtgcaaccaacaatgcaaatttactggcgtggacttgtcttccactgtttccaaaagaaaaatccattctcgggtctatgctgttcagcatgacattacagagtgagcctcccgtagaaatgataactccaggagtgtgggatgtaagtcagccatccccggtgaccctgcagattgattttccagctactgggtgggagtatatgaaacctgattctgaagagaatagaagtaatcttgaagagccactaaaggagtgtataaaacatattgccagactttcacagaaacagactcccctactactctctgaagaaaagaaaagatatttatggttttatcgcttctactgcaataatgaaaactgctcccttcctttagtcctgggtagtgcccctggatgggatgaaaggactgtttcagaaatgcataccattttgagaagatggacattttctcaacctttagaggctcttgggcttttgacttccagttttccagatcaagaaattcgtaaagtggcagttcaacaattagacaacctcttgaatgatgaactactggaatatctcccacagctagttcaggctgtcaagtttgaatggaaccttgagagtcctttagtgcaacttctactccaccgctccttgcagagcatccaggttgcccatcgtctttactggctgctaaaaaatgcagaaaatgaagcttattttaaaagctggtatcagaagctactagctgctctccaattctgtgcaggtaaagccttgaatgatgagttttccaaggagcagaaacttatcaaaattctgggagatattggggaaagagtcaagtctgccagtgaccatcaaagacaggaggtactgaagaaagaaattggcagactagaagagttctttcaagatgtaaatacttgtcatcttcctctgaaccctgccctatgtataaaagggattgatcacgatgcatgttcatattttacatctaatgctttgccattgaagattactttcatcaatgctaatctgatgggcaaaaacatcagcattatttttaaggctggagatgatcttcgtcaggatatgcttgttctgcagcttattcaagtgatggacaatatttggctgcaggaaggcttggatatgcaaatgatcatttatagatgtctatccacaggaaaagaccaacgattggtgcagatggtacctgatgctgtgaccctagcaaagattcatcgccattctggactgataggaccattgaaagaaaataccattaaaaagtggttcagtcagcacaaccacttaaaggcagattatgaaaaggccttgaggaactttttctactcctgtgctggctggtgtgtggtaacattcatcctgggagtatgtgaccgtcacaatgataatatcatgctgacaaagtcgggccacatgtttcatattgactttggaaaattcttaggtcatgcacaaacatttggagggataaaaagggaccgagctcctttcatttttacttcagagatggaatactttattacagagggtgggaaaaacccacagcattttcaagattttgtggaactttgctgtcgtgcttataatattatcagaaagcacagccaactgctcttgaacctgctggaaatgatgctgtatgcaggactgcctgagctaagtggaattcaagacctgaaatatgtgtataataatcttcgtccacaagacacagacctggaagcaacaagtcattttaccaagaaaataaaggaaagtctggagtgtttccctgttaaattgaataacttgatccacacacttgcacaaatgtcagccataagccctgccaaatctacttcacagacttttcctcaggaatcctgtttgctgagtacaactaggtcgattgaaagagcaacaattttagggttcagcaagaaatccagtaatctgtatctgatccaggtgacacacagcaacaacgaaacaagcctgacagaaaaatcatttgagcagttttcaaaacttcacagccaacttcagaagcagtttgcatcactgactctcccagagtttcctcattggtggcacctaccttttacaaattcagatcacagaagattcagagatctaaatcattacatggaacagatattaaatgtatcacatgaagttacaaacgtatgttataattaatttttctatttttacataaaacatcaactattttatatttt

SEQ ID NO: 427480 - DNA, 2197 bp, Homo sapiens
ggctcgagcggccgcccgggcaggttgagatcgtgtttcatttcaggaagatatatgcgtcaggaaaatttctatcttcttttgtattatcaaggagatatttggagcagagtcaaccctctcagttacataaaataaaaaatggcatattcttggcaaacggatccaaatcctaatgaatcacacgaaaagcagtatgaacaccaagaatttctctttgtaaatcaaccccattcttctagccaagtcagtctgggttttgatcagatagtagatgagatcagtggcaaaattccacactacgagagtgaaattgatgaaaacaccttttttgtgcccactgcaccaaaatgggactcaacagggcattcattaaatgaagcacaccaaatatccttgaatgaattcacttctaaaagccgtgaactctcctggcatcaagttagcaaagcaccagcaattggttttagtccttctgtgttaccaaaacctcaaaatacgaataaagaatgctcctggggaagccccataggaaaacatcatggtgctgatgattccagattcagtattttagctccatcattcacaagtttggataaaattaatctagagaaagaattagaaaatgaaaatcataactaccatataggatttgaaagtagcattcctccaacaaattcatccttctcaagtgacttcatgccgaaagaagagaataaaaggagtggacatgtgaacattgtggaaccatctttgatgcttttgaaaggctctcttcaacccggaatgtgggaaagtacatggcagaagaatatagagtcaataggttgttccattcagctagtggaagtacctcaaagcagcaatacgagtctggcctctttttgcaacaaagtaaaaaaaatcagagaaagatatcatgcagctgatgttaatttcaattctgggaagatctggagcactactacagcatttccgtatcagctcttttctaagaccaagtttaatatacatatttttattgataactcaacacaacctcttcattttatgccatgtgctaattatcttgtcaaagatctaattgcagaaattctgcatttttgcacaaatgaccagctactccccaaagatcatattctaagtgtatgtggctctgaagaatttttacaaaacgaccactgtttggggagccacaaaatgtttcaaaaagataaatctgttattcagctccacctgcagaaaagtagggaagctccaggaaagctatctcgaaagcatgaagaggaccacagtcagttttatctgaatcaacttctagaatttatgcatatttggaaagtatccagacaatgtctcttaacactcatcagaaaatatgacttccacctgaaatacctattgaaaacccaggaaaacgtgtataatattattgaagaagttaaaaaaatatgcagtgttctagggtgtgtggaaaccaaacaaattacagatgcagtaaatgaactaagtctaattcttcagagaaaaggagagaatttttatcaaagttcagagacttcagcaaaaggcttgatagagaaggtaacaactgaactatccacatccatctaccagctaatcaatgtctactgtaacagcttttatgcagattttcagcctgtaaatgtacctagatgcacttcctatctaaatcccgggcttccttcccacctcagcttcacagtgtatgcagcacacaacattccagaaacctgggtgcacagctacaaagcgttttcttttacctgttggcttacatatgctggaaagaagctgtgccaagtgagaaactacagaaatattccagacaagaaattattttttttcttggtcaactggaatgaaacgatcaattttccccttgaaataaagtcacttccaagggaatccatgctcactgtaaaactgtttgggattgcctgtgcaaccaacaatgcaaatttactggcgtggacttgtcttccactgtttccaaaagagagcagctatacaagtgtctttccttctcatgagtgagtttccttaaagttttacctgcagtatttgtaagatctaccattttttgtagaatatttctagctagtcactgaaaataaaaaaaggttaagtccattttactctcccatcatgtaacacactacttgcacatatcaat

SEQ ID NO: 427481 - DNA, 568 bp, Homo sapiens
agtctgacattaacctatctattccagggtataagatattagcagctaattttttttattaaaagcaatactcaaaaaagagatgtatttaagcatttctgatttatattttcattattttctccgtttttaggtagtatatgatgaagtcacagagctccaaggacatgtcttaatgcttattgtgaagagtaaaactgtatttgtgggagcaattaacatccgactctgtagtgtcccactcgataaagaaaaatggtatccattaggaaacagtataatttgaccattgctatgaacatatgcattattcattaactacttgtatttttttcacttccgggcctctgaatcacataagtaaggcatctttgttgtcaaagacagcacagggtattaaggacacagaaaaaaaatcagaattagtcttttgtgttgtttattttctacctgtgctttcattgttttttcataatcttttctccttcagtggagtactgattgcatgaaatttgatgtgtaaaataataaaagacctttattaaatcattttaatatattttaaatt

SEQ ID NO: 427482 - DNA, 5098 bp, Homo sapiens
ggctcgagcggccgcccgggcaggttgagatcgtgtttcatttcaggaagatatatgcgtcaggaaaatttctatcttcttttgtattatcaaggagatatttggagcagagtcaaccctctcagttacataaaataaaaaatggcatattcttggcaaacggatccaaatcctaatgaatcacacgaaaagcagtatgaacaccaagaatttctctttgtaaatcaaccccattcttctagccaagtcagtctgggttttgatcagatagtagatgagatcagtggcaaaattccacactacgagagtgaaattgatgaaaacaccttttttgtgcccactgcaccaaaatgggactcaacagggcattcattaaatgaagcacaccaaatatccttgaatgaattcacttctaaaagccgtgaactctcctggcatcaagttagcaaagcaccagcaattggttttagtccttctgtgttaccaaaacctcaaaatacgaataaagaatgctcctggggaagccccataggaaaacatcatggtgctgatgattccagattcagtattttagctccatcattcacaagtttggataaaattaatctagagaaagaattagaaaatgaaaatcataactaccatataggatttgaaagtagcattcctccaacaaattcatccttctcaagtgacttcatgccgaaagaagagaataaaaggagtggacatgtgaacattgtggaaccatctttgatgcttttgaaaggctctcttcaacccggaatgtgggaaagtacatggcagaagaatatagagtcaataggttgttccattcagctagtggaagtacctcaaagcagcaatacgagtctggcctctttttgcaacaaagtaaaaaaaatcagagaaagatatcatgcagctgatgttaatttcaattctgggaagatctggagcactactacagcatttccgtatcagctcttttctaagaccaagtttaatatacatatttttattgataactcaacacaacctcttcattttatgccatgtgctaattatcttgtcaaagatctaattgcagaaattctgcatttttgcacaaatgaccagctactccccaaagatcatattctaagtgtatgtggctctgaagaatttttacaaaacgaccactgtttggggagccacaaaatgtttcaaaaagataaatctgttattcagctccacctgcagaaaagtagggaagctccaggaaagctatctcgaaagcatgaagaggaccacagtcagttttatctgaatcaacttctagaatttatgcatatttggaaagtatccagacaatgtctcttaacactcatcagaaaatatgacttccacctgaaatacctattgaaaacccaggaaaacgtgtataatattattgaagaagttaaaaaaatatgcagtgttctagggtgtgtggaaaccaaacaaattacagatgcagtaaatgaactaagtctaattcttcagagaaaaggagagaatttttatcaaagttcagagacttcagcaaaaggcttgatagagaaggtaacaactgaactatccacatccatctaccagctaatcaatgtctactgtaacagcttttatgcagattttcagcctgtaaatgtacctagatgcacttcctatctaaatcccgggcttccttcccacctcagcttcacagtgtatgcagcacacaacattccagaaacctgggtgcacagctacaaagcgttttcttttacctgttggcttacatatgctggaaagaagctgtgccaagtgagaaactacagaaatattccagacaagaaattattttttttcttggtcaactggaatgaaacgatcaattttccccttgaaataaagtcacttccaagggaatccatgctcactgtaaaactgtttgggattgcctgtgcaaccaacaatgcaaatttactggcgtggacttgtcttccactgtttccaaaagaaaaatccattctcgggtctatgctgttcagcatgacattacagagtgagcctcccgtagaaatgataactccaggagtgtgggatgtaagtcagccatccccggtgaccctgcagattgattttccagctactgggtgggagtatatgaaacctgattctgaagagaatagaagtaatcttgaagagccactaaaggagtgtataaaacatattgccagactttcacagaaacagactcccctactactctctgaagaaaagaaaagatatttatggttttatcgcttctactgcaataatgaaaactgctcccttcctttagtcctgggtagtgcccctggatgggatgaaaggactgtttcagaaatgcataccattttgagaagatggacattttctcaacctttagaggctcttgggcttttgacttccagttttccagatcaagaaattcgtaaagtggcagttcaacaattagacaacctcttgaatgatgaactactggaatatctcccacagctagttcaggctgtcaagtttgaatggaaccttgagagtcctttagtgcaacttctactccaccgctccttgcagagcatccaggttgcccatcgtctttactggctgctaaaaaatgcagaaaatgaagcttattttaaaagctggtatcagaagctactagctgctctccaattctgtgcaggtaaagccttgaatgatgagttttccaaggagcagaaacttatcaaaattctgggagatattggggaaagagtcaagtctgccagtgaccatcaaagacaggaggtactgaagaaagaaattggcagactagaagagttctttcaagatgtaaatacttgtcatcttcctctgaaccctgccctatgtataaaagggattgatcacgatgcatgttcatattttacatctaatgctttgccattgaagattactttcatcaatgctaatctgatgggcaaaaacatcagcattatttttaaggctggagatgatcttcgtcaggatatgcttgttctgcagcttattcaagtgatggacaatatttggctgcaggaaggcttggatatgcaaatgatcatttatagatgtctatccacaggaaaagaccaacgattggtgcagatggtacctgatgctgtgaccctagcaaagattcatcgccattctggactgataggaccattgaaagaaaataccattaaaaagtggttcagtcagcacaaccacttaaaggcagattatgaaaaggccttgaggaactttttctactcctgtgctggctggtgtgtggtaacattcatcctgggagtatgtgaccgtcacaatgataatatcatgctgacaaagtcgggccacatgtttcatattgactttggaaaattcttaggtcatgcacaaacatttggagggataaaaagggaccgagctcctttcatttttacttcagagatggaatactttattacagagggtgggaaaaacccacagcattttcaagattttgtggaactttgctgtcgtgcttataatattatcagaaagcacagccaactgctcttgaacctgctggaaatgatgctgtatgcaggactgcctgagctaagtggaattcaagacctgaaatatgtgtataataatcttcgtccacaagacacagacctggaagcaacaagtcattttaccaagaaaataaaggaaagtctggagtgtttccctgttaaattgaataacttgatccacacacttgcacaaatgtcagccataagccctgccaaatctacttcacagacttttcctcaggaatcctgtttgctgagtacaactaggtcgattgaaagagcaacaattttagggttcagcaagaaatccagtaatctgtatctgatccaggtgacacacagcaacaacgaaacaagcctgacagaaaaatcatttgagcagttttcaaaacttcacagccaacttcagaagcagtttgcatcactgactctcccagagtttcctcattggtggcacctaccttttacaaattcagatcacagaagattcagagatctaaatcattacatggaacagatattaaatgtatcacatgaagttacaaacagtgattgtgtacttagctttttcctctctgaggctgtgcaacaaacagttgaatcatcacctgtgtacctaggtgagaagaagtttccagacaagaagcctaaggtgcagttagtcatatcctacgaggatgtgaagctgaccatactagtgaaacacatgaaaaacattcatctcccagatggctctgcgcccagtgcacatgttgaattttatcttttaccatatcccagtgaagttcgtaggaggaaaacaaaatctgttccaaaatgtacggaccccacttacaatgaaattgtagtatatgatgaagtcacagagctccaaggacatgtcttaatgcttattgtgaagagtaaaactgtatttgtgggagcaattaacatccgactctgtagtgtcccactcgataaagaaaaatggtatccattaggaaacagtataatttgaccattgctatgaacatatgcattattcattaactacttgtatttttttcacttccgggcctctgaatcacataagtaaggcatctttgttgtcaaagacagcacagggtattaaggacacagaaaaaaaatcagaattagtcttttgtgttgtttattttctacctgtgctttcattgttttttcataatcttttctccttcagtggagtactgattgcatgaaatttgatgtgtaaaataataaaagacctttattaaatcattttaatatattttaaattaaacataggtttacatttgttttaattgtgtgcctacagttaaaagcagtatttttaatgtattttataagaaagacaatcaaataaacctcgatgctgcgtttcctttaggaggggtatcatgatctactacttgctccttggttgtcattcgttgcaggagcgtttagttcattaaggcggtatattgtatccaaaaatacgggaaccccct

SEQ ID NO: 427483 - DNA, 1441 bp, Homo sapiens
atgttgagttagtgttgattgtctgctgttggttactcattgctccgctcgtgccgtattgggttggttggtgtttgctggtatcgtcttatctggtcgtcttgctgttgatctgtgtcgtgttgcttggtggttcttgcttgcttgtcgggtgtctggtgtgtttgtggctgctgggttgtgtgagatgttatggttcgagtgatccagctcctccggtatattatgatgtgccataatagtcgcaagttccccgcgtgtggtcgccccgatgttttttctccagcctcgcgccacgggcaatttttcctcaccgttattgtgttgacacaacccgcggtttgacacacaccgctgtgtaagaagttttgtaataaatggttctccccttcttagtgccccttttttaaagatcctctctcgttagggtttgatttttgggtccccccgaaatagtggggctccccgccccccccggggagttaaagggggttctcccctttccgccccaaagggtgtctccccccagcggttaccgcacgggtttttctccccccccgatctcacggcacccgtgtggggtgtgaatacgcggtctcgggctcccacgatggctcttatgctgcgttttttttatattcccgcggccctccccccctttatataggggagcccccccctctgtggtcgccccacgagaacacctcttgggggtgtatcacgcgcgtatacagcacttttggggccccccccctctcagaggggagtatccctctctttgtaggcgcgcgtcccgccccccttttgtgtgttttttctttttctttaaattttaaatccactcaaaaggctttatactctaattgagatttcccacgaacaaaatttcgcagcggcgcgattatacctctcttcttctgagaaaaaatattatctttgagactcctctcgtgaatatagagacaccccacgcttatattggggggaagaaagggggctggtataggttttacaattaatcctatattttttatatttctcgagaaatatgagatagtttataatatgagaaagtgtccccgctctttccacgcttctgagattaatataaagaatagacacaaatgggccccacaatgggctgaaagatataaatagccaccacggagaaatgccacaaagctgtataaagctatagggcactgcccaagaggaaaattctcacgaaataaccccaaagtggccacccaaggagaacctttggctgggaatttgaagttattttcacgtcactctcttgtctcttggctcccactcgttttcactggatacggtgtttacaattccaatctctctatttctgggtgaagggtcttggtggtgggggtattgctacggtcttttaattataataaatatttattgaatgcttccgcaaaaa

SEQ ID NO: 427484 - DNA, 233 bp, Homo sapiens
tggttgagagctgggagcaggtgccgaagcgcaggcactcgttgatgtcttggcatccgggctggccgggcacggtgtggaagcccgagcggcaggcacagtaggccgcggtctcactggatacggtgtttacaattccaatctctctatttctgggtgaagggtcttggtggtgggggtattgctacggtcttttaattataataaatatttattgaatgcttccgcaaaaa

SEQ ID NO: 427485 - DNA, 2689 bp, Homo sapiens
cctcagcgcgctacggtccgcgggcaactccgcagaagccccagcccccaggaccccaggacccagtggcgcagccggcagccccggatccctgatctgcttgggcagctcctgcagaacctggaacagtgaatgggtaggggacactgggcgtgcagaaggcggggggcagtgtggaacatgccttcaccacctccagcttctgctgccggaggctgcacccacctgtgcccatggcctgcacgggcccatcacttcctagcgccttcgacattctaggtgcagcaggccaggacaagctcttgtatctgaagcacaaactgaagaccccacgcccaggctgccaggggcaggacctcctgcatgccatggttctcctgaagctgggccaggaaactgaggccaggatctctctagaggcattgaaggccgatgcggtggcccggctggtggcccgccagtgggctggcgtggacagcaccgaggacccagaggagcccccagatgtgtcctgggctgtggcccgcttgtaccacctgctggctgaggagaagctgtgccccgcctcgctgcgggacgtggcctaccaggaagccgtccgcaccctcagctccagggacgaccaccggctgggggaacttcaggatgaggcccgaaaccggtgtgggtgggacattgctggggatccagggagcatccggacgctccagtccaatctgggctgcctcccaccatcctcggctttgccctctgggaccaggagcctcccacgccccattgacggtgtttcggactggagccaagggtgctccctgcgatccactggcagccctgcctccctggccagcaacttggaaatcagccagtcccctaccatgcccttcctcagcctgcaccgcagcccacatgggcccagcaagctctgtgacgacccccaggccagcttggtgcccgagcctgtccccggtggctgccaggagcctgaggagatgagctggccgccatcgggggagattgccagcccaccagagctgccaagcagcccacctcctgggcttcccgaagtggccccagatgcaacctccactggcctccctgatacccccgcagctccagaaaccagcaccaactacccagtggagtgcaccgaggggtctgcaggcccccagtctctccccttgcctattctggagccggtcaaaaacccctgctctgtcaaagaccagacgccactccaactttctgtagaagataccacctctccaaataccaagccgtgcccacctactcccaccaccccagaaacatcccctcctcctcctcctcctcctccttcatctactccttgttcagctcacctgaccccctcctccctgttcccttcctccctggaatcatcatcggaacagaaattctataactttgtgatcctccacgccagggcagacgaacacatcgccctgcgggttcgggagaagctggaggcccttggcgtgcccgacggggccaccttctgcgaggatttccaggtgccggggcgcggggagctgagctgcctgcaggacgccatagaccactcagctttcatcatcctacttctcacctccaacttcgactgtcgcctgagcctgcaccaggtgaaccaagccatgatgagcaacctcacgcgacaggggtcgccagactgtgtcatccccttcctgcccctggagagctccccggcccagctcagctccgacacggccagcctgctctccgggctggtgcggctggacgaacactcccagatcttcgccaggaaggtggccaacaccttcaagccccacaggcttcaggcccgaaaggccatgtggaggaaggaacaggacacccgagccctgcgggaacagagccaacacctggacggtgagcggatgcaggcggcggcactgaacgcagcctactcagcctacctccagagctacttgtcctaccaggcacagatggagcagctccaggtggcttttgggagccacatgtcatttgggactggggcgccctatggggctcgaatgccctttgggggccaggtgcccctgggagccccgccaccctttcccacttggccggggtgcccgcagccgccacccctgcacgcatggcaggctggcacccccccaccgccctccccacagccagcagcctttccacagtcactgcccttcccgcagtccccagccttccctacggcctcacccgcaccccctcagagcccagggctgcaacccctcattatccaccacgcacagatggtacagctggggctgaacaaccacatgtggaaccagagagggtcccaggcgcccgaggacaagacgcaggaggcagaatgaccgcgtgtccttgcctgaccacctggggaacacccctggacccaggcatcggccaggaccccatagagcaccccggtctgccctgtgccctgtggacagtggaagatgaggtcatctgccactttcaggacattgtccgggagcccttcatttaggacaaaacgggcgcgatgatgccctggctttcagggtggtcagaactggatacggtgtttacaattccaatctctctatttctgggtgaagggtcttggtggtgggggtattgctacggtcttttaattataataaatatttattgaatgcttccgcaaaaa

SEQ ID NO: 427486 - DNA, 2608 bp, Homo sapiens
cctcagcgcgctacggtccgcgggcaactccgcagaagccccagcccccaggaccccaggacccagtggcgcagccggcagccccggatccctgatctgcttgggcagctcctgcagaacctggaacagtgaatgggtaggggacactgggcgtgcagaaggcggggggcagtgtggaacatgccttcaccacctccagcttctgctgccggaggctgcacccacctgtgcccatggcctgcacgggcccatcacttcctagcgccttcgacattctaggtgcagcaggccaggacaagctcttgtatctgaagcacaaactgaagaccccacgcccaggctgccaggggcaggacctcctgcatgccatggttctcctgaagctgggccaggaaactgaggccaggatctctctagaggcattgaaggccgatgcggtggcccggctggtggcccgccagtgggctggcgtggacagcaccgaggacccagaggagcccccagatgtgtcctgggctgtggcccgcttgtaccacctgctggctgaggagaagctgtgccccgcctcgctgcgggacgtggcctaccaggaagccgtccgcaccctcagctccagggacgaccaccggctgggggaacttcaggatgaggcccgaaaccggtgtgggtgggacattgctggggatccagggagcatccggacgctccagtccaatctgggctgcctcccaccatcctcggctttgccctctgggaccaggagcctcccacgccccattgacggtgtttcggactggagccaagggtgctccctgcgatccactggcagccctgcctccctggccagcaacttggaaatcagccagtcccctaccatgcccttcctcagcctgcaccgcagcccacatgggcccagcaagctctgtgacgacccccaggccagcttggtgcccgagcctgtccccggtggctgccaggagcctgaggagatgagctggccgccatcgggggagattgccagcccaccagagctgccaagcagcccacctcctgggcttcccgaagtggccccagatgcaacctccactggcctccctgatacccccgcagctccagaaaccagcaccaactacccagtggagtgcaccgaggggtctgcaggcccccagtctctccccttgcctattctggagccggtcaaaaacccctgctctgtcaaagaccagacgccactccaactttctgtagaagataccacctctccaaataccaagccgtgcccacctactcccaccaccccagaaacatcccctcctcctcctcctcctcctccttcatctactccttgttcagctcacctgaccccctcctccctgttcccttcctccctggaatcatcatcggaacagaaattctataactttgtgatcctccacgccagggcagacgaacacatcgccctgcgggttcgggagaagctggaggcccttggcgtgcccgacggggccaccttctgcgaggatttccaggtgccggggcgcggggagctgagctgcctgcaggacgccatagaccactcagctttcatcatcctacttctcacctccaacttcgactgtcgcctgagcctgcaccaggtgaaccaagccatgatgagcaacctcacgcgacaggggtcgccagactgtgtcatccccttcctgcccctggagagctccccggcccagctcagctccgacacggccagcctgctctccgggctggtgcggctggacgaacactcccagatcttcgccaggaaggtggccaacaccttcaagccccacaggcttcaggcccgaaaggccatgtggaggaaggaacaggacacccgagccctgcgggaacagagccaacacctggacggtgagcggatgcaggcggcggcactgaacgcagcctactcagcctacctccagagctacttgtcctaccaggcacagatggagcagctccaggtggcttttgggagccacatgtcatttgggactggggcgccctatggggctcgaatgccctttgggggccaggtgcccctgggagccccgccaccctttcccacttggccggggtgcccgcagccgccaccctccccagccttccctacggcctcacccgcaccccctcagagcccagggctgcaacccctcattatccaccacgcacagatggtacagctggggctgaacaaccacatgtggaaccagagagggtcccaggcgcccgaggacaagacgcaggaggcagaatgaccgcgtgtccttgcctgaccacctggggaacacccctggacccaggcatcggccaggaccccatagagcaccccggtctgccctgtgccctgtggacagtggaagatgaggtcatctgccactttcaggacattgtccgggagcccttcatttaggacaaaacgggcgcgatgatgccctggctttcagggtggtcagaactggatacggtgtttacaattccaatctctctatttctgggtgaagggtcttggtggtgggggtattgctacggtcttttaattataataaatatttattgaatgcttccgcaaaaa

SEQ ID NO: 427487 - DNA, 1229 bp, Homo sapiens
cctcagcgcgctacggtccgcgggcaactccgcagaagccccagcccccaggaccccaggacccagtggcgcagccggcagccccggatccctgatctgcttgggcagctcctgcagaacctggaacagtgaatgggtaggggacactgggcgtgcagaaggcggggggcagtgtggaacatgccttcaccacctccagcttctgctgccggaggctgcacccacctgtgcccatggcctgcacgggcccatcacttcctagcgccttcgacattctaggtgcagcaggccaggacaagctcttgtatctgaagcacaaactgaagaccccacgcccaggctgccaggggcaggacctcctgcatgccatggttctcctgaagctgggccaggaaactgaggccaggatctctctagaggcattgaaggccgatgcggtggcccggctggtggcccgccagtgggctggcgtggacagcaccgaggacccagaggagcccccagatgtgtcctgggctgtggcccgcttgtaccacctgctggctgaggagaagctgtgccccgcctcgctgcgggacgtggcctaccaggaagccgtccgcaccctcagctccagggacgaccaccggctgggggaacttcaggatgaggcccgaaaccggtgtgggtgggacattgctggggatccagggagcatccggacgctccagtccaatctgggctgcctcccaccatcctcggctttgccctctgggaccaggagcctcccacgccccattgacggtgtttcggactggagccaagggtgctccctgcgatccactggcagccctgcctccctggccagcaacttggaaatcagccagtcccctaccatgcccttcctcagcctgcaccgcagcccacatgggcccagcaagctctgtgacgacccccaggccagcttggtgcccgagcctgtccccggtggctgccaggagcctgaggagatgagctggccgccatcgggggagattgccagcccaccagagcactttcaggacattgtccgggagcccttcatttaggacaaaacgggcgcgatgatgccctggctttcagggtggtcagaactggatacggtgtttacaattccaatctctctatttctgggtgaagggtcttggtggtgggggtattgctacggtcttttaattataataaatatttattgaatgcttccgcaaaaa

SEQ ID NO: 427488 - DNA, 1114 bp, Homo sapiens
gagtgggtgcgagtgagaatgagtggcaaaatgtaatgaaaactttacatgaatgcttatttaggttgttcaaagtaaaaagggctacaggtcacagatcgtcagtgcctgagaaagaacattgacttactctatatcaattgaggggaaagtgcagtaccgtcatcttcaagccttgtaagcataaaagagaataggctgcccatataagtcaaaggaaaatgagcccaggccttgctatgaagcagtgtgtgaatggacaatgttgaatgaatgtctggctcagtgatggagagccaggttcatctttgaaatctagggctcttcactcatgaagcagactcctagtcctggagtgactgtgtacgagagcgtggttgtggtgctgtatgtgaacgcatgcaagcttgattcaccttcagggggctgataacctagtaaatcatcaaaatgagatcataagtgttaatgtacactggacatgaaaacaaagactggtttagcagcagacattggtttactctgcagcctgtgttttctgtttccccctttcccacctccttccccccacccaatccttttttttttcttttttgcttttcttttctttttttttagtttttatttactttacctagtatgcctttttttagttgcttctcaagtcagaaaacttttcaggaaggtttccctgtgcatttgcaccagatgaatgtttgatgctatgaaaagctttccatatcatcaaaactaatttgtgtagatttttgcatgaaaaaaatcataaatttccctcaaaatagactgtgttgcagtacacaagttgccataatagtataaaacagtaaaatgtgcttaaaaggccatccttttcattttcagagataacataaagatctttgcatgaggtaaatctacagcatagttcatttttagattttgttgagtcctgtaaagaagaagaagaaaaaagtttcagttgtggtagaataccgtgctgtgtttaaatgttacttgttttcaaactttgttttctatgaaaatgatatggaaacttctaaaatggaatttggtgcatatgtactgctgaataaagaccgatgaagaggtttga

SEQ ID NO: 427489 - DNA, 738 bp, Homo sapiens
cggacgcgtgggtcgacccacgcgtccgcatcagtgcttcagttttctctctatccaaagcaaggttttaactttccttcattctccagtaaaacagaccgagacaacttgaactatattttgagtattgctatatcttcaacatatagctccaaatgatggattgtatacaaagcatagtacagaaggtttcagtaattggaaggtgaacacagcaatgctttacataatttgtgttttttagtaaaaaatattggattcaaagtaagccaatgagcttgtatacaaattttatatacaaattattgtatagaacagtgatatggaaaataggtaagggtgatattaatatctctgggtataaggactaccttatcgtttaaatattttatttccatctatagcctaatatagaacattgattttctagtagaaattctgggaagggcttttctgtctctgaaattgattcagtacagttgacagttcatcacggttacctggttaaacactttttttttttttttaattctccagtgatctaggaaattgtttcatttttaacacaggcttatttctgatggggatgggggcatagaataatatgcctaataagctaaacgttcttaacgtttcatgtcttaaactgtctttttgaacattgagaccacctcaagtgctgtaaaaataagaatgttatattaggggtgtgtgagacgccctagtctaaaatctatc

SEQ ID NO: 427490 - DNA, 2623 bp, Homo sapiens
gagtgggtgcgagtgagaatgagtggcaaaatgtaatgaaaactttacatgaatgcttatttaggttgttcaaagtaaaaagggctacaggtcacagatcgtcagtgcctgagaaagaacattgacttactctatatcaattgaggggaaagtgcagtaccgtcatcttcaagccttgtaagcataaaagagaataggctgcccatataagtcaaaggaaaatgagcccaggccttgctatgaagcagtgtgtgaatggacaatgttgaatgaatgtctggctcagtgatggagagccaggttcatctttgaaatctagggctcttcactcatgaagcagactcctagtcctggagtgactgtgtacgagagcgtggttgtggtgctgtatgtgaacgcatgcaagcttgattcaccttcagggggctgataacctagtaaatcatcaaaatgagatcataagtgttaatgtacactggacatgaaaacaaagactggtttagcagcagacattggtttactctgcagcctgtgttttctgtttccccctttcccacctccttccccccacccaatccttttttttttcttttttgcttttcttttctttttttttagtttttatttactttacctagtatgcctttttttagttgcttctcaagtcagaaaacttttcaggaaggtttccctgtgcatttgcaccagatgaatgtttgatgctatgaaaagctttccatatcatcaaaactaatttgtgtagatttttgcatgaaaaaaatcataaatttccctcaaaatagactgtgttgcagtacacaagttgccataatagtataaaacagtaaaatgtgcttaaaaggccatccttttcattttcagagataacataaagatctttgcatgaggtaaatctacagcatagttcatttttagattttgttgagtcctgtaaagaagaagaagaaaaaagtttcagttgtggtagaataccgtgctgtgtttaaatgttacttgttttcaaactttgttttctatgaaaatgatatggaaacttctaaaatggaatttggtgcatatgtactgctgaataaagaccgatgaagaggtttgagtagatgtacaaatcaagtaatggtttgaacacctttaataatatgcctaatctgttcaattgttttagaatctttttatcttagatgtaggcagccatgaacaatctattttgagccactttagggagaaaactttgtatttttaaaacttgcataaaagttatgcaagtggtttttataaattggaataatacctcagttttgaggttatgcacactaaattaaatgtgacataaattaatttgtacaaaaagaactctttataaggtggctcattgtaggaaatcctgtgccttcccctttgagcacaagtgttgcatgaacaacagtttgctataagaaacataccagattagccaccattagcatctatatctactttgtgtttaaaaatcaactggtaattctgaaacactgtagaatggataaaaattattttgtgatcataactctttgttgaactagagtatttttgcagcattccttgtcatcagaaacatggttaaagtttaaaactagaagcagcagaaaactagcttgtaaaatttatccaagtagagtgcaggctaggctgtcttggggaaataaacattaaaacttaaagcaatgttttacatggggtgtgtgtgtgtggtgtgtggatttttttttttttataaagttagagtataattcaatggcttacattagcttcctgtctttttacctagaaccagcataataagaaatttctttggttctgtcatttcagtatggacatattaatattttagcccactgagtttgtccagttgacaccatcagtgcttcagttttctctctatccaaagcaaggttttaactttccttcattctccagtaaaacagaccgagacaacttgaactatattttgagtattgctatatcttcaacatatagctccaaatgatggattgtatacaaagcatagtacagaaggtttcagtaattggaaggtgaacacagcaatgctttacataatttgtgttttttagtaaaaaatattggattcaaagtaagccaatgagcttgtatacaaattttatatacaaattattgtatagaacagtgatatggaaaataggtaagggtgatattaatatctctgggtataaggactaccttatcgtttaaatattttatttccatctatagcctaatatagaacattgattttctagtagaaattctgggaagggcttttctgtctctgaaattgattcagtacagttgacagttcatcacggttacctggttaaacactttttttttttttttaattctccagtgatctaggaaattgtttcatttttaacacaggcttatttctgatggggatgggggcatagaataatatgcctaataagctaaacgttcttaacgtttcatgtcttaaactgtctttttgaacattgagaccacctcaagtgctgtaaaaataagaatgttatattaggggtgtgtgagacgccctagtctaaaatctatc

SEQ ID NO: 427491 - DNA, 1619 bp, Homo sapiens
gagtgggtgcgagtgagaatgagtggcaaaatgtaatgaaaactttacatgaatgcttatttaggttgttcaaagtaaaaagggctacaggtcacagatcgtcagtgcctgagaaagaacattgacttactctatatcaattgaggggaaagtgcagtaccgtcatcttcaagccttgtaagcataaaagagaataggctgcccatataagtcaaaggaaaatgagcccaggccttgctatgaagcagtgtgtgaatggacaatgttgaatgaatgtctggctcagtgatggagagccaggttcatctttgaaatctagggctcttcactcatgaagcagactcctagtcctggagtgactgtgtacgagagcgtggttgtggtgctgtatgtgaacgcatgcaagcttgattcaccttcagggggctgataacctagtaaatcatcaaaatgagatcataagtgttaatgtacactggacatgaaaacaaagactggtttagcagcagacattggtttactctgcagcctgtgttttctgtttccccctttcccacctccttccccccacccaatccttttttttttcttttttgcttttcttttctttttttttagtttttatttactttacctagtatgcctttttttagttgcttctcaagtcagaaaacttttcaggaaggtttccctgtgcatttgcaccagatgaatgtttgatgctatgaaaagctttccatatcatcaaaactaatttgtgtagatttttgcatgaaaaaaatcataaatttccctcaaaatagactgtgttgcagtacacaagttgccataatagtataaaacagtaaaatgtgcttaaaaggccatccttttcattttcagagataacataaagatctttgcatgaggtaaatctacagcatagttcatttttagattttgttgagtcctgtaaagaagaagaagaaaaaagtttcagttgtggtagaataccgtgctgtgtttaaatgttacttgttttcaaactttgttttctatgaaaatgatatggaaacttctaaaatggaatttggtgcatatgtactgctgaataaagaccgatgaagaggtttgagtagatgtacaaatcaagtaatggtttgaacacctttaataatatgcctaatctgttcaattgttttagaatctttttatcttagatgtaggcagccatgaacaatctattttgagccactttagggagaaaactttgtatttttaaaacttgcataaaagttatgcaagtggtttttataaattggaataatacctcagttttgaggttatgcacactaaattaaatgtgacataaattaatttgtacaaaaagaactctttataaggtggctcattgtaggaaatcctgtgccttcccctttgagcacaagtgttgcatgaacaacagtttgctataagaaacataccagattagccaccattagcatctatatctactttgtgtttaaaaatcaactggtaattctgaaacactgtagaatggataaaaattattttttaaccaaaacctgtttttaaaaaaaaaaaaccccccaaccaccccccccaaaaataattatgga

SEQ ID NO: 427492 - DNA, 808 bp, Homo sapiens
gcgagggtgaaccctagttgagaagtttcaagtagcattttaagaaaaaaagtttcagttgtggtagaataccgtgctgtgtttaaatgttacttgttttcaaactttgttttctatgaaaatgatatggaaacttctaaaatggaatttggtgcatatgtactgctgaataaagaccgatgaagaggtttgagtagatgtacaaatcaagtaatggtttgaacacctttaataatatgcctaatctgttcaattgttttagaatctttttatcttagatgtaggcagccatgaacaatctattttgagccactttagggagaaaactttgtatttttaaaacttgcataaaagttatgcaagtggtttttataaattggaataatacctcagttttgaggttatgcacactaaattaaatgtgacataaattaatttgtacaaaaagaactctttataaggtggctcattgtaggaaatcctgtgccttcccctttgagcacaagtgttgcatgaacaacagtttgctataagaaacataccagattagccaccattagcatctatatctactttgtgtttaaaaatcaactggtaattctgaaacactgtagaatggataaaaattattttgtgatcataactctttgttgaactagagtatttttgcagcattccttgtcatcagaaacatggttaaagtttaaaactagaagcagcagaaaactagcttgtaaaatttatccaagtagagtgcaggctaggctgtcttggggaaataaacattaaaacttaaagcaatgtttta

SEQ ID NO: 427493 - DNA, 794 bp, Homo sapiens
atctcactaagcatttttgtaaattatatacgttgctatagaaacttctagaactaggcgtgctgtgtttaaatgttacttgttttcaaactttgttttctatgaaaatgatatggaaacttctaaaatggaatttggtgcatatgtactgctgaataaagaccgatgaagaggtttgagtagatgtacaaatcaagtaatggtttgaacacctttaataatatgcctaatctgttcaattgttttagaatctttttatcttagatgtaggcagccatgaacaatctattttgagccactttagggagaaaactttgtatttttaaaacttgcataaaagttatgcaagtggtttttataaattggaataatacctcagttttgaggttatgcacactaaattaaatgtgacataaattaatttgtacaaaaagaactctttataaggtggctcattgtaggaaatcctgtgccttcccctttgagcacaagtgttgcatgaacaacagtttgctataagaaacataccagattagccaccattagcatctatatctactttgtgtttaaaaatcaactggtaattctgaaacactgtagaatggataaaaattattttgtgatcataactctttgttgaactagagtatttttgcagcattccttgtcatcagaaacatggttaaagtttaaaactagaagcagcagaaaactagcttgtaaaatttatccaagtagagtgcaggctaggctgtcttggggaaataaacattaaaacttaaagcaatgtttta

SEQ ID NO: 427494 - DNA, 1506 bp, Homo sapiens
gagtgggtgcgagtgagaatgagtggcaaaatgtaatgaaaactttacatgaatgcttatttaggttgttcaaagtaaaaagggctacaggtcacagatcgtcagtgcctgagaaagaacattgacttactctatatcaattgaggggaaagtgcagtaccgtcatcttcaagccttgtaagcataaaagagaataggctgcccatataagtcaaaggaaaatgagcccaggccttgctatgaagcagtgtgtgaatggacaatgttgaatgaatgtctggctcagtgatggagagccaggttcatctttgaaatctagggctcttcactcatgaagcagactcctagtcctggagtgactgtgtacgagagcgtggttgtggtgctgtatgtgaacgcatgcaagcttgattcaccttcagggggctgataacctagtaaatcatcaaaatgagatcataagtgttaatgtacactggacatgaaaacaaagactggtttagcagcagacattggtttactctgcagcctgtgttttctgtttccccctttcccacctccttccccccacccaatccttttttttttcttttttgcttttcttttctttttttttagtttttatttactttacctagtatgcctttttttagttgcttctcaagtcagaaaacttttcaggaaggtttccctgtgcatttgcaccagatgaatgtttgatgctatgaaaagctttccatatcatcaaaactaatttgtgtagatttttgcatgaaaaaaatcataaatttccctcaaaatagactgtgttgcagtacacaagttgccataatagtataaaacagtaaaatgtgcttaaaaggccatccttttcattttcagagataacataaagatctttgcatgaggtaaatctacagcatagttcatttttagattttgttgagtcctgtaaagaagaagaagaaaaaagtttcagttgtggtagaataccgtgctgtgtttaaatgttacttgttttcaaactttgttttctatgaaaatgatatggaaacttctaaaatggaatttggtgcatatgtactgctgaataaagaccgatgaagaggtttgagtagatgtacaaatcaagtaatggtttgaacacctttaataatatgcctaatctgttcaattgttttagaatctttttatcttagatgtaggcagccatgaacaatctattttgagccactttagggagaaaactttgtatttttaaaacttgcataaaagttatgcaagtggtttttataaattggaataatacctcagttttgaggttatgcacactaaattaaatgtgacataaattaatttgtacaaacctgtgtgtcaaatatgagcaactcttaacctgacccgtggcaaccatctgggacctgtgtctaaggaaggttttaaattcgcctgcctccagttccctttattgcctcattcctacctattggacttctaaactagggg

SEQ ID NO: 427495 - DNA, 490 bp, Homo sapiens
gcgtcgacgctgattgatttattgactggctgattgatttattgactggctgattgatttattgactggctgattgaactatttaaacaataaggcccctgggggattggtatatggccgatttacaaagaactctttataaggtggctcattgtaggaaatcctgtgccttcccctttgagcacaagtgttgcatgaacaacagtttgctataagaaacataccagattagccaccattagcatctatatctactttgtgtttaaaaatcaactggtaattctgaaacactgtagaatggataaaaattattttgtgatcataactctttgttgaactagagtatttttgcagcattccttgtcatcagaaacatggttaaagtttaaaactagaagcagcagaaaactagcttgtaaaatttatccaagtagagtgcaggctaggctgtcttggggaaataaacattaaaacttaaagcaatgtttta

SEQ ID NO: 427496 - DNA, 1729 bp, Homo sapiens
gagtgggtgcgagtgagaatgagtggcaaaatgtaatgaaaactttacatgaatgcttatttaggttgttcaaagtaaaaagggctacaggtcacagatcgtcagtgcctgagaaagaacattgacttactctatatcaattgaggggaaagtgcagtaccgtcatcttcaagccttgtaagcataaaagagaataggctgcccatataagtcaaaggaaaatgagcccaggccttgctatgaagcagtgtgtgaatggacaatgttgaatgaatgtctggctcagtgatggagagccaggttcatctttgaaatctagggctcttcactcatgaagcagactcctagtcctggagtgactgtgtacgagagcgtggttgtggtgctgtatgtgaacgcatgcaagcttgattcaccttcagggggctgataacctagtaaatcatcaaaatgagatcataagtgttaatgtacactggacatgaaaacaaagactggtttagcagcagacattggtttactctgcagcctgtgttttctgtttccccctttcccacctccttccccccacccaatccttttttttttcttttttgcttttcttttctttttttttagtttttatttactttacctagtatgcctttttttagttgcttctcaagtcagaaaacttttcaggaaggtttccctgtgcatttgcaccagatgaatgtttgatgctatgaaaagctttccatatcatcaaaactaatttgtgtagatttttgcatgaaaaaaatcataaatttccctcaaaatagactgtgttgcagtacacaagttgccataatagtataaaacagtaaaatgtgcttaaaaggccatccttttcattttcagagataacataaagatctttgcatgaggtaaatctacagcatagttcatttttagattttgttgagtcctgtaaagaagaagaagaaaaaagtttcagttgtggtagaataccgtgctgtgtttaaatgttacttgttttcaaactttgttttctatgaaaatgatatggaaacttctaaaatggaatttggtgcatatgtactgctgaataaagaccgatgaagaggtttgagtagatgtacaaatcaagtaatggtttgaacacctttaataatatgcctaatctgttcaattgttttagaatctttttatcttagatgtaggcagccatgaacaatctattttgagccactttagggagaaaactttgtatttttaaaacttgcataaaagttatgcaagtggtttttataaattggaataatacctcagttttgaggttatgcacactaaattaaatgtgacataaattaatttgtacaaaaagaactctttataaggtggctcattgtaggaaatcctgtgccttcccctttgagcacaagtgttgcatgaacaacagtttgctataagaaacataccagattagccaccattagcatctatatctactttgtgtttaaaaatcaactggtaattctgaaacactgtagaatggataaaaattattttgtgatcataactctttgttgaactagagtatttttgcagcattccttgtcatcagaaacatggttaaagtttaaaactagaagcagcagaaaactagcttgtaaaatttatccaagtagagtgcaggctaggctgtcttggggaaataaacattaaaacttaaagcaatgtttta

SEQ ID NO: 427497 - DNA, 722 bp, Homo sapiens
aaaaaggaagaaaagaaaaaaaggaaaccagccctgtcatggaatttctctccttccctgcacagtaaagacttttgggttttcatggataaaatcaatgtcagtactgaaactcctactctcccctcccgccccactctcccccgttgcccgagatggccaagttcaggcctgtgcaatgccgcttccctctgagcctccctctcaagggccacgcaggcagctgcagcagggccagctgcaggatggggctgccggtcactgaattgtcgttcaaatgcatcatctttgtggcgtctttctcatgcgagcaaagccacgtgctctcctgtctgctgtcacatctgtgcctggattgcttaaatattgtttgtgatggggaggttttaatctggtgatgcagagggaagcagggctgtgggggcacgtttaattggctcccagcagcgtggggagtgcttctatggtgtgtggggttttttgttgcctccctctagaagtgttaccgttttcacgtcctattaatgtcctctggttgttaaattacagcagcacattacagtgcactgggttccctcctggagtgaatacaaacggagggcatctacttgtatttttagaagttttgggagaatttagtgatttgtggctttgatcaatcctgttgactggtgtatgtctgcgcaaacctgtttcaaataaatcttttgttaaagtaaaaa

SEQ ID NO: 427498 - DNA, 7325 bp, Homo sapiens
  misc_feature (1)..(1): n is a, c, g, or t
  misc_feature (3)..(4): n is a, c, g, or t
  misc_feature (6)..(6): n is a, c, g, or t
  misc_feature (11)..(12): n is a, c, g, or t
  misc_feature (17)..(17): n is a, c, g, or t
  misc_feature (3486)..(3486): n is a, c, g, or t
ncnntnttctnncttcngtcggatgcctcctccctgtagtgattcctgtgactttgatgaccccaggctgttgaagaacattgaggatcgccatcccacagccccttgcattcaggagttcctcacccttctggccgtgtgccacacggttgttcctgagaaggatggagataacatcatctaccaggcctcttccccagatgaagctgctttggtgaaaggagctaaaaagctgggctttgtcttcacagccagaacaccattctcagtcatcatagaagcgatgggacaggaacaaacatttggaatccttaatgtcctggaattttctagtgacagaaaaagaatgtctgtaattgttcgaactccttcaggacgacttcggctttactgtaaaggggctgataatgtgatttttgagagactttcaaaagactcaaaatatatggaggaaacattatgccatctggaatactttgccacggaaggcttgcggactctctgtgtggcttatgctgatctctctgagaatgagtatgaggagtggctgaaagtctatcaggaagccagcaccatattgaaggacagagctcaacggttggaagagtgttacgagatcattgagaagaatttgctgctacttggagccacagccatagaagatcgccttcaagcaggagttccagaaaccatcgcaacactgttgaaggcagaaattaaaatatgggtgttgacaggagacaaacaagaaactgcgattaatatagggtattcctgccgattggtatcgcagaatatggcccttatcctattgaaggaggactctttggatgccacaagggcagccattactcagcactgcactgaccttgggaatttgctgggcaaggaaaatgacgtggccctcatcatcgatggccacaccctgaagtacgcgctctccttcgaagtccggaggagtttcctggatttggcactctcgtgcaaagcggtcatatgctgcagagtgtctcctctgcagaagtctgagatagtggatgtggtgaagaagcgggtgaaggccatcaccctcgccatcggagacggcgccaacgatgtcgggatgatccagacagcccacgtgggtgtgggaatcagtgggaatgaaggcatgcaggccaccaacaactcggattacgccatcgcacagttttcctacttagagaagcttctgttggttcatggagcctggagctacaaccgggtgaccaagtgcatcttgtactgcttctataagaacgtggtcctgtatattattgagctttggttcgcctttgttaatggattttctgggcagattttatttgaacgttggtgcatcggcctgtacaatgtgattttcaccgctttgccgcccttcactctgggaatctttgagaggtcttgcactcaggagagcatgctcaggtttccccagctctacaaaatcacccagaatggcgaaggcttcaacacaaaggttttctggggtcactgcatcaacgccttggtccactccctcatcctcttctggtttcccatgaaagctctggagcatgatactgtgttgacaagtggtcatgctaccgactatttatttgttggaaatattgtttacacatatgttgttgttactgtttgtctgaaagctggtttggagaccacagcttggactaaattcagtcatctggctgtctggggaagcatgctgacctggctggtgttttttggcatctactcgaccatctggcccaccattcccattgctccagatatgagaggacaggcaactatggtcctgagctccgcacacttctggttgggattatttctggttcctactgcctgtttgattgaagatgtggcatggagagcagccaagcacacctgcaaaaagacattgctggaggaggtgcaggagctggaaaccaagtctcgagtcctgggaaaagcggtgctgcgggatagcaatggaaagaggctgaacgagcgcgaccgcctgatcaagaggctgggccggaagacgcccccgacgctgttccggggcagctccctgcagcagggcgtcccgcatgggtatgctttttctcaagaagaacacggagctgttagtcaggaagaagtcatccgtgcttatgacaccaccaaaaagaaatccaggaagaaataagacatgaattttcctgactgatcttaggaaagagattcagtttgttgcacccagtgttaacacatctttgtcagagaagactggcgtcagcagccaaaacaccaggaaacacatttctgtggccttagccaagcagtttgttagttacatattccctcgcaaacctggagtgcagaccacaggggaagctatctttgccctcccaactcgtctgcagtgcttagcctaacttttgtttatgtcgttatgaagcattcaactgtgctctgtgaggtgtgaaattaaaaacattatgtttcaccaatatttaaacatcagtactagttgtcctgggagaaagggaaaggagttttatgttgcgtgagaggcccatcctgtgtaattggagcagggcacacttgcttcctgttgagttaactcagaggttaagtccaacgggccacatgcagacttcactgtaggcaggttgctctcctgctttgattcctgttttgtgtgtaaaattggcataaacttcttgattgcagtgaaatcacaaaattctctatcggggtggtcaacctgagaacatttatttgaacctcttagccacatttccagcagggcaaaccaactgatgccctggaagagtcttccgcaccctctccaggtgcactcggcccagtcctgccgccgtgtccaggcgcccctcacccccacacctgctgcatggctggccacaccactcagtgcatggcggccgatgggcagccaacccaaacccgcgcctttccttgttccactgcagactcagatacagatgcgaaaaattccttcttccaccgcccttctcgttctgtaaagaaagaaaagaaacatagcctttctgcatatattctaaacgtctctctgcctctgtctgacatggggccaccccacaggtcagagtggtggtagaaccccttcaggactcccagccgtggtcaggctctgaatactcccttcccaacatccagactgctgggcctttggcatccacttacattagaacccacgtttgtttcagagcacattttggactttcactgttgggaaatgaatgaatttataacatgcctgcacagcgaaggaacacacctgtcgctcttagctctagagtcagaggatgagtaaacccagatgcaagagtataggacattgagtggggagaacaagacgaccacagaagtcctcagaaggagaaggaaggacacggagacactgagaggaggacacagaggaatcgccaccagatctttgcagtagaaactctgaaatangccttgagacccagacaattgtcatgatcagcccagtgtgtatgagagcttaaacaagaccttcacacacagttctaattgaaaagaattccaaacatttcagggaaacacctttttaaaaaatatactgacatggtttcctttctgtatcccatcagtgttagacacaggtacctatcagaatacggcatatcctgaattatctaagacaaggaagtgaagagcggaatcactgactttcccaactgcagagtcccacacttaaatctcaacagaacctagatgtcttcaggcatgaatgtgagcacctggagcccttactaaacaacctgcctggagccctgttctctgctctggttgccaaaccagatttttggatggcctaaatacttgtgggcaactgttactggtgaaaaatgggagtggagagcatgttttggattttcactgtggggaaatgaatgaatttatcacatgactgtgcagcgaaggagcacacctgtcactcttagctctagagtcggaggatgagtcaaccctgtaggaatgattgtgctaaattaggaaataacactttagtgcactttgcttcctaacccttttttgtcagaaatctacaacctactgggcatggaaatgatttaaaatatgatctgcattgactaagaaaactcatcctcacttatgaggtgaccaggatgcagagagggcctgaggggcagcagaacaatgcaattcacaggtgaggctccaaaaagggccatttctttctccccaaggtgcatagaacatttttaaatatcagagtacccagcaagacggaaggactgtcatgcaggaactctaacacaaaatgtgcctatgactaacacgacaaaccaaggtgtatggtttctttgcacacccagaaaggtgatggccaagatacagaggagaaacgaaaactggaattgaatgtgcattaggcatcttaactattcatattttgtttcatttgggaactaagcctatttggaaagagtggattagaaattgaattctttgtcaaacagttagctctgtcttgaacttgaagccttccaaatcagaattatgtatttaagtgtgtgtttgtgtttgtttggggtttttgtttcttacattagagttcatattttctgggatttaaggatacaggtgtattttcctattctcttgagaagtagactaaacaatatttgcagtgatgacagacgcacacagaagaaaacattagaagagatgcctttctatcctctcatgtggttgagcattcttacagccaaatgactaaattggctgtaaattggtttctaggaggagcagctgtcactacgtgtgatgtataatatttagccagggccaactcaggggctgtgtcatttgtcctatctttaaattgaggtcagagtgtcacacacaacccctcccctggggcagggtggactggactaggttgcatacgctggctgtcagctcagcaaaaatgccacatggggcttgtcactccgccagacactcactgactcacgggctggcaggtcacgctcggttagcgctccagggcctgactctggattgagctaaactggcagaatccactcaggccaacccttggtctactgctgtgtacagacagcccagtcctgtgttgagtctctcttctcctggatgaccctgcaaaaggaagagagcagttgtactgtgggcttagttctgggtttccactgcacactgacacgtgccagcaagggtagctgtggaaaacacgtatcaggagagcagagtagtctggatgaatactctgtgctgatcagaacgggctcggtcataatttaggagtggagctgatgtgtctgtcctgcctcaatgcagaatattccaggcttcttgaccagggttatgttcacccatctcccaacacacacatgcacacatgaaaacaaaaacatggtaactcttttggttcggcacaccatacaaaacgtgctttggggcgaggagtgctgtttcttttaacacttgtagaggaatatcctgagaagtgaacctgggctttgggagagctcagctgagaattctgttgacattttctttcccttgacaaggcttcaggttcgtctcactatagggagctggctgtgaaaatcagtaataacttgtcaagaagcagtgaaaaatgcgggggggtggaaagagtctaggtaactaatgtcttataatgcatatgtatgtaaatattacaggatttaaggttgaattttttaaaaagaaagttatagtctgtaatttccatttgttataataatgacctttaatcttgtcatttggaaccataaagcatttttatcaggtacctctgttccaagggatttatgtcttagaccatagctgaattgaatgtttgcaaaacactgctataggataaggtggtctttagttttgaacgtgtgaaaggactgcacacttttcagccagggtttgagttactgcccagggtcatcgtctcaaagtaattcaaggagtgatttaacatcagcatttgaaatgtagtcttcatctcctgggatccataaaaaaatgtgaacagggaaatggtggctaagcagagcctgaaataataacttggcaaagaaatgagtttatcaggtcgagtcaaaacatggcatcccctgttacactcaagaaatgctttcttcatgtaaatgtttatacgggcatatataatcacaatgggaacagttaaaaccccctcccttcaaaaaaagaaaatctatatcagttgggtttggttttggttcttcattggctcaaggcagttaactgtctcagtatagcctttggggagatttaacctcattctagccatttttccatcctgaaggccaagaaggactattagaagggtttttgaggggtttcggaggtgagggcccaagacccccataatgacatcattaggtattcttgaaaggtgttaacagaccagcacgctcgatgtgttgtacccttcatttatttttttttctcagcatcccaagttgtccatcagtacattccccttcaccttacctgatcttcatttaatgcccagtctgtaactaatgttctgtttaaagctctcttaatttgttggctatgagtgatttgtgaatctgggatgtaaccctgagtgaggagaaaagggcattgagccagcataaatctgaatgggcagaagccacaaacaaatgggagcagaaaagaagggcgagctcccccgcgccgcaccccgtgtataatccagtgttaacctctgaggaacacctcggctctcccaactgaggagagacaaaagagggattctttttacacccaggctggcgcattttcaagtgacaatctcgggctctagttgcctttgagatatccactctgctctttctcccaggcctcagaccaagaaaaacatgctctcaagattagcccataggcagttcttgtgacctggctgaagaaagaaaggagacctgtttgttttaaaagtcgggcgcaaagtgtcaggtggctttgatttatgacagaaagaggaagaagaaagttggagtaatagcactatccaaataaccctgcccaggaaacttgggggtcaagagagcttatcaagagccttttataggtaagctcttccgtgtgaaagagaaaaggccggaaagagggagagagcccagagagcaggctgcgaactcacttccaatgggattggagtctgttgtattcttaagagatagcctgatatgtggtttataggtgaatcaataaacaccaacaacaacaaaaaa

SEQ ID NO: 427499 - DNA, 668 bp, Homo sapiens
aaaaaggaagaaaagaaaaaaaggaaaccagccctgtcatggaatttctctccttccctgcacagtaaagacttttgggttttcatggatcgttgcccgagatggccaagttcaggcctgtgcaatgccgcttccctctgagcctccctctcaagggccacgcaggcagctgcagcagggccagctgcaggatggggctgccggtcactgaattgtcgttcaaatgcatcatctttgtggcgtctttctcatgcgagcaaagccacgtgctctcctgtctgctgtcacatctgtgcctggattgcttaaatattgtttgtgatggggaggttttaatctggtgatgcagagggaagcagggctgtgggggcacgtttaattggctcccagcagcgtggggagtgcttctatggtgtgtggggttttttgttgcctccctctagaagtgttaccgttttcacgtcctattaatgtcctctggttgttaaattacagcagcacattacagtgcactgggttccctcctggagtgaatacaaacggagggcatctacttgtatttttagaagttttgggagaatttagtgatttgtggctttgatcaatcctgttgactggtgtatgtctgcgcaaacctgtttcaaataaatcttttgttaaagtaaaaa

SEQ ID NO: 427500 - DNA, 2494 bp, Homo sapiens
  misc_feature (1)..(1): n is a, c, g, or t
  misc_feature (3)..(4): n is a, c, g, or t
  misc_feature (6)..(6): n is a, c, g, or t
  misc_feature (11)..(12): n is a, c, g, or t
  misc_feature (17)..(17): n is a, c, g, or t
ncnntnttctnncttcngtcggatgcctcctccctgtagtgattcctgtgactttgatgaccccaggctgttgaagaacattgaggatcgccatcccacagccccttgcattcaggagttcctcacccttctggccgtgtgccacacggttgttcctgagaaggatggagataacatcatctaccaggcctcttccccagatgaagctgctttggtgaaaggagctaaaaagctgggctttgtcttcacagccagaacaccattctcagtcatcatagaagcgatgggacaggaacaaacatttggaatccttaatgtcctggaattttctagtgacagaaaaagaatgtctgtaattgttcgaactccttcaggacgacttcggctttactgtaaaggggctgataatgtgatttttgagagactttcaaaagactcaaaatatatggaggaaacattatgccatctggaatactttgccacggaaggcttgcggactctctgtgtggcttatgctgatctctctgagaatgagtatgaggagtggctgaaagtctatcaggaagccagcaccatattgaaggacagagctcaacggttggaagagtgttacgagatcattgagaagaatttgctgctacttggagccacagccatagaagatcgccttcaagcaggagttccagaaaccatcgcaacactgttgaaggcagaaattaaaatatgggtgttgacaggagacaaacaagaaactgcgattaatatagggtattcctgccgattggtatcgcagaatatggcccttatcctattgaaggaggactctttggatgccacaagggcagccattactcagcactgcactgaccttgggaatttgctgggcaaggaaaatgacgtggccctcatcatcgatggccacaccctgaagtacgcgctctccttcgaagtccggaggagtttcctggatttggcactctcgtgcaaagcggtcatatgctgcagagtgtctcctctgcagaagtctgagatagtggatgtggtgaagaagcgggtgaaggccatcaccctcgccatcggagacggcgccaacgatgtcgggatgatccagacagcccacgtgggtgtgggaatcagtgggaatgaaggcatgcaggccaccaacaactcggattacgccatcgcacagttttcctacttagagaagcttctgttggttcatggagcctggagctacaaccgggtgaccaagtgcatcttgtactgcttctataagaacgtggtcctgtatattattgagctttggttcgcctttgttaatggattttctgggcagattttatttgaacgttggtgcatcggcctgtacaatgtgattttcaccgctttgccgcccttcactctgggaatctttgagaggtcttgcactcaggagagcatgctcaggtttccccagctctacaaaatcacccagaatggcgaaggcttcaacacaaaggttttctggggtcactgcatcaacgccttggtccactccctcatcctcttctggtttcccatgaaagctctggagcatgatactgtgttgacaagtggtcatgctaccgactatttatttgttggaaatattgtttacacatatgttgttgttactgtttgtctgaaagctggtttggagaccacagcttggactaaattcagtcatctggctgtctggggaagcatgctgacctggctggtgttttttggcatctactcgaccatctggcccaccattcccattgctccagatatgagaggacaggcaactatggtcctgagctccgcacacttctggttgggattatttctggttcctactgcctgtttgattgaagatgtggcatggagagcagccaagcacacctgcaaaaagacattgctggaggaggtgcaggagctggaaaccaagtctcgagtcctgggaaaagcggtgctgcgggatagcaatggaaagaggctgaacgagcgcgaccgcctgatcaagaggctgggccggaagacgcccccgacgctgttccggggcagctccctgcagcagggcgtcccgcatgggtatgctttttctcaagaagaacacggagctgttagtcaggaagaagtcatccgtgcttatgacaccaccaaaaagaaatccaggaagaaataagacatgaattttcctgactgatcttaggaaagagattcagtttgttgcacccagtgttaacacatctttgtcagagaagactggcgtcagcagccaaaacaccaggaaacacatttctgtggccttagccaagcagtttgttagttacatattccctcgcaaacctggagtgcagaccacaggggaagctatctttgccctcccaactcgtctgcagtgcttagcctaacttttgtttatgtcgttatgaagcattcaactgtgctctgtgaggtgtgaaattaaaaacattatgtttcaccaata

SEQ ID NO: 427501 - DNA, 3260 bp, Homo sapiens
  misc_feature (1)..(1): n is a, c, g, or t
  misc_feature (3)..(4): n is a, c, g, or t
  misc_feature (6)..(6): n is a, c, g, or t
  misc_feature (11)..(12): n is a, c, g, or t
  misc_feature (17)..(17): n is a, c, g, or t
ncnntnttctnncttcngtcggatgcctcctccctgtagtgattcctgtgactttgatgaccccaggctgttgaagaacattgaggatcgccatcccacagccccttgcattcaggagttcctcacccttctggccgtgtgccacacggttgttcctgagaaggatggagataacatcatctaccaggcctcttccccagatgaagctgctttggtgaaaggagctaaaaagctgggctttgtcttcacagccagaacaccattctcagtcatcatagaagcgatgggacaggaacaaacatttggaatccttaatgtcctggaattttctagtgacagaaaaagaatgtctgtaattgttcgaactccttcaggacgacttcggctttactgtaaaggggctgataatgtgatttttgagagactttcaaaagactcaaaatatatggaggaaacattatgccatctggaatactttgccacggaaggcttgcggactctctgtgtggcttatgctgatctctctgagaatgagtatgaggagtggctgaaagtctatcaggaagccagcaccatattgaaggacagagctcaacggttggaagagtgttacgagatcattgagaagaatttgctgctacttggagccacagccatagaagatcgccttcaagcaggagttccagaaaccatcgcaacactgttgaaggcagaaattaaaatatgggtgttgacaggagacaaacaagaaactgcgattaatatagggtattcctgccgattggtatcgcagaatatggcccttatcctattgaaggaggactctttggatgccacaagggcagccattactcagcactgcactgaccttgggaatttgctgggcaaggaaaatgacgtggccctcatcatcgatggccacaccctgaagtacgcgctctccttcgaagtccggaggagtttcctggatttggcactctcgtgcaaagcggtcatatgctgcagagtgtctcctctgcagaagtctgagatagtggatgtggtgaagaagcgggtgaaggccatcaccctcgccatcggagacggcgccaacgatgtcgggatgatccagacagcccacgtgggtgtgggaatcagtgggaatgaaggcatgcaggccaccaacaactcggattacgccatcgcacagttttcctacttagagaagcttctgttggttcatggagcctggagctacaaccgggtgaccaagtgcatcttgtactgcttctataagaacgtggtcctgtatattattgagctttggttcgcctttgttaatggattttctgggcagattttatttgaacgttggtgcatcggcctgtacaatgtgattttcaccgctttgccgcccttcactctgggaatctttgagaggtcttgcactcaggagagcatgctcaggtttccccagctctacaaaatcacccagaatggcgaaggcttcaacacaaaggttttctggggtcactgcatcaacgccttggtccactccctcatcctcttctggtttcccatgaaagctctggagcatgatactgtgttgacaagtggtcatgctaccgactatttatttgttggaaatattgtttacacatatgttgttgttactgtttgtctgaaagctggtttggagaccacagcttggactaaattcagtcatctggctgtctggggaagcatgctgacctggctggtgttttttggcatctactcgaccatctggcccaccattcccattgctccagatatgagaggacaggcaactatggtcctgagctccgcacacttctggttgggattatttctggttcctactgcctgtttgattgaagatgtggcatggagagcagccaagcacacctgcaaaaagacattgctggaggaggtgcaggagctggaaaccaagtctcgagtcctgggaaaagcggtgctgcgggatagcaatggaaagaggctgaacgagcgcgaccgcctgatcaagaggctgggccggaagacgcccccgacgctgttccggggcagctccctgcagcagggcgtcccgcatgggtatgctttttctcaagaagaacacggagctgttagtcaggaagaagtcatccgtgcttatgacaccaccaaaaagaaatccaggaagaaataagacatgaattttcctgactgatcttaggaaagagattcagtttgttgcacccagtgttaacacatctttgtcagagaagactggcgtcagcagccaaaacaccaggaaacacatttctgtggccttagccaagcagtttgttagttacatattccctcgcaaacctggagtgcagaccacaggggaagctatctttgccctcccaactcgtctgcagtgcttagcctaacttttgtttatgtcgttatgaagcattcaactgtgctctgtgaggtgtgaaattaaaaacattatgtttcaccaatatttaaacatcagtactagttgtcctgggagaaagggaaaggagttttatgttgcgtgagaggcccatcctgtgtaattggagcagggcacacttgcttcctgttgagttaactcagaggttaagtccaacgggccacatgcagacttcactgtaggcaggttgctctcctgctttgattcctgttttgtgtgtaaaattggcataaacttcttgattgcagtgaaatcacaaaattctctatcggggtggtcaacctgagaacatttatttgaacctcttagccacatttccagcagggcaaaccaactgatgccctggaagagtcttccgcaccctctccaggtgcactcggcccagtcctgccgccgtgtccaggcgcccctcacccccacacctgctgcatggctggccacaccactcagtgcatggcggccgatgggcagccaacccaaacccgcgcctttccttgttccactgcagactcagatacagatgcgaaaaattccttcttccaccgcccttctcgttctgtaaagaaagaagtgttaccgttttcacgtcctattaatgtcctctggttgttaaattacagcagcacattacagtgcactgggttccctcctggagtgaatacaaacggagggcatctacttgtatttttagaagttttgggagaatttagtgatttgtggctttgatcaatcctgttgactggtgtatgtctgcgcaaacctgtttcaaataaatcttttgttaaagtaaaaa

SEQ ID NO: 427502 - DNA, 333 bp, Homo sapiens
ctaggatatgtggtcgtgaaacacgcgcatgtttgacgaccacataaatcagttaaatattgggacactaaccatccaggtcaagaaaagtcacatgccatagccatggtattgcacatcattcatcttgcattctttgagaataagaagatcagtaaatagttcagaagtgggaagctttgtccaggcctgtgtgtgaacccaatgttttgtttagaaatagaacaagtaagttcattgctatagcataacacaaaatttgcataagtggacatgcgcgtgtttgacgaccacatatgtggtcaattttggaatacgtcgtggtgaacatgc

SEQ ID NO: 427503 - DNA, 1852 bp, Homo sapiens
ataaaggatactcaatctgtgtaagttttgaacaaacaaagcagtcatagtgagaagccacagaagcctcctacattaaaaatactccagcataataaaggaaggtaaatgttaaagcgcctgcttgatgaattcagcaagtgatcattcacacaaaaagaaaaccaactgagacgctgtcactagggtttttcaaataggtagagaatcttaaatatccagtaatgatgacaacctcacttactgggagcttactcgtggggctaaggaggatgcgtgatgatcccatttttattgtcacagctaccgaaggaagataccctcatcaacccaattttacaaatggagaaatagaagctcagggaagaatctgaagtagtctcaaaggaagtgacaggaaggatgtggagaaagctgagtgtcaaagtcagtattcaagaccggatttactgctacttagagatgaatgaagaaatcagagggaacgcagtgtgctgatgctaaagcggctgtcaccacccagctgtgtgacataggacatcttctttctctgtctcacttgactaatatgttgtgtcaggggagacatgattgtaattgcctaaagcaattcttgtgatcaagaatcagaagcatgaacagtattgccctctgtgttagcccctttataagggaggaagtcatcttcagcatgctgaattgtcatctttcttagcagtgcaaatgactaaaacttagccaatgtagagtttgtccaaatttggagctcataactcagttcttgagcaaagtgaaaagaaaacattgtgattatggggaaaatatttgtacgggacttatcaaataaagataggaaaagaagaaaactcaaatattataggcagaaatgctaaaggttttaaaatatgtcaggattggaagaaggcatggataaagaacaaagttcagttaggaaagagaaacacagaaggaagagacacaataaaagtcattatgtattctgtgagaagtcagacagtaagatttgtgggaaatgggttggtttgttgtatggtatgtattttagcaataatctttatggcagagaaagctaaaatcctttagcttgcgtgaatgatcacttgctgaattcctcaaggtaggcatgatgaaggagggtttagaggagacacagacacaatgaactgacctagatagaaagccttagtatactcagctaggaatagtgattctgagggcacactgtgacatgattatgtcattacatgtatggtagtgatggggatgatagaaggaagaacttatggcatattttcaccaccacataaatcagttaaatattgggacactaaccatccaggtcaagaaaagtcacatgccatagccatggtattgcacatcattcatcttgcattctttgagaataagaagatcagtaaatagttcagaagtgggaagctttgtccaggcctgtgtgtgaacccaatgttttgtttagaaatagaacaagtaagttcattgctatagcataacacaaaatttgcataagtggtggtcagcaaatccttgaatgctgcttaatgtgagaggttggtaaaatcctttgtgcaacactctaactccctgaatgttttgctgtgctgggacctgtgcatgccagacaaggccaagctggctgaaagagcaaccagccacctctgcaacctgccacctcctgctggcaggatttgtttttgcatcctgtgaagagccaaggaggcaccagggcataagtctactcacttatatctgtttgtctggaacataacccatgtttgtttttacaacaaataaaattgatcttgaataaaaa

SEQ ID NO: 427504 - DNA, 2015 bp, Homo sapiens
gaacgtgaggaacacgagtagttcaagaaaatgctgaagatgcgcttggctgggaagctaggataggctgacgaagtcagacttagtgtgggaacctggctgggaaagggtttcttctgtccataaaagctactccaatggctgtgggagacttaattccaattccaggtgatacagccgtcagtctcccactagctgtaggatggtgtgctgcagttcacagacctaagtcaatgttagtctaccactgtacgtctggtaacctcaatccctgcaaccggagcaaaatgtgattccaggtcttggcaacctctgaaattccaactccatttgcgagagctttgaggaggccatatgctgatttcaccacaagcaacttcacaacccagtactggaatgccatcagccagcaggcccctgccattatctgtgacttctatctgtggctcattggaaggaaacccagctaccgaaggaagataccctcatcaacccaattttacaaatggagaaatagaagctcagggaagaatctgaagtagtctcaaaggaagtgacaggaaggatgtggagaaagctgagtgtcaaagtcagtattcaagaccggatttactgctacttagagatgaatgaagaaatcagagggaacgcagtgtgctgatgctaaagcggctgtcaccacccagctgtgtgacataggacatcttctttctctgtctcacttgactaatatgttgtgtcaggggagacatgattgtaattgcctaaagcaattcttgtgatcaagaatcagaagcatgaacagtattgccctctgtgttagcccctttataagggaggaagtcatcttcagcatgctgaattgtcatctttcttagcagtgcaaatgactaaaacttagccaatgtagagtttgtccaaatttggagctcataactcagttcttgagcaaagtgaaaagaaaacattgtgattatggggaaaatatttgtacgggacttatcaaataaagataggaaaagaagaaaactcaaatattataggcagaaatgctaaaggttttaaaatatgtcaggattggaagaaggcatggataaagaacaaagttcagttaggaaagagaaacacagaaggaagagacacaataaaagtcattatgtattctgtgagaagtcagacagtaagatttgtgggaaatgggttggtttgttgtatggtatgtattttagcaataatctttatggcagagaaagctaaaatcctttagcttgcgtgaatgatcacttgctgaattcctcaaggtaggcatgatgaaggagggtttagaggagacacagacacaatgaactgacctagatagaaagccttagtatactcagctaggaatagtgattctgagggcacactgtgacatgattatgtcattacatgtatggtagtgatggggatgatagaaggaagaacttatggcatattttcaccaccacataaatcagttaaatattgggacactaaccatccaggtcaagaaaagtcacatgccatagccatggtattgcacatcattcatcttgcattctttgagaataagaagatcagtaaatagttcagaagtgggaagctttgtccaggcctgtgtgtgaacccaatgttttgtttagaaatagaacaagtaagttcattgctatagcataacacaaaatttgcataagtggtggtcagcaaatccttgaatgctgcttaatgtgagaggttggtaaaatcctttgtgcaacactctaactccctgaatgttttgctgtgctgggacctgtgcatgccagacaaggccaagctggctgaaagagcaaccagccacctctgcaacctgccacctcctgctggcaggatttgtttttgcatcctgtgaagagccaaggaggcaccagggcataagtctactcacttatatctgtttgtctggaacataacccatgtttgtttttacaacaaataaaattgatcttgaataaaaa

SEQ ID NO: 427505 - DNA, 571 bp, Homo sapiens
ctaggatatgtggtcgtgaaacacgcgcatgtttgacgaccacataaatcagttaaatattgggacactaaccatccaggtcaagaaaagtcacatgccatagccatggtattgcacatcattcatcttgcattctttgagaataagaagatcagtaaatagttcagaagtgggaagctttgtccaggcctgtgtgtgaacccaatgttttgtttagaaatagaacaagtaagttcattgctatagcataacacaaaatttgcataagtggtggtcagcaaatccttgaatgctgcttaatgtgagaggttggtaaaatcctttgtgcaacactctaactccctgaatgttttgctgtgctgggacctgtgcatgccagacaaggccaagctggctgaaagagcaaccagccacctctgcaacctgccacctcctgctggcaggatttgtttttgcatcctgtgaagagccaaggaggcaccagggcataagtctactcacttatatctgtttgtctggaacataacccatgtttgtttttacaacaaataaaattgatcttgaataaaaa

SEQ ID NO: 427506 - DNA, 1625 bp, Homo sapiens
  misc_feature (1564)..(1564): n is a, c, g, or t
  misc_feature (1567)..(1567): n is a, c, g, or t
  misc_feature (1570)..(1570): n is a, c, g, or t
  misc_feature (1573)..(1573): n is a, c, g, or t
  misc_feature (1575)..(1575): n is a, c, g, or t
  misc_feature (1588)..(1588): n is a, c, g, or t
ataaaggatactcaatctgtgtaagttttgaacaaacaaagcagtcatagtgagaagccacagaagcctcctacattaaaaatactccagcataataaaggaaggtaaatgttaaagcgcctgcttgatgaattcagcaagtgatcattcacacaaaaagaaaaccaactgagacgctgtcactagggtttttcaaataggtagagaatcttaaatatccagtaatgatgacaacctcacttactgggagcttactcgtggggctaaggaggatgcgtgatgatcccatttttattgtcacagctaccgaaggaagataccctcatcaacccaattttacaaatggagaaatagaagctcagggaagaatctgaagtagtctcaaaggaagtgacaggaaggatgtggagaaagctgagtgtcaaagtcagtattcaagaccggatttactgctacttagagatgaatgaagaaatcagagggaacgcagtgtgctgatgctaaagcggctgtcaccacccagctgtgtgacataggacatcttctttctctgtctcacttgactaatatgttgtgtcaggggagacatgattgtaattgcctaaagcaattcttgtgatcaagaatcagaagcatgaacagtattgccctctgtgttagcccctttataagggaggaagtcatcttcagcatgctgaattgtcatctttcttagcagtgcaaatgactaaaacttagccaatgtagagtttgtccaaatttggagctcataactcagttcttgagcaaagtgaaaagaaaacattgtgattatggggaaaatatttgtacgggacttatcaaataaagataggaaaagaagaaaactcaaatattataggcagaaatgctaaaggttttaaaatatgtcaggattggaagaaggcatggataaagaacaaagttcagttaggaaagagaaacacagaaggaagagacacaataaaagtcattatgtattctgtgagaagtcagacagtaagatttgtgggaaatgggttggtttgttgtatggtatgtattttagcaataatctttatggcagagaaagctaaaatcctttagcttgcgtgaatgatcacttgctgaattcctcaaggtaggcatgatgaaggagggtttagaggagacacagacacaatgaactgacctagatagaaagccttagtatactcagctaggaatagtgattctgagggcacactgtgacatgattatgtcattacatgtatggtagtgatggggatgatagaaggaagaacttatggcatattttcaccaccacataaatcagttaaatattgggacactaaccatccaggtcaagaaaagtcacatgccatagccatggtattgcacatcattcatcttgcattctttgagaataagaagatcagtaaatagttcagaagtgggaagctttgtccaggcctgtgtgtgaacccaatgttttgtttagaaatagaacaagtaagttcattgctatagcataacacaaaatttgcataagtgggcatgcttcacnacnacntangnggtggtcaaacangcgcatgcttgaccaccacatatgtcgtcgtcaaaca

SEQ ID NO: 427507 - DNA, 1564 bp, Homo sapiens
  misc_feature (1503)..(1503): n is a, c, g, or t
  misc_feature (1506)..(1506): n is a, c, g, or t
  misc_feature (1509)..(1509): n is a, c, g, or t
  misc_feature (1512)..(1512): n is a, c, g, or t
  misc_feature (1514)..(1514): n is a, c, g, or t
  misc_feature (1527)..(1527): n is a, c, g, or t
ataaaggatactcaatctgtgtaagttttgaacaaacaaagcagtcatagtgagaagccacagaagcctcctacattaaaaatactccagcataataaaggaaggtaaatgttaaagcgcctgcttgatgaattcagcaagtgatcattcacacaaaaagaaaaccaactgagacgctgtcactagggtttttcaaataggtagagaatcttaaatatccagtaatgatgacaacctcacttactgggagcttactcgtggggctaaggaggatgcgtgatgatcccatttttattgtcacagctaccgaaggaagataccctcatcaacccaattttacaaatggagaaatagaagctcagggaagaatctgaagtagtctcaaaggaagtgacaggaaggatgtggagaaagctgagtgtcaaagtcagtattcaagaccggatttactgctacttagagatgaatgaagaaatcagagggaacgcagtgtgctgatgctaaagcggctgtcaccacccagctgtgtgacataggacatcttctttctctgtctcacttgactaatatgttgtgtcaggggagacatgattgtaattgcctaaagcaattcttgtgatcaagaatcagaagcatgaacagtattgccctctgtgttagcccctttataagggaggaagtcatcttcagcatgctgaattgtcatctttcttagcagtgcaaatgactaaaacttagccaatgtagagtttgtccaaatttggagctcataactcagttcttgagcaaagtgaaaagaaaacattgtgattatggggaaaatatttgtacgggacttatcaaataaagataggaaaagaagaaaactcaaatattataggcagaaatgctaaaggttttaaaatatgtcaggattggaagaaggcatggataaagaacaaagttcagttaggaaagagaaacacagaaggaagagacacaataaaagtcattatgtattctgtgagaagtcagacagtaagatttgtgggaaatgggttggtttgttgtatggtatgtattttagcaataatctttatggcagagaaagctaaaatcctttagcttgcgtgaatgatcacttgctgaattcctcaaggtaggcatgatgaaggagggtttagaggagacacagacacaatgaactgacctagatagaaagccttagtatactcagctaggaatagtgattctgagggcacactgtgacatgattatgtcattacatgtatggtagtgatggggatgatagaaggaagaacttatggcatattttcaccaccacataaatcagttaaatattgggacactaaccatccaggtcaagaaaagtcacatgccatagccatggtattgcacatcattcatcttgcattctttgagaataagaagatcagtaaatagttcagaagtgggaagctttgtccaggcctgtgtgtgaacccaatgtttgcatgcttcacnacnacntangnggtggtcaaacangcgcatgcttgaccaccacatatgtcgtcgtcaaaca

SEQ ID NO: 427508 - DNA, 817 bp, Homo sapiens
gaacgtgaggaacacgagtagttcaagaaaatgctgaagatgcgcttggctgggaagctaggataggctgacgaagtcagacttagtgtgggaacctggctgggaaagggtttcttctgtccataaaagctactccaatggctgtgggagacttaattccaattccaggtgatacagccgtcagtctcccactagctgtaggatggtgtgctgcagttcacagacctaagtcaatgttagtctaccactgtacgtctggtaacctcaatccctgcaaccggagcaaaatgtgattccaggtcttggcaacctctgaaattccaactccatttgcgagagctttgaggaggccatatgctgatttcaccacaagcaacttcacaacccagtactggaatgccatcagccagcaggcccctgccattatctgtgacttctatctgtggctcattggaaggaaacccagtttttcacaaaatctgaggagctgatacggaaagcacaccagatctcatgtgttgaaatgtgaacatgctcaccacagaccaaggacattcaacctgtcaatccccaggatttccaagccaggagtttcatctcttacttgtggaaaatttgtccatttaattgtgaaccaatcagcttttcattgtgtcaaaatcaaatctggatagtgaaatatatattttatctttattgttatcttaaatatatcttggcttaaagagacataagtagctcttccccactacaccagataatgagttgcaaataaatcattcagtagtaaagttcaaagaaagcttgaaagcaaaaa

SEQ ID NO: 427509 - DNA, 658 bp, Homo sapiens
gaacgtgaggaacacgagtagttcaagaaaatgctgaagatgcgcttggctgggaagctaggataggctgacgaagtcagacttagtgtgggaacctggctgggaaagggtttcttctgtccataaaagctactccaatggctgtgggagacttaattccaattccaggtgatacagccgtcagtctcccactagctgtaggatggtgtgctgcagttcacagacctaagtcaatgttagtctaccactgtacgtctggtaacctcaatccctgcaaccggagcaaaatgtgattccaggtcttggcaacctctgaaattccaactccatttgcgagagctttgaggaggccatatgctgatttcaccacaagcaacttcacaacccagtactggaatgccatcagccagcaggcccctgccattatctgtgacttctatctgtggctcattggaaggaaacccagacaaggccaagctggctgaaagagcaaccagccacctctgcaacctgccacctcctgctggcaggatttgtttttgcatcctgtgaagagccaaggaggcaccagggcataagtctactcacttatatctgtttgtctggaacataacccatgtttgtttttacaacaaataaaattgatcttgaataaaaa

SEQ ID NO: 427510 - DNA, 765 bp, Homo sapiens
gaacgtgaggaacacgagtagttcaagaaaatgctgaagatgcgcttggctgggaagctaggataggctgacgaagtcagacttagtgtgggaacctggctgggaaagggtttcttctgtccataaaagctactccaatggctgtgggagacttaattccaattccaggtgatacagccgtcagtctcccactagctgtaggatggtgtgctgcagttcacagacctaagtcaatgttagtctaccactgtacgtctggtaacctcaatccctgcaaccggagcaaaatgtgattccaggtcttggcaacctctgaaattccaactccatttgcgagagctttgaggaggccatatgctgatttcaccacaagcaacttcacaacccagtactggaatgccatcagccagcaggcccctgccattatctgtgacttctatctgtggctcattggaaggaaacccagctaccgaaggaagataccctcatcaacccaattttacaaatggagaaatagaagctcagggaagaatctgaagtagtctcaaaggaagtgacaggaaggatgtggagaaagctgagtgtcaaagtcagtattcaagaccggatttactgctacttagagatgaatgaagaaatcagagggaacgcagtgtgctgatgctaaagaaaaagaagatgtgaaatcttgtgctgagtgggtgtctctctctaaggccaggaattgtagaatatgagaaagagatggagaagatgaagacttta

SEQ ID NO: 427511 - DNA, 651 bp, Homo sapiens
gaacgtgaggaacacgagtagttcaagaaaatgctgaagatgcgcttggctgggaagctaggataggctgacgaagtcagacttagtgtgggaacctggctgggaaagggtttcttctgtccataaaagctactccaatggctgtgggagacttaattccaattccaggtgatacagccgtcagtctcccactagctgtaggatggtgtgctgcagttcacaggtgtggatgctcaagtgggctttcaaagatgccattatctgtgacttctatctgtggctcattggaaggaaacccagtttttcacaaaatctgaggagctgatacggaaagcacaccagatctcatgtgttgaaatgtgaacatgctcaccacagaccaaggacattcaacctgtcaatccccaggatttccaagccaggagtttcatctcttacttgtggaaaatttgtccatttaattgtgaaccaatcagcttttcattgtgtcaaaatcaaatctggatagtgaaatatatattttatctttattgttatcttaaatatatcttggcttaaagagacataagtagctcttccccactacaccagataatgagttgcaaataaatcattcagtagtaaagttcaaagaaagcttgaaagcaaaaa

SEQ ID NO: 427512 - DNA, 681 bp, Homo sapiens
gaacgtgaggaacacgagtagttcaagaaaatgctgaagatgcgcttggctgggaagctaggataggctgacgaagtcagacttagtgtgggaacctggctgggaaagggtttcttctgtccataaaagctactccaatggctgtgggagacttaattccaattccaggtgatacagccgtcagtctcccactagctgtaggatggtgtgctgcagttcacagacctaagtcaatgttagtctaccactgtacgtctggtaacctcaatccctgcaaccggagcaaaatgtgattccaggtcttggcaacctctgaaattccaactccatttgcgagagctttgaggaggccatatgctgatttcaccacaagcaacttcacaacccagtactggaatgccatcagccagcaggcccctgccattatctgtgacttctatctgtggctcattggaaggaaacccagacaaggccaagctggctgaaagagcaaccagccacctctgcaacctgccacctcctgctggcaggatttgtttttgcatcctgtgaagagccaaggaggcaccagggcataagtctactcacttatatctgtttgtctggaacataacccatgtttgtttttacaacaaataaaattgatcttgaataaaaaacaaaaaaaacaaaagtcgacgc

SEQ ID NO: 427513 - DNA, 897 bp, Homo sapiens
gaacgtgaggaacacgagtagttcaagaaaatgctgaagatgcgcttggctgggaagctaggataggctgacgaagtcagacttagtgtgggaacctggctgggaaagggtttcttctgtccataaaagctactccaatggctgtgggagacttaattccaattccaggtgatacagccgtcagtctcccactagctgtaggatggtgtgctgcagttcacagacctaagtcaatgttagtctaccactgtacgtctggtaacctcaatccctgcaaccggagcaaaatgtcatctaccacagtgcctggcaagtgttaaatgctgaataaatatatttgaaatgactaaaggaaggattgatacagatttaggaaaaggaaagattccaggtcttggcaacctctgaaattccaactccatttgcgagagctttgaggaggccatatgctgatttcaccacaagcaacttcacaacccagtactggaatgccatcagccagcaggcccctgccattatctgtgacttctatctgtggctcattggaaggaaacccaggtgagaagctgagtcaatggccttgagaatgtcactgcatatgggagattgaggccccaaagtctttagggcttccttcagccaaagattaaaggagacaactgaatctgacccatatatacagattgaacacacctactctgaaaatccaaaatctgaaattctccaaaatccaaaaagttttgagtgctgacatgatgccacaagtggaaaattccacacatcttacctcatgtgatgggtcacagtcaaaacacattcaaaactttgtttcatgcataaaattatttaaaatattgtataagattaccttcaggttatgtgtatgtggctaagtgt

SEQ ID NO: 427514 - DNA, 1519 bp, Homo sapiens
ggctgcgtggttgccaggaaaccgcgaagccgcggtccctgcctctgagtctctctcgaccatggccaaattcgtcatcgcgggtagagcagattgtccatattatgctaaaacagaacttgtggcagactatttacaaaagaatcttcctgattttcggatacataaaatcacacaacgtcctgaggtttgggaggattggctaaaagatgtgtgtgaaaagaataagtggagtcacaagaattcccctatcatctggagagagctgttggatcgtggaggaaagggtttgcttttgggaggatataatgagttcctggagcatgctcagctttactatgatgtcacctctagcatgacgactgaactgatgatggtaattgctcaagagaacctgggggcacatatagaaaaagagcaggaggaagaagccctgaaaacttgcatcaaccccttgcaggtctggatcaccagtgcctctgctcctgcctgctacaacctaattcccatattgacgagtggcgaagtgtttgggatgcatacagaaattagcataactctatttgacaacaagcaggcggaagaacatctcaaaagccttgtggtggagacccaagacctggcatctcccgtcctgcgcagtgtctccatctgcacgaaggtggaggaggccttccgccaggcccacgtcattgtggtgctggatgacagcaccaacaaggaggtgttcactctggaggactgcctccgaagcagggtgcctctctgcaggctctatgggtacctgatagagaaaaatgctcatgagtctgtcagagtcatcgtgggagggagaacctttgtaaacctgaagacagttttactcatgagatatgccccacgcattgcacacaacattattgctgtggcgctgggggtggaaggtgaagcgaaagccatactggccagaaaactgaagacagctccttcatgtgagtgaatgtctctttatgtttttgtttttattttgaaacaacatgatttcaaagcagctaggaagaacactgtcccctctaggaacattctgagtatctggaataggaagtataaaacagacataaagaacttattgtgtgatttgactactgtgcaaacatttttttttactggcttttgtgtctggctttttccatcattataaaaatcaataaatatttaataagatacaatttatattattcaggtgataatgtgacacatcgtattccatttttcccatggtaatagtcaattaagataaccagtgttttaaaaaaaatcaaaactatgtgcaagtggctctgccctacttcccacccgtatgatcttgagccgtcatttagtctttcagtgcgtcagtttcctcatctgtaaaatgaggacgttaacagtgcctatctcctagaattgatgtggggattcaatgagatgtattcctaaagtgctaagaagagtgtatggcacataataaacatttctaaggatgttaaacttatcaata

SEQ ID NO: 427515 - DNA, 1707 bp, Homo sapiens
ggctgcgtggttgccaggaaaccgcgaagccgcggtccctgcctctgagtctctctcgaccatggccaaattcgtcatcgcgggtagagcagattgtccatattatgctaaaacagaacttgtggcagactatttacaaaagaatcttcctgattttcggatacataaaatcacacaacgtcctgaggtttgggaggattggctaaaagatgtgtgtgaaaagaataagtggagtcacaagaattcccctatcatctggagagagctgttggatcgtggaggaaagggtttgcttttgggaggatataatgagttcctggagcatgctcagctttactatgatgtcacctctagcatgacgactgaactgatgatggtaattgctcaagagaacctgggggcacatatagaaaaagagcaggaggaagaagccctgaaaacttgcatcaaccccttgcaggtctggatcaccagtgagtgggtaaaaagagaatttgtggcaattcttaaaaacttgaccaccacaggaagacaatttggaggcattttggctgcacacagtatagccactacactgaaatactggtaccatggctcaccacctggggagattgtatctttaggaatattgagtgaaggccagtttggtattccgaaagggatcgtcttttctatgcctgtgaaatttgagaatggaacttgggtggttcttacagatctcaaagatgttgaaataagtgaacaaataatgacccgaatgacaagtgatctaattcaggagaaacttgttgcacttggagacaagatacattttcagccataccaatcaggacataaagatctggtccctgatgaagaaaaaaatctagctatgtcagatgcagcagagtttccaaatcagattcctcaaaccacctttgaaaagccacagagtcttgagttcctaaatgaatttgaaggcaaaaccgtggaatcctaacagatcaaattggatgaaatatataattacttgatagcacaataaacatagaaagaatttatatgaatgtctatatttaaggaagaataatttgaaagatttatgtcagtcttagataataccatgcaaggcaattaaatcactgtgacagcacagaggtcagagttccgtcattttgcattacttgtatccactcatgtttgtttcataataattgcattttcttagaactattttggtgtcaaatgctattttttatattacattaaaatagagttgtcagtcattgcatctgcccatacatcttctgagagaacctgcttccttccatcagccatacctaagacctgcacctaagtggccatgtttgctcaaatgtcctcatcaccttggcctcaactaattaggccaaacagatgtacttcactcaaggagaaccaatcatattttctctctgtctctcaaaaaaaaattgaactgagaccagtgagtaagttggtgtctgggtcaggttaatggtggtgaactatgtgcctgtgagctcttcagagctggttgggttcaccaccttcataagacctgcctctgtaccatttttccttgagtgtgctttgtataaaggtctgtacaataaatcacacttttttaaagcttagattgaataggtttctgctccttgacaagagatatggcctgaataaaatgaattttgaaagaaaagcctaata

SEQ ID NO: 427516 - DNA, 1332 bp, Homo sapiens
ttacgttgatctgagaaaaacaagggtgtacagatatgagagtgccatttggggacctcttcattattcacgccctgttttaaacttgatttttgacagtgagtgggtaaaaagagaatttgtggcaattcttaaaaacttgaccaccacaggaagacaatttggaggcattttggctgcacacagtatagccactacactgaaatactggtaccatggctcaccacctggggagattgtatctttaggaatattgagtgaaggccagtttggtattccgaaagggatcgtcttttctatgcctgtgaaatttgagaatggaacttgggtggttcttacagatctcaaagatgttgaaataagtgaacaaataatgacccgaatgacaagtgatctaattcaggagaaacttgttgcacttggagacaagatacattttcagccataccaatcaggacataaagatctggtccctgatgaagaaaaaaatctagctatgtcagatgcagcagagtttccaaatcagattcctcaaaccacctttgaaaagccacagagtcttgagttcctaaatgaatttgaaggcaaaaccgtggaatcctaacagatcaaattggatgaaatatataattacttgatagcacaataaacatagaaagaatttatatgaatgtctatatttaaggaagaataatttgaaagatttatgtcagtcttagataataccatgcaaggcaattaaatcactgtgacagcacagaggtcagagttccgtcattttgcattacttgtatccactcatgtttgtttcataataattgcattttcttagaactattttggtgtcaaatgctattttttatattacattaaaatagagttgtcagtcattgcatctgcccatacatcttctgagagaacctgcttccttccatcagccatacctaagacctgcacctaagtggccatgtttgctcaaatgtcctcatcaccttggcctcaactaattaggccaaacagatgtacttcactcaaggagaaccaatcatattttctctctgtctctcaaaaaaaaattgaactgagaccagtgagtaagttggtgtctgggtcaggttaatggtggtgaactatgtgcctgtgagctcttcagagctggttgggttcaccaccttcataagacctgcctctgtaccatttttccttgagtgtgctttgtataaaggtctgtacaataaatcacacttttttaaagcttagattgaataggtttctgctccttgacaagagatatggcctgaataaaatgaattttgaaagaaaagcctaata

SEQ ID NO: 427517 - DNA, 1157 bp, Homo sapiens
agacacacccaggatcaatactttgcatccttcaatccaatcaagttggcactcggtattaaccatcacaattagaaaaagataagtattatttcatgtatttttttgtttcattaatatgtacacaaatgtacacattggactataatgtaaaatgtgtcttttattgtgggtcatagtcactgaagtttgaaaaacattgactcagaacatctcatgacctagttaggttgttggttatattctaaatccagcatgttttatttaattttgatttcaggacataaagatctggtccctgatgaagaaaaaaatctagctatgtcagatgcagcagagtttccaaatcagattcctcaaaccacctttgaaaagccacagagtcttgagttcctaaatgaatttgaaggcaaaaccgtggaatcctaacagatcaaattggatgaaatatataattacttgatagcacaataaacatagaaagaatttatatgaatgtctatatttaaggaagaataatttgaaagatttatgtcagtcttagataataccatgcaaggcaattaaatcactgtgacagcacagaggtcagagttccgtcattttgcattacttgtatccactcatgtttgtttcataataattgcattttcttagaactattttggtgtcaaatgctattttttatattacattaaaatagagttgtcagtcattgcatctgcccatacatcttctgagagaacctgcttccttccatcagccatacctaagacctgcacctaagtggccatgtttgctcaaatgtcctcatcaccttggcctcaactaattaggccaaacagatgtacttcactcaaggagaaccaatcatattttctctctgtctctcaaaaaaaaattgaactgagaccagtgagtaagttggtgtctgggtcaggttaatggtggtgaactatgtgcctgtgagctcttcagagctggttgggttcaccaccttcataagacctgcctctgtaccatttttccttgagtgtgctttgtataaaggtctgtacaataaatcacacttttttaaagcttagattgaataggtttctgctccttgacaagagatatggcctgaataaaatgaattttgaaagaaaagcctaata

SEQ ID NO: 427518 - DNA, 979 bp, Homo sapiens
ggctgcgtggttgccaggaaaccgcgaagccgcggtccctgcctctgagtctctctcgaccatggccaaattcgtcatcgcgggtagagcagattgtccatattatgctaaaacagaacttgtggcagactatttacaaaagaatcttcctgattttcggatacataaaatcacacaacgtcctgaggtttgggaggattggctaaaagatgtgtgtgaaaagaataagtggagtcacaagaattcccctatcatctggagagagctgttggatcgtggaggaaagggtttgcttttgggaggatataatgagttcctggagcatgctcagctttactatgatgtcacctctagcatgacgactgaactgatgatggtaattgctcaagagaacctgggggcacatatagaaaaagagcaggaggaagaagccctgaaaacttgcatcaaccccttgcaggtctggatcaccagtgagtgggtaaaaagagaatttgtggcaattcttaaaaacttgaccaccacaggaagacaatttggaggcattttggctgcacacagtatagccactacactgaaatactggtaccatggctcaccacctggggagattgtatctttaggaatattgagtgaaggccagtttggtattccgaaagggatcgtcttttctatgcctgtgaaatttgagaatggaacttgggtggttcttacagatctcaaagatgttgaaataagtgaacaaataatgacccgaatgacaagtgatctaattcaggagaaacttgttgcacttggagacaagatacattttcagccataccaatcaggacataaagatctggtccctgatgaagaaaaaaatctagctatgtcagatgcagcagagtttccaaatcagattcctcaaaccacctttgaaaagccacagagtcttgagttcctaaatggtaggtggtagacaaaacattaactagta

SEQ ID NO: 427519 - DNA, 1341 bp, Homo sapiens
tgggatatcattcaacaggattggctaaaagatgtgtgtgaaaagaataagtggagtcacaagaattcccctatcatctggagagagctgttggatcgtggaggaaagggtttgcttttgggaggatataatgagttcctggagcatgctcagctttactatgatgtcacctctagcatgacgactgaactgatgatggtaattgctcaagagaacctgggggcacatatagaaaaagagcaggaggaagaagccctgaaaacttgcatcaaccccttgcaggtctggatcaccagtgcctctgctcctgcctgctacaacctaattcccatattgacgagtggcgaagtgtttgggatgcatacagaaattagcataactctatttgacaacaagcaggcggaagaacatctcaaaagccttgtggtggagacccaagacctggcatctcccgtcctgcgcagtgtctccatctgcacgaaggtggaggaggccttccgccaggcccacgtcattgtggtgctggatgacagcaccaacaaggaggtgttcactctggaggactgcctccgaagcagggtgcctctctgcaggctctatgggtacctgatagagaaaaatgctcatgagtctgtcagagtcatcgtgggagggagaacctttgtaaacctgaagacagttttactcatgagatatgccccacgcattgcacacaacattattgctgtggcgctgggggtggaaggtgaagcgaaagccatactggccagaaaactgaagacagctccttcatgtgagtgaatgtctctttatgtttttgtttttattttgaaacaacatgatttcaaagcagctaggaagaacactgtcccctctaggaacattctgagtatctggaataggaagtataaaacagacataaagaacttattgtgtgatttgactactgtgcaaacatttttttttactggcttttgtgtctggctttttccatcattataaaaatcaataaatatttaataagatacaatttatattattcaggtgataatgtgacacatcgtattccatttttcccatggtaatagtcaattaagataaccagtgttttaaaaaaaatcaaaactatgtgcaagtggctctgccctacttcccacccgtatgatcttgagccgtcatttagtctttcagtgcgtcagtttcctcatctgtaaaatgaggacgttaacagtgcctatctcctagaattgatgtggggattcaatgagatgtattcctaaagtgctaagaagagtgtatggcacataataaacatttctaaggatgttaaacttatcaata

SEQ ID NO: 427520 - DNA, 1569 bp, Homo sapiens
ggctgcgtggttgccaggaaaccgcgaagccgcggtccctgcctctgagtctctctcgaccatggccaaattcgtcatcgcgggtagagcagattgtccatattatgctaaaacagaacttgtggcagactatttacaaaagaatcttcctgattttcggatacataaaatcacacaacgtcctgaggtttgggaggattggctaaaagatgtgtgtgaaaagaataagtggagtcacaagaattcccctatcatctggagagagctgttggatcgtggaggaaagggtttgcttttgggaggatataatgagttcctggagcatgctcagctttactatgatgtcacctctagcatgacgactgaactgatgatggtaattgctcaagagaacctgggggcacatatagaaaaagagcaggaggaagaagccctgaaaacttgcatcaaccccttgcaggtctggatcaccagtgagtgggtaaaaagagaatttgtggcaattcttaaaaacttgaccaccacaggaagacaatttggaggcattttggctgcacacagtatagccactacactgaaatactggtaccatggctcaccacctggggagattgtatctttaggaatattgagtgaaggccagtttggtattccgaaagggatcgtcttttctatgcctgtgaaatttgagaatggaacttgggtggttcttacagatctcaaagatgttgaaataagtgaacaaataatgacccgaatgacaagtgatctaattcaggagaaacttgttgcacttggagacaagatacattttcagccataccaatcaggacataaagatctggtccctgatgaagaaaaaaatctagctatgtcagatgcagcagagtttccaaatcagattcctcaaaccacctttgaaaagccacagagtcttgagttcctaaatgaatttgaaggcaaaaccgtggaatcctaacagatcaaattggatgaaatatataattacttgatagcacaataaacatagaaagaataaaaaaaaaaaaaaaaaaaaaaaaaaaaaaaaaaaaaaaaaaaaaaaaaaaaaaaaaaaaaaaaaaaaaaaaaaaaaaagaagaaagaaagagaaaacagagaaaccacgaagacacacaagagacacacacagcaaaaacgagagcaaaccaacaagaaagagagggagggacgacgcggcgaacagtacagggacgacgacggaagggacacagcgcgggcagaggcaccacacggaggcagcagcacagcgaacgcagcacaaagggaggtatagaggacgcacgagcgcggggcggagagaaggaagagaggatagacgtgcgcacagcgcgagaaagagtgcgctggcaggggaggctggaaaggatgaaacacaaaccaagcaacatacaggataaacgagagaacgcgaaacgagggaagaacgaaacgaaagaagaaataaggaggggaggcgtaggacgaaggggcgacgagagcaaggggggagcggggaagcgccggaagagaggagagaggagcaaataa

SEQ ID NO: 427521 - DNA, 1723 bp, Homo sapiens
aaggctcttttcttggttgtaccctgaatcctagagataggaattggtccttctcacctgcttcttgaccccttccctgcatgctgatggtgctttggatccctgttctttctggctcaaagattttgcttcccactgctttttccagggttctagccctgggaatgatgattggcgctttcttgctaatataatgacatgagccaccagattgctgggttttaaatacattagtaggctattgtaacaagcaagtttggggcttgctttttccctcgaaagatcttattaagggatgggatccttgctgcagattagtagcagaaagattatttctcaggggatgagaggctggataactgtagtaatgctcttgctgtttcctacagctcctacccagagattctacccagtgaaactcccacagcaacgcaggtagatggggctgacctggcctctccaatgtctcctcgaactagcaaaagccgcatgtccatgaagctgcgtcgttcctctggctcagccaataaatcctaaggagacaagcagcccagcagtgatcagcagtagccaccttagcacgaacatagggttaaccctttcaggccttcatgtctgccataacatgcatgtttcttcctgtacatttatttgagaaaacactggatttaaataattttaaataatttgtagcttaatattaaagatttaagttatttattgtttcattttttttcccacaatccaagctgccatattttgagggcagggggagttttattctacaccctttaccttcctagataattatgtctaagtagttttatctttaatttcatggttaactgtgagccaaaatacaattggacaattagtctcattatttattgtgccccattgcaactttatggttcaataaatatataattttttacaaatgtaaaattttacatttaagcatttgtaaagttacagcaaaagatgtacctgttaatacacagaatgtgtacagattatttgttatgacaataaaacactcaaaataaatggtctttagcatctcaaattccaactgaaatcattttagtattaactcttcttcccaaagcaatgtctcatttcttggctgtgcaggtgatgccatgttatatccaataactagaaaaatcactgtgctgaacttttatgtttagcttccaagtatttttctaatgttttgcatttcaagtggtatcactgttaaatgccatttgttttcagattgtggccttttattattggctgctagatcctggtgtttctatgttcttttttaagcaccaaaaagaagatggggaagaaaagaaggaaaattttctgatataaatatgttgttcaaattatgagtattatttaaaaaagaaaaaggaacataacccaggagtctaagttaaatctaatattgttaatactgaacttgcaggtccaggttggtatacattccaccctctagaagtattttcttacagtagataagctgctcacattttgttttgaatgggcatctcctgaggaaatgtagcatgacattggtactaactgcatgtgtaaatacatcatactggcaaaccgtaaaatataaattatgtatcatcattcatgtagtatctataatttgtaacagtgggggggaaagatgacatggtatttaataatacaataaaaatattcttatcacttccta

SEQ ID NO: 427522 - DNA, 1054 bp, Homo sapiens
gaaattgcttttaaagatataatattttatagggctatatctgcccaataattagcagctttaaaccagtcatacctgtcaccaaacagtacaaacgaaaccacaataaaaaatgatcttttgagctccctcttataatccctatatatcccaaaagtcatatccattatgttaattgtaataatagtttattgtaatcaatgtgcaatatatgaatcaatttatcccatcagattacacagtctgtgtgagcactgtaagaatgttagtaacagatacggtatgcacaaacataggagctcatgtgtacttttaaaacctcatccttgaggatatattaataatagaaataaatcagcattctttatgactcaagtagtataaatcaataggtagagtaggatgtgaaatgaaatgtaggttgttactacattttttacatctaaaattgaggtctttctactgtaaattatttatagagtttgggaatgttgaatatataccacaaatgtaatttgctaaattgttaggaagtactgataactatacaccacacacactaaaaatccttatttgactctgttgagtgaagggagatttcactttaaaggcagtgaggaagacatggaagaattgtttttgaggaaaatattatttgagtttgccataatgtagagcaatgctctctgataaagccctccttctatggtgatggaaatgttctatatctgcactgtctaatgtggaagccgctaactacatgtggctgttgaacaattgaaatgtggctagtgtactgaggaactgaatttttatttaattcattttaattcaataaatttaaacttaatgtggctgtggctaccacattggacaatgcagctctagagattttatgtctgagtgattaggataacatgccaacagtacagtgaacactttaaaaggtagatatttacagaatctctcatagaccttttttcttcttttcttttttcctatttgaacttgttttgttagttggtaagtataacatttgaatttacaaagcatt

SEQ ID NO: 427523 - DNA, 3275 bp, Homo sapiens
atcatggccttacctctaaagacactgctccaaccatttcatgctacgggagcagaaagcgataaaacagaaaaatctgttctcaattgcatttataaggttttacatgggtgtgtttatggagctcagtgttttagcaatccaaggtattttcccatgagcctctctgatttggcatctgtagattatgatccttttatgcatttggaaagtctgaaagagcctgagcctctgcactctcctgactcagaacgatcttctaaactccagccagtaacagaagtgaaaactcaaatgcagcatggattaatctctatagcagcccgcactgttattacacatctggtaaatcacctgggccattatccaatgagcggtggtcctgctatgctaacaagtcaggtgtgtgaaaatcacgacaatcattacagtgaaagtactgaactttctcctgaactctttgagagtccaaatatccagttctttgtgttaaataatacaaccttagtgtcctgtatccagatcagatcagaagagaatatgcctggaggaggtttatctgctggccttgcatcagccaattcaaatgtcagaatcatagtacgtgatctctctggaaaatattcatgggattctgctatactgtatggcccacctcctgtaagtggcttgtcagaacctacatctttcatgctttcattgtctcaccaagagaagccagaagagcctccgacatctaatgaatgcttagaagatataaccgtaaaagatggactttctctccagtttaaaagatttagagaaactgtaccaacttgggatacaataagagatgaagaagatgttcttgatgagctcttgcagtatttgggtgttactagtcctgaatgcttacagagaactggaatctcacttaatattcctgctccacaacctgtgtgcatttctgaaaaacaagaaaatgatgttattaatgctatccttaagcaacatacagaagaaaaagaatttgttgagaagcactttaatgacttaaacatgaaagctgtggaacaagatgaaccaatacctcaaaaacctcagtcagcattttattattgcagattgcttcttagtatattgggaatgaattcctgggacaaacggaggagctttcatctcctgaagaaaaatgaaaagctacttagagaacttaggaacttggattcaaggcagtgccgagagacacacaagattgcagtattttatgttgctgaaggacaagaagacaaacactccattctcaccaatacaggaggaagtcaagcatatgaagattttgtagctggtcttggttgggaggtaaatcttacaaaccattgtggttttatgggaggactacaaaaaaacaaaagcactggattgaccactccatattttgctacctctacagtagaggtaatatttcacgtgtcaacaagaatgccttctgattctgatgattctttgaccaaaaaattgagacatttgggaaatgatgaagtgcacattgtttggtcagagcatactagagactacaggagaggaattattcccacagaatttggtgatgtccttattgtaatatatccaatgaaaaatcacatgttcagtattcagataatgaaaaaaccagaggttcccttctttggtcccctttttgatggtgctattgtgaatggaaaggttctacccattatggttagagcaacagctataaatgcaagccgtgctctgaaatctctgattccattgtatcaaaacttctatgaggagagagcacgatacctgcaaacaattgtccagcaccacttagaaccaacaacatttgaagattttgcagcacaggttttttctccagctccctaccaccatttaccatctgatgccgatcattaaatatcagttctgtttatctgaaggctcctacccagagattctacccagtgaaactcccacagcaacgcaggtagatggggctgacctggcctctccaatgtctcctcgaactagcaaaagccgcatgtccatgaagctgcgtcgttcctctggctcagccaataaatcctaaggagacaagcagcccagcagtgatcagcagtagccaccttagcacgaacatagggttaaccctttcaggccttcatgtctgccataacatgcatgtttcttcctgtacatttatttgagaaaacactggatttaaataattttaaataatttgtagcttaatattaaagatttaagttatttattgtttcattttttttcccacaatccaagctgccatattttgagggcagggggagttttattctacaccctttaccttcctagataattatgtctaagtagttttatctttaatttcatggttaactgtgagccaaaatacaattggacaattagtctcattatttattgtgccccattgcaactttatggttcaataaatatataattttttacaaatgtaaaattttacatttaagcatttgtaaagttacagcaaaagatgtacctgttaatacacagaatgtgtacagattatttgttatgacaataaaacactcaaaataaatggtctttagcatctcaaattccaactgaaatcattttagtattaactcttcttcccaaagcaatgtctcatttcttggctgtgcaggtgatgccatgttatatccaataactagaaaaatcactgtgctgaacttttatgtttagcttccaagtatttttctaatgttttgcatttcaagtggtatcactgttaaatgccatttgttttcagattgtggccttttattattggctgctagatcctggtgtttctatgttcttttttaagcaccaaaaagaagatggggaagaaaagaaggaaaattttctgatataaatatgttgttcaaattatgagtattatttaaaaaagaaaaaggaacataacccaggagtctaagttaaatctaatattgttaatactgaacttgcaggtccaggttggtatacattccaccctctagaagtattttcttacagtagataagctgctcacattttgttttgaatgggcatctcctgaggaaatgtagcatgacattggtactaactgcatgtgtaaatacatcatactggcaaaccgtaaaatataaattatgtatcatcattcatgtagtatctataatttgtaacagtgggggggaaagatgacatggtatttaataatacaataaaaatattcttatcacttccta

SEQ ID NO: 427524 - DNA, 3222 bp, Homo sapiens
atcatggccttacctctaaagacactgctccaaccatttcatgctacgggagcagaaagcgataaaacagaaaaatctgttctcaattgcatttataaggttttacatgggtgtgtttatggagctcagtgttttagcaatccaaggtattttcccatgagcctctctgatttggcatctgtagattatgatccttttatgcatttggaaagtctgaaagagcctgagcctctgcactctcctgactcagaacgatcttctaaactccagccagtaacagaagtgaaaactcaaatgcagcatggattaatctctatagcagcccgcactgttattacacatctggtaaatcacctgggccattatccaatgagcggtggtcctgctatgctaacaagtcaggtgtgtgaaaatcacgacaatcattacagtgaaagtactgaactttctcctgaactctttgagagtccaaatatccagttctttgtgttaaataatacaaccttagtgtcctgtatccagatcagatcagaagagaatatgcctggaggaggtttatctgctggccttgcatcagccaattcaaatgtcagaatcatagtacgtgatctctctggaaaatattcatgggattctgctatactgtatggcccacctcctgtaagtggcttgtcagaacctacatctttcatgctttcattgtctcaccaagagaagccagaagagcctccgacatctaatgaatgcttagaagatataaccgtaaaagatggactttctctccagttatgttcttgatgagctcttgcagtatttgggtgttactagtcctgaatgcttacagagaactggaatctcacttaatattcctgctccacaacctgtgtgcatttctgaaaaacaagaaaatgatgttattaatgctatccttaagcaacatacagaagaaaaagaatttgttgagaagcactttaatgacttaaacatgaaagctgtggaacaagatgaaccaatacctcaaaaacctcagtcagcattttattattgcagattgcttcttagtatattgggaatgaattcctgggacaaacggaggagctttcatctcctgaagaaaaatgaaaagctacttagagaacttaggaacttggattcaaggcagtgccgagagacacacaagattgcagtattttatgttgctgaaggacaagaagacaaacactccattctcaccaatacaggaggaagtcaagcatatgaagattttgtagctggtcttggttgggaggtaaatcttacaaaccattgtggttttatgggaggactacaaaaaaacaaaagcactggattgaccactccatattttgctacctctacagtagaggtaatatttcacgtgtcaacaagaatgccttctgattctgatgattctttgaccaaaaaattgagacatttgggaaatgatgaagtgcacattgtttggtcagagcatactagagactacaggagaggaattattcccacagaatttggtgatgtccttattgtaatatatccaatgaaaaatcacatgttcagtattcagataatgaaaaaaccagaggttcccttctttggtcccctttttgatggtgctattgtgaatggaaaggttctacccattatggttagagcaacagctataaatgcaagccgtgctctgaaatctctgattccattgtatcaaaacttctatgaggagagagcacgatacctgcaaacaattgtccagcaccacttagaaccaacaacatttgaagattttgcagcacaggttttttctccagctccctaccaccatttaccatctgatgccgatcattaaatatcagttctgtttatctgaaggctcctacccagagattctacccagtgaaactcccacagcaacgcaggtagatggggctgacctggcctctccaatgtctcctcgaactagcaaaagccgcatgtccatgaagctgcgtcgttcctctggctcagccaataaatcctaaggagacaagcagcccagcagtgatcagcagtagccaccttagcacgaacatagggttaaccctttcaggccttcatgtctgccataacatgcatgtttcttcctgtacatttatttgagaaaacactggatttaaataattttaaataatttgtagcttaatattaaagatttaagttatttattgtttcattttttttcccacaatccaagctgccatattttgagggcagggggagttttattctacaccctttaccttcctagataattatgtctaagtagttttatctttaatttcatggttaactgtgagccaaaatacaattggacaattagtctcattatttattgtgccccattgcaactttatggttcaataaatatataattttttacaaatgtaaaattttacatttaagcatttgtaaagttacagcaaaagatgtacctgttaatacacagaatgtgtacagattatttgttatgacaataaaacactcaaaataaatggtctttagcatctcaaattccaactgaaatcattttagtattaactcttcttcccaaagcaatgtctcatttcttggctgtgcaggtgatgccatgttatatccaataactagaaaaatcactgtgctgaacttttatgtttagcttccaagtatttttctaatgttttgcatttcaagtggtatcactgttaaatgccatttgttttcagattgtggccttttattattggctgctagatcctggtgtttctatgttcttttttaagcaccaaaaagaagatggggaagaaaagaaggaaaattttctgatataaatatgttgttcaaattatgagtattatttaaaaaagaaaaaggaacataacccaggagtctaagttaaatctaatattgttaatactgaacttgcaggtccaggttggtatacattccaccctctagaagtattttcttacagtagataagctgctcacattttgttttgaatgggcatctcctgaggaaatgtagcatgacattggtactaactgcatgtgtaaatacatcatactggcaaaccgtaaaatataaattatgtatcatcattcatgtagtatctataatttgtaacagtgggggggaaagatgacatggtatttaataatacaataaaaatattcttatcacttccta

SEQ ID NO: 427525 - DNA, 3244 bp, Homo sapiens
atcatggccttacctctaaagacactgctccaaccatttcatgctacgggagcagaaagcgataaaacagaaaaatctgttctcaattgcatttataaggttttacatgggtgtgtttatggagctcagtgttttagcaatccaaggtattttcccatgagcctctctgatttggcatctgtagattatgatccttttatgcatttggaaagtctgaaagagcctgagcctctgcactctcctgactcagaacgatcttctaaactccagccagtaacagaagtgaaaactcaaatgcagcatggattaatctctatagcagcccgcactgttattacacatctggtaaatcacctgggccattatccaatgagcggtggtcctgctatgctaacaagtcaggtgtgtgaaaatcacgacaatcattacagtgaaagtactgaactttctcctgaactctttgagagtccaaatatccagttctttgtgttaaataatacaaccttagtgtcctgtatccagatcagatcagaagagaatatgcctggaggaggtttatctgctggccttgcatcagccaattcaaatgtcagaatcatagtacgtgatctctctggaaaatattcatgggattctgctatactgtatggcccacctcctgtaagtggcttgtcagaacctacatctttcatgctttcattgtctcaccaagagaagccagaagagcctccgacatctaatgaatgcttagaagatataaccgtaaaagatggactttctctccagtttaaaagatttagagaaactgtaccaacttgggatacaataagagatgaagaagatgttcttgatgagctcttgcagtatttgggtgttactagtcctgaatgcttacagagaactggaatctcacttaatattcctgctccacaacctgtgtgcatttctgaaaaacaagaaaatgatgttattaatgctatccttaagcaacatacagaagaaaaagaatttgttgagaagcactttaatgacttaaacatgaaagctgtggaacaagatgaaccaatacctcaaaaacctcagtcagcattttattattgcagattgcttcttagtatattgggaatgaattcctgggacaaacggaggagctttcatctcctgaagaaaaatgaaaagctacttagagaacttaggaacttggattcaaggcagtgccgagagacacacaagattgcagtattttatgttgctgaaggacaagaagacaaacactccattctcaccaatacaggaggaagtcaagcatatgaagattttgtagctggtcttggttgggaggtaaatcttacaaaccattgtggttttatgggaggactacaaaaaaacaaaagcactggattgaccactccatattttgctacctctacagtagaggtaatatttcacgtgtcaacaagaatgccttctgattctgatgattctttgaccaaaaaattgagacatttgggaaatgatgaagtgcacattgtttggtcagagcatactagagactacaggagaggaattattcccacagaatttggtgatgtccttattgtaatatatccaatgaaaaatcacatgttcagtattcagataatgaaaaaaccagaggttcccttctttggtcccctttttgatggtgctattgtgaatggaaaggttctacccattatggttagagcaacagctataaatgcaagccgtgctctgaaatctctgattccattgtatcaaaacttctatgaggagagagcacgatacctgcaaacaattgtccagcaccacttagaaccaacaacatttgaagattttgcagcacaggttttttctccagctccctaccaccatttaccatctgatgccggctcctacccagagattctacccagtgaaactcccacagcaacgcaggtagatggggctgacctggcctctccaatgtctcctcgaactagcaaaagccgcatgtccatgaagctgcgtcgttcctctggctcagccaataaatcctaaggagacaagcagcccagcagtgatcagcagtagccaccttagcacgaacatagggttaaccctttcaggccttcatgtctgccataacatgcatgtttcttcctgtacatttatttgagaaaacactggatttaaataattttaaataatttgtagcttaatattaaagatttaagttatttattgtttcattttttttcccacaatccaagctgccatattttgagggcagggggagttttattctacaccctttaccttcctagataattatgtctaagtagttttatctttaatttcatggttaactgtgagccaaaatacaattggacaattagtctcattatttattgtgccccattgcaactttatggttcaataaatatataattttttacaaatgtaaaattttacatttaagcatttgtaaagttacagcaaaagatgtacctgttaatacacagaatgtgtacagattatttgttatgacaataaaacactcaaaataaatggtctttagcatctcaaattccaactgaaatcattttagtattaactcttcttcccaaagcaatgtctcatttcttggctgtgcaggtgatgccatgttatatccaataactagaaaaatcactgtgctgaacttttatgtttagcttccaagtatttttctaatgttttgcatttcaagtggtatcactgttaaatgccatttgttttcagattgtggccttttattattggctgctagatcctggtgtttctatgttcttttttaagcaccaaaaagaagatggggaagaaaagaaggaaaattttctgatataaatatgttgttcaaattatgagtattatttaaaaaagaaaaaggaacataacccaggagtctaagttaaatctaatattgttaatactgaacttgcaggtccaggttggtatacattccaccctctagaagtattttcttacagtagataagctgctcacattttgttttgaatgggcatctcctgaggaaatgtagcatgacattggtactaactgcatgtgtaaatacatcatactggcaaaccgtaaaatataaattatgtatcatcattcatgtagtatctataatttgtaacagtgggggggaaagatgacatggtatttaataatacaataaaaatattcttatcacttccta

SEQ ID NO: 427526 - DNA, 1920 bp, Homo sapiens
tttgtgtttcatatgtaaaactgatcaagtgcaatttaacaattttttaatttcgtttttcccctttttatgttgtatgtgactgtatgactgtactcaaagagcttttaaagcagtataaattgttttcttgtctttccagttgagacatttgggaaatgatgaagtgcacattgtttggtcagagcatactagagactacaggagaggaattattcccacagaatttggtgatgtccttattgtaatatatccaatgaaaaatcacatgttcagtattcagataatgaaaaaaccagaggttcccttctttggtcccctttttgatggtgctattgtgaatggaaaggttctacccattatggttagagcaacagctataaatgcaagccgtgctctgaaatctctgattccattgtatcaaaacttctatgaggagagagcacgatacctgcaaacaattgtccagcaccacttagaaccaacaacatttgaagattttgcagcacaggttttttctccagctccctaccaccatttaccatctgatgccgatcattaaatatcagttctgtttatctgaaggctcctacccagagattctacccagtgaaactcccacagcaacgcaggtagatggggctgacctggcctctccaatgtctcctcgaactagcaaaagccgcatgtccatgaagctgcgtcgttcctctggctcagccaataaatcctaaggagacaagcagcccagcagtgatcagcagtagccaccttagcacgaacatagggttaaccctttcaggccttcatgtctgccataacatgcatgtttcttcctgtacatttatttgagaaaacactggatttaaataattttaaataatttgtagcttaatattaaagatttaagttatttattgtttcattttttttcccacaatccaagctgccatattttgagggcagggggagttttattctacaccctttaccttcctagataattatgtctaagtagttttatctttaatttcatggttaactgtgagccaaaatacaattggacaattagtctcattatttattgtgccccattgcaactttatggttcaataaatatataattttttacaaatgtaaaattttacatttaagcatttgtaaagttacagcaaaagatgtacctgttaatacacagaatgtgtacagattatttgttatgacaataaaacactcaaaataaatggtctttagcatctcaaattccaactgaaatcattttagtattaactcttcttcccaaagcaatgtctcatttcttggctgtgcaggtgatgccatgttatatccaataactagaaaaatcactgtgctgaacttttatgtttagcttccaagtatttttctaatgttttgcatttcaagtggtatcactgttaaatgccatttgttttcagattgtggccttttattattggctgctagatcctggtgtttctatgttcttttttaagcaccaaaaagaagatggggaagaaaagaaggaaaattttctgatataaatatgttgttcaaattatgagtattatttaaaaaagaaaaaggaacataacccaggagtctaagttaaatctaatattgttaatactgaacttgcaggtccaggttggtatacattccaccctctagaagtattttcttacagtagataagctgctcacattttgttttgaatgggcatctcctgaggaaatgtagcatgacattggtactaactgcatgtgtaaatacatcatactggcaaaccgtaaaatataaattatgtatcatcattcatgtagtatctataatttgtaacagtgggggggaaagatgacatggtatttaataatacaataaaaatattcttatcacttccta

SEQ ID NO: 427527 - DNA, 2358 bp, Homo sapiens
gaaattgcttttaaagatataatattttatagggctatatctgcccaataattagcagctttaaaccagtcatacctgtcaccaaacagtacaaacgaaaccacaataaaaaatgatcttttgagctccctcttataatccctatatatcccaaaagtcatatccattatgttaattgtaataatagtttattgtaatcaatgtgcaatatatgaatcaatttatcccatcagattacacagtctgtgtgagcactgtaagaatgttagtaacagatacggtatgcacaaacataggagctcatgtgtacttttaaaacctcatccttgaggatatattaataatagaaataaatcagcattctttatgactcaagtagtataaatcaataggtagagtaggatgtgaaatgaaatgtaggttgttactacattttttacatctaaaattgaggtctttctactgtaaattatttatagagtttgggaatgttgaatatataccacaaatgtaatttgctaaattgttaggaagtactgataactatacaccacacacactaaaaatccttatttgactctgttgagtgaagggagatttcactttaaaggcagtgaggaagacatggaagaattgtttttgaggaaaatattatttgagtttgccataatgtagagcaatgctctctgataaagccctccttctatggtgatggaaatgttctatatctgcactgtctaatgtggaagccgctaactacatgtggctgttgaacaattgaaatgtggctagtgtactgaggaactgaatttttatttaattcattttaattcaataaatttaaacttaatgtggctgtggctaccacattggacaatgcagctctagagattttatgtctgagtgattaggataacatgccaacagtacagtgaacactttaaaaggtagatatttacagaatctctcatagaccttttttcttcttttcttttttcctatttgaacttgttttgttagttggctcctacccagagattctacccagtgaaactcccacagcaacgcaggtagatggggctgacctggcctctccaatgtctcctcgaactagcaaaagccgcatgtccatgaagctgcgtcgttcctctggctcagccaataaatcctaaggagacaagcagcccagcagtgatcagcagtagccaccttagcacgaacatagggttaaccctttcaggccttcatgtctgccataacatgcatgtttcttcctgtacatttatttgagaaaacactggatttaaataattttaaataatttgtagcttaatattaaagatttaagttatttattgtttcattttttttcccacaatccaagctgccatattttgagggcagggggagttttattctacaccctttaccttcctagataattatgtctaagtagttttatctttaatttcatggttaactgtgagccaaaatacaattggacaattagtctcattatttattgtgccccattgcaactttatggttcaataaatatataattttttacaaatgtaaaattttacatttaagcatttgtaaagttacagcaaaagatgtacctgttaatacacagaatgtgtacagattatttgttatgacaataaaacactcaaaataaatggtctttagcatctcaaattccaactgaaatcattttagtattaactcttcttcccaaagcaatgtctcatttcttggctgtgcaggtgatgccatgttatatccaataactagaaaaatcactgtgctgaacttttatgtttagcttccaagtatttttctaatgttttgcatttcaagtggtatcactgttaaatgccatttgttttcagattgtggccttttattattggctgctagatcctggtgtttctatgttcttttttaagcaccaaaaagaagatggggaagaaaagaaggaaaattttctgatataaatatgttgttcaaattatgagtattatttaaaaaagaaaaaggaacataacccaggagtctaagttaaatctaatattgttaatactgaacttgcaggtccaggttggtatacattccaccctctagaagtattttcttacagtagataagctgctcacattttgttttgaatgggcatctcctgaggaaatgtagcatgacattggtactaactgcatgtgtaaatacatcatactggcaaaccgtaaaatataaattatgtatcatcattcatgtagtatctataatttgtaacagtgggggggaaagatgacatggtatttaataatacaataaaaatattcttatcacttccta

SEQ ID NO: 427528 - DNA, 1933 bp, Homo sapiens
atcatggccttacctctaaagacactgctccaaccatttcatgctacgggagcagaaagcgataaaacagaaaaatctgttctcaattgcatttataaggttttacatgggtgtgtttatggagctcagtgttttagcaatccaaggtattttcccatgagcctctctgatttggcatctgtagattatgatccttttatgcatttggaaagtctgaaagagcctgagcctctgcactctcctgactcagaacgatcttctaaactccagccagtaacagaagtgaaaactcaaatgcagcatggattaatctctatagcagcccgcactgttattacacatctggtaaatcacctgggccattatccaatgagcggtggtcctgctatgctaacaagtcaggtgtgtgaaaatcacgacaatcattacagtgaaagtactgaactttctcctgaactctttgagagtccaaatatccagttctttgtgttaaataatacaaccttagtgtcctgtatccagatcagatcagaagagaatatgcctggaggaggtttatctgctggccttgcatcagccaattcaaatgtcagaatcatagtacgtgatctctctggaaaatattcatgggattctgctatactgtatggcccacctcctgtaagtggcttgtcagaacctacatctttcatgctttcattgtctcaccaagagaagccagaagagcctccgacatctaatgaatgcttagaagatataaccgtaaaagatggactttctctccagtttaaaagatttagagaaactgtaccaacttgggatacaataagagatgaagaagatgttcttgatgagctcttgcagtatttgggtgttactagtcctgaatgcttacagagaactggaatctcacttaatattcctgctccacaacctgtgtgcatttctgaaaaacaagaaaatgatgttattaatgctatccttaagcaacatacagaagaaaaagaatttgttgagaagcactttaatgacttaaacatgaaagctgtggaacaagatgaaccaatacctcaaaaacctcagtcagcattttattattgcagattgcttcttagtatattgggaatgaattcctgggacaaacggaggagctttcatctcctgaagaaaaatgaaaagctacttagagaacttaggaacttggattcaaggcagtgccgagagacacacaagattgcagtattttatgttgctgaaggacaagaagacaaacactccattctcaccaatacaggaggaagtcaagcatatgaagattttgtagctggtcttggttgggaggtaaatcttacaaaccattgtggttttatgggaggactacaaaaaaacaaaagcactggattgaccactccatattttgctacctctacagtagaggtaatatttcacgtgtcaacaagaatgccttctgattctgatgattctttgaccaaaaaattgagacatttgggaaatgatgaagtgcacattgtttggtcagagcatactagagactacaggagaggaattattcccacagaatttggtgatgtccttattgtaatatatccaatgaaaaatcacatgttcagtattcagataatgaaaaaaccagaggttcccttctttggtcccctttttgatggtgctattgtgaatggaaaggttctacccattatggttagagcaacagctataaatgcaagccgtgctctgaaatctctgattccattgtatcaaaactttttattctccctcaagctctgctactcaaatgtccagtacctgttgcaaagtaggaaagccaaaactaagtggaatggaattgatgaattgattggttctgctaatgcagttgcctttcgttataataaaacattataaaaccttttgg

SEQ ID NO: 427529 - DNA, 496 bp, Homo sapiens
tcaaccatgggattcggctacattgcaaaacagacaactcttaagatgcttatgtattcacacctatgtgtccttcctgatgctctttctcttcatttgtcaaatctttcttaccttcatctaactcaattttatcttctcctttaagtttctgtttttgcagtcaaaagtgatcgtgcctgtcttttattctaatggcaattttgtagtaattttttacttacattgcatttatatctccttctgtagactataagatctaattctttttcatctttttattgctacatactttgtacatagaacttaattgttggatgaatgagtagataaaatagtgattaaattaatggtgtaatcttttgttttatagccgagagacacacaagattgcagtattttatgttgctgaaggacaagaagacaaacactccattctcaccaatacaggaggaagtcaagcatatgaagattttgtagctggtcttggttggga

SEQ ID NO: 427530 - DNA, 379 bp, Homo sapiens
gaaattggctaagtgtgtaaattatttactcagttacatgaagcacatagttcttttgaatagacaccctataaacctttgacatttttattgtcctagtatgagtgacccatcacagaaaagaattgaattcaaatagtatttttactgaaggaagaactaaagaagcagcagaaatacttttggatgcaaagtgtcttgattgctcttatttacaatctgtctgtaatttgaatgtaaaattatgttctgatttctcaatcaggttcccttctttggtcccctttttgatggtgctattgtgaatggaaaggttctacccattatggttagagcaacagctataaatgcaagccgtgctctgaaatctctgattcca

SEQ ID NO: 427531 - DNA, 693 bp, Homo sapiens
cccattcatttatattttttatttccagtgaaaactcaaatgcagcatggattaatctctatagcagcccgcactgttattacacatctggtaaatcacctgggccattatccaatgagcggtggtcctgctatgctaacaagtcaggtgtgtgaaaatcacgacaatcattacagtgaaagtactgaactttctcctgaactctttgagagtccaaatatccagttctttgtgttaaataatacaaccttagtgtcctgtatccagatcagatcagaagagaatatgcctggaggaggtttatctgctggccttgcatcagccaattcaaatgtcagaatcatagtacgtgatctctctggaaaatattcatgggattctgctatactgtatggcccacctcctgtaagtggcttgtcagaacctacatctttcatgctttcattgtctcaccaagagaagccagaagagcctccgacatctaatgaatgcttagaagatataaccgtaaaagatggactttctctccagtttaaaagatttagagaaactgtaccaacttgggatacaataagagatgaagaagatgttcttgatgagctcttgcagtatttgggtgttactagtcctgaatgcttacagagaactggaatctcacttaatattcctgctccacaacctgtgtgcatttct

SEQ ID NO: 427532 - DNA, 3198 bp, Homo sapiens
atcatggccttacctctaaagacactgctccaaccatttcatgctacgggagcagaaagcgataaaacagaaaaatctgttctcaattgcatttataaggttttacatgggtgtgtttatggagctcagtgttttagcaatccaaggtattttcccatgagcctctctgatttggcatctgtagattatgatccttttatgcatttggaaagtctgaaagagcctgagcctctgcactctcctgactcagaacgatcttctaaactccagccagtaacagaagtgaaaactcaaatgcagcatggattaatctctatagcagcccgcactgttattacacatctggtaaatcacctgggccattatccaatgagcggtggtcctgctatgctaacaagtcaggtgtgtgaaaatcacgacaatcattacagtgaaagtactgaactttctcctgaactctttgagagtccaaatatccagttctttgtgttaaataatacaaccttagtgtcctgtatccagatcagatcagaagagaatatgcctggaggaggtttatctgctggccttgcatcagccaattcaaatgtcagaatcatagtacgtgatctctctggaaaatattcatgggattctgctatactgtatggcccacctcctgtaagtggcttgtcagaacctacatctttcatgctttcattgtctcaccaagagaagccagaagagcctccgacatctaatgaatgcttagaagatataaccgtaaaagatggactttctctccagtttaaaagatttagagaaactgtaccaacttgggatacaataagagatgaagaagatgttcttgatgagctcttgcagtatttgggtgttactagtcctgaatgcttacagagaactggaatctcacttaatattcctgctccacaacctgtgtgcatttctgaaaaacaagaaaatgatgttattaatgctatccttaagcaacatacagaagaaaaagaatttgttgagaagcactttaatgacttaaacatgaaagctgtggaacaagatgaaccaatacctcaaaaacctcagtcagcattttattattgcagattgcttcttagtatattgggaatgaattcctgggacaaacggaggagctttcatctcctgaagaaaaatgaaaagctacttagagaacttaggaacttggattcaaggcagtgccgagagacacacaagattgcagtattttatgttgctgaaggacaagaagacaaacactccattctcaccaatacaggaggaagtcaagcatatgaagattttgtagctggtcttggttgggaggtaaatcttacaaaccattgtggttttatgggaggactacaaaaaaacaaaagcactggattgaccactccatattttgctacctctacagtagaggtaatatttcacgtgtcaacaagaatgccttctgattctgatgattctttgaccaaaaaattgagacatttgggaaatgatgaagtgcacattgtttggtcagagcatactagagactacaggagaggaattattcccacagaatttggtgatgtccttattgtaatatatccaatgaaaaatcacatgttcagtattcagataatgaaaaaaccagaggttcccttctttggtcccctttttgatggtgctattgtgaatggaaaggttctacccattatggttagagcaacagctataaatgcaagccgtgctctgaaatctctgattccattgtatcaaaacttttagaaccaacaacatttgaagattttgcagcacaggttttttctccagctccctaccaccatttaccatctgatgccggctcctacccagagattctacccagtgaaactcccacagcaacgcaggtagatggggctgacctggcctctccaatgtctcctcgaactagcaaaagccgcatgtccatgaagctgcgtcgttcctctggctcagccaataaatcctaaggagacaagcagcccagcagtgatcagcagtagccaccttagcacgaacatagggttaaccctttcaggccttcatgtctgccataacatgcatgtttcttcctgtacatttatttgagaaaacactggatttaaataattttaaataatttgtagcttaatattaaagatttaagttatttattgtttcattttttttcccacaatccaagctgccatattttgagggcagggggagttttattctacaccctttaccttcctagataattatgtctaagtagttttatctttaatttcatggttaactgtgagccaaaatacaattggacaattagtctcattatttattgtgccccattgcaactttatggttcaataaatatataattttttacaaatgtaaaattttacatttaagcatttgtaaagttacagcaaaagatgtacctgttaatacacagaatgtgtacagattatttgttatgacaataaaacactcaaaataaatggtctttagcatctcaaattccaactgaaatcattttagtattaactcttcttcccaaagcaatgtctcatttcttggctgtgcaggtgatgccatgttatatccaataactagaaaaatcactgtgctgaacttttatgtttagcttccaagtatttttctaatgttttgcatttcaagtggtatcactgttaaatgccatttgttttcagattgtggccttttattattggctgctagatcctggtgtttctatgttcttttttaagcaccaaaaagaagatggggaagaaaagaaggaaaattttctgatataaatatgttgttcaaattatgagtattatttaaaaaagaaaaaggaacataacccaggagtctaagttaaatctaatattgttaatactgaacttgcaggtccaggttggtatacattccaccctctagaagtattttcttacagtagataagctgctcacattttgttttgaatgggcatctcctgaggaaatgtagcatgacattggtactaactgcatgtgtaaatacatcatactggcaaaccgtaaaatataaattatgtatcatcattcatgtagtatctataatttgtaacagtgggggggaaagatgacatggtatttaataatacaataaaaatattcttatcacttccta

SEQ ID NO: 427533 - DNA, 1366 bp, Homo sapiens
atcatggccttacctctaaagacactgctccaaccatttcatgctacgggagcagaaagcgataaaacagaaaaatctgttctcaattgcatttataaggttttacatgggtgtgtttatggagctcagtgttttagcaatccaaggtattttcccatgagcctctctgatttggcatctgtagattatgatccttttatgcatttggaaagtctgaaagagcctgagcctctgcactctcctgactcagaacgatcttctaaactccagccagtaacagaagtgaaaactcaaatgcagcatggattaatctctatagcagcccgcactgttattacacatctggtaaatcacctgggccattatccaatgagcggtggtcctgctatgctaacaagtcaggtgtgtgaaaatcacgacaatcattacagtgaaagtactgaactttctcctgaactctttgagagtccaaatatccagttctttgtgttaaataatacaaccttagtgtcctgtatccagatcagatcagaagagaatatgcctggaggaggtttatctgctggccttgcatcagccaattcaaatgtcagaatcatagtacgtgatctctctggaaaatattcatgggattctgctatactgtatggcccacctcctgtaagtggcttgtcagaacctacatctttcatgctttcattgtctcaccaagagaagccagaagagcctccgacatctaatgaatgcttagaagatataaccgtaaaagatggactttctctccagtttaaaagatttagagaaactgtaccaacttgggatacaataagagatgaagaagatgttcttgatgagctcttgcagtatttgggtgttactagtcctgaatgcttacagagaactggaatctcacttaatattcctgctccacaacctgtgtgcatttctgaaaaacaagaaaatgatgttattaatgctatccttaagcaacatacagaagaaaaagaatttgttgagaagcactttaatgacttaaacatgaaagctgtggaacaagatgaaccaatacctcaaaaacctcagtcagcattttattattgcagattgcttcttagtatattgggaatgaattcctgggacaaacggaggagctttcatctcctgaagaaaaatgaaaagctacttagagaacttaggaacttggattcaaggcagtgccgagagacacacaagattgcagtattttatgttgctgaaggacaagaagacaaacactccattctcaccaatacaggaggaagtcaagcatatgaagattttgtagctggtcttggttgggagcttattatttttaaattatacgaaa

SEQ ID NO: 427534 - DNA, 864 bp, Homo sapiens
aatgaaaaaagaatttctgtactttttaatttactgtaactccttagaccaagatgaaacaaacaaaacatcatcattatttttttaactacaaaataaacatacggattgttaattctttgtatttttcttgcctgttcctgtgggaaaagctgcattttcaatttgaaattagtccacaaatctataatatagttcttctttaggaaaagcattagaaaattggcatggataagattttgaaaacacctcaaatatgaggtttaatataatactacaaaacttgtgccactttatctgtgtaaaatgatctttatacttttctgttatgtttatgttttaagacagtgtctcgctatgttgcccaggctggaatgcagtggcacaaccacagctcactgaagtcttgacctcccaggctcaagtgatcctcccacctcagccttccaagtagctgggattacagatgcgtaccacaacgctcagcttactttttattttttgtagagaagggttcttcctattttgcttaggctggtcttgagcaactaggttcaaggaatcatcttgccttggcctcccacctaagtgttgggattataggtgtgagctaccacacccagcctgttttaacagcagctatagcaatggttttatattttgttaataagttatctgtattgctatagtaccaagaagagtaaacaaattgtattattatgttaaaatattggttatacaaatagcattcaatactaattattacagcaaaatagtctacaacagttacactggtttactcagtagattaagacaaaaatttttagcctgggtgacaaagcaagaccccatctcaaaaaaaaa

SEQ ID NO: 427535 - DNA, 560 bp, Homo sapiens
agaatgaaagctccatgacagcaggaactttgtctacctcgttcactgggcctcagtgctagcgcataataacccctcagtgtcagtgtgttgaatgaatgaatttactgttactctaatgtgataagttcaaggtatccgagaatgcaggtgggctcttcagactggctgaccaatagtactgtcttgatggggtttccactgtctgctaagttaaacatggaaagcgcttagaatggttctggcatgcaaccagttgcacgtgcattatttaatcacatagacaagtcaggattgaaggatagttctgtcgaagaactcaagaaaagatacggtggttgatttccatttttgctgaaataattgtttttgactttcatatgtaaattttttctactgaaagtgttttgctttttaagaaaatgaaattatatagcaggaaaggactatctttgaacataagttaattaactataaggtgaattgtgatttaactagtgagaattgtattcaagtgaactctgtttttctgaaaataaaaatataaacaatgagataca

SEQ ID NO: 427536 - DNA, 2315 bp, Homo sapiens
agcgtcggggctttgcgtgagtcactgccgggctcggcgtgagtcgctgcggggctgacggggtggcagtgcggcgggttacggcctggtcagaccataatgacttcagcaaataaagcaatcgaattacaactacaagtgaaacaaaatgcagaagaattacaagactttatgcgggatttagaaaactgggaaaaagacattaaacaaaaggatatggaactaagaagacagaatggtgttcctgaagagaatttacctcctattcgaaatgggaattttaggaaaaagaagaaaggcaaagctaaagagtcttccaaaaaaaccagagaggaaaacacaaaaaacaggataaaatcttatgattatgaggcatgggcaaaacttgatgtggaccgtatccttgatgagcttgacaaagacgatagtacccatgagtctctgtctcaagaatcagagtcggaagaagatgggattcatgtagattcacaaaaggctcttgttttaaaagaaaagggcaataaatacttcaaacaaggaaaatatgatgaagcaattgactgctacacaaaaggcatggatgccgatccatataatcccgtgttgccaacgaacagagcgtcagcatattttagactgaaaaaatttgctgttgctgagtctgattgtaatttagcagttgccttgaatagaagttatacaaaggcttattccagacgaggtgctgctcgatttgctttgcaaaaattagaagaggccaaaaaagattatgaaagagtattagaactagaaccaaataactttgaagcaacaaatgaactcaggaaaatcagtcaggctttagcatccaaagaaaactcatatccaaaggaagctgacatagtgattaagtcaacagaaggagagcgaaagcaaattgaagcacaacagaataagcagcaggccatttcagagaaagatcgggggaatggatttttcaaagaggggaaatatgaaagagcaattgaatgctatactcgagggatagcagcagatggtgctaatgcccttcttccagctaacagagctatggcctatctgaagattcagaaatatgaagaagctgaaaaagactgcacacaagccattttattagatggctcatattctaaagcttttgccagaagaggaactgcaagaacatttttgggaaagctaaatgaggcaaaacaagattttgaaactgttttacttctggaacctggaaataagcaagcagtaactgaactctccaaaattaaaaaggaattaattgagaaaggacactgggatgatgtctttcttgattccacacaaagacaaaatgtggtaaaacccattgataatccaccgcatcctggatcaactaaaccactcaagaaggttattattgaagaaactggtaatttgatacagactattgatgtgccagatagcactactgctgctgctccagagaataatcctattaatctagcaaatgtaatagcagccacaggcaccacaagtaagaagaattcaagccaagatgacctttttcccacaagtgatactccaagagcaaaagtattgaaaatagaagaagtcagtgatacttcatccctgcaacctcaagccagtttgaagcaggatgtatgtcagtcttacagcgagaaaatgcccatagagatagaacaaaaacctgctcagtttgccacaactgttcttcctccaattcctgcaaactcgttccagctcgaatctgatttcagacaattgaaaagttctccagatatgttgtatcagtatttaaagcaaattgaaccatctttgtatcctaagttgtttcagaaaaatctggatccagatgtattcaaccagatcgttaaaattctgcatgacttttacattgagaaagaaaagccattactcatctttgaaatcttacaaagactttctgaactaaaaaggtttgatatggcagtgatgtttatgtcagaaacagagaaaaagattgcacgtgcattatttaatcacatagacaagtcaggattgaaggatagttctgtcgaagaactcaagaaaagatacggtggttgatttccatttttgctgaaataattgtttttgactttcatatgtaaattttttctactgaaagtgttttgctttttaagaaaatgaaattatatagcaggaaaggactatctttgaacataagttaattaactataaggtgaattgtgatttaactagtgagaattgtattcaagtgaactctgtttttctgaaaataaaaatataaacaatgagataca

SEQ ID NO: 427537 - DNA, 2376 bp, Homo sapiens
agcgtcggggctttgcgtgagtcactgccgggctcggcgtgagtcgctgcggggctgacggggtggcagtgcggcgggttacggcctggtcagaccataatgacttcagcaaataaagcaatcgaattacaactacaagtgaaacaaaatgcagaagaattacaagactttatgcgggatttagaaaactgggaaaaagacattaaacaaaaggatatggaactaagaagacagaatggtgttcctgaagagaatttacctcctattcgaaatgggaattttaggaaaaagaagaaaggcaaagctaaagagtcttccaaaaaaaccagagaggaaaacacaaaaaacaggataaaatcttatgattatgaggcatgggcaaaacttgatgtggaccgtatccttgatgagcttgacaaagacgatagtacccatgagtctctgtctcaagaatcagagtcggaagaagatgggattcatgtagattcacaaaaggctcttgttttaaaagaaaagggcaataaatacttcaaacaaggaaaatatgatgaagcaattgactgctacacaaaaggcatggatgccgatccatataatcccgtgttgccaacgaacagagcgtcagcatattttagactgaaaaaatttgctgttgctgagtctgattgtaatttagcagttgccttgaatagaagttatacaaaggcttattccagacgaggtgctgctcgatttgctttgcaaaaattagaagaggccaaaaaagattatgaaagagtattagaactagaaccaaataactttgaagcaacaaatgaactcaggaaaatcagtcaggctttagcatccaaagaaaactcatatccaaaggaagctgacatagtgattaagtcaacagaaggagagcgaaagcaaattgaagcacaacagaataagcagcaggccatttcagagaaagatcgggggaatggatttttcaaagaggggaaatatgaaagagcaattgaatgctatactcgagggatagcagcagatggtgctaatgcccttcttccagctaacagagctatggcctatctgaagattcagaaatatgaagaagctgaaaaagactgcacacaagccattttattagatggctcatattctaaagcttttgccagaagaggaactgcaagaacatttttgggaaagctaaatgaggcaaaacaagattttgaaactgttttacttctggaacctggaaataagcaagcagtaactgaactctccaaaattaaaaaggaattaattgagaaaggacactgggatgatgtctttcttgattccacacaaagacaaaatgtggtaaaacccattgataatccaccgcatcctggatcaactaaaccactcaagaaggttattattgaagaaactggtaatttgatacagactattgatgtgccagatagcactactgctgctgctccagagaataatcctattaatctagcaaatgtaatagcagccacaggcaccacaagtaagaagaattcaagccaagatgacctttttcccacaagtgatactccaagagcaaaagtattgaaaatagaagaagtcagtgatacttcatccctgcaacctcaagccagtttgaagcaggatgtatgtcagtcttacagcgagaaaatgcccatagagatagaacaaaaacctgctcagtttgccacaactgttcttcctccaattcctgcaaactcgttccagctcgaatctgatttcagacaattgaaaagttctccagatatgttgtatcagtatttaaagcaaattgaaccatctttgtatcctaagttgtttcagaaaaatctggatccagatgtattcaaccagatcgttaaaattctgcatgacttttacattgagaaagaaaagccattactcatctttgaaatcttacaaagactttctgaactaaaaaggtttgatatggcagtgatgtttatgtcagaaacagagaaaaagattgcacgtgcattatttaatcacatagacaagtcaggattgaaggatagttctgtcgaagaactcaagaaaagatacggtggttgatttccatttttgctgaaataattgtttttgactttcatatgtaaattttttctactgaaagtgttttgctttttaagaaaatgaaattatatagcaggaaaggactatctttgaacataagttaattaactataaggtgaattgtgatttaactagtgagaattgtattcaagtgaactctgtttttctgaaaataaaaatataaacaatgagatacagaaaacaaaaaaacaaaagatggtctccttggccccagcgctggagcctctcagccgtcta

SEQ ID NO: 427538 - DNA, 1099 bp, Homo sapiens
agcgtcggggctttgcgtgagtcactgccgggctcggcgtgagtcgctgcggggctgacggggtggcagtgcggcgggttacggcctggtcagaccataatgacttcagcaaataaagcaatcgaattacaactacaagtgaaacaaaatgcagaagaattacaagactttatgcgggatttagaaaactgggaaaaagacattaaacaaaaggatatggaactaagaagacagaatggtgttcctgaagagaatttacctcctattcgaaatgggaattttaggaaaaagaagaaaggcaaagctaaagagtcttccaaaaaaaccagagaggaaaacacaaaaaacaggataaaatcttatgattatgaggcatgggcaaaacttgatgtggaccgtatccttgatgagcttgacaaagacgatagtacccatgagtctctgtctcaagaatcagagtcggaagaagatgggattcatgtagattcacaaaaggctcttgttttaaaagaaaagggcaataaatacttcaaacaaggaaaatatgatgaagcaattgactgctacacaaaaggcatggatgccgatccatataatcccgtgttgccaacgaacagagcgtcagcatattttagactgaaaaaatttgctgttgctgagtctgattgtaatttagcagttgccttgaatagaagttatacaaaggcttattccagacgaggtgctgctcgatttgctttgcaaaaattagaagaggccaaaaaagattatgaaagagtattagaactagaaccaaataactttgaagcaacaaatgaactcaggaaaatcagtcaggctttagcatccaaagaaaactcatatccaaaggaagctgacatagtgattaagtcaacagaaggagagcgaaagcaaattgaagcacaacagaataagcagcaggccatttcagagaaagatcgggggaatggattttctaaaaggggaaatataaaagacaattgatgctttactcaggggggccggtcccacatcccctataggatcgtttcaatcactgccgtcgtttacacgtgtgacttggaaacctgcgtaccca

SEQ ID NO: 427539 - DNA, 613 bp, Homo sapiens
agatagggtaaacatttttaaggtagtacagaatgaattaagtttaatctgcaagattaatatcattgagaatgcagggcaaattttatactgctaaagcaaaatattcctgaaagaaccattgttggattgctatataattttgtgttctcagattggctttttaaatatctgaattagaatttataaacctatgtattgctttaaaatgtaaaatgtttttgacaaatagattgctccttttaatttacattttgcttggtttttaaaaaatgagattaaaatggagaatttctttttctttttcagttgcacgtgcattatttaatcacatagacaagtcaggattgaaggatagttctgtcgaagaactcaagaaaagatacggtggttgatttccatttttgctgaaataattgtttttgactttcatatgtaaattttttctactgaaagtgttttgctttttaagaaaatgaaattatatagcaggaaaggactatctttgaacataagttaattaactataaggtgaattgtgatttaactagtgagaattgtattcaagtgaactctgtttttctgaaaataaaaatataaacaatgagataca

SEQ ID NO: 427540 - DNA, 357 bp, Homo sapiens
ttaagccacattccatttactcatttcgtaacccacacacccaggcagcctagttgcacgtgcattatttaatcacatagacaagtcaggattgaaggatagttctgtcgaagaactcaagaaaagatacggtggttgatttccatttttgctgaaataattgtttttgactttcatatgtaaattttttctactgaaagtgttttgctttttaagaaaatgaaattatatagcaggaaaggactatctttgaacataagttaattaactataaggtgaattgtgatttaactagtgagaattgtattcaagtgaactctgtttttctgaaaataaaaatataaacaatgagataca

SEQ ID NO: 427541 - DNA, 574 bp, Homo sapiens
tgcactgtgatctactttaagggttgatgtggttaggggtatgtatgttgggggatgtgataaccaactgatgaatttggaatatatattcctctttagtttttaaacaagtgtttattacgtaatatttgattcataccaaagaatatgtagagatgtatgttctaaagcatagtaataaaatgaatacatgagcctaccatctaacttaaagagaatttttccaatattattgaagctactggtatgctcctttctaatcccatgttcttttctcccctctactcccagaggtaaccactgtctgatttctctgtttattattttctttgcatttttctgtttaacatttttactgaggtataatgtgcatcaagtccaaaaatcttaagtgtgcatcttcctgaatttttactcaagtgtacacctgtgaaaccactgtttggatcaagatacagaacattctgggaggctgaggcacgagaatggcttgaacccgggaggcggaggttgcagtgagccaagatcacaccactgcactgcagcctgggccacagagggagactctgtctca

SEQ ID NO: 427542 - DNA, 2339 bp, Homo sapiens
tcaacgctttatactttccgtgtgcagcaagaaggggacatggccccaagatagccaatcaggtgagtcgctgcggggctgacggggtggcagtgcggcgggttacggcctggtcagaccataatgacttcagcaaataaagcaatcgaattacaactacaagtgaaacaaaatgcagaagaattacaagactttatgcgggatttagaaaactgggaaaaagacattaaacaaaaggatatggaactaagaagacagaatggtgttcctgaagagaatttacctcctattcgaaatgggaattttaggaaaaagaagaaaggcaaagctaaagagtcttccaaaaaaaccagagaggaaaacacaaaaaacaggataaaatcttatgattatgaggcatgggcaaaacttgatgtggaccgtatccttgatgagcttgacaaagacgatagtacccatgagtctctgtctcaagaatcagagtcggaagaagatgggattcatgtagattcacaaaaggctcttgttttaaaagaaaagggcaataaatacttcaaacaaggaaaatatgatgaagcaattgactgctacacaaaaggcatggatgccgatccatataatcccgtgttgccaacgaacagagcgtcagcatattttagactgaaaaaatttgctgttgctgagtctgattgtaatttagcagttgccttgaatagaagttatacaaaggcttattccagacgaggtgctgctcgatttgctttgcaaaaattagaagaggccaaaaaagattatgaaagagtattagaactagaaccaaataactttgaagcaacaaatgaactcaggaaaatcagtcaggctttagcatccaaagaaaactcatatccaaaggaagctgacatagtgattaagtcaacagaaggagagcgaaagcaaattgaagcacaacagaataagcagcaggccatttcagagaaagatcgggggaatggatttttcaaagaggggaaatatgaaagagcaattgaatgctatactcgagggatagcagcagatggtgctaatgcccttcttccagctaacagagctatggcctatctgaagattcagaaatatgaagaagctgaaaaagactgcacacaagccattttattagatggctcatattctaaagcttttgccagaagaggaactgcaagaacatttttgggaaagctaaatgaggcaaaacaagattttgaaactgttttacttctggaacctggaaataagcaagcagtaactgaactctccaaaattaaaaaggaattaattgagaaaggacactgggatgatgtctttcttgattccacacaaagacaaaatgtggtaaaacccattgataatccaccgcatcctggatcaactaaaccactcaagaaggttattattgaagaaactggtaatttgatacagactattgatgtgccagatagcactactgctgctgctccagagaataatcctattaatctagcaaatgtaatagcagccacaggcaccacaagtaagaagaattcaagccaagatgacctttttcccacaagtgatactccaagagcaaaagtattgaaaatagaagaagtcagtgatacttcatccctgcaacctcaagccagtttgaagcaggatgtatgtcagtcttacagcgagaaaatgcccatagagatagaacaaaaacctgctcagtttgccacaactgttcttcctccaattcctgcaaactcgttccagctcgaatctgatttcagacaattgaaaagttctccagatatgttgtatcagtatttaaagcaaattgaaccatctttgtatcctaagttgtttcagaaaaatctggatccagatgtattcaaccagatcgttaaaattctgcatgacttttacattgagaaagaaaagccattactcatctttgaaatcttacaaagactttctgaactaaaaaggtttgatatggcagtgatgtttatgtcagaaacagagaaaaagattgcacgtgcattatttaatcacatagacaagtcaggattgaaggatagttctgtcgaagaactcaagaaaagatacggtggttgatttccatttttgctgaaataattgtttttgactttcatatgtaaattttttctactgaaagtgttttgctttttaagaaaatgaaattatatagcaggaaaggactatctttgaacataagttaattaactataaggtgaattgtgatttaactagtgagaattgtattcaagtgaactctgtttttctgaaaataaaaatataaacaatgagataca

SEQ ID NO: 427543 - DNA, 2354 bp, Homo sapiens
agcgtcggggctttgcgtgagtcactgccgggctcggcgtgagtcgctgcggggctgacggggtggcagtgcggcgggttacggcctggtcagaccataatgacttcagcaaataaagcaatcgaattacaactacaagtgaaacaaaatgcagaagaattacaagactttatgcgggatttagaaaactgggaaaaagacattaaacaaaaggatatggaactaagaagacagaatggtgttcctgaagagaatttacctcctattcgaaatgggaattttaggaaaaagaagaaaggcaaagctaaagagtcttccaaaaaaaccagagaggaaaacacaaaaaacaggataaaatcttatgattatgaggcatgggcaaaacttgatgtggaccgtatccttgatgagcttgacaaagacgatagtacccatgagtctctgtctcaagaatcagagtcggaagaagatgggattcatgtagattcacaaaaggctcttgttttaaaagaaaagggcaataaatacttcaaacaaggaaaatatgatgaagcaattgactgctacacaaaaggcatggatgccgatccatataatcccgtgttgccaacgaacagagcgtcagcatattttagactgaaaaaatttgctgttgctgagtctgattgtaatttagcagttgccttgaatagaagttatacaaaggcttattccagacgaggtgctgctcgatttgctttgcaaaaattagaagaggccaaaaaagattatgaaagagtattagaactagaaccaaataactttgaagcaacaaatgaactcaggaaaatcagtcaggctttagcatccaaagaaaactcatatccaaaggaagctgacatagtgattaagtcaacagaaggagagcgaaagcaaattgaagcacaacagaataagcagcaggccatttcagagaaagatcgggggaatggatttttcaaagaggggaaatatgaaagagcaattgaatgctatactcgagggatagcagcagatggtgctaatgcccttcttccagctaacagagctatggcctatctgaagattcagaaatatgaagaagctgaaaaagactgcacacaagccattttattagatggctcatattctaaagcttttgccagaagaggaactgcaagaacatttttgggaaagctaaatgaggcaaaacaagattttgaaactgttttacttctggaacctggaaataagcaagcagtaactgaactctccaaaattaaaaaggaattaattgagaaaggacactgggatgatgtctttcttgattccacacaaagacaaaatgtggtaaaacccattgataatccaccgcatcctggatcaactaaaccactcaagaaggttattattgaagaaactggtaatttgatacagactattgatgtgccagatagcactactgctgctgctccagagaataatcctattaatctagcaaatgtaatagcagccacaggcaccacaagtaagaagaattcaagccaagatgacctttttcccacaagtgatactccaagagcaaaagtattgaaaatagaagaagtcagtgatacttcatccctgcaacctcaagccagtttgaagcaggatgtatgtcagtcttacagcgagaaaatgcccatagagatagaacaaaaacctgctcagtttgccacaactgttcttcctccaattcctgcaaactcgttccagctcgaatctgatttcagacaattgaaaagttctccagatatgttgtatcagtatttaaagcaaattgaaccatctttgtatcctaagttgtttcagaaaaatctggatccagatgtattcaaccagatcgttaaaattctgcatgacttttacattgagaaagaaaagccattactcatctttgaaatcttacaaagactttctgaactaaaaaggtttgatatggcagtgatgtttatgtcagaaacagagaaaaagattgcacgtgcattatttaatcacatagacaagtcaggattgaaggatagttctgtcgaagaactcaagaaaagatacggtggttgatttccatttttgctgaaataattgtttttgactttcatatgtaaattttttctactgaaagtgttttgctttttaagaaaatgaaattatatagcaggaaaggactatctttgaacataagttaattaactataaggtgaattgtgatttaactagtgagaattgtattcaagtgaactctgtttttctgaaaataaaaatataaacaatgagatacaactggcctcgttggcctcagcggtggagctctgcggccg

SEQ ID NO: 427544 - DNA, 541 bp, Homo sapiens
agcgtcggggctttgcgtgagtcactgccgggctcggcgtgagtcgctgcggggctgacggggtggcagtgcggcgggttacggcctggtcagaccataatgacttcagcaaataaagcaatcgaattacaactacaagtgaaacaaaatgcagaagaattacaagactttatgcgggatttagaaaactgggaaaaagacattaaacaaaaggatatggaactaagaagacagaatggtgttcctgaagagaatttacctcctattcgaaatgggaattttaggaaaaagaagaaaggcaaagctaaagagtcttccaaaaaaaccagagaggaaaacacaaaaaacaggataaaatcttatgattatgaggcatgggcaaaacttgatgtgtgtacacctgtgaaaccactgtttggatcaagatacagaacattctgggaggctgaggcacgagaatggcttgaacccgggaggcggaggttgcagtgagccaagatcacaccactgcactgcagcctgggccacagagggagactct

SEQ ID NO: 427545 - DNA, 405 bp, Homo sapiens
ttgaacccaggaggcggaggttgcggtgagccaagatcgcaccactgcactccagtcttggcaacaagagcgaaactccatctcaaaaacaaaaaaaaataaaagaaattctctcagggcttaactgaaatttaggacttgaacttcagtatgtacaaaaccagagtagagttctaggctggatctaggtatgtgtgttgtgagcagcattcagattagaatcaacaaagaacaaccctcccagtgctcttcactcccccagcctgtctaagccagtgatggcacatatgcatatgctacccctattcgggttgtccacccatggcagacattgccagtcagtcaccgcgctgctttggctgagggctcagatccttctcaaaacagggatcctcgctactacta

SEQ ID NO: 427546 - DNA, 3666 bp, Homo sapiens
gcctgctgccgcctgggccccgccgagcggagctagcgccgcgcgcagagcacacgctcgcgctccagctcccctcctgcgcggttcatgactgtgtcccctgaccgcagcctctgcgagcccccgccgcaggaccacggcccgctccccgccgccgcgagggccccgagcgaaggaaggaagggaggcgcgctgtgcgccccgcggagcccgcgaaccccgctcgctgccggctgcccagcctggctggcaccatgctgcccgcgcgctgcgcccgcctgctcacgccccacttgctgctggtgttggtgcagctgtcccctgctcgcggccaccgcaccacaggccccaggtttctaataagtgaccgtgacccacagtgcaacctccactgctccaggactcaacccaaacccatctgtgcctctgatggcaggtcctacgagtccatgtgtgagtaccagcgagccaagtgccgagacccgaccctgggcgtggtgcatcgaggtagatgcaaagatgctggccagagcaagtgtcgcctggagcgggctcaagccctggagcaagccaagaagcctcaggaagctgtgtttgtcccagagtgtggcgaggatggctcctttacccaggtgcagtgccatacttacactgggtactgctggtgtgtcaccccggatgggaagcccatcagtggctcttctgtgcagaataaaactcctgtatgttcaggttcagtcaccgacaagcccttgagccagggtaactcaggaaggaaagatgacgggtctaagccgacacccacgatggagacccagccggtgttcgatggagatgaaatcacagccccaactctatggattaaacacttggtgatcaaggactccaaactgaacaacaccaacataagaaattcagagaaagtctattcgtgtgaccaggagaggcagagtgccctggaagaggcccagcagaatccccgtgagggtattgtcatccctgaatgtgcccctgggggactctataagccagtgcaatgccaccagtccactggctactgctggtgtgtgctggtggacacagggcgcccgctgcctgggacctccacacgctacgtgatgcccagttgtgagagcgacgccagggccaagactacagaggcggatgaccccttcaaggacagggagctaccaggctgtccagaagggaagaaaatggagtttatcaccagcctactggatgctctcaccactgacatggttcaggccattaactcagcagcgcccactggaggtgggaggttctcagagccagaccccagccacaccctggaggagcgggtagtgcactggtatttcagccagctggacagcaatagcagcaacgacattaacaagcgggagatgaagcccttcaagcgctacgtgaagaagaaagccaagcccaagaaatgtgcccggcgtttcaccgactactgtgacctgaacaaagacaaggtcatttcactgcctgagctgaagggctgcctgggtgttagcaaagaaggacgcctcgtctaaggagcagaaaacccaagggcaggtggagagtccagggaggcaggatggatcaccagacacctaaccttcagcgttgcccatggccctgccacatcccgtgtaacataagtggtgcccaccatgtttgcacttttaataactcttacttgcgtgttttgtttttggtttcattttaaaacaccaatatctaataccacagtgggaaaaggaaagggaagaaagactttattctctctcttattgtaagtttttggatctgctactgacaacttttagagggttttgggggggtgggggagggtgttgttggggctgagaagaaagagatttatatgctgtatataaatatatatgtaaattgtatagttcttttgtacaggcattggcattgctgttgtttatttctctccctctgcctgctgtgggtggtgggcactctggacacatagtccagctttctaaaatccaggactctatcctgggcctactaaacttctgtttggagactgacccttgtgtataaagacgggagtcctgcaattgtactgcggactccacgagttcttttctggtgggaggactatattgccccatgccattagttgtcaaaattgataagtcacttggctctcggccttgtccagggaggttgggctaaggagagatggaaactgccctgggagaggaagggagtccagatcccatgaatagcccacacaggtaccggctctcagagggtccgtgcattcctgctctccggacccccaaagggcccagcattggtgggtgcaccagtatcttagtgaccctcggagcaaattatccacaaaggatttgcattacgtcactcgaaacgttttcatccatgcttagcatctactctgtataacgcatgagaggggaggcaaagaagaaaaagacacacagaagggcctttaaaaaagtagatatttaatatctaagcaggggaggggacaggacagaaagcctgcactgaggggtgcggtgccaacagggaaactcttcacctccctgcaaacctaccagtgaggctcccagagacgcagctgtctcagtgccaggggcagattgggtgtgacctctccactcctccatctcctgctgttgtcctagtggctatcacaggcctgggtgggtgggttgggggaggtgtcagtcaccttgttggtaacactaaagttgttttgttggttttttaaaaacccaatactgaggttcttcctgttccctcaagttttcttatgggcttccaggctttaagctaattccagaagtaaaactgatcttgggtttcctattctgcctcccctagaagggcaggggtgataacccagctacagggaaatcccggcccagctttccacaggcatcacaggcatcttccgcggattctagggtgggctgcccagccttctggtctgaggcgcagctccctctgcccaggtgctgtgcctattcaagtggccttcaggcagagcagcaagtggcccttagcgccccttcccataagcagctgtggtggcagtgagggaggttgggtagccctggactggtcccctcctcagatcacccttgcaaatctggcctcatcttgtattccaacccgacatccctaaaagtacctccacccgttccgggtctggaaggcgttggcaccacaagcactgtccctgtgggaggagcacaaccttctcgggacaggatctgatggggtcttgggctaaaggaggtccctgctgtcctggagaaagtcctagaggttatctcaggaatgactggtggccctgccccaacgtggaaaggtgggaaggaagccttctcccattagccccaatgagagaactcaacgtgccggagctgagtgggccttgcacgagacactggccccactttcaggcctggaggaagcatgcacacatggagacggcgcctgcctgtagatgtttggatcttcgagatctccccaggcatcttgtctcccacaggatcgtgtgtgtaggtggtgttgtgtggttttcctttgtgaaggagagagggaaactatttgtagcttgttttataaaaaataaaaaatgggtaaatcttg

SEQ ID NO: 427547 - DNA, 1940 bp, Homo sapiens
gcctgctgccgcctgggccccgccgagcggagctagcgccgcgcgcagagcacacgctcgcgctccagctcccctcctgcgcggttcatgactgtgtcccctgaccgcagcctctgcgagcccccgccgcaggaccacggcccgctccccgccgccgcgagggccccgagcgaaggaaggaagggaggcgcgctgtgcgccccgcggagcccgcgaaccccgctcgctgccggctgcccagcctggctggcaccatgctgcccgcgcgctgcgcccgcctgctcacgccccacttgctgctggtgttggtgcagctgtcccctgctcgcggccaccgcaccacaggccccaggtttctaataagtgaccgtgacccacagtgcaacctccactgctccaggactcaacccaaacccatctgtgcctctgatggcaggtcctacgagtccatgtgtgagtaccagcgagccaagtgccgagacccgaccctgggcgtggtgcatcgaggtagatgcaaagatgctggccagagcaagtgtcgcctggagcgggctcaagccctggagcaagccaagaagcctcaggaagctgtgtttgtcccagagtgtggcgaggatggctcctttacccaggtgcagtgccatacttacactgggtactgctggtgtgtcaccccggatgggaagcccatcagtggctcttctgtgcagaataaaactcctgtatgttcaggttcagtcaccgacaagcccttgagccagggtaactcaggaaggaaagatgacgggtctaagccgacacccacgatggagacccagccggtgttcgatggagatgaaatcacagccccaactctatggattaaacacttggtgatcaaggactccaaactgaacaacaccaacataagaaattcagagaaagtctattcgtgtgaccaggagaggcagagtgccctggaagaggcccagcagaatccccgtgagggtattgtcatccctgaatgtgcccctgggggactctataagccagtgcaatgccaccagtccactggctactgctggtgtgtgctggtggacacagggcgcccgctgcctgggacctccacacgctacgtgatgcccagttgtgagagcgacgccagggccaagactacagaggcggatgaccccttcaaggacagggagctaccaggctgtccagaagggaagaaaatggagtttatcaccagcctactggatgctctcaccactgacatggttcaggccattaactcagcagcgcccactggaggtgggaggttctcagagccagaccccagccacaccctggaggagcgggtagtgcactggtatttcagccagctggacagcaatagcagcaacgacattaacaagcgggagatgaagcccttcaagcgctacgtgaagaagaaagccaagcccaagaaatgtgcccggcgtttcaccgactactgtgacctgaacaaagacaaggtcatttcactgcctgagctgaagggctgcctgggtgttagcaaagaaggacgcctcgtctaaggagcagaaaacccaagggcaggtggagagtccagggaggcaggatggatcaccagacacctaaccttcagcgttgcccatggccctgccacatcccgtgtaacataagtggtgcccaccatgtttgcacttttaataactcttacttgcgtgttttgtttttggtttcattttaaaacaccaatatctaataccacagtgggaaaaggaaagggaagaaagactttattctctctcttattgtaagtttttggatctgctactgacaacttttagagggttttgggggggtgggggagggtgttgttggggctgagaagaaagagatttatatgctgtatataaatatatatgtaaattgtatagttcttttgtacaggc

SEQ ID NO: 427548 - DNA, 2877 bp, Homo sapiens
gcctgctgccgcctgggccccgccgagcggagctagcgccgcgcgcagagcacacgctcgcgctccagctcccctcctgcgcggttcatgactgtgtcccctgaccgcagcctctgcgagcccccgccgcaggaccacggcccgctccccgccgccgcgagggccccgagcgaaggaaggaagggaggcgcgctgtgcgccccgcggagcccgcgaaccccgctcgctgccggctgcccagcctggctggcaccatgctgcccgcgcgctgcgcccgcctgctcacgccccacttgctgctggtgttggtgcagctgtcccctgctcgcggccaccgcaccacaggccccaggtttctaataagtgaccgtgacccacagtgcaacctccactgctccaggactcaacccaaacccatctgtgcctctgatggcaggtcctacgagtccatgtgtgagtaccagcgagccaagtgccgagacccgaccctgggcgtggtgcatcgaggtagatgcaaagatgctggccagagcaagtgtcgcctggagcgggctcaagccctggagcaagccaagaagcctcaggaagctgtgtttgtcccagagtgtggcgaggatggctcctttacccaggtgcagtgccatacttacactgggtactgctggtgtgtcaccccggatgggaagcccatcagtggctcttctgtgcagaataaaactcctgtatgttcaggttcagtcaccgacaagcccttgagccagggtaactcaggaaggaaagatgacgggtctaagccgacacccacgatggagacccagccggtgttcgatggagatgaaatcacagccccaactctatggattaaacacttggtgatcaaggactccaaactgaacaacaccaacataagaaattcagagaaagtctattcgtgtgaccaggagaggcagagtgccctggaagaggcccagcagaatccccgtgagggtattgtcatccctgaatgtgcccctgggggactctataagccagtgcaatgccaccagtccactggctactgctggtgtgtgctggtggacacagggcgcccgctgcctgggacctccacacgctacgtgatgcccagttgtgagagcgacgccagggccaagactacagaggcggatgaccccttcaaggacagggagctaccaggctgtccagaagggaagaaaatggagtttatcaccagcctactggatgctctcaccactgacatggttcaggccattaactcagcagcgcccactggaggtgggaggttctcagagccagaccccagccacaccctggaggagcgggtagtgcactggtatttcagccagctggacagcaatagcagcaacgacattaacaagcgggagatgaagcccttcaagcgctacgtgaagaagaaagccaagcccaagaaatgtgcccggcgtttcaccgactactgtgacctgaacaaagacaaggtcatttcactgcctgagctgaagggctgcctgggtgttagcaaagaaggacgcctcgtctaaggagcagaaaacccaagggcaggtggagagtccagggaggcaggatggatcaccagacacctaaccttcagcgttgcccatggccctgccacatcccgtgtaacataagtggtgcccaccatgtttgcacttttaataactcttacttgcgtgttttgtttttggtttcattttaaaacaccaatatctaataccacagtgggaaaaggaaagggaagaaagactttattctctctcttattgtaagtttttggatctgctactgacaacttttagagggttttgggggggtgggggagggtgttgttggggctgagaagaaagagatttatatgctgtatataaatatatatgtaaattgtatagttcttttgtacaggcattggcattgctgttgtttatttctctccctctgcctgctgtgggtggtgggcactctggacacatagtccagctttctaaaatccaggactctatcctgggcctactaaacttctgtttggagactgacccttgtgtataaagacgggagtcctgcaattgtactgcggactccacgagttcttttctggtgggaggactatattgccccatgccattagttgtcaaaattgataagtcacttggctctcggccttgtccagggaggttgggctaaggagagatggaaactgccctgggagaggaagggagtccagatcccatgaatagcccacacaggtaccggctctcagagggtccgtgcattcctgctctccggacccccaaagggcccagcattggtgggtgcaccagtatcttagtgaccctcggagcaaattatccacaaaggatttgcattacgtcactcgaaacgttttcatccatgcttagcatctactctgtataacgcatgagaggggaggcaaagaagaaaaagacacacagaagggcctttaaaaaagtagatatttaatatctaagcaggggaggggacaggacagaaagcctgcactgaggggtgcggtgccaacagggaaactcttcacctccctgcaaacctaccagtgaggctcccagagacgcagctgtctcagtgccaggggcagattgggtgtgacctctccactcctccatctcctgctgttgtcctggaggaagcatgcacacatggagacggcgcctgcctgtagatgtttggatcttcgagatctccccaggcatcttgtctcccacaggatcgtgtgtgtaggtggtgttgtgtggttttcctttgtgaaggagagagggaaactatttgtagcttgttttataaaaaataaaaaatgggtaaatcttg

SEQ ID NO: 427549 - DNA, 3723 bp, Homo sapiens
gcctgctgccgcctgggccccgccgagcggagctagcgccgcgcgcagagcacacgctcgcgctccagctcccctcctgcgcggttcatgactgtgtcccctgaccgcagcctctgcgagcccccgccgcaggaccacggcccgctccccgccgccgcgagggccccgagcgaaggaaggaagggaggcgcgctgtgcgccccgcggagcccgcgaaccccgctcgctgccggctgcccagcctggctggcaccatgctgcccgcgcgctgcgcccgcctgctcacgccccacttgctgctggtgttggtgcagctgtcccctgctcgcggccaccgcaccacaggccccaggtttctaataagtgaccgtgacccacagtgcaacctccactgctccaggactcaacccaaacccatctgtgcctctgatggcaggtcctacgagtccatgtgtgagtaccagcgagccaagtgccgagacccgaccctgggcgtggtgcatcgaggtagatgcaaagatgctggccagagcaagtgtcgcctggagcgggctcaagccctggagcaagccaagaagcctcaggaagctgtgtttgtcccagagtgtggcgaggatggctcctttacccaggtgcagtgccatacttacactgggtactgctggtgtgtcaccccggatgggaagcccatcagtggctcttctgtgcagaataaaactcctgtatgttcaggttcagtcaccgacaagcccttgagccagggtaactcaggaaggaaagatgacgggtctaagccgacacccacgatggagacccagccggtgttcgatggagatgaaatcacagccccaactctatggattaaacacttggtgatcaaggactccaaactgaacaacaccaacataagaaattcagagaaagtctattcgtgtgaccaggagaggcagagtgccctggaagaggcccagcagaatccccgtgagggtattgtcatccctgaatgtgcccctgggggactctataagccagtgcaatgccaccagtccactggctactgctggtgtgtgctggtggacacagggcgcccgctgcctgggacctccacacgctacgtgatgcccagttgtgagagcgacgccagggccaagactacagaggcggatgaccccttcaaggacagggagctaccaggctgtccagaagggaagaaaatggagtttatcaccagcctactggatgctctcaccactgacatggttcaggccattaactcagcagcgcccactggaggtgggaggttctcagagccagaccccagccacaccctggaggagcgggtagtgcactggtatttcagccagctggacagcaatagcagcaacgacattaacaagcgggagatgaagcccttcaagcgctacgtgaagaagaaagccaagcccaagaaatgtgcccggcgtttcaccgactactgtgacctgaacaaagacaaggtcatttcactgcctgagctgaagggctgcctgggtgttagcaaagaagcaggtggtagccttggcagtttcccccaggcaaaatgagcaggcacaaacccattcagacgcctcgtctaaggagcagaaaacccaagggcaggtggagagtccagggaggcaggatggatcaccagacacctaaccttcagcgttgcccatggccctgccacatcccgtgtaacataagtggtgcccaccatgtttgcacttttaataactcttacttgcgtgttttgtttttggtttcattttaaaacaccaatatctaataccacagtgggaaaaggaaagggaagaaagactttattctctctcttattgtaagtttttggatctgctactgacaacttttagagggttttgggggggtgggggagggtgttgttggggctgagaagaaagagatttatatgctgtatataaatatatatgtaaattgtatagttcttttgtacaggcattggcattgctgttgtttatttctctccctctgcctgctgtgggtggtgggcactctggacacatagtccagctttctaaaatccaggactctatcctgggcctactaaacttctgtttggagactgacccttgtgtataaagacgggagtcctgcaattgtactgcggactccacgagttcttttctggtgggaggactatattgccccatgccattagttgtcaaaattgataagtcacttggctctcggccttgtccagggaggttgggctaaggagagatggaaactgccctgggagaggaagggagtccagatcccatgaatagcccacacaggtaccggctctcagagggtccgtgcattcctgctctccggacccccaaagggcccagcattggtgggtgcaccagtatcttagtgaccctcggagcaaattatccacaaaggatttgcattacgtcactcgaaacgttttcatccatgcttagcatctactctgtataacgcatgagaggggaggcaaagaagaaaaagacacacagaagggcctttaaaaaagtagatatttaatatctaagcaggggaggggacaggacagaaagcctgcactgaggggtgcggtgccaacagggaaactcttcacctccctgcaaacctaccagtgaggctcccagagacgcagctgtctcagtgccaggggcagattgggtgtgacctctccactcctccatctcctgctgttgtcctagtggctatcacaggcctgggtgggtgggttgggggaggtgtcagtcaccttgttggtaacactaaagttgttttgttggttttttaaaaacccaatactgaggttcttcctgttccctcaagttttcttatgggcttccaggctttaagctaattccagaagtaaaactgatcttgggtttcctattctgcctcccctagaagggcaggggtgataacccagctacagggaaatcccggcccagctttccacaggcatcacaggcatcttccgcggattctagggtgggctgcccagccttctggtctgaggcgcagctccctctgcccaggtgctgtgcctattcaagtggccttcaggcagagcagcaagtggcccttagcgccccttcccataagcagctgtggtggcagtgagggaggttgggtagccctggactggtcccctcctcagatcacccttgcaaatctggcctcatcttgtattccaacccgacatccctaaaagtacctccacccgttccgggtctggaaggcgttggcaccacaagcactgtccctgtgggaggagcacaaccttctcgggacaggatctgatggggtcttgggctaaaggaggtccctgctgtcctggagaaagtcctagaggttatctcaggaatgactggtggccctgccccaacgtggaaaggtgggaaggaagccttctcccattagccccaatgagagaactcaacgtgccggagctgagtgggccttgcacgagacactggccccactttcaggcctggaggaagcatgcacacatggagacggcgcctgcctgtagatgtttggatcttcgagatctccccaggcatcttgtctcccacaggatcgtgtgtgtaggtggtgttgtgtggttttcctttgtgaaggagagagggaaactatttgtagcttgttttataaaaaataaaaaatgggtaaatcttg

SEQ ID NO: 427550 - DNA, 1997 bp, Homo sapiens
gcctgctgccgcctgggccccgccgagcggagctagcgccgcgcgcagagcacacgctcgcgctccagctcccctcctgcgcggttcatgactgtgtcccctgaccgcagcctctgcgagcccccgccgcaggaccacggcccgctccccgccgccgcgagggccccgagcgaaggaaggaagggaggcgcgctgtgcgccccgcggagcccgcgaaccccgctcgctgccggctgcccagcctggctggcaccatgctgcccgcgcgctgcgcccgcctgctcacgccccacttgctgctggtgttggtgcagctgtcccctgctcgcggccaccgcaccacaggccccaggtttctaataagtgaccgtgacccacagtgcaacctccactgctccaggactcaacccaaacccatctgtgcctctgatggcaggtcctacgagtccatgtgtgagtaccagcgagccaagtgccgagacccgaccctgggcgtggtgcatcgaggtagatgcaaagatgctggccagagcaagtgtcgcctggagcgggctcaagccctggagcaagccaagaagcctcaggaagctgtgtttgtcccagagtgtggcgaggatggctcctttacccaggtgcagtgccatacttacactgggtactgctggtgtgtcaccccggatgggaagcccatcagtggctcttctgtgcagaataaaactcctgtatgttcaggttcagtcaccgacaagcccttgagccagggtaactcaggaaggaaagatgacgggtctaagccgacacccacgatggagacccagccggtgttcgatggagatgaaatcacagccccaactctatggattaaacacttggtgatcaaggactccaaactgaacaacaccaacataagaaattcagagaaagtctattcgtgtgaccaggagaggcagagtgccctggaagaggcccagcagaatccccgtgagggtattgtcatccctgaatgtgcccctgggggactctataagccagtgcaatgccaccagtccactggctactgctggtgtgtgctggtggacacagggcgcccgctgcctgggacctccacacgctacgtgatgcccagttgtgagagcgacgccagggccaagactacagaggcggatgaccccttcaaggacagggagctaccaggctgtccagaagggaagaaaatggagtttatcaccagcctactggatgctctcaccactgacatggttcaggccattaactcagcagcgcccactggaggtgggaggttctcagagccagaccccagccacaccctggaggagcgggtagtgcactggtatttcagccagctggacagcaatagcagcaacgacattaacaagcgggagatgaagcccttcaagcgctacgtgaagaagaaagccaagcccaagaaatgtgcccggcgtttcaccgactactgtgacctgaacaaagacaaggtcatttcactgcctgagctgaagggctgcctgggtgttagcaaagaagcaggtggtagccttggcagtttcccccaggcaaaatgagcaggcacaaacccattcagacgcctcgtctaaggagcagaaaacccaagggcaggtggagagtccagggaggcaggatggatcaccagacacctaaccttcagcgttgcccatggccctgccacatcccgtgtaacataagtggtgcccaccatgtttgcacttttaataactcttacttgcgtgttttgtttttggtttcattttaaaacaccaatatctaataccacagtgggaaaaggaaagggaagaaagactttattctctctcttattgtaagtttttggatctgctactgacaacttttagagggttttgggggggtgggggagggtgttgttggggctgagaagaaagagatttatatgctgtatataaatatatatgtaaattgtatagttcttttgtacaggc

SEQ ID NO: 427551 - DNA, 3818 bp, Homo sapiens
  misc_feature (3669)..(3669): n is a, c, g, or t
gcctgctgccgcctgggccccgccgagcggagctagcgccgcgcgcagagcacacgctcgcgctccagctcccctcctgcgcggttcatgactgtgtcccctgaccgcagcctctgcgagcccccgccgcaggaccacggcccgctccccgccgccgcgagggccccgagcgaaggaaggaagggaggcgcgctgtgcgccccgcggagcccgcgaaccccgctcgctgccggctgcccagcctggctggcaccatgctgcccgcgcgctgcgcccgcctgctcacgccccacttgctgctggtgttggtgcagctgtcccctgctcgcggccaccgcaccacaggccccaggtttctaataagtgaccgtgacccacagtgcaacctccactgctccaggactcaacccaaacccatctgtgcctctgatggcaggtcctacgagtccatgtgtgagtaccagcgagccaagtgccgagacccgaccctgggcgtggtgcatcgaggtagatgcaaagatgctggccagagcaagtgtcgcctggagcgggctcaagccctggagcaagccaagaagcctcaggaagctgtgtttgtcccagagtgtggcgaggatggctcctttacccaggtgcagtgccatacttacactgggtactgctggtgtgtcaccccggatgggaagcccatcagtggctcttctgtgcagaataaaactcctgtatgttcaggttcagtcaccgacaagcccttgagccagggtaactcaggaaggaaagatgacgggtctaagccgacacccacgatggagacccagccggtgttcgatggagatgaaatcacagccccaactctatggattaaacacttggtgatcaaggactccaaactgaacaacaccaacataagaaattcagagaaagtctattcgtgtgaccaggagaggcagagtgccctggaagaggcccagcagaatccccgtgagggtattgtcatccctgaatgtgcccctgggggactctataagccagtgcaatgccaccagtccactggctactgctggtgtgtgctggtggacacagggcgcccgctgcctgggacctccacacgctacgtgatgcccagttgtgagagcgacgccagggccaagactacagaggcggatgaccccttcaaggacagggagctaccaggctgtccagaagggaagaaaatggagtttatcaccagcctactggatgctctcaccactgacatggttcaggccattaactcagcagcgcccactggaggtgggaggttctcagagccagaccccagccacaccctggaggagcgggtagtgcactggtatttcagccagctggacagcaatagcagcaacgacattaacaagcgggagatgaagcccttcaagcgctacgtgaagaagaaagccaagcccaagaaatgtgcccggcgtttcaccgactactgtgacctgaacaaagacaaggtcatttcactgcctgagctgaagggctgcctgggtgttagcaaagaaggacgcctcgtctaaggagcagaaaacccaagggcaggtggagagtccagggaggcaggatggatcaccagacacctaaccttcagcgttgcccatggccctgccacatcccgtgtaacataagtggtgcccaccatgtttgcacttttaataactcttacttgcgtgttttgtttttggtttcattttaaaacaccaatatctaataccacagtgggaaaaggaaagggaagaaagactttattctctctcttattgtaagtttttggatctgctactgacaacttttagagggttttgggggggtgggggagggtgttgttggggctgagaagaaagagatttatatgctgtatataaatatatatgtaaattgtatagttcttttgtacaggcattggcattgctgttgtttatttctctccctctgcctgctgtgggtggtgggcactctggacacatagtccagctttctaaaatccaggactctatcctgggcctactaaacttctgtttggagactgacccttgtgtataaagacgggagtcctgcaattgtactgcggactccacgagttcttttctggtgggaggactatattgccccatgccattagttgtcaaaattgataagtcacttggctctcggccttgtccagggaggttgggctaaggagagatggaaactgccctgggagaggaagggagtccagatcccatgaatagcccacacaggtaccggctctcagagggtccgtgcattcctgctctccggacccccaaagggcccagcattggtgggtgcaccagtatcttagtgaccctcggagcaaattatccacaaaggatttgcattacgtcactcgaaacgttttcatccatgcttagcatctactctgtataacgcatgagaggggaggcaaagaagaaaaagacacacagaagggcctttaaaaaagtagatatttaatatctaagcaggggaggggacaggacagaaagcctgcactgaggggtgcggtgccaacagggaaactcttcacctccctgcaaacctaccagtgaggctcccagagacgcagctgtctcagtgccaggggcagattgggtgtgacctctccactcctccatctcctgctgttgtcctagtggctatcacaggcctgggtgggtgggttgggggaggtgtcagtcaccttgttggtaacactaaagttgttttgttggttttttaaaaacccaatactgaggttcttcctgttccctcaagttttcttatgggcttccaggctttaagctaattccagaagtaaaactgatcttgggtttcctattctgcctcccctagaagggcaggggtgataacccagctacagggaaatcccggcccagctttccacaggcatcacaggcatcttccgcggattctagggtgggctgcccagccttctggtctgaggcgcagctccctctgcccaggtgctgtgcctattcaagtggccttcaggcagagcagcaagtggcccttagcgccccttcccataagcagctgtggtggcagtgagggaggttgggtagccctggactggtcccctcctcagatcacccttgcaaatctggcctcatcttgtattccaacccgacatccctaaaagtacctccacccgttccgggtctggaaggcgttggcaccacaagcactgtccctgtgggaggagcacaaccttctcgggacaggatctgatggggtcttgggctaaaggaggtccctgctgtcctggagaaagtcctagaggttatctcaggaatgactggtggccctgccccaacgtggaaaggtgggaaggaagccttctcccattagccccaatgagagaactcaacgtgccggagctgagtgggccttgcacgagacactggccccactttcaggcctggaggaagcatgcacacatggagacggcgcctgcctgtagatgtttggatcttcgagatctccccaggcatcttgtctcccacaggatcgtgtgtgtaggtggtgttgtgtggttttcctttgtgaaggagagagggaaactatttgtagcttgttttataaaaaataaaaaatgggtaaatcttgacncaaaaacacaaaccccaaccaccacaacaaaacaaaacaaaggggcgccacacagagagacccacccagggggggaccaaagtagaggtaaccacgcagaagcgggacaaacgagaggccacaaagaggcgaggcataaagcgaccgag

SEQ ID NO: 427552 - DNA, 2992 bp, Homo sapiens
gttgtgaggaagggaggggaactgggaggagtggatgtgggagagagctgaagcctcaatgcctcagactttgaaaaatgactattaagaagtctgaggttacacttccactcacatagtctctttgcccagactttttctctctccttttcctcacccctagaaatcacagccccaactctatggattaaacacttggtgatcaaggactccaaactgaacaacaccaacataagaaattcagagaaagtctattcgtgtgaccaggagaggcagagtgccctggaagaggcccagcagaatccccgtgagggtattgtcatccctgaatgtgcccctgggggactctataagccagtgcaatgccaccagtccactggctactgctggtgtgtgctggtggacacagggcgcccgctgcctgggacctccacacgctacgtgatgcccagttgtgagagcgacgccagggccaagactacagaggcggatgaccccttcaaggacagggagctaccaggctgtccagaagggaagaaaatggagtttatcaccagcctactggatgctctcaccactgacatggttcaggccattaactcagcagcgcccactggaggtgggaggttctcagagccagaccccagccacaccctggaggagcgggtagtgcactggtatttcagccagctggacagcaatagcagcaacgacattaacaagcgggagatgaagcccttcaagcgctacgtgaagaagaaagccaagcccaagaaatgtgcccggcgtttcaccgactactgtgacctgaacaaagacaaggtcatttcactgcctgagctgaagggctgcctgggtgttagcaaagaaggacgcctcgtctaaggagcagaaaacccaagggcaggtggagagtccagggaggcaggatggatcaccagacacctaaccttcagcgttgcccatggccctgccacatcccgtgtaacataagtggtgcccaccatgtttgcacttttaataactcttacttgcgtgttttgtttttggtttcattttaaaacaccaatatctaataccacagtgggaaaaggaaagggaagaaagactttattctctctcttattgtaagtttttggatctgctactgacaacttttagagggttttgggggggtgggggagggtgttgttggggctgagaagaaagagatttatatgctgtatataaatatatatgtaaattgtatagttcttttgtacaggcattggcattgctgttgtttatttctctccctctgcctgctgtgggtggtgggcactctggacacatagtccagctttctaaaatccaggactctatcctgggcctactaaacttctgtttggagactgacccttgtgtataaagacgggagtcctgcaattgtactgcggactccacgagttcttttctggtgggaggactatattgccccatgccattagttgtcaaaattgataagtcacttggctctcggccttgtccagggaggttgggctaaggagagatggaaactgccctgggagaggaagggagtccagatcccatgaatagcccacacaggtaccggctctcagagggtccgtgcattcctgctctccggacccccaaagggcccagcattggtgggtgcaccagtatcttagtgaccctcggagcaaattatccacaaaggatttgcattacgtcactcgaaacgttttcatccatgcttagcatctactctgtataacgcatgagaggggaggcaaagaagaaaaagacacacagaagggcctttaaaaaagtagatatttaatatctaagcaggggaggggacaggacagaaagcctgcactgaggggtgcggtgccaacagggaaactcttcacctccctgcaaacctaccagtgaggctcccagagacgcagctgtctcagtgccaggggcagattgggtgtgacctctccactcctccatctcctgctgttgtcctagtggctatcacaggcctgggtgggtgggttgggggaggtgtcagtcaccttgttggtaacactaaagttgttttgttggttttttaaaaacccaatactgaggttcttcctgttccctcaagttttcttatgggcttccaggctttaagctaattccagaagtaaaactgatcttgggtttcctattctgcctcccctagaagggcaggggtgataacccagctacagggaaatcccggcccagctttccacaggcatcacaggcatcttccgcggattctagggtgggctgcccagccttctggtctgaggcgcagctccctctgcccaggtgctgtgcctattcaagtggccttcaggcagagcagcaagtggcccttagcgccccttcccataagcagctgtggtggcagtgagggaggttgggtagccctggactggtcccctcctcagatcacccttgcaaatctggcctcatcttgtattccaacccgacatccctaaaagtacctccacccgttccgggtctggaaggcgttggcaccacaagcactgtccctgtgggaggagcacaaccttctcgggacaggatctgatggggtcttgggctaaaggaggtccctgctgtcctggagaaagtcctagaggttatctcaggaatgactggtggccctgccccaacgtggaaaggtgggaaggaagccttctcccattagccccaatgagagaactcaacgtgccggagctgagtgggccttgcacgagacactggccccactttcaggcctggaggaagcatgcacacatggagacggcgcctgcctgtagatgtttggatcttcgagatctccccaggcatcttgtctcccacaggatcgtgtgtgtaggtggtgttgtgtggttttcctttgtgaaggagagagggaaactatttgtagcttgttttataaaaaataaaaaatgggtaaatcttg

SEQ ID NO: 427553 - DNA, 2459 bp, Homo sapiens
cggtgggtcgttctcagagccagaccccagccacaccctggaggagcgggtagtgcactggtatttcagccagctggacagcaatagcagaacgttctcagagccagaccccagccacaccctggaggagcgggtagtgcactggtatttcagccagctggacagcaatagcagcaacgacattaacaagcgggagatgaagcccttcaagcgctacgtgaagaagaaagccaagcccaagaaatgtgcccggcgtttcaccgactactgtgacctgaacaaagacaaggtcatttcactgcctgagctgaagggctgcctgggtgttagcaaagaaggacgcctcgtctaaggagcagaaaacccaagggcaggtggagagtccagggaggcaggatggatcaccagacacctaaccttcagcgttgcccatggccctgccacatcccgtgtaacataagtggtgcccaccatgtttgcacttttaataactcttacttgcgtgttttgtttttggtttcattttaaaacaccaatatctaataccacagtgggaaaaggaaagggaagaaagactttattctctctcttattgtaagtttttggatctgctactgacaacttttagagggttttgggggggtgggggagggtgttgttggggctgagaagaaagagatttatatgctgtatataaatatatatgtaaattgtatagttcttttgtacaggcattggcattgctgttgtttatttctctccctctgcctgctgtgggtggtgggcactctggacacatagtccagctttctaaaatccaggactctatcctgggcctactaaacttctgtttggagactgacccttgtgtataaagacgggagtcctgcaattgtactgcggactccacgagttcttttctggtgggaggactatattgccccatgccattagttgtcaaaattgataagtcacttggctctcggccttgtccagggaggttgggctaaggagagatggaaactgccctgggagaggaagggagtccagatcccatgaatagcccacacaggtaccggctctcagagggtccgtgcattcctgctctccggacccccaaagggcccagcattggtgggtgcaccagtatcttagtgaccctcggagcaaattatccacaaaggatttgcattacgtcactcgaaacgttttcatccatgcttagcatctactctgtataacgcatgagaggggaggcaaagaagaaaaagacacacagaagggcctttaaaaaagtagatatttaatatctaagcaggggaggggacaggacagaaagcctgcactgaggggtgcggtgccaacagggaaactcttcacctccctgcaaacctaccagtgaggctcccagagacgcagctgtctcagtgccaggggcagattgggtgtgacctctccactcctccatctcctgctgttgtcctagtggctatcacaggcctgggtgggtgggttgggggaggtgtcagtcaccttgttggtaacactaaagttgttttgttggttttttaaaaacccaatactgaggttcttcctgttccctcaagttttcttatgggcttccaggctttaagctaattccagaagtaaaactgatcttgggtttcctattctgcctcccctagaagggcaggggtgataacccagctacagggaaatcccggcccagctttccacaggcatcacaggcatcttccgcggattctagggtgggctgcccagccttctggtctgaggcgcagctccctctgcccaggtgctgtgcctattcaagtggccttcaggcagagcagcaagtggcccttagcgccccttcccataagcagctgtggtggcagtgagggaggttgggtagccctggactggtcccctcctcagatcacccttgcaaatctggcctcatcttgtattccaacccgacatccctaaaagtacctccacccgttccgggtctggaaggcgttggcaccacaagcactgtccctgtgggaggagcacaaccttctcgggacaggatctgatggggtcttgggctaaaggaggtccctgctgtcctggagaaagtcctagaggttatctcaggaatgactggtggccctgccccaacgtggaaaggtgggaaggaagccttctcccattagccccaatgagagaactcaacgtgccggagctgagtgggccttgcacgagacactggccccactttcaggcctggaggaagcatgcacacatggagacggcgcctgcctgtagatgtttggatcttcgagatctccccaggcatcttgtctcccacaggatcgtgtgtgtaggtggtgttgtgtggttttcctttgtgaaggagagagggaaactatttgtagcttgttttataaaaaataaaaaatgggtaaatcttg

SEQ ID NO: 427554 - DNA, 2080 bp, Homo sapiens
gaatacaaaagctagtttcacattaagaactagaagtgacactgctgttttctcaccagcagaatactaacttttcaagtcccattcatattacgacaaaaaagaatggcttcacaaatctcattcattttataagtagcatcatcttcatcttaaaaatataagtcatctaattgtttacagtgttacacactgttcaaagaaccacatagctctgattccttccttccaaaaatttacattccaaggaagatatactgatgtgaagactcaccaaatgcagacaagaactattaaaagtaccccatggatggacctccaaatgagtttagggtaattgcgcttaaaatattaggaccaaagtacatttattttatagatggaggaggggaggagacgagtggggaccagcttgacatccagtcttcacctggacatatggaaagaacaaatgtgcgatctgctcgttccctctgaaggtctctgttacgtatttcctcctctcctccagagcataataaccaatgactgctctcagaaaggtactgtgaccaccacttgcttggctctccaacttcctcccccatttccctcttgactcctgtttgccataacaccttctgtcccctagccttgcctcaggtccccgacgaatcctgcccttaatctgtgggggtggtaggtggcactggtttgaagagcttactggatctccctcagtgagtcagcctggagttgtgtttgaaaaccacaggccctgactgtggctgtcagacctcccagacaccacctgctgctgcctatcatcatcttcaggtgctgggctcccctgtgggcctcgtctgcccgccctctgctgcagctgtcccatgggcgcccgccctctctgacaccacaagagagcccatctagattccaggaaaaaactcatctttatttgccttcttcccactgaaggtaaaagcaacattaataaccacaacaaatacttagtgagtgcttactattattcatttaattgttggcccttccatccctggccatgatgagagacatgccatagcttactcctaaagagacctgaggacacacgtgcacaaacatattgggcatatcatcaatggcatcaaaactgattttccctgtctacccagaacaggcctgagggagagggaaaagcggatacccacctgtgtcgctgtttgcgtgccaagtccaggaacagtccatacagccctgctgcatcccacgacgctgtcacaaagcaggagttcatccgaggccaagatggagaaactgaggcccagaaattgatgtccagaatgctttgctcttagccactgtactattatggcatattttatctttatgtattgcatcatttcatggattcaagtttatcaatgtcctttgacaagtttaaaaatctgtctgctaaaatctatcaaatacattaaggaaaagtcccacttggcacatctcccacaccagatgttaattattcatactgcatgactgaggattttggaggcagagagagattcatctgcaatatttggaacaccaatggaggtctacgtcaacacagaatttatacagcagctggtgctagtcagagctaatgacagaatttcagtttaataaaaagacccccaactgagcacaccatcttgaaaaaagtatacttatcaaacagctttcaatcagttcaagagagacaccttaattggggagaggaagaattgcagagtagtttgtaatcatgccaattccagatcaataactgcatgtctgttctttggtagaaatagcttttgctttatattaagtaatcacatatatattctctctatttggataaggaaaccttcgctttatttgacaatgtataatgatatactcttctaattcacctctgtgtcttcacaataaacatgagtaaaatttagacaagtgatggtaaaggtcaatataattatttatttttaaaataaattttgtatctaacaggaaagcagttcttatgaaatttttatattttcaaaaattgttttgttcaaataaaattttatgagtaaag

SEQ ID NO: 427555 - DNA, 1610 bp, Homo sapiens
agggatcccgggctgctgccgctaccaacaagggtacacactgcggtcctcaaggccaggaggggggtgggggcagggaatgcctcagccaacagggcagcggctcggccctgctgctggcccggtgggaagtagcctggggccccgcgactgaaatccgagccaggcctgggcagtctccgctagaaacgctctgggcgcgcactcctggagacgcggaggcccgggcgctccagaccagtgtccttgtaggaggcttcttcacgaagcttagagtttggcctttcatagggaaagacttgctcgggagcaagtctaagggattttaagggattttaaatcttcctgggccagggctagggagctctagtgacagtgtcttggtctggaatccaactctccaattttgaggccgcagggaggaattctgagactttagaggccgcacagccttcagcgcgctcaccgcgtccaggcgtcagtgaggggctatctcgaggcgcgagtgcacaaaaggtagcgcgagtctcttctcaggcgatccagataagaggaaatgagagccgggttttctgacttccaactcattagggaccaggttctttttcttcaggatcaggcacagagactgactgaatggctccaattatcaggatttgaaaacccagtatcagaatctaccactttgtgcctgagggagagggaaaagcggatacccacctgtgtcgctgtttgcgtgccaagtccaggaacagtccatacagccctgctgcatcccacgacgctgtcacaaagcaggagttcatccgaggccaagatggagaaactgaggcccagaaattgatgtccagaatgctttgctcttagccactgtactattatggcatattttatctttatgtattgcatcatttcatggattcaagtttatcaatgtcctttgacaagtttaaaaatctgtctgctaaaatctatcaaatacattaaggaaaagtcccacttggcacatctcccacaccagatgttaattattcatactgcatgactgaggattttggaggcagagagagattcatctgcaatatttggaacaccaatggaggtctacgtcaacacagaatttatacagcagctggtgctagtcagagctaatgacagaatttcagtttaataaaaagacccccaactgagcacaccatcttgaaaaaagtatacttatcaaacagctttcaatcagttcaagagagacaccttaattggggagaggaagaattgcagagtagtttgtaatcatgccaattccagatcaataactgcatgtctgttctttggtagaaatagcttttgctttatattaagtaatcacatatatattctctctatttggataaggaaaccttcgctttatttgacaatgtataatgatatactcttctaattcacctctgtgtcttcacaataaacatgagtaaaatttagacaagtgatggtaaaggtcaatataattatttatttttaaaataaattttgtatctaacaggaaagcagttcttatgaaatttttatattttcaaaaattgttttgttcaaataaaattttatgagtaaag

SEQ ID NO: 427556 - DNA, 1983 bp, Homo sapiens
gaatacaaaagctagtttcacattaagaactagaagtgacactgctgttttctcaccagcagaatactaacttttcaagtcccattcatattacgacaaaaaagaatggcttcacaaatctcattcattttataagtagcatcatcttcatcttaaaaatataagtcatctaattgtttacagtgttacacactgttcaaagaaccacatagctctgattccttccttccaaaaatttacattccaaggaagatatactgatgtgaagactcaccaaatgcagacaagaactattaaaagtaccccatggatggacctccaaatgagtttagggtaattgcgcttaaaatattaggaccaaagtacatttattttatagatggaggaggggaggagacgagtggggaccagcttgacatccagtcttcacctggacatatggaaagaacaaatgtgcgatctgctcgttccctctgaaggtctctgttacgtatttcctcctctcctccagagcataataaccaatgactgctctcagaaaggtactgtgaccaccacttgcttggctctccaacttcctcccccatttccctcttgactcctgtttgccataacaccttctgtcccctagccttgcctcaggtccccgacgaatcctgcccttaatctgtgggggtggtaggtggcactggtttgaagagcttactggatctccctcagtgctgggctcccctgtgggcctcgtctgcccgccctctgctgcagctgtcccatgggcgcccgccctctctgacaccacaagagagcccatctagattccaggaaaaaactcatctttatttgccttcttcccactgaaggtaaaagcaacattaataaccacaacaaatacttagtgagtgcttactattattcatttaattgttggcccttccatccctggccatgatgagagacatgccatagcttactcctaaagagacctgaggacacacgtgcacaaacatattgggcatatcatcaatggcatcaaaactgattttccctgtctacccagaacaggcctgagggagagggaaaagcggatacccacctgtgtcgctgtttgcgtgccaagtccaggaacagtccatacagccctgctgcatcccacgacgctgtcacaaagcaggagttcatccgaggccaagatggagaaactgaggcccagaaattgatgtccagaatgctttgctcttagccactgtactattatggcatattttatctttatgtattgcatcatttcatggattcaagtttatcaatgtcctttgacaagtttaaaaatctgtctgctaaaatctatcaaatacattaaggaaaagtcccacttggcacatctcccacaccagatgttaattattcatactgcatgactgaggattttggaggcagagagagattcatctgcaatatttggaacaccaatggaggtctacgtcaacacagaatttatacagcagctggtgctagtcagagctaatgacagaatttcagtttaataaaaagacccccaactgagcacaccatcttgaaaaaagtatacttatcaaacagctttcaatcagttcaagagagacaccttaattggggagaggaagaattgcagagtagtttgtaatcatgccaattccagatcaataactgcatgtctgttctttggtagaaatagcttttgctttatattaagtaatcacatatatattctctctatttggataaggaaaccttcgctttatttgacaatgtataatgatatactcttctaattcacctctgtgtcttcacaataaacatgagtaaaatttagacaagtgatggtaaaggtcaatataattatttatttttaaaataaattttgtatctaacaggaaagcagttcttatgaaatttttatattttcaaaaattgttttgttcaaataaaattttatgagtaaag

SEQ ID NO: 427557 - DNA, 1876 bp, Homo sapiens
gaatacaaaagctagtttcacattaagaactagaagtgacactgctgttttctcaccagcagaatactaacttttcaagtcccattcatattacgacaaaaaagaatggcttcacaaatctcattcattttataagtagcatcatcttcatcttaaaaatataagtcatctaattgtttacagtgttacacactgttcaaagaaccacatagctctgattccttccttccaaaaatttacattccaaggaagatatactgatgtgaagactcaccaaatgcagacaagaactattaaaagtaccccatggatggacctccaaatgagtttagggtaattgcgcttaaaatattaggaccaaagtacatttattttatagatggaggaggggaggagacgagtggggaccagcttgacatccagtcttcacctggacatatggaaagaacaaatgtgcgatctgctcgttccctctgaaggtctctgttacgtatttcctcctctcctccagagcataataaccaatgactgctctcagaaaggtactgtgaccaccacttgcttggctctccaacttcctcccccatttccctcttgactcctgtttgccataacaccttctgtcccctagccttgcctcaggtccccgacgaatcctgcccttaatctgtgggggtggtaggtggcactggtttgaagagcttactggatctccctcagtgagtcagcctggagttgtgtttgaaaaccacaggccctgactgtggctgtcagacctcccagacaccacctgctgctgcctatcatcatcttcaggtgctgggctcccctgtgggcctcgtctgcccgccctctgctgcagctgtcccatgggcgcccgccctctctgacaccacaagagagcccatctagattccaggaaaaaactcatctttatttgccttcttcccactgaaggtaaaagcaacattaataaccacaacaaatacttagtgagtgcttactattattcatttaattgttggcccttccatccctggccatgatgagagacatgccatagcttactcctaaagagacctgaggacacacgtgcacaaacatattgggcatatcatcaatggcatcaaaactgattttccctgtctacccagaacaggcctgagggagagggaaaagcggatacccacctgtgtcgctgtttgcgtgccaagtccaggaacagtccatacagccctgctgcatcccacgacgctgtcacaaagcaggagttcatccgaggccaagatgttaattattcatactgcatgactgaggattttggaggcagagagagattcatctgcaatatttggaacaccaatggaggtctacgtcaacacagaatttatacagcagctggtgctagtcagagctaatgacagaatttcagtttaataaaaagacccccaactgagcacaccatcttgaaaaaagtatacttatcaaacagctttcaatcagttcaagagagacaccttaattggggagaggaagaattgcagagtagtttgtaatcatgccaattccagatcaataactgcatgtctgttctttggtagaaatagcttttgctttatattaagtaatcacatatatattctctctatttggataaggaaaccttcgctttatttgacaatgtataatgatatactcttctaattcacctctgtgtcttcacaataaacatgagtaaaatttagacaagtgatggtaaaggtcaatataattatttatttttaaaataaattttgtatctaacaggaaagcagttcttatgaaatttttatattttcaaaaattgttttgttcaaataaaattttatgagtaaag

SEQ ID NO: 427558 - DNA, 1482 bp, Homo sapiens
agggatcccgggctgctgccgctaccaacaagggtacacactgcggtcctcaaggccaggaggggggtgggggcagggaatgcctcagccaacagggcagcggctcggccctgctgctggcccggtgggaagtagcctggggccccgcgactgaaatccgagccaggcctgggcagtctccgctagaaacgctctgggcgcgcactcctggagacgcggaggcccgggcgctccagaccagtgtccttgtaggaggcttcttcacgaagcttagagtttggcctttcatagggaaagacttgctcgggagcaagtctaagggattttaagggattttaaatcttcctgggccagggctagggagctctagtgacagtgtcttggtctggaatccaactctccaattttgaggccgcagggaggaattctgagactttagaggccgcacagccttcagcgcgctcaccgcgtccaggcgtcagtgaggggctatctcgaggcgcgagtgcacaaaaggtagcgcgagtctcttctcaggcgatccagataagaggaaatgagagccgggttttctgacttccaactcattagggaccaggttctttttcttcaggatcaggcacagagactgactgaatggctccaattatcaggatttgaaaacccagtatcagaatctaccactttgtatggagaaactgaggcccagaaattgatgtccagaatgctttgctcttagccactgtactattatggcatattttatctttatgtattgcatcatttcatggattcaagtttatcaatgtcctttgacaagtttaaaaatctgtctgctaaaatctatcaaatacattaaggaaaagtcccacttggcacatctcccacaccagatgttaattattcatactgcatgactgaggattttggaggcagagagagattcatctgcaatatttggaacaccaatggaggtctacgtcaacacagaatttatacagcagctggtgctagtcagagctaatgacagaatttcagtttaataaaaagacccccaactgagcacaccatcttgaaaaaagtatacttatcaaacagctttcaatcagttcaagagagacaccttaattggggagaggaagaattgcagagtagtttgtaatcatgccaattccagatcaataactgcatgtctgttctttggtagaaatagcttttgctttatattaagtaatcacatatatattctctctatttggataaggaaaccttcgctttatttgacaatgtataatgatatactcttctaattcacctctgtgtcttcacaataaacatgagtaaaatttagacaagtgatggtaaaggtcaatataattatttatttttaaaataaattttgtatctaacaggaaagcagttcttatgaaatttttatattttcaaaaattgttttgttcaaataaaattttatgagtaaag

SEQ ID NO: 427559 - DNA, 1406 bp, Homo sapiens
agggatcccgggctgctgccgctaccaacaagggtacacactgcggtcctcaaggccaggaggggggtgggggcagggaatgcctcagccaacagggcagcggctcggccctgctgctggcccggtgggaagtagcctggggccccgcgactgaaatccgagccaggcctgggcagtctccgctagaaacgctctgggcgcgcactcctggagacgcggaggcccgggcgctccagaccagtgtccttgtaggaggcttcttcacgaagcttagagtttggcctttcatagggaaagacttgctcgggagcaagtctaagggattttaagggattttaaatcttcctgggccagggctagggagctctagtgacagtgtcttggtctggaatccaactctccaattttgaggccgcagggaggaattctgagactttagaggccgcacagccttcagcgcgctcaccgcgtccaggcgtcagtgaggggctatctcgaggcgcgagtgcacaaaaggtagcgcgagtctcttctcaggcgatccagataagaggaaatgagagccgggttttctgacttccaactcattagggaccaggttctttttcttcaggatcaggcacagagactgactgaatggctccaattatcaggatttgaaaacccagtatcagaatctaccactttgtgcctgagggagagggaaaagcggatacccacctgtgtcgctgtttgcgtgccaagtccaggaacagtccatacagccctgctgcatcccacgacgctgtcacaaagcaggagttcatccgaggccaagatgttaattattcatactgcatgactgaggattttggaggcagagagagattcatctgcaatatttggaacaccaatggaggtctacgtcaacacagaatttatacagcagctggtgctagtcagagctaatgacagaatttcagtttaataaaaagacccccaactgagcacaccatcttgaaaaaagtatacttatcaaacagctttcaatcagttcaagagagacaccttaattggggagaggaagaattgcagagtagtttgtaatcatgccaattccagatcaataactgcatgtctgttctttggtagaaatagcttttgctttatattaagtaatcacatatatattctctctatttggataaggaaaccttcgctttatttgacaatgtataatgatatactcttctaattcacctctgtgtcttcacaataaacatgagtaaaatttagacaagtgatggtaaaggtcaatataattatttatttttaaaataaattttgtatctaacaggaaagcagttcttatgaaatttttatattttcaaaaattgttttgttcaaataaaattttatgagtaaag

SEQ ID NO: 427560 - DNA, 1025 bp, Homo sapiens
accttgattacagtgttgtgagactctaagcagagggcccatctaagccatgcccttacctagaaactgtaagataataagtagttgttgtttagagccacaaagtatgcagtaatttgttacgcagaaatagaaaacaaatacacggtgctgtgctaatgatcacatgcatgatctcttagtgcttcaagtaacgtcataagcccgatactaatattatcttcatttacagatggagaaactgaggcccagaaattgatgtccagaatgctttgctcttagccactgtactattatggcatattttatctttatgtattgcatcatttcatggattcaagtttatcaatgtcctttgacaagtttaaaaatctgtctgctaaaatctatcaaatacattaaggaaaagtcccacttggcacatctcccacaccagatgttaattattcatactgcatgactgaggattttggaggcagagagagattcatctgcaatatttggaacaccaatggaggtctacgtcaacacagaatttatacagcagctggtgctagtcagagctaatgacagaatttcagtttaataaaaagacccccaactgagcacaccatcttgaaaaaagtatacttatcaaacagctttcaatcagttcaagagagacaccttaattggggagaggaagaattgcagagtagtttgtaatcatgccaattccagatcaataactgcatgtctgttctttggtagaaatagcttttgctttatattaagtaatcacatatatattctctctatttggataaggaaaccttcgctttatttgacaatgtataatgatatactcttctaattcacctctgtgtcttcacaataaacatgagtaaaatttagacaagtgatggtaaaggtcaatataattatttatttttaaaataaattttgtatctaacaggaaagcagttcttatgaaatttttatattttcaaaaattgttttgttcaaataaaattttatgagtaaag

SEQ ID NO: 427561 - DNA, 1417 bp, Homo sapiens
gaatacaaaagctagtttcacattaagaactagaagtgacactgctgttttctcaccagcagaatactaacttttcaagtcccattcatattacgacaaaaaagaatggcttcacaaatctcattcattttataagtagcatcatcttcatcttaaaaatataagtcatctaattgtttacagtgttacacactgttcaaagaaccacatagctctgattccttccttccaaaaatttacattccaaggaagatatactgatgtgaagactcaccaaatgcagacaagaactattaaaagtaccccatggatggacctccaaatgagtttagggtaattgcgcttaaaatattaggaccaaagtacatttattttatagatggaggaggggaggagacgagtggggaccagcttgacatccagtcttcacctggacatatggaaagaacaaatgtgcgatctgctcgttccctctgaaggtctctgttacgtatttcctcctctcctccagagcataataaccaatgactgctctcagaaaggtactgtgaccaccacttgcttggctctccaacttcctcccccatttccctcttgactcctgtttgccataacaccttctgtcccctagccttgcctcaggtccccgacgaatcctgcccttaatctgtgggggtggtaggtggcactggtttgaagagcttactggatctccctcagtgagtcagcctggagttgtgtttgaaaaccacaggccctgactgtggctgtcagacctcccagacaccacctgctgctgcctatcatcatcttcaggtgctgggctcccctgtgggcctcgtctgcccgccctctgctgcagctgtcccatgggcgcccgccctctctgacaccacaagagagcccatctagattccaggaaaaaactcatctttatttgccttcttcccactgaaggtaaaagcaacattaataaccacaacaaatacttagtgagtgcttactattattcatttaattgttggcccttccatccctggccatgatgagagacatgccatagcttactcctaaagagacctgaggacacacgtgcacaaacatattgggcatatcatcaatggcatcaaaactgattttccctgtctacccagaacaggcctgagggagagggaaaagcggatacccacctgtgtcgctgtttgcgtgccaagtccaggaacagtccatacagccctgctgcatcccacgacgctgtcacaaagcaggagttcatccgaggccaaggtgttgtcatgagaatattcgttaaagtagggacgctgactttgttcttgggcagattctcttcctgtggagtatccagcctgtttgcctagttttcctgttcttctggggtctgatctctatctgtttt

SEQ ID NO: 427562 - DNA, 949 bp, Homo sapiens
agggatcccgggctgctgccgctaccaacaagggtacacactgcggtcctcaaggccaggaggggggtgggggcagggaatgcctcagccaacagggcagcggctcggccctgctgctggcccggtgggaagtagcctggggccccgcgactgaaatccgagccaggcctgggcagtctccgctagaaacgctctgggcgcgcactcctggagacgcggaggcccgggcgctccagaccagtgtccttgtaggaggcttcttcacgaagcttagagtttggcctttcatagggaaagacttgctcgggagcaagtctaagggattttaagggattttaaatcttcctgggccagggctagggagctctagtgacagtgtcttggtctggaatccaactctccaattttgaggccgcagggaggaattctgagactttagaggccgcacagccttcagcgcgctcaccgcgtccaggcgtcagtgaggggctatctcgaggcgcgagtgcacaaaaggtagcgcgagtctcttctcaggcgatccagataagaggaaatgagagccgggttttctgacttccaactcattagggaccaggttctttttcttcaggatcaggcacagagactgactgaatggctccaattatcaggatttgaaaacccagtatcagaatctaccactttgtatgttaattattcatactgcatgactgaggattttggaggcagagagagattcatctgcaatatttggaacaccaatggaggtctacgtcaacacagaatttatacagcagctggtgctagtcagagcgtctactggcacaatttccgtttgatacgtaggcctatcgatggccacaccatcatgcgaccactatacgcatcctacacctatcaatcatttcgagtataactactcgattgacgagagcaaccagtaccg

SEQ ID NO: 427563 - DNA, 322 bp, Homo sapiens
gcggaggttgcagtgagccaagatggcactactgtacaccagcctgggcgacagagtgagactccatctcaaaaacaacaaaaacttcaagtgcctattctaataaccttgcttggacagttaatttggatttggtgtctgttataagcaaaaatttataatttagattttgctttttaaagtttgttctttgagtatgggaattagcaagctgtttttttccttttttttaaaaaaagtaaacatgaatactttgcctaccatcctaataagattgaatcagcactgtaatatagcacaaaagggtattagaatctagctc

SEQ ID NO: 427564 - DNA, 3067 bp, Homo sapiens
tcggctagtacgaggctgggtttaatcggccgaggctcaacatggctgctgcccttgtcagtggaggtggagttcggaggtggtgcggagctcctgtttgacggtattaagaaacatcgagtcactttgcctggacaggaggaaccctgggacatccggaacctgctcatctggatcaagaagaatttgctaaaagagcggccagagttgttcatccagggagacagcgtgtgagtcccactcctcccttccctgaagcaggtggagggagggacggatatttgagcccccaccctcgggttcagtcctggccttctctgaatccggttctccccttcctcctccctaactcttccagctctgagatctgttttcagttttcttgttactaaaccgaactcttgaggattttttaaatcccagatgaaaggagcctggtgaatttctcagaaaacttggattctgccctctggttgccacagacttgctgtgggaccttaggcgacttacttcgcttctctgggcctcagttactctctacacagaaagtgctgaggaaaaaacgtagctagtacaactgaagagctaaatattctgttttatttcattgtaatttaaatagccacatgcagctagtagattaccatacagtgcagcacgggtctagaattccaaggagtcattgactctgtgcgtgcacacacccatgcacatgcacacacactcactggggacaccccatagaagcccagtgcagtctccttggaaaggaccaggttccagttgccacgaagttacttctaaaacaaggccagtcccccacgtgaaaggtggccggtgcagttgtgaggctcgcttatttgcctcgaagcataggtcactgtcaggtcctaagggatcaggcctaggggatcagccctccttcaggtcatggtccagtggtcctggaggccacctctaaggccagcagtgctccttgggccattaccagtgggagccaggctaagctgcctgaccaaatgttgacctaccctgccttatgccaggcaggactgcacgtgagcattgccatgtggcatggcaactgattcggaagaggcaaaacagccttctctccaggatgggcatgcagaggcctaaaaaaaagccgaagttcttttccagggctaacgagaataagattagacccctggaaaagtcctactaatggttaccatgacagtgtggcaagcactccacacatatcagctcatttcgttttcgtataggccttgtgggttagacagtatcacttatcccattttcagatgaggaacctgatactcagaaacaaaatgacctgcccatggtctgggtggtggtgctggctggcatttgcacccattttccatctggctacaaagaccatgcatgactgacctggtttccttcacactcagaccagcctccccttcctgggatatctttagccagaccccaggaggaaggctcctcagcacactctcctgcagcccaaagctctcagcctctcttcctctgtgctactgcctcctgcctctcactccttgctactcaccaccatctttcccacaggcggccaggaattctggtgctgattaacgatgccgactgggagctactggtcagtaccttgggggacatccctcccccagcccctgcccttgctgcttcagtgggaaagcgttgggcctctcctcaggcacatatagagtggctgggtaatcctccgccccactccagccccacactgaggctgctggagtctcccactccaggtgaggaagggatgggtagctggggacatgggagtactcctccatcctgaagatttgcaggttgaggtataggatacccatttttctggtagagtctgtctcttccagagcagccagtcctcagcccctgttctcccaactcctggggtggacctgggaaggtggccctgagggtctcccgctcccctctctcccgcaccagggtgagctggactaccagcttcaggaccaggacagcgtcctcttcatctccactctgcacggcggctgagggcccttctctgggcctgggcacccttagaggggagaacgaagcaatcagacatccccttgggccctgcttccaggtctccctgtcccccttgcctgccttcttccctgctctgtcccctaagctccctccaggcagggaaaagaggccaggtgctaaaaatgagcctttctcaagcacgtgagcagcggaaggcagacaggcgccagagcccagcactcccttttccagcagctgtggtgggggagggttcccctccagtttgtcaagagttgaaggaggctctgtggccaggtgacctggctgccttccactccttgtacctcagtctaaacatggagtggccgctgacaaggcgctccagccccagagccagcgtcttcatggggaagatgaatggacctgagtagctgaaggaaggcccctccctacccaaagactggaggcttctcagcctcaatttccctgtctgtacagctgagggctctgcctgtcccccactgctatcagtatggaaccccagctggggtcccctattgagtgccgactccccccaccgccagcagctgctcctccagccacacccctcctgctccccccacccctagcccttgaccctggctggcctgccccgctccacaggccaccagatgggctcctgagaccctccccaggctgcttacagctcattctgctgggggtagagatgaggggagggagtaagttaaaccttggactagcaagtagaagcctggggggatgcgtgtgcctcagtttcctcctccacaactgaatatagtggctgaaaactggggagatacttgatggcgcgaatgtccgttttctctcccttcccacctcctgcaggaagcaggacggggcaggcagcacctggtaggcacagtgctttgcccctcctccccttcccttctggaagtcttggggcctcagtgcttgcaacagccggccttgggcaaataaaagactaggttgtttacta

SEQ ID NO: 427565 - DNA, 228 bp, Homo sapiens
cgaatcttacctactgacctcacctatacgcggcaactttgagccactaccgacggacacaatacgtacaataatgcagtgccgaattcgcacgaggcctcgtgcggggcaggcagcacctggtaggcacagtgctttgcccctcctccccttcccttctggaagtcttggggcctcagtgcttgcaacagccggccttgggcaaataaaagactaggttgtttacta

SEQ ID NO: 427566 - DNA, 1322 bp, Homo sapiens
cccggaaatttgcgggcgcgccggaagttgaggggagtttcctgcgagctcggcttcctcaacatggctgcgcccttgtcagtggaggtggagttcggaggtggtgcggagctcctgtttgacggtattaagaaacatcgagtcactttgcctggacaggaggaaccctgggacatccggaacctgctcatctggatcaagaagaatttgctaaaagagcggccagagttgttcatccagggagacagcgtgcggccaggaattctggtgctgattaacgatgccgactgggagctactgggtgagctggactaccagcttcaggaccaggacagcgtcctcttcatctccactctgcacggcggctgagggcccttctctgggcctgggcacccttagaggggagaacgaagcaatcagacatccccttgggccctgcttccaggtctccctgtcccccttgcctgccttcttccctgctctgtcccctaagctccctccaggcagggaaaagaggccaggtgctaaaaatgagcctttctcaagcacgtgagcagcggaaggcagacaggcgccagagcccagcactcccttttccagcagctgtggtgggggagggttcccctccagtttgtcaagagttgaaggaggctctgtggccaggtgacctggctgccttccactccttgtacctcagtctaaacatggagtggccgctgacaaggcgctccagccccagagccagcgtcttcatggggaagatgaatggacctgagtagctgaaggaaggcccctccctacccaaagactggaggcttctcagcctcaatttccctgtctgtacagctgagggctctgcctgtcccccactgctatcagtatggaaccccagctggggtcccctattgatcctgctccccccacccctagcccttgaccctggctggcctgccccgctccacaggccaccagatgggctcctgagaccctccccaggctgcttacagctcattctgctgggggtagagatgaggggagggagtaagttaaaccttggactagcaagtagaagcctggggggatgcgtgtgcctcagtttcctcctccacaactgaatatagtggctgaaaactggggagatacttgatggcgcgaatgtccgttttctctcccttcccacctcctgcaggaagcaggacggggcaggcagcacctggtaggcacagtgctttgcccctcctccccttcccttctggaagtcttggggcctcagtgcttgcaacagccggccttgggcaaataaaagactaggttgtttacta

SEQ ID NO: 427567 - DNA, 1348 bp, Homo sapiens
tcggctagtacgaggctgggtttaatcggccgaggctcaacatggctgctgcccttgtcagtggaggtggagttcggaggtggtgcggagctcctgtttgacggtattaagaaacatcgagtcactttgcctggacaggaggaaccctgggacatccggaacctgctcatctggatcaagaagaatttgctaaaagagcggccagagttgttcatccagggagacagcgtgcggccaggaattctggtgctgattaacgatgccgactgggagctactgggtgagctggactaccagcttcaggaccaggacagcgtcctcttcatctccactctgcacggcggctgagggcccttctctgggcctgggcacccttagaggggagaacgaagcaatcagacatccccttgggccctgcttccaggtctccctgtcccccttgcctgccttcttccctgctctgtcccctaagctccctccaggcagggaaaagaggccaggtgctaaaaatgagcctttctcaagcacgtgagcagcggaaggcagacaggcgccagagcccagcactcccttttccagcagctgtggtgggggagggttcccctccagtttgtcaagagttgaaggaggctctgtggccaggtgacctggctgccttccactccttgtacctcagtctaaacatggagtggccgctgacaaggcgctccagccccagagccagcgtcttcatggggaagatgaatggacctgagtagctgaaggaaggcccctccctacccaaagactggaggcttctcagcctcaatttccctgtctgtacagctgagggctctgcctgtcccccactgctatcagtatggaaccccagctggggtcccctattgagtgccgactccccccaccgccagcagctgctcctccagccacacccctcctgctccccccacccctagcccttgaccctggctggcctgccccgctccacaggccaccagatgggctcctgagaccctccccaggctgcttacagctcattctgctgggggtagagatgaggggagggagtaagttaaaccttggactagcaagtagaagcctggggggatgcgtgtgcctcagtttcctcctccacaactgaatatagtggctgaaaactggggagatacttgatggcgcgaatgtccgttttctctcccttcccacctcctgcaggaagcaggacggggcaggcagcacctggtaggcacagtgctttgcccctcctccccttcccttctggaagtcttggggcctcagtgcttgcaacagccggccttgggcaaataaaagactaggttgtttacta

SEQ ID NO: 427568 - DNA, 1387 bp, Homo sapiens
catttattgagtgcctaccatgtgccgggcagcaagccagacactgaggatacaaagataaatagaagtctgtccgtgccctacagcgttcagcatttctgccccttagaagggggaggtggtgcggagctcctgtttgacggtattaagaaacatcgagtcactttgcctggacaggaggaaccctgggacatccggaacctgctcatctggatcaagaagaatttgctaaaagagcggccagagttgttcatccagggagacagcgtgcggccaggaattctggtgctgattaacgatgccgactgggagctactgggtgagctggactaccagcttcaggaccaggacagcgtcctcttcatctccactctgcacggcggctgagggcccttctctgggcctgggcacccttagaggggagaacgaagcaatcagacatccccttgggccctgcttccaggtctccctgtcccccttgcctgccttcttccctgctctgtcccctaagctccctccaggcagggaaaagaggccaggtgctaaaaatgagcctttctcaagcacgtgagcagcggaaggcagacaggcgccagagcccagcactcccttttccagcagctgtggtgggggagggttcccctccagtttgtcaagagttgaaggaggctctgtggccaggtgacctggctgccttccactccttgtacctcagtctaaacatggagtggccgctgacaaggcgctccagccccagagccagcgtcttcatggggaagatgaatggacctgagtagctgaaggaaggcccctccctacccaaagactggaggcttctcagcctcaatttccctgtctgtacagctgagggctctgcctgtcccccactgctatcagtatggaaccccagctggggtcccctattgagtgccgactccccccaccgccagcagctgctcctccagccacacccctcctgctccccccacccctagcccttgaccctggctggcctgccccgctccacaggccaccagatgggctcctgagaccctccccaggctgcttacagctcattctgctgggggtagagatgaggggagggagtaagttaaaccttggactagcaagtagaagcctggggggatgcgtgtgcctcagtttcctcctccacaactgaatatagtggctgaaaactggggagatacttgatggcgcgaatgtccgttttctctcccttcccacctcctgcaggaagcaggacggggcaggcagcacctggtaggcacagtgctttgcccctcctccccttcccttctggaagtcttggggcctcagtgcttgcaacagccggccttgggcaaataaaagactaggttgtttacta

SEQ ID NO: 427569 - DNA, 3129 bp, Homo sapiens
cccggaaatttgcgggcgcgccggaagttgaggggagtttcctgcgagctcggcttcctcaacatggctgcgcccttgtcagtggaggtggagttcgggagctcacctggctgtctttttctctggtcctcctttgcagaggtggtgcggagctcctgtttgacggtattaagaaacatcgagtcactttgcctggacaggaggaaccctgggacatccggaacctgctcatctggatcaagaagaatttgctaaaagagcggccagagttgttcatccagggagacagcgtgtgagtcccactcctcccttccctgaagcaggtggagggagggacggatatttgagcccccaccctcgggttcagtcctggccttctctgaatccggttctccccttcctcctccctaactcttccagctctgagatctgttttcagttttcttgttactaaaccgaactcttgaggattttttaaatcccagatgaaaggagcctggtgaatttctcagaaaacttggattctgccctctggttgccacagacttgctgtgggaccttaggcgacttacttcgcttctctgggcctcagttactctctacacagaaagtgctgaggaaaaaacgtagctagtacaactgaagagctaaatattctgttttatttcattgtaatttaaatagccacatgcagctagtagattaccatacagtgcagcacgggtctagaattccaaggagtcattgactctgtgcgtgcacacacccatgcacatgcacacacactcactggggacaccccatagaagcccagtgcagtctccttggaaaggaccaggttccagttgccacgaagttacttctaaaacaaggccagtcccccacgtgaaaggtggccggtgcagttgtgaggctcgcttatttgcctcgaagcataggtcactgtcaggtcctaagggatcaggcctaggggatcagccctccttcaggtcatggtccagtggtcctggaggccacctctaaggccagcagtgctccttgggccattaccagtgggagccaggctaagctgcctgaccaaatgttgacctaccctgccttatgccaggcaggactgcacgtgagcattgccatgtggcatggcaactgattcggaagaggcaaaacagccttctctccaggatgggcatgcagaggcctaaaaaaaagccgaagttcttttccagggctaacgagaataagattagacccctggaaaagtcctactaatggttaccatgacagtgtggcaagcactccacacatatcagctcatttcgttttcgtataggccttgtgggttagacagtatcacttatcccattttcagatgaggaacctgatactcagaaacaaaatgacctgcccatggtctgggtggtggtgctggctggcatttgcacccattttccatctggctacaaagaccatgcatgactgacctggtttccttcacactcagaccagcctccccttcctgggatatctttagccagaccccaggaggaaggctcctcagcacactctcctgcagcccaaagctctcagcctctcttcctctgtgctactgcctcctgcctctcactccttgctactcaccaccatctttcccacaggcggccaggaattctggtgctgattaacgatgccgactgggagctactggtcagtaccttgggggacatccctcccccagcccctgcccttgctgcttcagtgggaaagcgttgggcctctcctcaggcacatatagagtggctgggtaatcctccgccccactccagccccacactgaggctgctggagtctcccactccaggtgaggaagggatgggtagctggggacatgggagtactcctccatcctgaagatttgcaggttgaggtataggatacccatttttctggtagagtctgtctcttccagagcagccagtcctcagcccctgttctcccaactcctggggtggacctgggaaggtggccctgagggtctcccgctcccctctctcccgcaccagggtgagctggactaccagcttcaggaccaggacagcgtcctcttcatctccactctgcacggcggctgagggcccttctctgggcctgggcacccttagaggggagaacgaagcaatcagacatccccttgggccctgcttccaggtctccctgtcccccttgcctgccttcttccctgctctgtcccctaagctccctccaggcagggaaaagaggccaggtgctaaaaatgagcctttctcaagcacgtgagcagcggaaggcagacaggcgccagagcccagcactcccttttccagcagctgtggtgggggagggttcccctccagtttgtcaagagttgaaggaggctctgtggccaggtgacctggctgccttccactccttgtacctcagtctaaacatggagtggccgctgacaaggcgctccagccccagagccagcgtcttcatggggaagatgaatggacctgagtagctgaaggaaggcccctccctacccaaagactggaggcttctcagcctcaatttccctgtctgtacagctgagggctctgcctgtcccccactgctatcagtatggaaccccagctggggtcccctattgagtgccgactccccccaccgccagcagctgctcctccagccacacccctcctgctccccccacccctagcccttgaccctggctggcctgccccgctccacaggccaccagatgggctcctgagaccctccccaggctgcttacagctcattctgctgggggtagagatgaggggagggagtaagttaaaccttggactagcaagtagaagcctggggggatgcgtgtgcctcagtttcctcctccacaactgaatatagtggctgaaaactggggagatacttgatggcgcgaatgtccgttttctctcccttcccacctcctgcaggaagcaggacggggcaggcagcacctggtaggcacagtgctttgcccctcctccccttcccttctggaagtcttggggcctcagtgcttgcaacagccggccttgggcaaataaaagactaggttgtttacta

SEQ ID NO: 427570 - DNA, 2975 bp, Homo sapiens
caataatccaccggccggttgtactcgagtcactttgcctggacaggaggaaccctgggacatccggaacctgctcatctggatcaagaagaatttgctaaaagagcggccagagttgttcatccagggagacagcgtgtgagtcccactcctcccttccctgaagcaggtggagggagggacggatatttgagcccccaccctcgggttcagtcctggccttctctgaatccggttctccccttcctcctccctaactcttccagctctgagatctgttttcagttttcttgttactaaaccgaactcttgaggattttttaaatcccagatgaaaggagcctggtgaatttctcagaaaacttggattctgccctctggttgccacagacttgctgtgggaccttaggcgacttacttcgcttctctgggcctcagttactctctacacagaaagtgctgaggaaaaaacgtagctagtacaactgaagagctaaatattctgttttatttcattgtaatttaaatagccacatgcagctagtagattaccatacagtgcagcacgggtctagaattccaaggagtcattgactctgtgcgtgcacacacccatgcacatgcacacacactcactggggacaccccatagaagcccagtgcagtctccttggaaaggaccaggttccagttgccacgaagttacttctaaaacaaggccagtcccccacgtgaaaggtggccggtgcagttgtgaggctcgcttatttgcctcgaagcataggtcactgtcaggtcctaagggatcaggcctaggggatcagccctccttcaggtcatggtccagtggtcctggaggccacctctaaggccagcagtgctccttgggccattaccagtgggagccaggctaagctgcctgaccaaatgttgacctaccctgccttatgccaggcaggactgcacgtgagcattgccatgtggcatggcaactgattcggaagaggcaaaacagccttctctccaggatgggcatgcagaggcctaaaaaaaagccgaagttcttttccagggctaacgagaataagattagacccctggaaaagtcctactaatggttaccatgacagtgtggcaagcactccacacatatcagctcatttcgttttcgtataggccttgtgggttagacagtatcacttatcccattttcagatgaggaacctgatactcagaaacaaaatgacctgcccatggtctgggtggtggtgctggctggcatttgcacccattttccatctggctacaaagaccatgcatgactgacctggtttccttcacactcagaccagcctccccttcctgggatatctttagccagaccccaggaggaaggctcctcagcacactctcctgcagcccaaagctctcagcctctcttcctctgtgctactgcctcctgcctctcactccttgctactcaccaccatctttcccacaggcggccaggaattctggtgctgattaacgatgccgactgggagctactggtcagtaccttgggggacatccctcccccagcccctgcccttgctgcttcagtgggaaagcgttgggcctctcctcaggcacatatagagtggctgggtaatcctccgccccactccagccccacactgaggctgctggagtctcccactccaggtgaggaagggatgggtagctggggacatgggagtactcctccatcctgaagatttgcaggttgaggtataggatacccatttttctggtagagtctgtctcttccagagcagccagtcctcagcccctgttctcccaactcctggggtggacctgggaaggtggccctgagggtctcccgctcccctctctcccgcaccagggtgagctggactaccagcttcaggaccaggacagcgtcctcttcatctccactctgcacggcggctgagggcccttctctgggcctgggcacccttagaggggagaacgaagcaatcagacatccccttgggccctgcttccaggtctccctgtcccccttgcctgccttcttccctgctctgtcccctaagctccctccaggcagggaaaagaggccaggtgctaaaaatgagcctttctcaagcacgtgagcagcggaaggcagacaggcgccagagcccagcactcccttttccagcagctgtggtgggggagggttcccctccagtttgtcaagagttgaaggaggctctgtggccaggtgacctggctgccttccactccttgtacctcagtctaaacatggagtggccgctgacaaggcgctccagccccagagccagcgtcttcatggggaagatgaatggacctgagtagctgaaggaaggcccctccctacccaaagactggaggcttctcagcctcaatttccctgtctgtacagctgagggctctgcctgtcccccactgctatcagtatggaaccccagctggggtcccctattgagtgccgactccccccaccgccagcagctgctcctccagccacacccctcctgctccccccacccctagcccttgaccctggctggcctgccccgctccacaggccaccagatgggctcctgagaccctccccaggctgcttacagctcattctgctgggggtagagatgaggggagggagtaagttaaaccttggactagcaagtagaagcctggggggatgcgtgtgcctcagtttcctcctccacaactgaatatagtggctgaaaactggggagatacttgatggcgcgaatgtccgttttctctcccttcccacctcctgcaggaagcaggacggggcaggcagcacctggtaggcacagtgctttgcccctcctccccttcccttctggaagtcttggggcctcagtgcttgcaacagccggccttgggcaaataaaagactaggttgtttacta

SEQ ID NO: 427571 - DNA, 1704 bp, Homo sapiens
tcggctagtacgaggctgggtttaatcggccgaggctcaacatggctgctgcccttgtcagtggaggtggagttcggaggtggtgcggagctcctgtttgacggtattaagaaacatcgagtcactttgcctggacaggaggaaccctgggacatccggaacctgctcatctggatcaagaagaatttgctaaaagagcggccagagttgttcatccagggagacagcgtgcggccaggaattctggtgctgattaacgatgccgactgggagctactggtcagtaccttgggggacatccctcccccagcccctgcccttgctgcttcagtgggaaagcgttgggcctctcctcaggcacatatagagtggctgggtaatcctccgccccactccagccccacactgaggctgctggagtctcccactccaggtgaggaagggatgggtagctggggacatgggagtactcctccatcctgaagatttgcaggttgaggtataggatacccatttttctggtagagtctgtctcttccagagcagccagtcctcagcccctgttctcccaactcctggggtggacctgggaaggtggccctgagggtctcccgctcccctctctcccgcaccagggtgagctggactaccagcttcaggaccaggacagcgtcctcttcatctccactctgcacggcggctgagggcccttctctgggcctgggcacccttagaggggagaacgaagcaatcagacatccccttgggccctgcttccaggtctccctgtcccccttgcctgccttcttccctgctctgtcccctaagctccctccaggcagggaaaagaggccaggtgctaaaaatgagcctttctcaagcacgtgagcagcggaaggcagacaggcgccagagcccagcactcccttttccagcagctgtggtgggggagggttcccctccagtttgtcaagagttgaaggaggctctgtggccaggtgacctggctgccttccactccttgtacctcagtctaaacatggagtggccgctgacaaggcgctccagccccagagccagcgtcttcatggggaagatgaatggacctgagtagctgaaggaaggcccctccctacccaaagactggaggcttctcagcctcaatttccctgtctgtacagctgagggctctgcctgtcccccactgctatcagtatggaaccccagctggggtcccctattgagtgccgactccccccaccgccagcagctgctcctccagccacacccctcctgctccccccacccctagcccttgaccctggctggcctgccccgctccacaggccaccagatgggctcctgagaccctccccaggctgcttacagctcattctgctgggggtagagatgaggggagggagtaagttaaaccttggactagcaagtagaagcctggggggatgcgtgtgcctcagtttcctcctccacaactgaatatagtggctgaaaactggggagatacttgatggcgcgaatgtccgttttctctcccttcccacctcctgcaggaagcaggacggggcaggcagcacctggtaggcacagtgctttgcccctcctccccttcccttctggaagtcttggggcctcagtgcttgcaacagccggccttgggcaaataaaagactaggttgtttacta

SEQ ID NO: 427572 - DNA, 930 bp, Homo sapiens
cccggaaatttgcgggcgcgccggaagttgaggggagtttcctgcgagctcggcttcctcaacatggctgcgcccttgtcagtggaggtggagttcggaggtggtgcggagctcctgtttgacggtattaagaaacatcgagtcactttgcctggacaggaggaaccctgggacatccggaacctgctcatctggatcaagaagaatttgctaaaagagcggccagagttgttcatccagggagacagcgtgcggccaggaattctggtgctgattaacgatgccgactgggagctactgggtgagctggactaccagcttcaggaccaggacagcgtcctcttcatctccactctgcacggcggctgagggcccttctctgggcctgggcacccttagaggggagaacgaagcaatcagacatcccccactgctatcagtatggaaccccagctggggtcccctattgagtgccgactccccccaccgccagcagctgctcctccagccacacccctcctgctccccccacccctagcccttgaccctggctggcctgccccgctccacaggccaccagatgggctcctgagaccctccccaggctgcttacagctcattctgctgggggtagagatgaggggagggagtaagttaaaccttggactagcaagtagaagcctggggggatgcgtgtgcctcagtttcctcctccacaactgaatatagtggctgaaaactggggagatacttgatggcgcgaatgtccgttttctctcccttcccacctcctgcaggaagcaggacggggcaggcagcacctggtaggcacagtgctttgcccctcctccccttcccttctggaagtcttggggcctcagtgcttgcaacagccggccttgggcaaataaaagactaggttgtttacta

SEQ ID NO: 427573 - DNA, 1057 bp, Homo sapiens
cccggaaatttgcgggcgcgccggaagttgaggggagtttcctgcgagctcggcttcctcaacatggctgcgcccttgtcagtggaggtggagttcgggagctcacctggctgtctttttctctggtcctcctttgcagaggtggtgcggagctcctgtttgacggtattaagaaacatcgagtcactttgcctggacaggaggaaccctgggacatccggaacctgctcatctggatcaagaagaatttgctaaaagagcggccagagttgttcatccagggagacagcgtgcggccaggaattctggtgctgattaacgatgccgactgggagctactgggtgagctggactaccagcttcaggaccaggacagcgtcctcttcatctccactctgcacggcggctgagggcccttctctgggcctgggcacccttagaggggagaacgaagcaatcagacatccccttgggccctgcttccaggtctccctgtcccccttgcctgccttcttccctgctctgtcccctaagctccctccaggcagggaaaagaggccaggtgctaaaaatgagcctttctcaagcacgtgagcagcggaaggcagacaggcgccagagcccagcactcccttttccagcagtcctgctccccccacccctagcccttgaccctggctggcctgccccgctccacaggccaccagatgggctcctgagaccctccccaggctgcttacagctcattctgctgggggtagagatgaggggagggagtaagttaaaccttggactagcaagtagaagcctggggggatgcgtgtgcctcagtttcctcctccacaactgaatatagtggctgaaaactggggagatacttgatggcgcgaatgtccgttttctctcccttcccacctcctgcaggaagcaggacggggcaggcagcacctggtaggcacagtgctttgcccctcctccccttcccttctggaagtcttggggcctcagtgcttgcaacagccggccttgggcaaataaaagactaggttgtttacta

SEQ ID NO: 427574 - DNA, 506 bp, Homo sapiens
tcggctagtacgaggctgggtttaatcggccgaggctcaacatggctgctgcccttgtcagtggaggtggagttcggaggtggtgcggagctcctgtttgacggtattaagaaacatcgagtcactttgcctggacaggaggaaccctgtgagtattggctttctgaacccctctcttggggccattgaacaggagttggtccatggggaacactcagccccgttcaggcctgtgttctgcatccgtgtgctaagctgcctctctagcaggcagaggaataaaaacaagagtctacacggctgggccggtggctcatgcctgtaatcccagcactttgggaggccaaggtgggtggatcacaaggtcaggagttcgagaccagcctggccaacatggtgaaatcctgtctctattaaaaatacaaaaattagctgggcatggtggcgcgtgcatgtaatcccagctactcaggaggctgaggcaggagaattgcttgaaccggaac

SEQ ID NO: 427575 - DNA, 466 bp, Homo sapiens
cccggaaatttgcgggcgcgccggaagttgaggggagtttcctgcgagctcggcttcctcaacatggctgcgcccttgtcagtggaggtggagttcgggtgagtcacagagctggggcgccgtggggatggattgaagtcgtcgggcccagaattcctttccttctgccgtggggcctgacacggccgaatcactgggtgtcccagtgcccgctgtgagctacgctacccgcctaggagagtctgagaggccagtctctcttggcagtgaggccgtctgtccggaaatagaggcgcacattgggagggaaatgctctctgtgtaccactcggtgccctgtgctccgccggagtcggaggtcgtgactgttagcaggcagcctctctctcttcttttccattcctatctcggaccaatcccatctgtttggcatctgagctcctagaacctagaaggaccaccctcc

SEQ ID NO: 427576 - DNA, 1369 bp, Homo sapiens
cccggaaatttgcgggcgcgccggaagttgaggggagtttcctgcgagctcggcttcctcaacatggctgcgcccttgtcagtggaggtggagttcggaggtggtgcggagctcctgtttgacggtattaagaaacatcgagtcactttgcctggacaggaggaaccctgggacatccggaacctgctcatctggatcaagaagaatttgctaaaagagcggccagagttgttcatccagggagacagcgtgcggccaggaattctggtgctgattaacgatgccgactgggagctactgggtgagctggactaccagcttcaggaccaggacagcgtcctcttcatctccactctgcacggcggctgagggcccttctctgggcctgggcacccttagaggggagaacgaagcaatcagacatccccttgggccctgcttccaggtctccctgtcccccttgcctgccttcttccctgctctgtcccctaagctccctccaggcagggaaaagaggccaggtgctaaaaatgagcctttctcaagcacgtgagcagcggaaggcagacaggcgccagagcccagcactcccttttccagcagctgtggtgggggagggttcccctccagtttgtcaagagttgaaggaggctctgtggccaggtgacctggctgccttccactccttgtacctcagtctaaacatggagtggccgctgacaaggcgctccagccccagagccagcgtcttcatggggaagatgaatggacctgagtagctgaaggaaggcccctccctacccaaagactggaggcttctcagcctcaatttccctgtctgtacagctgagggctctgcctgtcccccactgctatcagtatggaaccccagctggggtcccctattgagtgccgactccccccaccgccagcagctgctcctccagccacacccctcctgctccccccacccctagcccttgaccctggctggcctgccccgctccacaggccaccagatgggctcctgagaccctccccaggctgcttacagctcattctgctgggggtagagatgaggggagggagtaagttaaaccttggactagcaagtagaagcctggggggatgcgtgtgcctcagtttcctcctccacaactgaatatagtggctgaaaactggggagatacttgatggcgcgaatgtccgttttctctcccttcccacctcctgcaggaagcaggacggggcaggcagcacctggtaggcacagtgctttgcccctcctccccttcccttctggaagtcttggggcctcagtgcttgcaacagccggccttgggcaaataaaagactaggttgtttacta

SEQ ID NO: 427577 - DNA, 1393 bp, Homo sapiens
cccggaaatttgcgggcgcgccggaagttgaggggagtttcctgcgagctcggcttcctcaacatggctgcgcccttgtcagtggaggtggagttcggaggtggtgcggagctcctgtttgacggtattaagaaacatcgagtcactttgcctggacaggaggaaccctgggacatccggaacctgctcatctggatcaagaagaatttgctaaaagagcggccagagttgttcatccagggagacagcgtgcggccaggaattctggtgctgattaacgatgccgactgggagctactgggtgagctggactaccagcttcaggaccaggacagcgtcctcttcatctccactctgcacggcggctgagggcccttctctgggcctgggcacccttagaggggagaacgaagcaatcagacatccccttgggccctgcttccaggtctccctgtcccccttgcctgccttcttccctgctctgtcccctaagctccctccaggcagggaaaagaggccaggtgctaaaaatgagcctttctcaagcacgtgagcagcggaaggcagacaggcgccagagcccagcactcccttttccagcagctgtggtgggggagggttcccctccagtttgtcaagagttgaaggaggctctgtggccaggtgacctggctgccttccactccttgtacctcagtctaaacatggagtggccgctgacaaggcgctccagccccagagccagcgtcttcatggggaagatgaatggacctgagtagctgaaggaaggcccctccctacccaaagactggaggcttctcagcctcaatttccctgtctgtacagctgagggctctgcctgtcccccactgctatcagtatggaaccccagctggggtcccctattgagtgccgactccccccaccgccagcagctgctcctccagccacacccctcctgctccccccacccctagcccttgaccctggctggcctgccccgctccacaggccaccagatgggctcctgagaccctccccaggctgcttacagctcattctgctgggggtagagatgaggggagggagtaagttaaaccttggactagcaagtagaagcctggggggatgcgtgtgcctcagtttcctcctccacaactgaatatagtggctgaaaactggggagatacttgatggcgcgaatgtccgttttctctcccttcccacctcctgcaggaagcaggacggggcaggcagcacctggtaggcacagtgctttgcccctcctccccttcccttctggaagtcttggggcctcagtgcttgcaacagccggccttgggcaaataaaagactaggttgtttactaaaaaaaaaaaaacacaacaacaaa

SEQ ID NO: 427578 - DNA, 1410 bp, Homo sapiens
cccggaaatttgcgggcgcgccggaagttgaggggagtttcctgcgagctcggcttcctcaacatggctgcgcccttgtcagtggaggtggagttcgggagctcacctggctgtctttttctctggtcctcctttgcagaggtggtgcggagctcctgtttgacggtattaagaaacatcgagtcactttgcctggacaggaggaaccctgggacatccggaacctgctcatctggatcaagaagaatttgctaaaagagcggccagagttgttcatccagggagacagcgtgcggccaggaattctggtgctgattaacgatgccgactgggagctactgggtgagctggactaccagcttcaggaccaggacagcgtcctcttcatctccactctgcacggcggctgagggcccttctctgggcctgggcacccttagaggggagaacgaagcaatcagacatccccttgggccctgcttccaggtctccctgtcccccttgcctgccttcttccctgctctgtcccctaagctccctccaggcagggaaaagaggccaggtgctaaaaatgagcctttctcaagcacgtgagcagcggaaggcagacaggcgccagagcccagcactcccttttccagcagctgtggtgggggagggttcccctccagtttgtcaagagttgaaggaggctctgtggccaggtgacctggctgccttccactccttgtacctcagtctaaacatggagtggccgctgacaaggcgctccagccccagagccagcgtcttcatggggaagatgaatggacctgagtagctgaaggaaggcccctccctacccaaagactggaggcttctcagcctcaatttccctgtctgtacagctgagggctctgcctgtcccccactgctatcagtatggaaccccagctggggtcccctattgagtgccgactccccccaccgccagcagctgctcctccagccacacccctcctgctccccccacccctagcccttgaccctggctggcctgccccgctccacaggccaccagatgggctcctgagaccctccccaggctgcttacagctcattctgctgggggtagagatgaggggagggagtaagttaaaccttggactagcaagtagaagcctggggggatgcgtgtgcctcagtttcctcctccacaactgaatatagtggctgaaaactggggagatacttgatggcgcgaatgtccgttttctctcccttcccacctcctgcaggaagcaggacggggcaggcagcacctggtaggcacagtgctttgcccctcctccccttcccttctggaagtcttggggcctcagtgcttgcaacagccggccttgggcaaataaaagactaggttgtttacta

SEQ ID NO: 427579 - DNA, 1225 bp, Homo sapiens
gttcgatctgtgcatccctttccacgggacatccggaacctgctcatctggatcaagaagaatttgctaaaagagcggccagagttgttcatccagggagacagcgtgcggccaggaattctggtgctgattaacgatgccgactgggagctactgggtgagctggactaccagcttcaggaccaggacagcgtcctcttcatctccactctgcacggcggctgagggcccttctctgggcctgggcacccttagaggggagaacgaagcaatcagacatccccttgggccctgcttccaggtctccctgtcccccttgcctgccttcttccctgctctgtcccctaagctccctccaggcagggaaaagaggccaggtgctaaaaatgagcctttctcaagcacgtgagcagcggaaggcagacaggcgccagagcccagcactcccttttccagcagctgtggtgggggagggttcccctccagtttgtcaagagttgaaggaggctctgtggccaggtgacctggctgccttccactccttgtacctcagtctaaacatggagtggccgctgacaaggcgctccagccccagagccagcgtcttcatggggaagatgaatggacctgagtagctgaaggaaggcccctccctacccaaagactggaggcttctcagcctcaatttccctgtctgtacagctgagggctctgcctgtcccccactgctatcagtatggaaccccagctggggtcccctattgagtgccgactccccccaccgccagcagctgctcctccagccacacccctcctgctccccccacccctagcccttgaccctggctggcctgccccgctccacaggccaccagatgggctcctgagaccctccccaggctgcttacagctcattctgctgggggtagagatgaggggagggagtaagttaaaccttggactagcaagtagaagcctggggggatgcgtgtgcctcagtttcctcctccacaactgaatatagtggctgaaaactggggagatacttgatggcgcgaatgtccgttttctctcccttcccacctcctgcaggaagcaggacggggcaggcagcacctggtaggcacagtgctttgcccctcctccccttcccttctggaagtcttggggcctcagtgcttgcaacagccggccttgggcaaataaaagactaggttgtttacta

SEQ ID NO: 427580 - DNA, 1725 bp, Homo sapiens
cccggaaatttgcgggcgcgccggaagttgaggggagtttcctgcgagctcggcttcctcaacatggctgcgcccttgtcagtggaggtggagttcggaggtggtgcggagctcctgtttgacggtattaagaaacatcgagtcactttgcctggacaggaggaaccctgggacatccggaacctgctcatctggatcaagaagaatttgctaaaagagcggccagagttgttcatccagggagacagcgtgcggccaggaattctggtgctgattaacgatgccgactgggagctactggtcagtaccttgggggacatccctcccccagcccctgcccttgctgcttcagtgggaaagcgttgggcctctcctcaggcacatatagagtggctgggtaatcctccgccccactccagccccacactgaggctgctggagtctcccactccaggtgaggaagggatgggtagctggggacatgggagtactcctccatcctgaagatttgcaggttgaggtataggatacccatttttctggtagagtctgtctcttccagagcagccagtcctcagcccctgttctcccaactcctggggtggacctgggaaggtggccctgagggtctcccgctcccctctctcccgcaccagggtgagctggactaccagcttcaggaccaggacagcgtcctcttcatctccactctgcacggcggctgagggcccttctctgggcctgggcacccttagaggggagaacgaagcaatcagacatccccttgggccctgcttccaggtctccctgtcccccttgcctgccttcttccctgctctgtcccctaagctccctccaggcagggaaaagaggccaggtgctaaaaatgagcctttctcaagcacgtgagcagcggaaggcagacaggcgccagagcccagcactcccttttccagcagctgtggtgggggagggttcccctccagtttgtcaagagttgaaggaggctctgtggccaggtgacctggctgccttccactccttgtacctcagtctaaacatggagtggccgctgacaaggcgctccagccccagagccagcgtcttcatggggaagatgaatggacctgagtagctgaaggaaggcccctccctacccaaagactggaggcttctcagcctcaatttccctgtctgtacagctgagggctctgcctgtcccccactgctatcagtatggaaccccagctggggtcccctattgagtgccgactccccccaccgccagcagctgctcctccagccacacccctcctgctccccccacccctagcccttgaccctggctggcctgccccgctccacaggccaccagatgggctcctgagaccctccccaggctgcttacagctcattctgctgggggtagagatgaggggagggagtaagttaaaccttggactagcaagtagaagcctggggggatgcgtgtgcctcagtttcctcctccacaactgaatatagtggctgaaaactggggagatacttgatggcgcgaatgtccgttttctctcccttcccacctcctgcaggaagcaggacggggcaggcagcacctggtaggcacagtgctttgcccctcctccccttcccttctggaagtcttggggcctcagtgcttgcaacagccggccttgggcaaataaaagactaggttgtttacta

SEQ ID NO: 427581 - DNA, 1059 bp, Homo sapiens
cccggaaatttgcgggcgcgccggaagttgaggggagtttcctgcgagctcggcttcctcaacatggctgcgcccttgtcagtggaggtggagttcggaggtggtgcggagctcctgtttgacggtattaagaaacatcgagtcactttgcctggacaggaggaaccctgggacatccggaacctgctcatctggatcaagaagaatttgctaactaaaaatgagcctttctcaagcacgtgagcagcggaaggcagacaggcgccagagcccagcactcccttttccagcagctgtggtgggggagggttcccctccagtttgtcaagagttgaaggaggctctgtggccaggtgacctggctgccttccactccttgtacctcagtctaaacatggagtggccgctgacaaggcgctccagccccagagccagcgtcttcatggggaagatgaatggacctgagtagctgaaggaaggcccctccctacccaaagactggaggcttctcagcctcaatttccctgtctgtacagctgagggctctgcctgtcccccactgctatcagtatggaaccccagctggggtcccctattgagtgccgactccccccaccgccagcagctgctcctccagccacacccctcctgctccccccacccctagcccttgaccctggctggcctgccccgctccacaggccaccagatgggctcctgagaccctccccaggctgcttacagctcattctgctgggggtagagatgaggggagggagtaagttaaaccttggactagcaagtagaagcctggggggatgcgtgtgcctcagtttcctcctccacaactgaatatagtggctgaaaactggggagatacttgatggcgcgaatgtccgttttctctcccttcccacctcctgcaggaagcaggacggggcaggcagcacctggtaggcacagtgctttgcccctcctccccttcccttctggaagtcttggggcctcagtgcttgcaacagccggccttgggcaaataaaagactaggttgtttacta

SEQ ID NO: 427582 - DNA, 573 bp, Homo sapiens
tcggctagtacgaggctgggtttaatcggccgaggctcaacatggctgctgcccttgtcagtggaggtggagttcggaggtggtgcggagctcctgtttgacggtattaagaaacatcgagtcactttgcctggacaggaggaaccctgggacatccggaacctgctcatctggatcaagaagaatttgctaagctggcctgccccgctccacaggccaccagatgggctcctgagaccctccccaggctgcttacagctcattctgctgggggtagagatgaggggagggagtaagttaaaccttggactagcaagtagaagcctggggggatgcgtgtgcctcagtttcctcctccacaactgaatatagtggctgaaaactggggagatacttgatggcgcgaatgtccgttttctctcccttcccacctcctgcaggaagcaggacggggcaggcagcacctggtaggcacagtgctttgcccctcctccccttcccttctggaagtcttggggcctcagtgcttgcaacagccggccttgggcaaataaaagactaggttgtttacta

SEQ ID NO: 427583 - DNA, 773 bp, Homo sapiens
gcgaattcactagtgattatccccggttcctgggtaggccccctgttcctatttacaggatccataaagagactcaaagagatagggtagtgccagccccagagagagggggctgtggagggacttctacccccagggcttctcagtggcatctcctggctggcccctgacactcaatcttccttggtttccaagatgcttcatgatcttccccctccctgacatccccgacctcccttttctgtcccttttgcaactcattgtcctctacctgccatcagatgtggctgttcctcagtctcagtccagagtcctctcttctcactcagcatctctcctcctgtgacctcgtctgcacccacaactccagttacaaggcacgaggtttggttatgaaatcactcacagatttataactgcaggcttggctccttccgggagcttgagacccactgccgcctccgcaacacctccacctgggagtttcagaggcgctctccctcagcgtgtctgcagctgcgtgcctgcagctgcgtgcctgccttctccctgcacctgctctgctccccaggtccctttctcagaccaaagcctgcccgggcttcacaggctgagggtccaccttgccacctccgtttgcctcagtcctcatggagccctggctccactgtctgctggcttctccccatctactctgtgtcactccatccgaccaccattgtctccatcaggacagttggaacacctcttctcagcactctcgcccccaccca

SEQ ID NO: 427584 - DNA, 1108 bp, Homo sapiens
agaacgggtgaaaagccaggcctcaagcccacactactgacactgcactacaccacctctcaggagagaaggcaaatatttccttgactcagccaccttcctcctagcaaggcttagacccccaggctctgggggtcccttcctgctacagtatgaccctctctggtgcttgtcatcaagaagtggtatgcggtggacttgctggagagagtgtctgcagccaggcatcatggagggagggatggatcttgagggactgtaatggttgtgaatgggggagttggcccccagcactctctggtggccgtatgaccttgggcacgtctcctgaccactctaagcagcttttgattcccctgtccaagagggtaggccccctgttcctatttacaggatccataaagagactcaaagagatagggtagtgccagccccagagagagggggctgtggagggacttctacccccagggcttctcagtggcatctcctggctggcccctgacactcaatcttccttggtttccaagatgcttcatgatcttccccctccctgacatccccgacctcccttttctgtcccttttgcaactcattgtcctctacctgccatcagatgtggctgttcctcagtctcagtccagagtcctctcttctcactcagcatctctcctcctgtgacctcgtctgcacccacaactccagttacaaggcacgaggtttggttatgaaatcactcacagatttataactgcaggcttggctccttccgggagcttgagacccactgccgcctccgcaacacctccacctgggagtttcagaggcgctctccctcagcgtgtctgcagctgcgtgcctgcagctgcgtgcctgccttctccctgcacctgctctgctccccaggtccctttctcagaccaaagcctgcccgggcttcacaggctgagggtccaccttgccacctccgtttgcctcagtcctcatggagccctggctccactgtctgctggcttctccccatctactctgtgtcactccatccgaccaccattgtctccatcaggacagttggaacacctcttctcagcactctcgcccccaccca

SEQ ID NO: 427585 - DNA, 650 bp, Homo sapiens
tccctcatgggttctgcaggatgaaggaaaggaaaggaaaagacagagaaaggaaggaaatagcttttcatgagcacctactgtgtaccaggtgcttccctggcatgagctctcgtaacccttatagcaacatgagtttagagcaagaatcacaccccgactttacagagatggaaactgaggctcagagaagtaagggacctgcccaaggccactcagcacctagaaagtgtgcctagcacataggaggcacacaaaaatatgtgttgaatgggtgaatgaatgagagaacgggtgaaaagccaggcctcaagcccacactactgacactgcactacaccacctctcaggagagaaggcaaatatttccttgactcagccaccttcctcctagcaaggcttagacccccaggctctgggggtcccttcctgctacagtatgaccctctctggtgcttgtcatcaagaagtggtatgcggtggacttgctggagagagtgtctgcagccaggcatcatggagggagggatggatcttgagggactgtaatggttgtgaatgggggagttggcccccagcactctctggtggccgtatgaccttgggcacgtctcctgaccactctaagcagcttttgattcccctgtcca

SEQ ID NO: 427586 - DNA, 607 bp, Homo sapiens
aagttgttgccgctggcttccggtcccctgagactggggcctcgctcgctcccgacccggttgcaagtgttgcggtgggagaaagtcgcgtccgcatcggaggggaagcgccgtcatgcctaagtattatgaggacaagccgcagggcggcgcgtgcgcgggcctgaaggaggacctgggcgcgtgtctgctgcagtcggactgtgtggtccaggaaggaaaatcacctcggcagtgtttgaaggaaggatactgcaactctttgaagtacgcattttttgagtgtaaaagatcagtgttggataacagggcaagattcagaggaagaaaaggatattgatgcattatgttgaagccaacatggaaaacaacaaatattttccctggtcattaacacaaagaagccaaaacaggaaacatactttttactacatctgtttggttggaccagatttcccctccgtggaacactgaagaaagtggatgagttgttttcgaatatgtataaagtaaatgattctcttgatccaagttatttttagaagaaaaacctaattgaacaggtatgggttgggagcataataaatgtgttttgagaattgttcta

SEQ ID NO: 427587 - DNA, 514 bp, Homo sapiens
attcggcacgacgcggctttttaaatgaccccaggcctcgctaaaaataagcggcggcgcgtgcgcgggcctgaaggaggacctgggcgcgtgtctgctgcagtcggactgtgtggtccaggaaggaaaatcacctcggcagtgtttgaaggaaggatactgcaactctttgaagtacgcattttttgagtgtaaaagatcagtgttggataacagggcaagattcagaggaagaaaaggatattgatgcattatgttgaagccaacatggaaaacaacaaatattttccctggtcattaacacaaagaagccaaaacaggaaacatactttttactacatctgtttggttggaccagatttcccctccgtggaacactgaagaaagtggatgagttgttttcgaatatgtataaagtaaatgattctcttgatccaagttatttttagaagaaaaacctaattgaacaggtatgggttgggagcataataaatgtgttttgagaattgttcta

SEQ ID NO: 427588 - DNA, 2339 bp, Homo sapiens
atggcaggttggtgctgtagtctcttcttgccagtctttaacccacctgaaacctgcagcacctcgctctagggaggaattcaacataaacatgtatttagttctaggtgctgctttgggagactgtcaaggagttagagggcctcagagaaactcagggtaatggtaaggatgtaaattccagtggggctggaggaaagcagggaaaaagcagattcaaaaggcatctcttgaagagacttcttaggatttaatgactcctggatgatcaggacaatgaaactctgccagaggaacttcactcatcatagggtatcttcgtctccactaacagcttccagatccactgactcttcatcagaatcacctagaagtggtgtggctttttaaaagtacagattccactgctgccctcaccctacccccaataagttaaaagtttctttcctaggttggttttgggcacagccatgtttgagagcactgactgatcttgacctcagaaggcaaaaaagcttgggagtgtattagttagaatatagattcaagtgcatgttacagagacccagaataatagtggcttaaacgagatagagaactttctcttttgtccttgtgcctataatcagggcctagtcatttccctcagtcttccatgaacacagacactgttgatcttgtgactctgtgctgtgaaaataggaaaatatagcaagtagggtgttactctcatattcatggtccaagactggtttgcttccacatcatcaggcccggcaaccttatggagtgaagtgaggaaaggggcaagcctctttaaggaccaacccagaagttctacacctgtttcccacacattccagtggctagaacttagtcacaggaccacagctagatgcaagggcgtctaggagatctcacccagccatatgctggataaaaaggaagagcagacagctagcagtctgttatttggggtggagtggataacgaatgactgtctcttagctttagtgtatctagatggatctttaccccaggcagttgacaatataggttgaaagcttttgaaaaaggtagcatcttagatacagtttgaagaggcatcagcttataaactatagttataaccttttatatggttagtcttcttttgtctgcctccacgtcgttcatgtgggcaacacatcccaccagcagaattgcagagtttggagaggaaggaaacctgctactcttatccacttttgagagtcactgaggtagatgacatttgatatctaggacccaggcagacatacagactggaaggtggccaagactcctggggaacaggaataccacagacatagtaccctgtagcttttcataggaaaaactggcagagcgtgcctggcacttgcaacataaaggttctggggagtggctgcagtgatgcggctgtagagtcaaaatctgcttgagggaaaatccctgattatgcagagcagatgagctttgggttatattttttctggtgcatgaatgggccacatgtttctatttaagtagtattccagcctgccttgttaatatctttgtgaagtgtttcgtgccaacactaaaaatattctgattttagggtacccagttcacacatttcacccataaggaaatgaagataaccctttctagatttttatataaacagtttaaggaaaagtatccaatagaaaccagtgttttcaagaattcaacagtgtccttaaagttcccaagttactttacaatttttttttcattctttaggcaccaatagcccaaatgaattaagaactatttcctacataactttctattttcctcctttaacacttttaaaaaggactattttcagaaggacaattattttgtactttgtgagaaaatttccaaggtgtttatattgttttatgtgtctgtcataggaaggaaaatcacctcggcagtgtttgaaggaaggatactgcaactctttgaagtacgcattttttgagtgtaaaagatcagtgttggataacagggcaagattcagaggaagaaaaggatattgatgcattatgttgaagccaacatggaaaacaacaaatattttccctggtcattaacacaaagaagccaaaacaggaaacatactttttactacatctgtttggttggaccagatttcccctccgtggaacactgaagaaagtggatgagttgttttcgaatatgtataaagtaaatgattctcttgatccaagttatttttagaagaaaaacctaattgaacaggtatgggttgggagcataataaatgtgttttgagaattgttcta

SEQ ID NO: 427589 - DNA, 1690 bp, Homo sapiens
aagttgttgccgctggcttccggtcccctgagactggggcctcgctcgctcccgacccggttgcaagtgttgcggtgggagaaagtcgcgtccgcatcggaggggaagcgccgtcatgcctaagtattatgaggacaagccgcagggcggcgcgtgcgcgggcctgaaggaggacctgggcgcgtgtctgctgcagtcggactgtgtggtccaggaaggaaaatcacctcggcagtgtttgaaggaaggatactgcaactctttgaagtacgcattttttgagtgtaaaagatcagtgttggataacagggcaagattcagaggaagaaaaggatattgatgcattatgttgaagccaacatggaaaacaacaaatattttccctggtcattaacacaaagaagccaaaacaggaaacatactttttactacatctgtttggttggaccagatttcccctccgtggaacactgaagaaagtggatgagttgttttcgaatatgtataaagtaaatgattctcttgatccaagttatttttagaagaaaaacctaattgaacaggtatgggttgggagcataataaatgtgttttgagaattgttctaaagcacagaaaatggaaagactgttatttgcaaacttgactcttcaattgaattacccaattagtacaggccactgatttgactgacacagtcgataacatgcagcctatccagaaggtgtctgttgggaaagtttaggataaaactttttctttagttcagtcttttcctgtctagttctaaaatgaattgtgtttgattccttagagaagaaatacttcatttgtgctctgattcactgaagtaataacctcagcactttaatagcgtccacaggcatagctgatgctaggccccagattgtgttgcccaggctctttaccatcatcttcggactgtttttgtttcctggttacattttcagtctggcccgctctacataatgggccagtgtcagctccaagtccacatccttattatccatgattcaaaagggagagagagaacttcctttttcagggtccacaaatcaaatctataaaaggactctggtcttcccaggatcacctgcccttgcattggaccagtccctgtggaagaggggatgggggcctgtgatcttggccaggcctgggctatctatctgcactgtcattgctaactcctgtcagaatcacatggatgagtagtgggctgaatcccaaaaggaaaggggtttagagcaagtggaaacaacagatgttcactatagaaagcaagaatgaaaaccatgaagtggttgaagattagccttacagtaattttattctgatcacttaatacagtagagtcaaacaggaatccaagtttccaactttattatttttggcactgaagaattacaaagaactctagcgtctttatacctccgtggttcactggagttaaagcaatcggggcgttgtacagctcacttgagtttttaaaggttctactaaaaagtgagaattccacagcaatatgggtcattgttgcagaatatcacaaaggtctgttgtgtatactccttttcaccaggaaagggacaataatagtttttttcaatgtatatatatataagtgatctaactttttattaataaaagtaaacaactctaaaatgta

SEQ ID NO: 427590 - DNA, 3422 bp, Homo sapiens
atggcaggttggtgctgtagtctcttcttgccagtctttaacccacctgaaacctgcagcacctcgctctagggaggaattcaacataaacatgtatttagttctaggtgctgctttgggagactgtcaaggagttagagggcctcagagaaactcagggtaatggtaaggatgtaaattccagtggggctggaggaaagcagggaaaaagcagattcaaaaggcatctcttgaagagacttcttaggatttaatgactcctggatgatcaggacaatgaaactctgccagaggaacttcactcatcatagggtatcttcgtctccactaacagcttccagatccactgactcttcatcagaatcacctagaagtggtgtggctttttaaaagtacagattccactgctgccctcaccctacccccaataagttaaaagtttctttcctaggttggttttgggcacagccatgtttgagagcactgactgatcttgacctcagaaggcaaaaaagcttgggagtgtattagttagaatatagattcaagtgcatgttacagagacccagaataatagtggcttaaacgagatagagaactttctcttttgtccttgtgcctataatcagggcctagtcatttccctcagtcttccatgaacacagacactgttgatcttgtgactctgtgctgtgaaaataggaaaatatagcaagtagggtgttactctcatattcatggtccaagactggtttgcttccacatcatcaggcccggcaaccttatggagtgaagtgaggaaaggggcaagcctctttaaggaccaacccagaagttctacacctgtttcccacacattccagtggctagaacttagtcacaggaccacagctagatgcaagggcgtctaggagatctcacccagccatatgctggataaaaaggaagagcagacagctagcagtctgttatttggggtggagtggataacgaatgactgtctcttagctttagtgtatctagatggatctttaccccaggcagttgacaatataggttgaaagcttttgaaaaaggtagcatcttagatacagtttgaagaggcatcagcttataaactatagttataaccttttatatggttagtcttcttttgtctgcctccacgtcgttcatgtgggcaacacatcccaccagcagaattgcagagtttggagaggaaggaaacctgctactcttatccacttttgagagtcactgaggtagatgacatttgatatctaggacccaggcagacatacagactggaaggtggccaagactcctggggaacaggaataccacagacatagtaccctgtagcttttcataggaaaaactggcagagcgtgcctggcacttgcaacataaaggttctggggagtggctgcagtgatgcggctgtagagtcaaaatctgcttgagggaaaatccctgattatgcagagcagatgagctttgggttatattttttctggtgcatgaatgggccacatgtttctatttaagtagtattccagcctgccttgttaatatctttgtgaagtgtttcgtgccaacactaaaaatattctgattttagggtacccagttcacacatttcacccataaggaaatgaagataaccctttctagatttttatataaacagtttaaggaaaagtatccaatagaaaccagtgttttcaagaattcaacagtgtccttaaagttcccaagttactttacaatttttttttcattctttaggcaccaatagcccaaatgaattaagaactatttcctacataactttctattttcctcctttaacacttttaaaaaggactattttcagaaggacaattattttgtactttgtgagaaaatttccaaggtgtttatattgttttatgtgtctgtcataggaaggaaaatcacctcggcagtgtttgaaggaaggatactgcaactctttgaagtacgcattttttgagtgtaaaagatcagtgttggataacagggcaagattcagaggaagaaaaggatattgatgcattatgttgaagccaacatggaaaacaacaaatattttccctggtcattaacacaaagaagccaaaacaggaaacatactttttactacatctgtttggttggaccagatttcccctccgtggaacactgaagaaagtggatgagttgttttcgaatatgtataaagtaaatgattctcttgatccaagttatttttagaagaaaaacctaattgaacaggtatgggttgggagcataataaatgtgttttgagaattgttctaaagcacagaaaatggaaagactgttatttgcaaacttgactcttcaattgaattacccaattagtacaggccactgatttgactgacacagtcgataacatgcagcctatccagaaggtgtctgttgggaaagtttaggataaaactttttctttagttcagtcttttcctgtctagttctaaaatgaattgtgtttgattccttagagaagaaatacttcatttgtgctctgattcactgaagtaataacctcagcactttaatagcgtccacaggcatagctgatgctaggccccagattgtgttgcccaggctctttaccatcatcttcggactgtttttgtttcctggttacattttcagtctggcccgctctacataatgggccagtgtcagctccaagtccacatccttattatccatgattcaaaagggagagagagaacttcctttttcagggtccacaaatcaaatctataaaaggactctggtcttcccaggatcacctgcccttgcattggaccagtccctgtggaagaggggatgggggcctgtgatcttggccaggcctgggctatctatctgcactgtcattgctaactcctgtcagaatcacatggatgagtagtgggctgaatcccaaaaggaaaggggtttagagcaagtggaaacaacagatgttcactatagaaagcaagaatgaaaaccatgaagtggttgaagattagccttacagtaattttattctgatcacttaatacagtagagtcaaacaggaatccaagtttccaactttattatttttggcactgaagaattacaaagaactctagcgtctttatacctccgtggttcactggagttaaagcaatcggggcgttgtacagctcacttgagtttttaaaggttctactaaaaagtgagaattccacagcaatatgggtcattgttgcagaatatcacaaaggtctgttgtgtatactccttttcaccaggaaagggacaataatagtttttttcaatgtatatatatataagtgatctaactttttattaataaaagtaaacaactctaaaatgta

SEQ ID NO: 427591 - DNA, 1769 bp, Homo sapiens
aagttgttgccgctggcttccggtcccctgagactggggcctcgctcgctcccgacccggttgcaagtgttgcggtgggagaaagtcgcgtccgcatcggaggggaagcgccgtcatgcctaagtattatgaggacaagccgcagggcggcgcgtgcgcgggcctgaaggaggacctgggcgcgtgtctgctgcagtcggactgtgtggtccaggaaggaaaatcacctcggcagtgtttgaaggaaggatactgcaactctttgaagtacgcattttttgagtgtaaaagatcagtgttggataacagggcaagattcagaggaagaaaaggatattgatgcattatgttgaagccaacatggaaaacaacaaatattttccctggtcattaacacaaagaagccaaaacaggaaacatactttttactacatctgtttggttggaccagatttcccctccgtggaacactgaagaaagtggatgagttgttttcgaatatgtataaagtaaatgattctcttgatccaagttatttttagaagaaaaacctaattgaacaggtatgggttgggagcataataaatgtgttttgagaattgttctaaagcacagaaaatggaaagactgttatttgcaaacttgactcttcaattgaattacccaattagtacaggccactgatttgactgacacagtcgataacatgcagcctatccagaaggtgtctgttgggaaagtttaggataaaactttttctttagttcagtcttttcctgtctagttctaaaatgaattgtgtttgattccttagagaagaaatacttcatttgtgctctgattcactgaagtaataacctcagcactttaatagcgtccacaggcatagctgatgctaggccccagattgtgttgcccaggctctttaccatcatcttcggactgtttttgtttcctggttacattttcagtctggcccgctctacataatgggccagtgtcagctccaagtccacatccttattatccatgattcaaaagggagagagagaacttcctttttcagggtccacaaatcaaatctataaaaggactctggtcttcccaggatcacctgcccttgcattggaccagtccctgtggaagaggggatgggggcctgtgatcttggccaggcctgggctatctatctgcactgtcattgctaactcctgtcagaatcacatggatgagtagtgggctgaatcccaaaaggaaaggggtttagagcaagtggaaacaacagatgttcactatagaaagcaagaatgaaaaccatgaagtggttgaagattagccttacagtaattttattctgatcacttaatacagtagagtcaaacaggaatccaagtttccaactttattatttttggcactgaagaattacaaagaactctagcgtctttatacctccgtggttcactggagttaaagcaatcggggcgttgtacagctcacttgagtttttaaaggttctactaaaaagtgagaattccacagcaatatgggtcattgttgcagaatatcacaaaggtctgttgtgtatactccttttcaccaggaaagggacaataatagtttttttcaatgtatatatatataagtgatctaactttttattaataaaagtaaacaactctaaaatgtatattataaagccctgtcatctttgttgagtaatagctttattgagctttatttggagaaatacacataccgtaaaattc

SEQ ID NO: 427592 - DNA, 1536 bp, Homo sapiens
aagttgttgccgctggcttccggtcccctgagactggggcctcgctcgctcccgacccggttgcaagtgttgcggtgggagaaagtcgcgtccgcatcggaggggaagcgccgtcatgcctaagtattatgaggacaagccgcagggcggcgcgtgcgcgggcctgaaggaggacctgggcgcgtgtctgctgcagtcggactgtgtggtccaggaaggaaaatcacctcggcagtgtttgaaggaaggatactgcaactctttgaagtacgcattttttgagtgtaaaagatcagtgttggataacagggcaagattcagaggaagaaaaggatattgatgcattatgttgaaagtaaatgattctcttgatccaagttatttttagaagaaaaacctaattgaacaggtatgggttgggagcataataaatgtgttttgagaattgttctaaagcacagaaaatggaaagactgttatttgcaaacttgactcttcaattgaattacccaattagtacaggccactgatttgactgacacagtcgataacatgcagcctatccagaaggtgtctgttgggaaagtttaggataaaactttttctttagttcagtcttttcctgtctagttctaaaatgaattgtgtttgattccttagagaagaaatacttcatttgtgctctgattcactgaagtaataacctcagcactttaatagcgtccacaggcatagctgatgctaggccccagattgtgttgcccaggctctttaccatcatcttcggactgtttttgtttcctggttacattttcagtctggcccgctctacataatgggccagtgtcagctccaagtccacatccttattatccatgattcaaaagggagagagagaacttcctttttcagggtccacaaatcaaatctataaaaggactctggtcttcccaggatcacctgcccttgcattggaccagtccctgtggaagaggggatgggggcctgtgatcttggccaggcctgggctatctatctgcactgtcattgctaactcctgtcagaatcacatggatgagtagtgggctgaatcccaaaaggaaaggggtttagagcaagtggaaacaacagatgttcactatagaaagcaagaatgaaaaccatgaagtggttgaagattagccttacagtaattttattctgatcacttaatacagtagagtcaaacaggaatccaagtttccaactttattatttttggcactgaagaattacaaagaactctagcgtctttatacctccgtggttcactggagttaaagcaatcggggcgttgtacagctcacttgagtttttaaaggttctactaaaaagtgagaattccacagcaatatgggtcattgttgcagaatatcacaaaggtctgttgtgtatactccttttcaccaggaaagggacaataatagtttttttcaatgtatatatatataagtgatctaactttttattaataaaagtaaacaactctaaaatgta

SEQ ID NO: 427593 - DNA, 651 bp, Homo sapiens
aagttgttgccgctggcttccggtcccctgagactggggcctcgctcgctcccgacccggttgcaagtgttgcggtgggagaaagtcgcgtccgcatcggaggggaagcgccgtcatgcctaagtattatgaggacaagccgcagggcggcgcgtgcgcgggcctgaaggaggacctgggcgcgtgtctgctgcagtcggactgtgtggtccaggtagcgcggccgggcgctcccggtggtgacgacccctgtcccaggaaggaaaatcacctcggcagtgtttgaaggaaggatactgcaactctttgaagtacgcattttttgagtgtaaaagatcagtgttggataacagggcaagattcagaggaagaaaaggatattgatgcattatgttgaagccaacatggaaaacaacaaatattttccctggtcattaacacaaagaagccaaaacaggaaacatactttttactacatctgtttggttggaccagatttcccctccgtggaacactgaagaaagtggatgagttgttttcgaatatgtataaagtaaatgattctcttgatccaagttatttttagaagaaaaacctaattgaacaggtatgggttgggagcataataaatgtgttttgagaattgttcta

SEQ ID NO: 427594 - DNA, 1734 bp, Homo sapiens
aagttgttgccgctggcttccggtcccctgagactggggcctcgctcgctcccgacccggttgcaagtgttgcggtgggagaaagtcgcgtccgcatcggaggggaagcgccgtcatgcctaagtattatgaggacaagccgcagggcggcgcgtgcgcgggcctgaaggaggacctgggcgcgtgtctgctgcagtcggactgtgtggtccaggtagcgcggccgggcgctcccggtggtgacgacccctgtcccaggaaggaaaatcacctcggcagtgtttgaaggaaggatactgcaactctttgaagtacgcattttttgagtgtaaaagatcagtgttggataacagggcaagattcagaggaagaaaaggatattgatgcattatgttgaagccaacatggaaaacaacaaatattttccctggtcattaacacaaagaagccaaaacaggaaacatactttttactacatctgtttggttggaccagatttcccctccgtggaacactgaagaaagtggatgagttgttttcgaatatgtataaagtaaatgattctcttgatccaagttatttttagaagaaaaacctaattgaacaggtatgggttgggagcataataaatgtgttttgagaattgttctaaagcacagaaaatggaaagactgttatttgcaaacttgactcttcaattgaattacccaattagtacaggccactgatttgactgacacagtcgataacatgcagcctatccagaaggtgtctgttgggaaagtttaggataaaactttttctttagttcagtcttttcctgtctagttctaaaatgaattgtgtttgattccttagagaagaaatacttcatttgtgctctgattcactgaagtaataacctcagcactttaatagcgtccacaggcatagctgatgctaggccccagattgtgttgcccaggctctttaccatcatcttcggactgtttttgtttcctggttacattttcagtctggcccgctctacataatgggccagtgtcagctccaagtccacatccttattatccatgattcaaaagggagagagagaacttcctttttcagggtccacaaatcaaatctataaaaggactctggtcttcccaggatcacctgcccttgcattggaccagtccctgtggaagaggggatgggggcctgtgatcttggccaggcctgggctatctatctgcactgtcattgctaactcctgtcagaatcacatggatgagtagtgggctgaatcccaaaaggaaaggggtttagagcaagtggaaacaacagatgttcactatagaaagcaagaatgaaaaccatgaagtggttgaagattagccttacagtaattttattctgatcacttaatacagtagagtcaaacaggaatccaagtttccaactttattatttttggcactgaagaattacaaagaactctagcgtctttatacctccgtggttcactggagttaaagcaatcggggcgttgtacagctcacttgagtttttaaaggttctactaaaaagtgagaattccacagcaatatgggtcattgttgcagaatatcacaaaggtctgttgtgtatactccttttcaccaggaaagggacaataatagtttttttcaatgtatatatatataagtgatctaactttttattaataaaagtaaacaactctaaaatgta

SEQ ID NO: 427595 - DNA, 682 bp, Homo sapiens
agctgccggagcgggtcgcgccggaggggggcggaggcggaagtggcggtgccgggcccggggagtaggaaggagccggggctgtagccggagtggagcggctgccagccgaggagcaggcgcggccgcggcgccatattgcggccctcagcggccgcgaccgagtcatggctgagacctacggtgagggtggtggacgaagctggggtcctgggtctgggcccagggaggatgcggcctgtgggaatgggcggggctttgtagatcagggggcggggtctggtgtgatggaggcaggacctaagtggatgctgggaggggtttagtgggtctgaggctgagcttaatcgatttaggtggagcctgagggtctggtgcgtgggttaaatagatctggggcgggatttgagggagctggtcctgaggggttcagggaggccctgagggaagaggtgggccttaatggatctgggcggagcctgagtgaaggggcggggctgactgcatgaatggcaggagtcgggcttatgggctagagggaacactgaatggaagctcgggaccctggggctgatctggctggagagagctctggaatgggtttggggatgggctgtccttgagttaggggcaggacttagtggctcttaaaggggatgggagctggccctcgttccgaatt

SEQ ID NO: 427596 - DNA, 1198 bp, Homo sapiens
agctgccggagcgggtcgcgccggaggggggcggaggcggaagtggcggtgccgggcccggggagtaggaaggagccggggctgtagccggagtggagcggctgccagccgaggagcaggcgcggccgcggcgccatattgcggccctcagcggccgcgaccgagtcatggctgagacctacgacttcctcttcaaattcctggtgattggcagtgcaggaactggcaaatcatgtctccttcatcagttcattgagaataagttcaaacaggactccaaccacacaatcggcgtggagtttggatcccgggtggtcaacgtgggtgggaagactgtgaagctacagatttgggacacggctggccaggagcggtttcggtcagtgacgcggagttattaccgaggggcggctggagccctgctggtgtacgacatcaccagccgggagacatacaactcactggctgcctggctgacggatgcccgcaccctggccagccccaacatcgtggtcatcctctgtggcaacaagaaggacctggaccctgagcgggaggtcactttcctggaggcctcccgctttgcccaggagaatgagctgatgttcctggagaccagcgctctcacaggcgagaacgtggaggaggcgttcctcaagtgtgcccgcactatcctcaacaagattgactcaggcgagctagacccggagaggatgggctctggcattcagtacggggatgcgtccctccgccagcttcggcagcctcggagtgcccaggccgtggcccctcagccgtgtggctgctgagctctgtggagccagctcacctgttctccaggaccagccctgctggggcccaggcccaggctctgagaggccgtgtcctaacctgccctggccccggagaagctacgttgccacctgtcccccttccctggcctggtggggcctggctttggggcaagactgagccacgggggaagggggaatcccgtacctgctgctgcttcctctgtcttggctaacgtctgtccccctgaacccctaaccatatcccaagagctcccaaagcctgagaccagggtcatttgtccccaactccccatctggccctgctgttgctagtacctgttatttattacctggaggcctgtccagcacccaccctacccccataaagcattgtttacacctgt

SEQ ID NO: 427597 - DNA, 1733 bp, Homo sapiens
tgcaagtataaactcatttgaaaacattgtgttggccaaaccacccacatctggtggcttgagatctgcctgtgttcccctgttttgcaacctccaggtttaaaggaggttttgccatcagagaggtgtgggtgtgaattcagctctgattttctgactgtggggccttgtcatgctgctgatgggtagactctggttggcctgttcctgtcctagatggtgctagagacacagtgttggagacagccctaggcccaaccttcatggagctcacagttcagtgggtgagggtggaaggacagacccacttccagacagtgacacctcaggaaggtcagggcttgatggtgaagcaccgggagacaggggtcagagccagcaggggagagccccagagggtcagggccagtactgggggggcaggcagagggatcggggtgggatggagaacacaggcagaggggtcagggctgggatagggcaggcagaggcagaggggtcagttgggatgaggggacacaggcagaggagttacatgggatggggggcaagggcagaggggttggggtgggatggggggcccaggtagaggggtcaaggccaagtttgggaggcacaggcagagcggttgcatgggatgggggagcatgggcagagggctcaggggtggaatggggcaggcctaggcagaagggtcaggggtggaatggggcaggtccaggcagaagggtcaggaaaggaatggggcaggcccaggcagaagggtcaggggtgggatggggacccaggcagagggttggggccaggatgaggaagcacaagcagtggggtcagggccaggatagggggccacaagaagctgtgggagccctaagtcggtacctgactcagcccaggaagtcagggaggacttcttggaggaggagctgtgtgagctgagctctgaaggaagagctgggtgggcatatcgggaagcggacattagtggcagggaaatggcatgcgcagaggcctgaggtgagggtaaggggggatggaacattggaggaacaggatgagagtcagcaggtgagagctcagtggagggtggggactaactggggccctgacctcagagtgtgtgcccctgcagagctgatgttcctggagaccagcgctctcacaggcgagaacgtggaggaggcgttcctcaagtgtgcccgcactatcctcaacaagattgactcaggcgagctagacccggagaggatgggctctggcattcagtacggggatgcgtccctccgccagcttcggcagcctcggagtgcccaggccgtggcccctcagccgtgtggctgctgagctctgtggagccagctcacctgttctccaggaccagccctgctggggcccaggcccaggctctgagaggccgtgtcctaacctgccctggccccggagaagctacgttgccacctgtcccccttccctggcctggtggggcctggctttggggcaagactgagccacgggggaagggggaatcccgtacctgctgctgcttcctctgtcttggctaacgtctgtccccctgaacccctaaccatatcccaagagctcccaaagcctgagaccagggtcatttgtccccaactccccatctggccctgctgttgctagtacctgttatttattacctggaggcctgtccagcacccaccctacccccataaagcattgtttacacctgt

SEQ ID NO: 427598 - DNA, 833 bp, Homo sapiens
agctgccggagcgggtcgcgccggaggggggcggaggcggaagtggcggtgccgggcccggggagtaggaaggagccggggctgtagccggagtggagcggctgccagccgaggagcaggcgcggccgcggcgccatattgcggccctcagcggccgcgaccgagtcatggctgagacctacgacttcctcttcaaattcctggtgattggcagtgcaggaactggcaaatcatgtctccttcatcagttcattgagaataagtgtgagtttcccgcagtggtcctgggaaccctgagctgtgtttatgcgcatggtgtgggctggtgggcagccggtggggagggcagggctggccataggtacaagtccagtgctggctttttggtccttgctttgtcgtatgtcctttactaggttctccttgacctcaagtcactccagcaaggagaatgggtttgtagagactgagagggccttggaggatgggggatcctctgagctgtctcctctctccctgtactgccccttctgttcctcctactcccagtcaaacaggactccaaccacacaatcggcgtggagtttggatcccgggtggtcaacgtgggtgggaagactgtgaagctacagatttgggacacggctggccaggagcggtttcggtcagtgacgcggagttattaccgaggggcggctggagccctgctggtgtacgacatcaccagagcggagacatacactactggctgctgctgacggatgcccgcatcctggtttggcaggtcgacgggaggatggatcctgacatggtgaaatggccataggacagac

SEQ ID NO: 427599 - DNA, 1135 bp, Homo sapiens
agctgccggagcgggtcgcgccggaggggggcggaggcggaagtggcggtgccgggcccggggagtaggaaggagccggggctgtagccggagtggagcggctgccagccgaggagcaggcgcggccgcggcgccatattgcggccctcagcggccgcgaccgagtcatggctgagacctacgacttcctcttcaaattcctggtgattggcagtgcaggaactggcaaatcatgtctccttcatcagttcattgagaataagttcaaacaggactccaaccacacaatcggcgtggagtttggatcccgggtggtcaacgtgggtgggaagactgtgaagctacagatttgggacacggctggccaggagcggtttcgccgggagacatacaactcactggctgcctggctgacggatgcccgcaccctggccagccccaacatcgtggtcatcctctgtggcaacaagaaggacctggaccctgagcgggaggtcactttcctggaggcctcccgctttgcccaggagaatgagctgatgttcctggagaccagcgctctcacaggcgagaacgtggaggaggcgttcctcaagtgtgcccgcactatcctcaacaagattgactcaggcgagctagacccggagaggatgggctctggcattcagtacggggatgcgtccctccgccagcttcggcagcctcggagtgcccaggccgtggcccctcagccgtgtggctgctgagctctgtggagccagctcacctgttctccaggaccagccctgctggggcccaggcccaggctctgagaggccgtgtcctaacctgccctggccccggagaagctacgttgccacctgtcccccttccctggcctggtggggcctggctttggggcaagactgagccacgggggaagggggaatcccgtacctgctgctgcttcctctgtcttggctaacgtctgtccccctgaacccctaaccatatcccaagagctcccaaagcctgagaccagggtcatttgtccccaactccccatctggccctgctgttgctagtacctgttatttattacctggaggcctgtccagcacccaccctacccccataaagcattgtttacacctgt

SEQ ID NO: 427600 - DNA, 1741 bp, Homo sapiens
  misc_feature (788)..(788): n is a, c, g, or t
agctgccggagcgggtcgcgccggaggggggcggaggcggaagtggcggtgccgggcccggggagtaggaaggagccggggctgtagccggagtggagcggctgccagccgaggagcaggcgcggccgcggcgccatattgcggccctcagcggccgcgaccgagtcatggctgagacctacgacttcctcttcaaattcctggtgattggcagtgcaggaactggcaaatcatgtctccttcatcagttcattgagaataagttcaaacaggactccaaccacacaatcggcgtggagtttggatcccgggtggtcaacgtgggtgggaagactgtgaagctacagatttgggacacggctggccaggagcggtttcggtcagtgacgcggagttattaccgaggggcggctggagccctgctggtgtacgacatcaccagccgggagacatacaactcactggctgcctggctgacggatgcccgcaccctggccagccccaacatcgtggtcatcctctgtggcaacaagaaggacctggaccctgagcgggaggtcactttcctggaggcctcccgctttgcccaggagaatgagctgatgttcctggagaccagcgctctcacaggcgagaacgtggaggaggcgttcctcaagtgtgcccgcactatcctcaacaagattgactcaggcgagctagacccggagaggatgggctctggcattcagtacggggatgcggtcctccgccagcttcggcagcctcggagtgcccagggcgtggcncctcagccgtgtggctgctgagctctgtggagccagctcacctgttctccaggaccagccctgctggggccacaagaagctgtgggagccctaagtcggtacctgactcagcccaggaagtcagggaggacttcttggaggaggagctgtgtgagctgagctctgaaggaagagctgggtgggcatatcgggaagcggacattagtggcagggaaatggcatgcgcagaggcctgaggtgagggtaaggggggatggaacattggaggaacaggatgagagtcagcaggtgagagctcagtggagggtggggactaactggggccctgacctcagagtgtgtgcccctgcagagctgatgttcctggagaccagcgctctcacaggcgagaacgtggaggaggcgttcctcaagtgtgcccgcactatcctcaacaagattgactcaggcgagctagacccggagaggatgggctctggcattcagtacggggatgcgtccctccgccagcttcggcagcctcggagtgcccaggccgtggcccctcagccgtgtggctgctgagctctgtggagccagctcacctgttctccaggaccagccctgctggggcccaggcccaggctctgagaggccgtgtcctaacctgccctggccccggagaagctacgttgccacctgtcccccttccctggcctggtggggcctggctttggggcaagactgagccacgggggaagggggaatcccgtacctgctgctgcttcctctgtcttggctaacgtctgtccccctgaacccctaaccatatcccaagagctcccaaagcctgagaccagggtcatttgtccccaactccccatctggccctgctgttgctagtacctgttatttattacctggaggcctgtccagcacccaccctacccccataaagcattgtttacacctgt

SEQ ID NO: 427601 - DNA, 1841 bp, Homo sapiens
  misc_feature (5)..(5): n is a, c, g, or t
ggcangaccctgaggtgagaaccagcttgtcattttcagggaatagactgaaggtcaggagctatagtggagtgaatgagtcagagggtggtaggaggtgaagaggaacaagggctatatcgtagtccttgtttaaatagctttcaagagactttagcgacaaaatagctaagatctgggactctggagcccttggcctaggtttgaatctcacttctgcccagctgtgtcactttgggcaagtcagttaacctttctggcctgttacctcatccggaaaatgggaataatttttagtctacctccctcatagagttttcctgaggatgatgtgagctgttgatgtgagtaaagacctttagaactgttcctggcccacaacaacacacaattgacccatgtaacaaacctgcacatgtgggctgggcgcggtggctcatgcctgtaatcccagcactttgggaggctgaggcaggcggatcacctgaggtcgggagtttgagaccagcctgaccaacatggagaaaccccgtctctactaaaaatacagaattagctgagtgtggtggcgcatgcctgtaatcccagctactcgggaggctgaggcaggagaattgcttgaacctgggaggtggaggttgcggtgagccgagatcgcgccattgcactccagcctgggcaacgaaaagtgaaactctgtctcaaaaaaacaaaaacaacgacaaaaaaacccctgcacatgtactccctgaatctaaaataaaagttgaaaaaaaatatatagaatgtgcctggcacatggcaagtactacataagagttatctgttactgttacctattggtttgtttctgcccaaccaatagaatattcttattatatatgatgcactctggtatttgccgttctgtgctattctgtttgaatttaaaaattggtcaagacccaccaaactgatttccccaccaaggcagtgacacacattagaatgacctggagaattttaaaagatactgatgcccaggcctcaccctagagattctgaagtggtttcaggactttttcttaattaaaagataaatagagatgaggtctcactatgttgcccaggctggtctcaaactcctgggctcaagcattcctcctgccttggcttcccacagtgctgggattacaggcgtgagccactgcgtccatccagattcatgatatttagatgttgaaatgtggctttacagactcagacagctctctgaggcaaacaaagagggagatgcaggtaccctcagcacaagccccaaattacctgcaggggagaggcggaaaatcagacaatgtagaaaccgggagaagaaaggtatggacagaccgatgcagataggaggggaaggaaatacctggaaatgagatagagaccggctggacagaccccggggaccctgcaggtcaccacacccttctctttcagctcacctgttctccaggaccagccctgctggggcccaggcccaggctctgagaggccgtgtcctaacctgccctggccccggagaagctacgttgccacctgtcccccttccctggcctggtggggcctggctttggggcaagactgagccacgggggaagggggaatcccgtacctgctgctgcttcctctgtcttggctaacgtctgtccccctgaacccctaaccatatcccaagagctcccaaagcctgagaccagggtcatttgtccccaactccccatctggccctgctgttgctagtacctgttatttattacctggaggcctgtccagcacccaccctacccccataaagcattgtttacacctgt

SEQ ID NO: 427602 - DNA, 970 bp, Homo sapiens
agctgccggagcgggtcgcgccggaggggggcggaggcggaagtggcggtgccgggcccggggagtaggaaggagccggggctgtagccggagtggagcggctgccagccgaggagcaggcgcggccgcggcgccatattgcggccctcagcggccgcgaccgagtcatggctgagacctacgacttcctcttcaaattcctggtgattggcagtgcaggaactggcaaatcatgtctccttcatcagttcattgagaataagtgtgagtttcccgcagtggtcctgggaaccctgagctgtgtttatgcgcatggtgtgggctggtgggcagccggtggggagggcagggctggccataggtacaagtccagtgctggctttttggtccttgctttgtcgtatgtcctttactaggttctccttgacctcaagtcactccagcaaggagaatgggtttgtagagactgagagggccttggaggatgggggatcctctgagctgtctcctctctccctgtactgccccttctgttcctcctactcccagtcaaacaggactccaaccacacaatcggcgtggagtttggatcccgggtggtcaacgtgggtgggaagactgtgaagctacagatttgggacacggctggccaggagcggtttcggtaggtgggctgggctcccaagggtgatggggagagagagtgagaaggaaagagagagatgtgtgtgtagagtcacttggagacactgagagggcagacaaggcagacagagagagatgagacaccgtagttagcaggtatatatatccaaggagagagggagtactggagagataaagagatggtggaagaaaaagaggtaggggccaggcgcaatggctcatgccggtaatccccgtgctttgggaggccatggtgggaagattgcctgagcccaggagtttgagaccagcctgggcaacatag

SEQ ID NO: 427603 - DNA, 1992 bp, Homo sapiens
  misc_feature (5)..(5): n is a, c, g, or t
ggcangaccctgaggtgagaaccagcttgtcattttcagggaatagactgaaggtcaggagctatagtggagtgaatgagtcagagggtggtaggaggtgaagaggaacaagggctatatcgtagtccttgtttaaatagctttcaagagactttagcgacaaaatagctaagatctgggactctggagcccttggcctaggtttgaatctcacttctgcccagctgtgtcactttgggcaagtcagttaacctttctggcctgttacctcatccggaaaatgggaataatttttagtctacctccctcatagagttttcctgaggatgatgtgagctgttgatgtgagtaaagacctttagaactgttcctggcccacaacaacacacaattgacccatgtaacaaacctgcacatgtgggctgggcgcggtggctcatgcctgtaatcccagcactttgggaggctgaggcaggcggatcacctgaggtcgggagtttgagaccagcctgaccaacatggagaaaccccgtctctactaaaaatacagaattagctgagtgtggtggcgcatgcctgtaatcccagctactcgggaggctgaggcaggagaattgcttgaacctgggaggtggaggttgcggtgagccgagatcgcgccattgcactccagcctgggcaacgaaaagtgaaactctgtctcaaaaaaacaaaaacaacgacaaaaaaacccctgcacatgtactccctgaatctaaaataaaagttgaaaaaaaatatatagaatgtgcctggcacatggcaagtactacataagagttatctgttactgttacctattggtttgtttctgcctatgtctgtttctctccctctaactgtgatggttagagagagagattggattggaatccatcttttttccctgtatctttctctccctgtgggtatccctgattttggctccatctggtcagacttcctcttcaaattcctggtgattggcagtgcaggaactggcaaatcatgtctccttcatcagttcattgagaataagttcaaacaggactccaaccacacaatcggcgtggagtttggatcccgggtggtcaacgtgggtgggaagactgtgaagctacagatttgggacacggctggccaggagcggtttcggtcagtgacgcggagttattaccgaggggcggctggagccctgctggtgtacgacatcaccagccgggagacatacaactcactggctgcctggctgacggatgcccgcaccctggccagccccaacatcgtggtcatcctctgtggcaacaagaaggacctggaccctgagcgggaggtcactttcctggaggcctcccgctttgcccaggagaatgagctgatgttcctggagaccagcgctctcacaggcgagaacgtggaggaggcgttcctcaagtgtgcccgcactatcctcaacaagattgactcaggcgagctagacccggagaggatgggctctggcattcagtacggggatgcgtccctccgccagcttcggcagcctcggagtgcccaggccgtggcccctcagccgtgtggctgctgagctctgtggagccagctcacctgttctccaggaccagccctgctggggcccaggcccaggctctgagaggccgtgtcctaacctgccctggccccggagaagctacgttgccacctgtcccccttccctggcctggtggggcctggctttggggcaagactgagccacgggggaagggggaatcccgtacctgctgctgcttcctctgtcttggctaacgtctgtccccctgaacccctaaccatatcccaagagctcccaaagcctgagaccagggtcatttgtccccaactccccatctggccctgctgttgctagtacctgttatttattacctggaggcctgtccagcacccaccctacccccataaagcattgtttacacctgt

SEQ ID NO: 427604 - DNA, 1483 bp, Homo sapiens
agctgccggagcgggtcgcgccggaggggggcggaggcggaagtggcggtgccgggcccggggagtaggaaggagccggggctgtagccggagtggagcggctgccagccgaggagcaggcgcggccgcggcgccatattgcggccctcagcggccgcgaccgagtcatggctgagacctacgacttcctcttcaaattcctggtgattggcagtgcaggaactggcaaatcatgtctccttcatcagttcattgagaataagtgtgagtttcccgcagtggtcctgggaaccctgagctgtgtttatgcgcatggtgtgggctggtgggcagccggtggggagggcagggctggccataggtacaagtccagtgctggctttttggtccttgctttgtcgtatgtcctttactaggttctccttgacctcaagtcactccagcaaggagaatgggtttgtagagactgagagggccttggaggatgggggatcctctgagctgtctcctctctccctgtactgccccttctgttcctcctactcccagtcaaacaggactccaaccacacaatcggcgtggagtttggatcccgggtggtcaacgtgggtgggaagactgtgaagctacagatttgggacacggctggccaggagcggtttcggtcagtgacgcggagttattaccgaggggcggctggagccctgctggtgtacgacatcaccagccgggagacatacaactcactggctgcctggctgacggatgcccgcaccctggccagccccaacatcgtggtcatcctctgtggcaacaagaaggacctggaccctgagcgggaggtcactttcctggaggcctcccgctttgcccaggagaatgagctgatgttcctggagaccagcgctctcacaggcgagaacgtggaggaggcgttcctcaagtgtgcccgcactatcctcaacaagattgactcaggcgagctagacccggagaggatgggctctggcattcagtacggggatgcgtccctccgccagcttcggcagcctcggagtgcccaggccgtggcccctcagccgtgtggctgctgagctctgtggagccagctcacctgttctccaggaccagccctgctggggcccaggcccaggctctgagaggccgtgtcctaacctgccctggccccggagaagctacgttgccacctgtcccccttccctggcctggtggggcctggctttggggcaagactgagccacgggggaagggggaatcccgtacctgctgctgcttcctctgtcttggctaacgtctgtccccctgaacccctaaccatatcccaagagctcccaaagcctgagaccagggtcatttgtccccaactccccatctggccctgctgttgctagtacctgttatttattacctggaggcctgtccagcacccaccctacccccataaagcattgtttacacctgt

SEQ ID NO: 427605 - DNA, 1179 bp, Homo sapiens
agctgccggagcgggtcgcgccggaggggggcggaggcggaagtggcggtgccgggcccggggagtaggaaggagccggggctgtagccggagtggagcggctgccagccgaggagcaggcgcggccgcggcgccatattgcggccctcagcggccgcgaccgagtcatggctgagacctacgacttcctcttcaaattcctggtgattggcagtgcaggaactggcaaatcatgtctccttcatcagttcattgagaataagttcaaacaggactccaaccacacaatcggcgtggagtttggatcccgggtggtcaacgtgggtgggaagactgtgaagctacagatttgggacacggctggccaggagcggtttcggtcagtgacgcggagttattaccgaggggcggctggagccctgctggtgtacgacatcaccagccgggagacatacaactcactggctgcctggctgacggatgcccgcaccctggccagccccaacatcgtggtcatcctctgtggcaacaagaaggacctggaccctgagcgggaggtcactttcctggaggcctcccgctttgcccaggagaatgagctgatgttcctggagaccagcgctctcacaggcgagaacgtggaggaggcgttcctcaagtgtgcccgcactatcctcaacaagattgactcaggcgagctagacccggagaggatgggctctggcattcagtacggggatgcgtccctccgccagcttcggcagcctcggagtgcccaggccgtggcccctcagccgtgtggctgctgagctctgtggagccaggactttgcacctgctgtgcctgagcctaagtttgctcatctgtaaaatgaggctaataatagcacctgcttctatagatgttgagaagaagaaatacattaattcacgaaagtgctcagaatggggcctgatggtcaagacttgatcgatgagggctgtttttaaagttttcttcttatccatctttgggctgagctcaaatgaatgggtgtgtcttcttcacctcagggcttagcagagactctgtcctagagagtttgccctcagtaggtgaaatgtaacaaggcaaggcaaggctttttcacactttgctgactgcaatctacaggaggaaatatattttatgtgttaatca

SEQ ID NO: 427606 - DNA, 563 bp, Homo sapiens
  misc_feature (16)..(16): n is a, c, g, or t
  misc_feature (64)..(64): n is a, c, g, or t
  misc_feature (66)..(66): n is a, c, g, or t
ggcacggcattcgatnagtgtggggaggaatggggtgggttttgtatgttcaaactgtcatttnanttctacgttgttagatatggggtgtcggcagctgctgtagcgaagagagtttggcgcgatgtctcacaccattttgctggtacagcctaccaagaggccagaaggcagaacttatgctgactacgaatctgtgaatgaatgcatggaaggtgtttgtaaaatgtatgaagaacatctgaaaagaatgaatcccaacagtccctctatcacatatgacatcagtcagttgtttgatttcatcgatgatctggcagacctcagctgcctggtttaccgagctgatacccagacataccagccttataacaaagactggattaaagagaagatctacgtgctccttcgtcggcaggcccaacaggctgggaaataattgtgttggaagcactgggggggttggggtgggcttggaaacggcatggttgtgaagctagcgaacctgttgagtggaaacggtgaataagatgaatgcaggctccacctttgtaatactctag

SEQ ID NO: 427607 - DNA, 829 bp, Homo sapiens
gggctcctctcgcgaggattggctgttagcggcgttgtagttaagctcgtgtaacggcggcggtgtcggcagctgctgtagcgaagagagtttggcgcgatgtctcacaccattttgctggtacagcctaccaagaggccagaaggcagaacttatgctgactacgaatctgtgaatgaatgcatggaaggtgtttgtaaaatgtatgaagaacatctgaaaagaatgaatcccaacagtccctctatcacatatgacatcagtcagttgtttgatttcatcgatgatctggcagacctcagctgcctggtttaccgagctgatacccagacataccagccttataacaaagactggattaaagagaagatctacgtgctccttcgtcggcaggcccaacaggctgggaaataattgtgttggaagcactgggggggttggggtgggcttggaacacaggtgtgtacagcgtgctgtagtggaagttttgtatcatagtaatcctgtttccactttgttatactctagccaagattgactgtattagatgaaatgtgaggatcttgttcaatcggaaacccccgttacctcctctttttctttctctttctttttttttttttacttaaacatttttatgatgatttagatggaagttgttcttcgtcacttaatgttggttccagtccttcaactgttcatatctactttataacattcacatactaacccttcttcaagatggggtggggggtggaaatgcagtttagccatgtcctcaagataaagtcttggtaaaaataaataaatgtcctttagttatattttc

SEQ ID NO: 427608 - DNA, 888 bp, Homo sapiens
  misc_feature (16)..(16): n is a, c, g, or t
  misc_feature (64)..(64): n is a, c, g, or t
  misc_feature (66)..(66): n is a, c, g, or t
ggcacggcattcgatnagtgtggggaggaatggggtgggttttgtatgttcaaactgtcatttnanttctacgttgttagatatggagcggcgttgtagttaagctcgtgtaacggcggcggtgtcggcagctgctgtagcgaagagagtttggcgcgatgtctcacaccattttgctggtacagcctaccaagaggccagaaggcagaacttatgctgactacgaatctgtgaatgaatgcatggaaggtgtttgtaaaatgtatgaagaacatctgaaaagaatgaatcccaacagtccctctatcacatatgacatcagtcagttgtttgatttcatcgatgatctggcagacctcagctgcctggtttaccgagctgatacccagacataccagccttataacaaagactggattaaagagaagatctacgtgctccttcgtcggcaggcccaacaggctgggaaataattgtgttggaagcactgggggggttggggtgggcttggaacacaggtgtgtacagcgtgctgtagtggaagttttgtatcatagtaatcctgtttccactttgttatactctagccaagattgactgtattagatgaaatgtgaggatcttgttcaatcggaaacccccgttacctcctctttttctttctctttctttttttttttttacttaaacatttttatgatgatttagatggaagttgttcttcgtcacttaatgttggttccagtccttcaactgttcatatctactttataacattcacatactaacccttcttcaagatggggtggggggtggaaatgcagtttagccatgtcctcaagataaagtcttggtaaaaataaataaatgtcctttagttatattttc

SEQ ID NO: 427609 - DNA, 860 bp, Homo sapiens
ctggagttggttaaaaaatagtagagggatgatgctaactacttaggccggggtggggagcggcgttgtagttaagctcgtgtaacggcggcggtgtcggcagctgctgtagcgaagagagtttggcgcgatgtctcacaccattttgctggtacagcctaccaagaggccagaaggcagaacttatgctgactacgaatctgtgaatgaatgcatggaaggtgtttgtaaaatgtatgaagaacatctgaaaagaatgaatcccaacagtccctctatcacatatgacatcagtcagttgtttgatttcatcgatgatctggcagacctcagctgcctggtttaccgagctgatacccagacataccagccttataacaaagactggattaaagagaagatctacgtgctccttcgtcggcaggcccaacaggctgggaaataattgtgttggaagcactgggggggttggggtgggcttggaacacaggtgtgtacagcgtgctgtagtggaagttttgtatcatagtaatcctgtttccactttgttatactctagccaagattgactgtattagatgaaatgtgaggatcttgttcaatcggaaacccccgttacctcctctttttctttctctttctttttttttttttacttaaacatttttatgatgatttagatggaagttgttcttcgtcacttaatgttggttccagtccttcaactgttcatatctactttataacattcacatactaacccttcttcaagatggggtggggggtggaaatgcagtttagccatgtcctcaagataaagtcttggtaaaaataaataaatgtcctttagttatattttc

SEQ ID NO: 427610 - DNA, 778 bp, Homo sapiens
cggacgcgtgggtcgacccacgcgtccgagcgaagagagtttggcgcgatgtctcacaccattttgctggtacagcctaccaagaggccagaaggcagaacttatgctgactacgaatctgtgaatgaatgcatggaaggtgtttgtaaaatgtatgaagaacatctgaaaagaatgaatcccaacagtccctctatcacatatgacatcagtcagttgtttgatttcatcgatgatctggcagacctcagctgcctggtttaccgagctgatacccagacataccagccttataacaaagactggattaaagagaagatctacgtgctccttcgtcggcaggcccaacaggctgggaaataattgtgttggaagcactgggggggttggggtgggcttggaacacaggtgtgtacagcgtgctgtagtggaagttttgtatcatagtaatcctgtttccactttgttatactctagccaagattgactgtattagatgaaatgtgaggatcttgttcaatcggaaacccccgttacctcctctttttctttctctttctttttttttttttacttaaacatttttatgatgatttagatggaagttgttcttcgtcacttaatgttggttccagtccttcaactgttcatatctactttataacattcacatactaacccttcttcaagatggggtggggggtggaaatgcagtttagccatgtcctcaagataaagtcttggtaaaaataaataaatgtcctttagttatattttc

SEQ ID NO: 427611 - DNA, 1287 bp, Homo sapiens
  misc_feature (1174)..(1174): n is a, c, g, or t
gggctcctctcgcgaggattggctgttagcggcgttgtagttaagctcgtgtaacggcggcggtgtcggcagctgctgtagcgaagagagtttggcgcgatgtctcacaccattttgctggtacagcctaccaagaggccagaaggcagaacttatgctgactacgaatctgtgaatgaatgcatggaaggtgtttgtaaaatgtatgaagaacatctgaaaagaatgaatcccaacagtccctctatcacatatgacatcagtcagttgtttgatttcatcgatgatctggcagacctcagctgcctggtttaccgagctgatacccagacataccagccttataacaaagactggattaaagagaagatctacgtgctccttcgtcggcaggcccaacaggctgggaaataattgtgttggaagcactgggggggttggggtgggcttggaacacaggtgtgtacagcgtgctgtagtggaagttttgtatcatagtaatcctgtttccactttgttatactctagccaagattgactgtattagatgaaatgtgaggatcttgttcaatcggaaacccccgttacctcctctttttctttctctttctttttttttttttacttaaacatttttatgatgatttagatggaagttgttcttcgtcacttaatgttggttccagtccttcaactgttcatatctactttataacattcacatactaacccttcttcaagatggggtggggggtggaaatgcagtttagccatgtcctcaagataaagtcttggtaaaaataaataaatgtcctttagttatattttcaaaaaaaaaaaaaaaaaaaaaaaaaaaaaaaaaaaaaaaagggggggggccccaaaaaaaaacccccggggggccccaatggccccccccttttttggacaaagggggccccccaaaagggggggaaaaaaaagaggggggccgggggggggaaaaaaacgggcgggcggaacaccgccgcgggatctcgggaaggcccctcttcgggccgcgcacccaggggcgacccccccccaggaattaggatgcggaggacataaacctggggtgacagggcacccccggcatttgcggggggaactggcccgggctgtcctcgcaaaagacgcgctgacacacacaagntagcagacaacagacaaaagcactagaaagagagcaaaacgagtaaagtcaacgaaaaaaagaaaacacgaaaacagccagcaagacacaggaccgagcacaaacaagacgtc

SEQ ID NO: 427612 - DNA, 815 bp, Homo sapiens
gcgctcgggttaaggagggtgatggtggctatgatggtggggatgatgaggctattgttttttgtgaattcttcgataatggcccatttgggcaaaaagccagcggcgttgtagttaagctcgtgtaacggcggcggtgtcggcagctgctgtagcgaagagagtttggcgcgatggtgtttgtaaaatgtatgaagaacatctgaaaagaatgaatcccaacagtccctctatcacatatgacatcagtcagttgtttgatttcatcgatgatctggcagacctcagctgcctggtttaccgagctgatacccagacataccagccttataacaaagactggattaaagagaagatctacgtgctccttcgtcggcaggcccaacaggctgggaaataattgtgttggaagcactgggggggttggggtgggcttggaacacaggtgtgtacagcgtgctgtagtggaagttttgtatcatagtaatcctgtttccactttgttatactctagccaagattgactgtattagatgaaatgtgaggatcttgttcaatcggaaacccccgttacctcctctttttctttctctttctttttttttttttacttaaacatttttatgatgatttagatggaagttgttcttcgtcacttaatgttggttccagtccttcaactgttcatatctactttataacattcacatactaacccttcttcaagatggggtggggggtggaaatgcagtttagccatgtcctcaagataaagtcttggtaaaaataaataaatgtcctttagttatattttc

SEQ ID NO: 427613 - DNA, 834 bp, Homo sapiens
  misc_feature (16)..(16): n is a, c, g, or t
  misc_feature (64)..(64): n is a, c, g, or t
  misc_feature (66)..(66): n is a, c, g, or t
ggcacggcattcgatnagtgtggggaggaatggggtgggttttgtatgttcaaactgtcatttnanttctacgttgttagatatggagcggcgttgtagttaagctcgtgtaacggcggcggtgtcggcagctgctgtagcgaagagagtttggcgcgatgtctcacaccattttgctggtacagcctaccaagaggccagaaggcagaacttatgctgactacgaatctgtgaatgaatgcatggaaggtgtttgtaaaatgtatgaagaacatctggatttcatcgatgatctggcagacctcagctgcctggtttaccgagctgatacccagacataccagccttataacaaagactggattaaagagaagatctacgtgctccttcgtcggcaggcccaacaggctgggaaataattgtgttggaagcactgggggggttggggtgggcttggaacacaggtgtgtacagcgtgctgtagtggaagttttgtatcatagtaatcctgtttccactttgttatactctagccaagattgactgtattagatgaaatgtgaggatcttgttcaatcggaaacccccgttacctcctctttttctttctctttctttttttttttttacttaaacatttttatgatgatttagatggaagttgttcttcgtcacttaatgttggttccagtccttcaactgttcatatctactttataacattcacatactaacccttcttcaagatggggtggggggtggaaatgcagtttagccatgtcctcaagataaagtcttggtaaaaataaataaatgtcctttagttatattttc

SEQ ID NO: 427614 - DNA, 882 bp, Homo sapiens
  misc_feature (16)..(16): n is a, c, g, or t
  misc_feature (64)..(64): n is a, c, g, or t
  misc_feature (66)..(66): n is a, c, g, or t
  misc_feature (811)..(811): n is a, c, g, or t
ggcacggcattcgatnagtgtggggaggaatggggtgggttttgtatgttcaaactgtcatttnanttctacgttgttagatatggagcggcgttgtagttaagctcgtgtaacggcggcggtgtcggcagctgctgtagcgaagagagtttggcgcgatgtctcacaccattttgctggtacagcctaccaagaggccagaaggcagaacttatgctgactacgaatctgtgaatgaatgcatggaaggtgtttgtaaaatgtatgaagaacatctgaaaagaatgaatcccaacagtccctctatcacatatgacatcagtcagttgtttgatttcatcgatgatctggcagacctcagctgcctggtttaccgagctgatacccagacataccagccttataacaaagactggattaaagagaagatctacgtgctccttcgtcggcaggcccaacaggctgggaaataattgtgttggaagcactgggggggttggggtgggcttggaacacaggtgtgtacagcgtgctgtagtggaagttttgtatcatagtaatcctgtttccactttgttatactctagccaagattgactgtattagatgaaatgtgaggatcttgttcaatcggaaacccccgttacctcctctttttctttctctttctttttttttttttacttaaacatttttatgatgatttagatggaagttgttcttcgtcacttaatgttggttccagtccttcaactgttcagaagtcctcgacggactctgaaagcatgggagcagagatttgcggacgagnggggaaccatcagcaaacaaatgaagccaggaatcacagtaagggcgcaagggctgaggccagttgtttcc

SEQ ID NO: 427615 - DNA, 865 bp, Homo sapiens
  misc_feature (16)..(16): n is a, c, g, or t
  misc_feature (64)..(64): n is a, c, g, or t
  misc_feature (66)..(66): n is a, c, g, or t
  misc_feature (808)..(808): n is a, c, g, or t
  misc_feature (812)..(812): n is a, c, g, or t
ggcacggcattcgatnagtgtggggaggaatggggtgggttttgtatgttcaaactgtcatttnanttctacgttgttagatatggagcggcgttgtagttaagctcgtgtaacggcggcggtgtcggcagctgctgtagcgaagagagtttggcgcgatgtctcacaccattttgctggtacagcctaccaagaggccagaaggcagaacttatgctgactacgaatctgtgaatgaatgcatggaaggtgtttgtaaaatgtatgaagaacatctgaaaagaatgaatcccaacagtccctctatcacatatgacatcagtcagttgtttgatttcatcgatgatctggcagacctcagctgcctggtttaccgagctgatacccagacataccagccttataacaaagactggattaaagagaagatctacgtgctccttcgtcggcaggcccaacaggctgggaaataattgtgttggaagcactgggggggttggggtgggcttggaacacaggtgtgtacagcgtgctgtagtggaagttttgtatcatagtaatcctgtttccactttgttatactctagccaagattgactgtattagatgaaatgtgaggatcttgttcaatcggaaacccccgttacctcctctttttctttctctttctttttttttttttacttaaacatttttatgatgatttagatggaagttgttcttcgtcacttaatgttggttccagtccttcaactgttcaaaaaaacatccccagtccccccgcggggggggacgaaccacaacacanaacnaaaccacggtttagccacatgtcctcagagataaagtcttggtaaaaataaat

SEQ ID NO: 427616 - DNA, 801 bp, Homo sapiens
gggctcctctcgcgaggattggctgttagcggcgttgtagttaagctcgtgtaacggcggcggtgtcggcagctgctgtagcgaagagagtttggcgcgatgtctcacaccattttgctggtacagcctaccaagaggccagaaggcagaacttatgctgactacgaatctgtgaatgaatgcatggaaggtgtttgtaaaatgtatgaagaacatctgaaaagaatgaatcccaacagtccctctatcacatatgacatcagtcagttgtttgatttcatcgatgatctggcagacctcagctgcctggtttaccgagctgatacccagacataccagccttataacaaagactggattaaagagaagatctacgtgctccttcgtcggcaggcccaacaggctgggaaataattgtgttggaaacacaggtgtgtacagcgtgctgtagtggaagttttgtatcatagtaatcctgtttccactttgttatactctagccaagattgactgtattagatgaaatgtgaggatcttgttcaatcggaaacccccgttacctcctctttttctttctctttctttttttttttttacttaaacatttttatgatgatttagatggaagttgttcttcgtcacttaatgttggttccagtccttcaactgttcatatctactttataacattcacatactaacccttcttcaagatggggtggggggtggaaatgcagtttagccatgtcctcaagataaagtcttggtaaaaataaataaatgtcctttagttatattttc

SEQ ID NO: 427617 - DNA, 641 bp, Homo sapiens
gggctcctctcgcgaggattggctgttagcggcgttgtagttaagctcgtgtaacggcggcggtgtcggcagctgctgtagcgaagagagtttggcgcgatgtctcacaccattttgctggtacagcctaccaagaggccagaaggcagaacttatgctgactacgaatctgtgaatgaatgcatggaaggtgtttgtaaaatgtatgaagaacatctgaaaagaatgaatcccaacagtccctctatcacatatgacatcagtcagttgtttgatttcatcgatgatctggcagacctcagctgcctggtttaccgagctgatacccagacataccagccttataacaaagactggattaaagagaagatctacgtgctccttcgtcggcaggcccaacaggctgggaaataattgtgttggaagcactgggggggttggggtgggcttggaacacaggtgtgtacagcgtgctgtagtggaagttttgtatcatagtaatcctgtttccactttgttatactctagccaagattgactgtattagatgaaatgtgaggatcttgttcaaatccatttttatgatgaattacatggttggtctttggcaccttaaggttgtttcccagcccttcctgttc

SEQ ID NO: 427618 - DNA, 521 bp, Homo sapiens
gggctcctctcgcgaggattggctgttagcggcgttgtagttaagctcgtgtaacggcggcggtgtcggcagctgctgtagcgaagagagtttggcgcgatgtctcacaccattttgctggtacagcctaccaagaggccagaaggcagaacttatgctgactacgaatctgtgaatgaatgcatggaaggtgtttgtaaaatgtatgaagaacatctgaaaagaatgaatcccaacagtccctctatcacatatgacatcagtcagttgtttgatttcatcgatgatctggcagacctcagctgcctggtttaccgagctgatacccagacataccagccttataacaaagactggattaaagagaagatctacgtgctccttcgtcggcaggcccaacaggctgggaaataattgtgttggaagcactgggggggttggggtgggcttggaacacaggtgtgtacagcgtgctgtagtggaagttttgtatcttgtggtgtgccgttaggccgatctga

SEQ ID NO: 427619 - DNA, 729 bp, Homo sapiens
  misc_feature (16)..(16): n is a, c, g, or t
  misc_feature (64)..(64): n is a, c, g, or t
  misc_feature (66)..(66): n is a, c, g, or t
ggcacggcattcgatnagtgtggggaggaatggggtgggttttgtatgttcaaactgtcatttnanttctacgttgttagatatggagcggcgttgtagttaagctcgtgtaacggcggcggtgtcggcagctgctgtagcgaagagagtttggcgcgatgtctcacaccattttgctggtacagcctaccaagaggccagaaggcagaacttatgctgactacgaatctgtgaatgaatgcatggaaggtgtttgtaaaatgtatgaagaacatctggatttcatcgatgatctggcagacctcagctgcctggtttaccgagctgatacccagacataccagccttataacaaagactggattaaagagaagatctacgtgctccttcgtcggcaggcccaacaggctgggaaataattgtgttggaagcactgggggggttggggtgggcttggaacacaggtgtgtacagcgtgctgtagtggaagttttgtatccgttcttcgcttccctgtcctcactttgtcctactcttgcctctactgactgtcttaggattactcgtggcgtccctagtcacctagccatccctgcttctctctcttaacacttcctccctcgcctttctcatttcacctgcgcatttctacgtaagtcccaatcgtaatccctattttcttcacctttaccccttgcatccactcctttttcccttgcccaccttatc

SEQ ID NO: 427620 - DNA, 268 bp, Homo sapiens
  misc_feature (16)..(16): n is a, c, g, or t
  misc_feature (64)..(64): n is a, c, g, or t
  misc_feature (66)..(66): n is a, c, g, or t
ggcacggcattcgatnagtgtggggaggaatggggtgggttttgtatgttcaaactgtcatttnanttctacgttgttagatatggagcggcgttgtagttaagctcgtgtaacggcggcggtgtcggcagctgctgtagcgaagagagtttggcgcgatgtctcacaccattttgctggtacagcctaccaagaggtccaatcttccggataccagatatagcctaattacaaagaaagcattaacctgcctctgaggtgactaaag

SEQ ID NO: 427621 - DNA, 392 bp, Homo sapiens
tacagcgtgctgtagtggaagttttgtatcatagtaatcctgtttccactttgttatactctagccaagattgactgtattagatgaaatgtgaggatcttgttcaatcggaaacccccgttacctcctctttttctttctctttctttttttttttttacttaaacatttttatgatgatttagatggaagttgttcttcgtcacttaatgttggttccagtccttcaactgttcatatctactttataacattcacatactaacccttcttcaagatggggtggggggtggaaatgcagtttagccatgtcctcaagataaagtcttggtaaaaataaataaatgtcctttagttatattttctccctgagtgctttttttttttttgtc

SEQ ID NO: 427622 - DNA, 2450 bp, Homo sapiens
gagccgagatcgcgccaccgccctccagcctgggcgacagagcaagactctgtctcaaaaaaaaaaaaaaaaagagcaaattttttttccaaggtgatagggagagtccgtggctgatgtctgcactgaccagacgcccctagggggccagcgagggcgggtcccaggtgcagcggatgcagaggagagaggcccgggcgcggcgcgggggatggtgcgatcccgggcccgagggcatcagacggcggctgattagggtttgcatcacccggaccgggggattagctccggtttgcatcacccggaccgggggccgggcgcgcacgagactcgcagcggaagtggaggcggctccgcgcgcgtccgctgctaggacccgggcagggctggagctgggctgggatcccgagctcggcagcagcgcagcgggccggcccacctgctggtgccctggaggctctgagccccggcggcgcccgggcccacgcggaacgacggggcgagatgcgagccacccctctggctgctcctgcgggttccctgtccaggaagaagcggttggagttggatgacaacttagataccgagcgtcccgtccagaaacgagctcgaagtgggccccagcccagactgcccccctgcctgttgcccctgagcccacctactgctccagatcgtgcaactgctgtggccactgcctcccgtcttgggccctatgtcctcctggagcccgaggagggcgggcgggcctaccaggccctgcactgccctacaggcactgagtatacctgcaaggtgtaccccgtccaggaagccctggccgtgctggagccctacgcgcggctgcccccgcacaagcatgtggctcggcccactgaggtcctggctggtacccagctcctctacgcctttttcactcggacccatggggacatgcacagcctggtgcgaagccgccaccgtatccctgagcctgaggctgccgtgctcttccgccagatggccaccgccctggcgcactgtcaccagcacggtctggtcctgcgtgatctcaagctgtgtcgctttgtcttcgctgaccgtgagaggaagaagctggtgctggagaacctggaggactcctgcgtgctgactgggccagatgattccctgtgggacaagcacgcgtgcccagcctacgtgggacctgagatactcagctcacgggcctcatactcgggcaaggcagccgatgtctggagcctgggcgtggcgctcttcaccatgctggccggccactaccccttccaggactcggagcctgtcctgctcttcggcaagatccgccgcggggcctacgccttgcctgcaggcctctcggcccctgcccgctgtctggttcgctgcctccttcgtcgggagccagctgaacggctcacagccacaggcatcctcctgcacccctggctgcgacaggacccgatgcccttagctccaacccgatcccatctctgggaggctgcccaggtggtccctgatggactggggctggacgaagccagggaagaggagggagacagagaagtggttctgtatggctaggaccaccctactacacgctcagctgccaacagtggattgagtttgggggtagctccaagccttctcctgcctctgaactgagccaaaccttcagtgccttccagaagggagaaaggcagaagcctgtgtggagtgtgctgtgtacacatctgctttgttccacacacatgcagttcctgcttgggtgcttatcaggtgccaagccctgttctcggtgctgggagtacagcagtgagcaaaggagacaatattccctgctcacagagatgacaaactggcatccttgagctgacaacacttttccatgaccataggtcactgtctacactgggtacactttgtaccagtgtcggcctccactgatgctggtgctcaggcacctctgtccaaggacaatccctttcacaaacaaaccagctgcctttgtatcttgtaccttttcagagaaagggaggtatccctgtgccaaaggctccaggcctctcccctgcaactcaggacccaagcccagctcactctgggaactgtgttcccagcatctctgtcctcttgattaagagattctccttccaggcctaagcctgggatttgggccagagataagaatccaaactatgaggctagttcttgtctaactcaagactgttctggaatgagggtccaggcctgtcaaccatggggcttctgacctgagcaccaaggttgagggacaggattaggcagggtctgtcctgtggccacctggaaagtcccaggtgggactcttctggggacacttggggtccacaatcccaggtccatactctaggttttggataccatgagtatgtatgtttacctgtgcctaataaaggagaattatgaaataa

SEQ ID NO: 427623 - DNA, 497 bp, Homo sapiens
gcagatgtgtacacagctgcatgtgtgtggaacaaagcagatgtgtacacagcacactccacacacatgcagttcctgcttgggtgcttatcaggtgccaagccctgttctcggtgctgggagtacagcagtgagcaaaggagacaatattccctgctcacagagatgacaaactggcatccttgagctgacaacacttttccatgaccataggtcactgtctacactgggtacactttgtaccagtgtcggcctccactgatgctggtgctcaggcacctctgtccaagatacaaagaatctgttctttgagatcctggtttccttagcagagttgtaggttgcgggtttcattcacgtggaaattctaagtagaacttttgctgccccattttactgttggtgaagggccgttgttaatggaagtttacgttttaaaactcagatgactcagaaaccagactgtgatcattttttgcagcagcaaaatgacttat

SEQ ID NO: 427624 - DNA, 2487 bp, Homo sapiens
gagccgagatcgcgccaccgccctccagcctgggcgacagagcaagactctgtctcaaaaaaaaaaaaaaaaagagcaaattttttttccaaggtgatagggagagtccgtggctgatgtctgcactgaccagacgcccctagggggccagcgagggcgggtcccaggtgcagcggatgcagaggagagaggcccgggcgcggcgcgggggatggtgcgatcccgggcccgagggcatcagacggcggctgattagctccggtttgcatcacccggaccgggggattagctccggtttgcatcacccggaccgggggattagctccggtttgcatcacccggaccgggggccgggcgcgcacgagactcgcagcggaagtggaggcggctccgcgcgcgtccgctgctaggacccgggcagggctggagctgggctgggatcccgagctcggcagcagcgcagcgggccggcccacctgctggtgccctggaggctctgagccccggcggcgcccgggcccacgcggaacgacggggcgagatgcgagccacccctctggctgctcctgcgggttccctgtccaggaagaagcggttggagttggatgacaacttagataccgagcgtcccgtccagaaacgagctcgaagtgggccccagcccagactgcccccctgcctgttgcccctgagcccacctactgctccagatcgtgcaactgctgtggccactgcctcccgtcttgggccctatgtcctcctggagcccgaggagggcgggcgggcctaccaggccctgcactgccctacaggcactgagtatacctgcaaggtgtaccccgtccaggaagccctggccgtgctggagccctacgcgcggctgcccccgcacaagcatgtggctcggcccactgaggtcctggctggtacccagctcctctacgcctttttcactcggacccatggggacatgcacagcctggtgcgaagccgccaccgtatccctgagcctgaggctgccgtgctcttccgccagatggccaccgccctggcgcactgtcaccagcacggtctggtcctgcgtgatctcaagctgtgtcgctttgtcttcgctgaccgtgagaggaagaagctggtgctggagaacctggaggactcctgcgtgctgactgggccagatgattccctgtgggacaagcacgcgtgcccagcctacgtgggacctgagatactcagctcacgggcctcatactcgggcaaggcagccgatgtctggagcctgggcgtggcgctcttcaccatgctggccggccactaccccttccaggactcggagcctgtcctgctcttcggcaagatccgccgcggggcctacgccttgcctgcaggcctctcggcccctgcccgctgtctggttcgctgcctccttcgtcgggagccagctgaacggctcacagccacaggcatcctcctgcacccctggctgcgacaggacccgatgcccttagctccaacccgatcccatctctgggaggctgcccaggtggtccctgatggactggggctggacgaagccagggaagaggagggagacagagaagtggttctgtatggctaggaccaccctactacacgctcagctgccaacagtggattgagtttgggggtagctccaagccttctcctgcctctgaactgagccaaaccttcagtgccttccagaagggagaaaggcagaagcctgtgtggagtgtgctgtgtacacatctgctttgttccacacacatgcagttcctgcttgggtgcttatcaggtgccaagccctgttctcggtgctgggagtacagcagtgagcaaaggagacaatattccctgctcacagagatgacaaactggcatccttgagctgacaacacttttccatgaccataggtcactgtctacactgggtacactttgtaccagtgtcggcctccactgatgctggtgctcaggcacctctgtccaaggacaatccctttcacaaacaaaccagctgcctttgtatcttgtaccttttcagagaaagggaggtatccctgtgccaaaggctccaggcctctcccctgcaactcaggacccaagcccagctcactctgggaactgtgttcccagcatctctgtcctcttgattaagagattctccttccaggcctaagcctgggatttgggccagagataagaatccaaactatgaggctagttcttgtctaactcaagactgttctggaatgagggtccaggcctgtcaaccatggggcttctgacctgagcaccaaggttgagggacaggattaggcagggtctgtcctgtggccacctggaaagtcccaggtgggactcttctggggacacttggggtccacaatcccaggtccatactctaggttttggataccatgagtatgtatgtttacctgtgcctaataaaggagaattatgaaataa

SEQ ID NO: 427625 - DNA, 2348 bp, Homo sapiens
gatcagacggcggctgattagctccggtttgcatcacccggaccgggggattagctccggttggcatcagacggcggctgattagctccggtttgcatcacccggaccgggggattagctccttgcatcacccggaccgggggattagctccggggtttgcatcacccggaccgggggattagctccggtttgcatcacccggaccgggggccgggcgcgcacgagactcgcagcggaagtggaggcggctccgcgcgcgtccgctgctaggacccgggcagggctggagctgggctgggatcccgagctcggcagcagcgcagcgggccggcccacctgctggtgccctggaggctctgagccccggcggcgcccgggcccacgcggaacgacggggcgagatgcgagccacccctctggctgctcctgcgggttccctgtccaggaagaagcggttggagttggatgacaacttagataccgagcgtcccgtccagaaacgagctcgaagtgggccccagcccagactgcccccctgcctgttgcccctgagcccacctactgctccagatcgtgcaactgctgtggccactgcctcccgtcttgggccctatgtcctcctggagcccgaggagggcgggcgggcctaccaggccctgcactgccctacaggcactgagtatacctgcaaggtgtaccccgtccaggaagccctggccgtgctggagccctacgcgcggctgcccccgcacaagcatgtggctcggcccactgaggtcctggctggtacccagctcctctacgcctttttcactcggacccatggggacatgcacagcctggtgcgaagccgccaccgtatccctgagcctgaggctgccgtgctcttccgccagatggccaccgccctggcgcactgtcaccagcacggtctggtcctgcgtgatctcaagctgtgtcgctttgtcttcgctgaccgtgagaggaagaagctggtgctggagaacctggaggactcctgcgtgctgactgggccagatgattccctgtgggacaagcacgcgtgcccagcctacgtgggacctgagatactcagctcacgggcctcatactcgggcaaggcagccgatgtctggagcctgggcgtggcgctcttcaccatgctggccggccactaccccttccaggactcggagcctgtcctgctcttcggcaagatccgccgcggggcctacgccttgcctgcaggcctctcggcccctgcccgctgtctggttcgctgcctccttcgtcgggagccagctgaacggctcacagccacaggcatcctcctgcacccctggctgcgacaggacccgatgcccttagctccaacccgatcccatctctgggaggctgcccaggtggtccctgatggactggggctggacgaagccagggaagaggagggagacagagaagtggttctgtatggctaggaccaccctactacacgctcagctgccaacagtggattgagtttgggggtagctccaagccttctcctgcctctgaactgagccaaaccttcagtgccttccagaagggagaaaggcagaagcctgtgtggagtgtgctgtgtacacatctgctttgttccacacacatgcagttcctgcttgggtgcttatcaggtgccaagccctgttctcggtgctgggagtacagcagtgagcaaaggagacaatattccctgctcacagagatgacaaactggcatccttgagctgacaacacttttccatgaccataggtcactgtctacactgggtacactttgtaccagtgtcggcctccactgatgctggtgctcaggcacctctgtccaaggacaatccctttcacaaacaaaccagctgcctttgtatcttgtaccttttcagagaaagggaggtatccctgtgccaaaggctccaggcctctcccctgcaactcaggacccaagcccagctcactctgggaactgtgttcccagcatctctgtcctcttgattaagagattctccttccaggcctaagcctgggatttgggccagagataagaatccaaactatgaggctagttcttgtctaactcaagactgttctggaatgagggtccaggcctgtcaaccatggggcttctgacctgagcaccaaggttgagggacaggattaggcagggtctgtcctgtggccacctggaaagtcccaggtgggactcttctggggacacttggggtccacaatcccaggtccatactctaggttttggataccatgagtatgtatgtttacctgtgcctaataaaggagaattatgaaataa

SEQ ID NO: 427626 - DNA, 2316 bp, Homo sapiens
gatcagacggcggctgattagctccggtttgcatcacccggaccgggggattagctccggttggcatcagacggcggctgattagctccggtttgcatcacccggaccgggggattagctccggtttgcatcacccggaccgggggattagctccggtttgcatcacccggaccgggggccgggcgcgcacgagactcgcagcggaagtggaggcggctccgcgcgcgtccgctgctaggacccgggcagggctggagctgggctgggatcccgagctcggcagcagcgcagcgggccggcccacctgctggtgccctggaggctctgagccccggcggcgcccgggcccacgcggaacgacggggcgagatgcgagccacccctctggctgctcctgcgggttccctgtccaggaagaagcggttggagttggatgacaacttagataccgagcgtcccgtccagaaacgagctcgaagtgggccccagcccagactgcccccctgcctgttgcccctgagcccacctactgctccagatcgtgcaactgctgtggccactgcctcccgtcttgggccctatgtcctcctggagcccgaggagggcgggcgggcctaccaggccctgcactgccctacaggcactgagtatacctgcaaggtgtaccccgtccaggaagccctggccgtgctggagccctacgcgcggctgcccccgcacaagcatgtggctcggcccactgaggtcctggctggtacccagctcctctacgcctttttcactcggacccatggggacatgcacagcctggtgcgaagccgccaccgtatccctgagcctgaggctgccgtgctcttccgccagatggccaccgccctggcgcactgtcaccagcacggtctggtcctgcgtgatctcaagctgtgtcgctttgtcttcgctgaccgtgagaggaagaagctggtgctggagaacctggaggactcctgcgtgctgactgggccagatgattccctgtgggacaagcacgcgtgcccagcctacgtgggacctgagatactcagctcacgggcctcatactcgggcaaggcagccgatgtctggagcctgggcgtggcgctcttcaccatgctggccggccactaccccttccaggactcggagcctgtcctgctcttcggcaagatccgccgcggggcctacgccttgcctgcaggcctctcggcccctgcccgctgtctggttcgctgcctccttcgtcgggagccagctgaacggctcacagccacaggcatcctcctgcacccctggctgcgacaggacccgatgcccttagctccaacccgatcccatctctgggaggctgcccaggtggtccctgatggactggggctggacgaagccagggaagaggagggagacagagaagtggttctgtatggctaggaccaccctactacacgctcagctgccaacagtggattgagtttgggggtagctccaagccttctcctgcctctgaactgagccaaaccttcagtgccttccagaagggagaaaggcagaagcctgtgtggagtgtgctgtgtacacatctgctttgttccacacacatgcagttcctgcttgggtgcttatcaggtgccaagccctgttctcggtgctgggagtacagcagtgagcaaaggagacaatattccctgctcacagagatgacaaactggcatccttgagctgacaacacttttccatgaccataggtcactgtctacactgggtacactttgtaccagtgtcggcctccactgatgctggtgctcaggcacctctgtccaaggacaatccctttcacaaacaaaccagctgcctttgtatcttgtaccttttcagagaaagggaggtatccctgtgccaaaggctccaggcctctcccctgcaactcaggacccaagcccagctcactctgggaactgtgttcccagcatctctgtcctcttgattaagagattctccttccaggcctaagcctgggatttgggccagagataagaatccaaactatgaggctagttcttgtctaactcaagactgttctggaatgagggtccaggcctgtcaaccatggggcttctgacctgagcaccaaggttgagggacaggattaggcagggtctgtcctgtggccacctggaaagtcccaggtgggactcttctggggacacttggggtccacaatcccaggtccatactctaggttttggataccatgagtatgtatgtttacctgtgcctaataaaggagaattatgaaataa

SEQ ID NO: 427627 - DNA, 2541 bp, Homo sapiens
gagccgagatcgcgccaccgccctccagcctgggcgacagagcaagactctgtctcaaaaaaaaaaaaaaaaagagcaaattttttttccaaggtgatagggagagtccgtggctgatgtctgcactgaccagacgcccctagggggccagcgagggcgggtcccaggtgcagcggatgcagaggagagaggcccgggcgcggcgcgggggatggtgcgatcccgggcccgagggcatcagacggcggctgattagctccggtttgcatcacccggaccgggggattagctccggtttgcatcacccggaccgggggattagctccggtttgcatcacccggaccgggggccgggcgcgcacgagactcgcagcggaagtggaggcggctccgcgcgcgtccgctgctaggacccgggcagggctggagctgggctgggatcccgagctcggcagcagcgcagcgggccggcccacctgctggtgccctggaggctctgagccccggcggcgcccgggcccacgcggaacgacggggcgagatgcgagccacccctctggctgctcctgcgggttccctgtccaggaagaagcggttggagttggatgacaacttagataccgagcgtcccgtccagaaacgagctcgaagtgggccccagcccagactgcccccctgcctgttgcccctgagcccacctactgctccagatcgtgcaactgctgtggccactgcctcccgtcttgggccctatgtcctcctggagcccgaggagggcgggcgggcctaccaggccctgcactgccctacaggcactgagtatacctgcaaggtgtaccccgtccaggaagccctggccgtgctggagccctacgcgcggctgcccccgcacaagcatgtggctcggcccactgaggtcctggctggtacccagctcctctacgcctttttcactcggacccatggggacatgcacagcctggtgcgaagccgccaccgtatccctgagcctgaggctgccgtgctcttccgccagatggccaccgccctggcgcactgtcaccagcacggtctggtcctgcgtgatctcaagctgtgtcgctttgtcttcgctgaccgtgagaggaagaagctggtgctggagaacctggaggactcctgcgtgctgactgggccagatgattccctgtgggacaagcacgcgtgcccagcctacgtgggacctgagatactcagctcacgggcctcatactcgggcaaggcagccgatgtctggagcctgggcgtggcgctcttcaccatgctggccggccactaccccttccaggactcggagcctgtcctgctcttcggcaagatccgccgcggggcctacgccttgcctgcaggcctctcggcccctgcccgctgtctggttcgctgcctccttcgtcgggagccagctgaacggctcacagccacaggcatcctcctgcacccctggctgcgacaggacccgatgcccttagctccaacccgatcccatctctgggaggctgcccaggtggtccctgatggactggggctggacgaagccagggaagaggagggagacagagaagtggttctgtatggctaggaccaccctactacacgctcagctgccaacagtggattgagtttgggggtagctccaagccttctcctgcctctgaactgagccaaaccttcagtgccttccagaagggagaaaggcagaagcctgtgtggagtgtgctgtgtacacatctgctttgttccacacacatgcagttcctgcttgggtgcttatcaggtgccaagccctgttctcggtgctgggagtacagcagtgagcaaaggagacaatattccctgctcacagagatgacaaactggcatccttgagctgacaacacttttccatgaccataggtcactgtctacactgggtacactttgtaccagtgtcggcctccactgatgctggtgctcaggcacctctgtccaaggacaatccctttcacaaacaaaccagctgcctttgtatcttgtaccttttcagagaaagggaggtatccctgtgccaaaggctccaggcctctcccctgcaactcaggacccaagcccagctcactctgggaactgtgttcccagcatctctgtcctcttgattaagagattctccttccaggcctaagcctgggatttgggccagagataagaatccaaactatgaggctagttcttgtctaactcaagactgttctggaatgagggtccaggcctgtcaaccatggggcttctgacctgagcaccaaggttgagggacaggattaggcagggtctgtcctgtggccacctggaaagtcccaggtgggactcttctggggacacttggggtccacaatcccaggtccatactctaggttttggataccatgagtatgtatgtttacctgtgcctaataaaggagaattatgaaataaaaaaaccaaccacacacacaacccaccaacccaaaacacggagctaacaagaaa

SEQ ID NO: 427628 - DNA, 2672 bp, Homo sapiens
gagccgagatcgcgccaccgccctccagcctgggcgacagagcaagactctgtctcaaaaaaaaaaaaaaaaagagcaaattttttttccaaggtgatagggagagtccgtggctgatgtctgcactgaccagacgcccctagggggccagcgagggcgggtcccaggtgcagcggatgcagaggagagaggcccgggcgcggcgcgggggatggtgcgatcccgggcccgagggcatcagacggcggctgattagctccggtttgcatcacccggaccgggggattagctccggtttgcatcacccggaccgggggattagctccggtttgcatcacccggaccgggggccgggcgcgcacgagactcgcagcggaagtggaggcggctccgcgcgcgtccgctgctaggacccgggcagggctggagctgggctgggatcccgagctcggcagcagcgcagcgggccggcccacctgctggtgccctggaggctctgagccccggcggcgcccgggcccacgcggaacgacggggcgagatgcgagccacccctctggctgctcctgcgggttccctgtccaggaagaagcggttggagttggatgacaacttagataccgagcgtcccgtccagaaacgagctcgaagtgggccccagcccagactgcccccctgcctgttgcccctgagcccacctactgctccagatcgtgcaactgctgtggccactgcctcccgtcttgggccctatgtcctcctggagcccgaggagggcgggcgggcctaccaggccctgcactgccctacaggcactgagtatacctgcaaggtgtaccccgtccaggaagccctggccgtgctggagccctacgcgcggctgcccccgcacaagcatgtggctcggcccactgaggtcctggctggtacccagctcctctacgcctttttcactcggacccatggggacatgcacagcctggtgcgaagccgccaccgtatccctgagcctgaggctgccgtgctcttccgccagatggccaccgccctggcgcactgtcaccagcacggtctggtcctgcgtgatctcaagctgtgtcgctttgtcttcgctgaccgtgagaggaagaagctggtgctggagaacctggaggactcctgcgtgctgactgggccagatgattccctgtgggacaagcacgcgtgcccagcctacgtgggacctgagatactcagctcacgggcctcatactcgggcaaggcagccgatgtctggagcctgggcgtggcgctcttcaccatgctggccggccactaccccttccaggactcggagcctgtcctgctcttcggcaagatccgccgcggggcctacgccttgcctgcaggcctctcggcccctgcccgctgtctggttcgctgcctccttcgtcgggagccagctgaacggctcacagccacaggcatcctcctgcacccctggctgcgacaggacccgatgcccttagctccaacccgatcccatctctgggaggctgcccaggtggtccctgatggactggggctggacgaagccagggaagaggagggagacagagaagtggttctgtatggctaggaccaccctactacacgctcagctgccaacagtggattgagtttgggggtagctccaagccttctcctgcctctgaactgagccaaaccttcagtgccttccagaagggagaaaggcagaagcctgtgtggagtgtgctgtgtacacatctgctttgttccacacacatgcagttcctgcttgggtgcttatcaggtgccaagccctgttctcggtgctgggagtacagcagtgagcaaaggagacaatattccctgctcacagagatgacaaactggcatccttgagctgacaacacttttccatgaccataggtcactgtctacactgggtacactttgtaccagtgtcggcctccactgatgctggtgctcaggcacctctgtccaaggacaatccctttcacaaacaaaccagctgcctttgtatcttgtaccttttcagagaaagggaggtatccctgtgccaaaggctccaggcctctcccctgcaactcaggacccaagcccagctcactctgggaactgtgttcccagcatctctgtcctcttgattaagagattctccttccaggcctaagcctgggatttgggccagagataagaatccaaactatgaggctagttcttgtctaactcaagactgttctggaatgagggtccaggcctgtcaaccatggggcttctgacctgagcaccaaggttgagggacaggattaggcagggtctgtcctgtggccacctggaaagtcccaggtgggactcttctggggacacttggggtccacaatcccaggtccatactctaggttttggataccatgagtatgtatgtttacctgtgcctaataaaggagaattatgaaataattttatttttctctgcaatttcttccatcctttccaacgatctcttaccagtttttcctgccttcaaaactggcccccatggtgaaaggccgtagagttgtgtcttaacctgggctgagtggtttgtgagaacagattacctggagcccagtgggtcttcctgcaccccttctgtcgtcttctcg

SEQ ID NO: 427629 - DNA, 2396 bp, Homo sapiens
gagccgagatcgcgccaccgccctccagcctgggcgacagagcaagactctgtctcaaaaaaaaaaaaaaaaagagcaaattttttttccaaggtgatagggagagtccgtggctgatgtctgcactgaccagacgcccctagggggccagcgagggcgggtcccaggtgcagcggatgcagaggagagaggcccgggcgcggcgcgggggatggtgcgatcccgggcccgagggcatcagacggcggctgattagctccggtttgcatcacccggaccgggggattagctccggtttgcatcacccggaccgggggattagctccggtttgcatcacccggaccgggggccgggcgcgcacgagactcgcagcggaagtggaggcggctccgcgcgcgtccgctgctaggacccgggcagggctggagctgggctgggatcccgagctcggcagcagcgcagcgggccggcccacctgctggtgccctggaggctctgagccccggcggcgcccgggcccacgcggaacgacggggcgagatgcgagccacccctctggctgctcctgcgggttccctgtccaggaagaagcggttggagttggatgacaacttagataccgagcgtcccgtccagaaacgagctcgaagtgggccccagcccagactgcccccctgcctgttgcccctgagcccacctactgctccagatcgtgcaactgctgtggccactgcctcccgtcttgggccctatgtcctcctggagcccgaggagggcgggcgggcctaccaggccctgcactgccctacaggcactgagtatacctgcaaggtgtaccccgtccaggaagccctggccgtgctggagccctacgcgcggctgcccccgcacaagcatgtggctcggcccactgaggtcctggctggtacccagctcctctacgcctttttcactcggacccatggggacatgcacagcctggtgcgaagccgccaccgtatccctgagcctgaggctgccgtgctcttccgccagatggccaccgccctggcgcactgtcaccagcacggtctggtcctgcgtgatctcaagctgtgtcgctttgtcttcgctgaccgtgagaggaagaagctggtgctggagaacctggaggactcctgcgtgctgactgggccagatgattccctgtgggacaagcacgcgtgcccagcctacgtgggacctgagatactcagctcacgggcctcatactcgggcaaggcagccgatgtctggagcctgggcgtggcgctcttcaccatgctggccggccactaccccttccaggactcggagcctgtcctgctcttcggcaagatccgccgcggggcctacgccttgcctgcaggcctctcggcccctgcccgctgtctggttcgctgcctccttcgtcgggagccagctgaacggctcacagccacaggcatcctcctgcacccctggctgcgacaggacccgatgcccttagctccaacccgatcccatctctgggaggctgcccaggtggtccctgatggactggggctggacgaagccagggaagaggagggagacagagaagtggttctgtatggctaggaccaccctactacacgctcagctgccaacagtggattgagtttgggggtagctccaagccttctcctgcctctgaactgagccaaaccttcagtgccttccagaagggagaaaggcagaagcctgtgtggagtgtgctgtgtacacatctgctttgttccacacacatgcagttcctgcttgggtgcttatcaggtgccaagccctgttctcggtgctgggagtacagcagtgagcaaaggagacaatattccctgctcacagagatgacaaactggcatccttgagctgacaacacttttccatgaccataggtcactgtctacactgggtacactttgtaccagtgtcggcctccactgatgctggtgctcaggcacctctgtccaaggacaatccctttcacaaacaaaccagctgcctttgtatcttgtaccttttcagagaaagggaggtatccctgtgccaaaggctccaggcctctcccctgcaactcaggacccaagcccagctcactctgggaactgtgttcccagcatctctgtcctcttgattaagagattctccttccaggcctaagcctgggatttgggccagagataagaatccaaactatgaggctagttcttgtctaactcaagactgttctggaatgagggtccaggtgggactcttctggggacacttggggtccacaatcccaggtccatactctaggttttggataccatgagtatgtatgtttacctgtgcctaataaaggagaattatgaaataa

SEQ ID NO: 427630 - DNA, 2162 bp, Homo sapiens
  misc_feature (2142)..(2143): n is a, c, g, or t
gagccgagatcgcgccaccgccctccagcctgggcgacagagcaagactctgtctcaaaaaaaaaaaaaaaaagagcaaattttttttccaaggtgatagggagagtccgtggctgatgtctgcactgaccagacgcccctagggggccagcgagggcgggtcccaggtgcagcggatgcagaggagagaggcccgggcgcggcgcgggggatggtgcgatcccgggcccgagggcatcagacggcggctgattagctccggtttgcatcacccggaccgggggattagctccggtttgcatcacccggaccgggggattagctccggtttgcatcacccggaccgggggccgggcgcgcacgagactcgcagcggaagtggaggcggctccgcgcgcgtccgctgctaggacccgggcagggctggagctgggctgggatcccgagctcggcagcagcgcagcgggccggcccacctgctggtgccctggaggctctgagccccggcggcgcccgggcccacgcggaacgacggggcgagatgcgagccacccctctggctgctcctgcgggttccctgtccaggaagaagcggttggagttggatgacaacttagataccgagcgtcccgtccagaaacgagctcgaagtgggccccagcccagactgcccccctgcctgttgcccctgagcccacctactgctccagatcgtgcaactgctgtggccactgcctcccgtcttgggccctatgtcctcctggagcccgaggagggcgggcgggcctaccaggccctgcactgccctacaggcactgagtatacctgcaaggtgtaccccgtccaggaagccctggccgtgctggagccctacgcgcggctgcccccgcacaagcatgtggctcggcccactgaggtcctggctggtacccagctcctctacgcctttttcactcggacccatggggacatgcacagcctggtgcgaagccgccaccgtatccctgagcctgaggctgccgtgctcttccgccagatggccaccgccctggcgcactgtcaccagcacggtctggtcctgcgtgatctcaagctgtgtcgctttgtcttcgctgaccgtgagaggaagaagctggtgctggagaacctggaggactcctgcgtgctgactgggccagatgattccctgtgggacaagcacgcgtgcccagcctacgtgggacctgagatactcagctcacgggcctcatactcgggcaaggcagccgatgtctggagcctgggcgtggcgctcttcaccatgctggccggccactaccccttccaggactcggagcctgtcctgctcttcggcaagatccgccgcggggcctacgccttgcctgcaggcctctcggcccctgcccgctgtctggttcgctgcctccttcgtcgggagccagctgaacggctcacagccacaggcatcctcctgcacccctggctgcgacaggacccgatgcccttagctccaacccgatcccatctctgggaggctgcccaggtggtccctgatggactggggctggacgaagccagggaagaggagggagacagagaagtggttctgtatggctaggaccaccctactacacgctcagctgccaacagtggattgagtttgggggtagctccaagccttctcctgcctctgaactgagccaaaccttcagtgccttccagaagggagaaaggcagaagcctgtgtggagtgtgctgtgtacacatctgctttgttccacacacatgcagttcctgcttgggtgcttatcaggtgccaagccctgttctcggtgctgggagtacagcagtgagcaaaggagacaatattccctgctcacagagatgacaaactggcatccttgagctgacaacacttttccatgaccataggtcactgtctacactgggtacactttgtaccagtgtcggcctccactgatgctggtgctcaggcacctctgtccaaggacaatccctttcacaaacaaaccagctgcctttgtatcttgtaccttttcagagaaagggaggtatccctgtgccaaaggctccaggcctctcccctgcaactcgaaagccccaagcggcaactcgaaagcnncaagcgggggatcctctaa

SEQ ID NO: 427631 - DNA, 1880 bp, Homo sapiens
gagccgagatcgcgccaccgccctccagcctgggcgacagagcaagactctgtctcaaaaaaaaaaaaaaaaagagcaaattttttttccaaggtgatagggagagtccgtggctgatgtctgcactgaccagacgcccctagggggccagcgagggcgggtcccaggtgcagcggatgcagaggagagaggcccgggcgcggcgcgggggatggtgcgatcccgggcccgagggcatcagacggcggctgattagctccggtttgcatcacccggaccgggggattagctccggtttgcatcacccggaccgggggattagctccggtttgcatcacccggaccgggggccgggcgcgcacgagactcgcagcggaagtggaggcggctccgcgcgcgtccgctgctaggacccgggcagggctggagctgggctgggatcccgagctcggcagcagcgcagcgggccggcccacctgctggtgccctggaggctctgagccccggcggcgcccgggcccacgcggaacgacggggcgagatgcgagccacccctctggctgctcctgcgggttccctgtccaggaagaagcggttggagttggatgacaacttagataccgagcgtcccgtccagaaacgagctcgaagtgggccccagcccagactgcccccctgcctgttgcccctgagcccacctactgctccagatcgtgcaactgctgtggccactgcctcccgtcttgggccctatgtcctcctggagcccgaggagggcgggcgggcctaccaggccctgcactgccctacaggcactgagtatacctgcaaggtgtaccccgtccaggaagccctggccgtgctggagccctacgcgcggctgcccccgcacaagcatgtggctcggcccactgaggtcctggctggtacccagctcctctacgcctttttcactcggacccatggggacatgcacagcctggtgcgaagccgccaccgtatccctgagcctgaggctgccgtgctcttccgccagatggccaccgccctggcgcactgtcaccagcacggtctggtcctgcgtgatctcaagctgtgtcgctttgtcttcgctgaccgtgagaggaagaagctggtgctggagaacctggaggactcctgcgtgctgactgggccagatgattccctgtgggacaagcacgcgtgcccagcctacgtgggacctgagatactcagctcacgggcctcatactcgggcaaggcagccgatgtctggagcctgggcgtggcgctcttcaccatgctggccggccactaccccttccaggactcggagcctgtcctgctcttcggcaagatccgccgcggggcctacgccttgcctgcaggcctctcggcccctgcccgctgtctggttcgctgcctccttcgtcgggagccagctgaacggctcacagccacaggcatcctcctgcacccctggctgcgacaggacccgatgcccttagctccaacccgatcccatcttctgggaactgtgttcccagcatctctgtcctcttgattaagagattctccttccaggcctaagcctgggatttgggccagagataagaatccaaactatgaggctagttcttgtctaactcaagactgttctggaatgagggtccaggcctgtcaaccatggggcttctgacctgagcaccaaggttgagggacaggattaggcagggtctgtcctgtggccacctggaaagtcccaggtgggactcttctggggacacttggggtccacaatcccaggtccatactctaggttttggataccatgagtatgtatgtttacctgtgcctaataaaggagaattatgaaataa

SEQ ID NO: 427632 - DNA, 2020 bp, Homo sapiens
gttgggctggggaagccaggacggaggtgtccggccgtcacccctagaggagggcgtgcgggggtctgttttgcatgcgagccacccctctggctgctcctgcgggttccctgtccaggaagaagcggttggagttggatgacaacttagataccgagcgtcccgtccagaaacgagctcgaagtgggccccagcccagactgcccccctgcctgttgcccctgagcccacctactgctccagatcgtgcaactgctgtggccactgcctcccgtcttgggccctatgtcctcctggagcccgaggagggcgggcgggcctaccaggccctgcactgccctacaggcactgagtatacctgcaaggtgtaccccgtccaggaagccctggccgtgctggagccctacgcgcggctgcccccgcacaagcatgtggctcggcccactgaggtcctggctggtacccagctcctctacgcctttttcactcggacccatggggacatgcacagcctggtgcgaagccgccaccgtatccctgagcctgaggctgccgtgctcttccgccagatggccaccgccctggcgcactgtcaccagcacggtctggtcctgcgtgatctcaagctgtgtcgctttgtcttcgctgaccgtgagaggaagaagctggtgctggagaacctggaggactcctgcgtgctgactgggccagatgattccctgtgggacaagcacgcgtgcccagcctacgtgggacctgagatactcagctcacgggcctcatactcgggcaaggcagccgatgtctggagcctgggcgtggcgctcttcaccatgctggccggccactaccccttccaggactcggagcctgtcctgctcttcggcaagatccgccgcggggcctacgccttgcctgcaggcctctcggcccctgcccgctgtctggttcgctgcctccttcgtcgggagccagctgaacggctcacagccacaggcatcctcctgcacccctggctgcgacaggacccgatgcccttagctccaacccgatcccatctctgggaggctgcccaggtggtccctgatggactggggctggacgaagccagggaagaggagggagacagagaagtggttctgtatggctaggaccaccctactacacgctcagctgccaacagtggattgagtttgggggtagctccaagccttctcctgcctctgaactgagccaaaccttcagtgccttccagaagggagaaaggcagaagcctgtgtggagtgtgctgtgtacacatctgctttgttccacacacatgcagttcctgcttgggtgcttatcaggtgccaagccctgttctcggtgctgggagtacagcagtgagcaaaggagacaatattccctgctcacagagatgacaaactggcatccttgagctgacaacacttttccatgaccataggtcactgtctacactgggtacactttgtaccagtgtcggcctccactgatgctggtgctcaggcacctctgtccaaggacaatccctttcacaaacaaaccagctgcctttgtatcttgtaccttttcagagaaagggaggtatccctgtgccaaaggctccaggcctctcccctgcaactcaggacccaagcccagctcactctgggaactgtgttcccagcatctctgtcctcttgattaagagattctccttccaggcctaagcctgggatttgggccagagataagaatccaaactatgaggctagttcttgtctaactcaagactgttctggaatgagggtccaggcctgtcaaccatggggcttctgacctgagcaccaaggttgagggacaggattaggcagggtctgtcctgtggccacctggaaagtcccaggtgggactcttctggggacacttggggtccacaatcccaggtccatactctaggttttggataccatgagtatgtatgtttacctgtgcctaataaaggagaattatgaaataa

SEQ ID NO: 427633 - DNA, 2027 bp, Homo sapiens
cacagaccccgccgtcggggcgcggccaggtcagatcccttttgatccgggcctgggctgagtgctccccccgggcttcagatgcgagccacccctctggctgctcctgcgggttccctgtccaggaagaagcggttggagttggatgacaacttagataccgagcgtcccgtccagaaacgagctcgaagtgggccccagcccagactgcccccctgcctgttgcccctgagcccacctactgctccagatcgtgcaactgctgtggccactgcctcccgtcttgggccctatgtcctcctggagcccgaggagggcgggcgggcctaccaggccctgcactgccctacaggcactgagtatacctgcaaggtgtaccccgtccaggaagccctggccgtgctggagccctacgcgcggctgcccccgcacaagcatgtggctcggcccactgaggtcctggctggtacccagctcctctacgcctttttcactcggacccatggggacatgcacagcctggtgcgaagccgccaccgtatccctgagcctgaggctgccgtgctcttccgccagatggccaccgccctggcgcactgtcaccagcacggtctggtcctgcgtgatctcaagctgtgtcgctttgtcttcgctgaccgtgagaggaagaagctggtgctggagaacctggaggactcctgcgtgctgactgggccagatgattccctgtgggacaagcacgcgtgcccagcctacgtgggacctgagatactcagctcacgggcctcatactcgggcaaggcagccgatgtctggagcctgggcgtggcgctcttcaccatgctggccggccactaccccttccaggactcggagcctgtcctgctcttcggcaagatccgccgcggggcctacgccttgcctgcaggcctctcggcccctgcccgctgtctggttcgctgcctccttcgtcgggagccagctgaacggctcacagccacaggcatcctcctgcacccctggctgcgacaggacccgatgcccttagctccaacccgatcccatctctgggaggctgcccaggtggtccctgatggactggggctggacgaagccagggaagaggagggagacagagaagtggttctgtatggctaggaccaccctactacacgctcagctgccaacagtggattgagtttgggggtagctccaagccttctcctgcctctgaactgagccaaaccttcagtgccttccagaagggagaaaggcagaagcctgtgtggagtgtgctgtgtacacatctgctttgttccacacacatgcagttcctgcttgggtgcttatcaggtgccaagccctgttctcggtgctgggagtacagcagtgagcaaaggagacaatattccctgctcacagagatgacaaactggcatccttgagctgacaacacttttccatgaccataggtcactgtctacactgggtacactttgtaccagtgtcggcctccactgatgctggtgctcaggcacctctgtccaaggacaatccctttcacaaacaaaccagctgcctttgtatcttgtaccttttcagagaaagggaggtatccctgtgccaaaggctccaggcctctcccctgcaactcaggacccaagcccagctcactctgggaactgtgttcccagcatctctgtcctcttgattaagagattctccttccaggcctaagcctgggatttgggccagagataagaatccaaactatgaggctagttcttgtctaactcaagactgttctggaatgagggtccaggcctgtcaaccatggggcttctgacctgagcaccaaggttgagggacaggattaggcagggtctgtcctgtggccacctggaaagtcccaggtgggactcttctggggacacttggggtccacaatcccaggtccatactctaggttttggataccatgagtatgtatgtttacctgtgcctaataaaggagaattatgaaataa

SEQ ID NO: 427634 - DNA, 2472 bp, Homo sapiens
gagccgagatcgcgccaccgccctccagcctgggcgacagagcaagactctgtctcaaaaaaaaaaaaaaaaagagcaaattttttttccaaggtgatagggagagtccgtggctgatgtctgcactgaccagacgcccctagggggccagcgagggcgggtcccaggtgcagcggatgcagaggagagaggcccgggcgcggcgcgggggatggtgcgatcccgggcccgagggcatcagacggcggctgattagctccggtttgcatcacccggaccgggggattagctccggtttgcatcacccggaccgggggattagctccggtttgcatcacccggaccgggggccgggcgcgcacgagactcgcagcggaagtggaggcggctccgcgcgcgtccgctgctaggacccgggcagggctggagctgggctgggatcccgagctcggcagcagcgcagcgggccggcccacctgctggtgccctggaggctctgagccccggcggcgcccgggcccacgcggaacgacggggcgagatgcgagccacccctctggctgctcctgcgggttccctgtccaggaagaagcggttggagttggatgacaacttagataccgagcgtcccgtccagaaacgagctcgaagtgggccccagcccagactgcccccctgcctgttgcccctgagcccacctactgctccagatcgtgcaactgctgtggccactgcctcccgtcttgggccctatgtcctcctggagcccgaggagggcgggcgggcctaccaggccctgcactgccctacaggcactgagtatacctgcaaggtgtaccccgtccaggaagccctggccgtgctggagccctacgcgcggctgcccccgcacaagcatgtggctcggcccactgaggtcctggctggtacccagctcctctacgcctttttcactcggacccatggggacatgcacagcctggtgcgaagccgccaccgtatccctgagcctgaggctgccgtgctcttccgccagatggccaccgccctggcgcactgtcacctgcgtgatctcaagctgtgtcgctttgtcttcgctgaccgtgagaggaagaagctggtgctggagaacctggaggactcctgcgtgctgactgggccagatgattccctgtgggacaagcacgcgtgcccagcctacgtgggacctgagatactcagctcacgggcctcatactcgggcaaggcagccgatgtctggagcctgggcgtggcgctcttcaccatgctggccggccactaccccttccaggactcggagcctgtcctgctcttcggcaagatccgccgcggggcctacgccttgcctgcaggcctctcggcccctgcccgctgtctggttcgctgcctccttcgtcgggagccagctgaacggctcacagccacaggcatcctcctgcacccctggctgcgacaggacccgatgcccttagctccaacccgatcccatctctgggaggctgcccaggtggtccctgatggactggggctggacgaagccagggaagaggagggagacagagaagtggttctgtatggctaggaccaccctactacacgctcagctgccaacagtggattgagtttgggggtagctccaagccttctcctgcctctgaactgagccaaaccttcagtgccttccagaagggagaaaggcagaagcctgtgtggagtgtgctgtgtacacatctgctttgttccacacacatgcagttcctgcttgggtgcttatcaggtgccaagccctgttctcggtgctgggagtacagcagtgagcaaaggagacaatattccctgctcacagagatgacaaactggcatccttgagctgacaacacttttccatgaccataggtcactgtctacactgggtacactttgtaccagtgtcggcctccactgatgctggtgctcaggcacctctgtccaaggacaatccctttcacaaacaaaccagctgcctttgtatcttgtaccttttcagagaaagggaggtatccctgtgccaaaggctccaggcctctcccctgcaactcaggacccaagcccagctcactctgggaactgtgttcccagcatctctgtcctcttgattaagagattctccttccaggcctaagcctgggatttgggccagagataagaatccaaactatgaggctagttcttgtctaactcaagactgttctggaatgagggtccaggcctgtcaaccatggggcttctgacctgagcaccaaggttgagggacaggattaggcagggtctgtcctgtggccacctggaaagtcccaggtgggactcttctggggacacttggggtccacaatcccaggtccatactctaggttttggataccatgagtatgtatgtttacctgtgcctaataaaggagaattatgaaataa

SEQ ID NO: 427635 - DNA, 2126 bp, Homo sapiens
gatcagacggcggctgattagctccggtttgcatcacccggaccgggggattagctccggttggcatcagacggcggctgattagctccggtttgcatcacccggaccgggggattagctccggtttgcatcacccggaccgggggattagctccggtttgcatcacccggaccgggggccgggcgcgcacgagaatgcgagccacccctctggctgctcctgcgggttccctgtccaggaagaagcggttggagttggatgacaacttagataccgagcgtcccgtccagaaacgagctcgaagtgggccccagcccagactgcccccctgcctgttgcccctgagcccacctactgctccagatcgtgcaactgctgtggccactgcctcccgtcttgggccctatgtcctcctggagcccgaggagggcgggcgggcctaccaggccctgcactgccctacaggcactgagtatacctgcaaggtgtaccccgtccaggaagccctggccgtgctggagccctacgcgcggctgcccccgcacaagcatgtggctcggcccactgaggtcctggctggtacccagctcctctacgcctttttcactcggacccatggggacatgcacagcctggtgcgaagccgccaccgtatccctgagcctgaggctgccgtgctcttccgccagatggccaccgccctggcgcactgtcacctgcgtgatctcaagctgtgtcgctttgtcttcgctgaccgtgagaggaagaagctggtgctggagaacctggaggactcctgcgtgctgactgggccagatgattccctgtgggacaagcacgcgtgcccagcctacgtgggacctgagatactcagctcacgggcctcatactcgggcaaggcagccgatgtctggagcctgggcgtggcgctcttcaccatgctggccggccactaccccttccaggactcggagcctgtcctgctcttcggcaagatccgccgcggggcctacgccttgcctgcaggcctctcggcccctgcccgctgtctggttcgctgcctccttcgtcgggagccagctgaacggctcacagccacaggcatcctcctgcacccctggctgcgacaggacccgatgcccttagctccaacccgatcccatctctgggaggctgcccaggtggtccctgatggactggggctggacgaagccagggaagaggagggagacagagaagtggttctgtatggctaggaccaccctactacacgctcagctgccaacagtggattgagtttgggggtagctccaagccttctcctgcctctgaactgagccaaaccttcagtgccttccagaagggagaaaggcagaagcctgtgtggagtgtgctgtgtacacatctgctttgttccacacacatgcagttcctgcttgggtgcttatcaggtgccaagccctgttctcggtgctgggagtacagcagtgagcaaaggagacaatattccctgctcacagagatgacaaactggcatccttgagctgacaacacttttccatgaccataggtcactgtctacactgggtacactttgtaccagtgtcggcctccactgatgctggtgctcaggcacctctgtccaaggacaatccctttcacaaacaaaccagctgcctttgtatcttgtaccttttcagagaaagggaggtatccctgtgccaaaggctccaggcctctcccctgcaactcaggacccaagcccagctcactctgggaactgtgttcccagcatctctgtcctcttgattaagagattctccttccaggcctaagcctgggatttgggccagagataagaatccaaactatgaggctagttcttgtctaactcaagactgttctggaatgagggtccaggcctgtcaaccatggggcttctgacctgagcaccaaggttgagggacaggattaggcagggtctgtcctgtggccacctggaaagtcccaggtgggactcttctggggacacttggggtccacaatcccaggtccatactctaggttttggataccatgagtatgtatgtttacctgtgcctaataaaggagaattatgaaataa

SEQ ID NO: 427636 - DNA, 2055 bp, Homo sapiens
gatcagacggcggctgattagctccggtttgcatcacccggaccgggggattagctccggttggcatcagacggcggctgattagctccggtttgcatcacccggaccgggggattagctccttgcatcacccggaccgggggattagctccggggtttgcatcacccggaccgggggattagctccggtttgcatcacccggaccgggggccgggcgcgcacgagactcgcagcggaagtggaggcggctccgcgcgcgtccgctgctaggacccgggcagggctggagctgggctgggatcccgagctcggcagcagcgcagcgggccggcccacctgctggtgccctggaggctctgagccccggcggcgcccgggcccacgcggaacgacggggcgagatgcgagccacccctctggctgctcctgcgggttccctgtccaggaagaagcggttggagttggatgacaacttagataccgagcgtcccgtccagaaacgagctcgaagtgggccccagcccagactgcccccctgcctgttgcccctgagcccacctactgctccagatcgtgcaactgctgtggccactgcctcccgtcttgggccctatgtcctcctggagcccgaggagggcgggcgggcctaccaggccctgcactgccctacaggcactgagtatacctgcaaggaagaagctggtgctggagaacctggaggactcctgcgtgctgactgggccagatgattccctgtgggacaagcacgcgtgcccagcctacgtgggacctgagatactcagctcacgggcctcatactcgggcaaggcagccgatgtctggagcctgggcgtggcgctcttcaccatgctggccggccactaccccttccaggactcggagcctgtcctgctcttcggcaagatccgccgcggggcctacgccttgcctgcaggcctctcggcccctgcccgctgtctggttcgctgcctccttcgtcgggagccagctgaacggctcacagccacaggcatcctcctgcacccctggctgcgacaggacccgatgcccttagctccaacccgatcccatctctgggaggctgcccaggtggtccctgatggactggggctggacgaagccagggaagaggagggagacagagaagtggttctgtatggctaggaccaccctactacacgctcagctgccaacagtggattgagtttgggggtagctccaagccttctcctgcctctgaactgagccaaaccttcagtgccttccagaagggagaaaggcagaagcctgtgtggagtgtgctgtgtacacatctgctttgttccacacacatgcagttcctgcttgggtgcttatcaggtgccaagccctgttctcggtgctgggagtacagcagtgagcaaaggagacaatattccctgctcacagagatgacaaactggcatccttgagctgacaacacttttccatgaccataggtcactgtctacactgggtacactttgtaccagtgtcggcctccactgatgctggtgctcaggcacctctgtccaaggacaatccctttcacaaacaaaccagctgcctttgtatcttgtaccttttcagagaaagggaggtatccctgtgccaaaggctccaggcctctcccctgcaactcaggacccaagcccagctcactctgggaactgtgttcccagcatctctgtcctcttgattaagagattctccttccaggcctaagcctgggatttgggccagagataagaatccaaactatgaggctagttcttgtctaactcaagactgttctggaatgagggtccaggcctgtcaaccatggggcttctgacctgagcaccaaggttgagggacaggattaggcagggtctgtcctgtggccacctggaaagtcccaggtgggactcttctggggacacttggggtccacaatcccaggtccatactctaggttttggataccatgagtatgtatgtttacctgtgcctaataaaggagaattatgaaataa

SEQ ID NO: 427637 - DNA, 1187 bp, Homo sapiens
  misc_feature (1116)..(1116): n is a, c, g, or t
  misc_feature (1124)..(1124): n is a, c, g, or t
  misc_feature (1130)..(1130): n is a, c, g, or t
  misc_feature (1141)..(1141): n is a, c, g, or t
  misc_feature (1143)..(1143): n is a, c, g, or t
  misc_feature (1150)..(1150): n is a, c, g, or t
gagccgagatcgcgccaccgccctccagcctgggcgacagagcaagactctgtctcaaaaaaaaaaaaaaaaagagcaaattttttttccaaggtgatagggagagtccgtggctgatgtctgcactgaccagacgcccctagggggccagcgagggcgggtcccaggtgcagcggatgcagaggagagaggcccgggcgcggcgcgggggatggtgcgatcccgggcccgagggcatcagacggcggctgattagctccggtttgcatcacccggaccgggggattagctccggtttgcatcacccggaccgggggattagctccggtttgcatcacccggaccgggggccgggcgcgcacgagactcgcagcggaagtggaggcggctccgcgcgcgtccgctgctaggacccgggcagggctggagctgggctgggatcccgagctcggcagcagcgcagcgggccggcccacctgctggtgccctggaggctctgagccccggcggcgcccgggcccacgcggaacgacggggcgagatgcgagccacccctctggctgctcctgcgggttccctgtccaggaagaagcggttggagttggatgacaacttagataccgagcgtcccgtccagaaacgagctcgaagtgggccccagcccagactgcccccctgcctgttgcccctgagcccacctactgctccagatcgtgcaactgctgtggccactgcctcccgtcttgggccctatgtcctcctggagcccgaggagggcgggcgggcctaccaggccctgcactgccctacaggcactgagtatacctgcaaggtgtaccccgtccaggaagccctggccgtgctggagccctacgcgcggctgcccccgcacaagcatgtggctcggcccactgaggtcctggctggtacccagctcctctacgcctttttcactcggacccatggggacatgcacagcctggtgcgaagccgccaccgtatccctgagcctgaggctgccgtgctcttccgccagatggccaccgccctggcgcactgtcaccagcacggtctggtcctgcgtgatctcaagctgtgtcgttgtttctgacgtgnaggaaaantgtgtngaactgggggncnggtgtgntggcaagttcctgtgcaggggtgcactagggccggaa

SEQ ID NO: 427638 - DNA, 3402 bp, Homo sapiens
gcaggggtggcctgggttggggcaccacagagagcccccgtggagtggtgaggggtgatgtgataaagtcaacggggggcattcgttccctcccctgggagcagaggcccttctagtgtgtcaggctctgggcggagggcagcagcccctgggcaggcatcggagcttccagcctggggagaccttggagatcatcttggccagagtgaagacccacccagggagggccaggaccacctgtgggctgtgcacatgtgaccctgacgaggatgtgccccaaactacatgtgatgttcttcatttccaaatcaatctggccacgtcggagtcatccttgccgcagcatcgcttgcacatgtgatgttcttcatttccaaatcaacctggccacgtcggagtcttccttgctgcagcatcgcttgcacatgtgatgttcttcatttccaaatcaacctggccacgtcggagtcatccttgctgcagcatcgcttgcacatgtgatgttcttcatttccaaatcaacctggccacgtcagagtcatccttgctgcagcatcgcttgcacatgtgatgttcttcatttccaaatcaatctggccacgtcggagtcatccttgctgcagcatcgcttgcacatgtgatgttcttcatttccaaatcaacctggccatgtcggagtcatccttgctgcagcatcgcttgcactcacctccagcccatacatcaatgggagagaaagggcctgagtttcagccagtaaataccctggaattgtgaggtatagctctaagaatgtgttacgtgactgaacggcttctgtaatgtccatcccagcagaattgagagccactgctatagctgatccttctctgaggctcaggtccttgcttgaaccttcccagcgcttgtctggcttctccttgtatgccccagcagcagggagctcattccctccactggatgggcaacttgcaaaaggaaaactcagagatgtttatcacagcattattcataatcaaaaaccaactgcaaacaccccaggttcaaattaaaaaacgacaggaaaaggattatgagtaagttctggtaaattcacccaatagaatcatcaccagaggttaaaaatgatcactgggaagcttatgtagcaacattgaaaggttttacaaagtgacactgagttaattttacagtatgattgtaaatatatgataaaatatgttgattttaaaaacaaacactacttgagcacttgctatgttttggtccctgtacttagtgttgtcacacattatctcacttagtctcccaactgcccagtaggttagttggtatttgccccttttacagatgaggaaacagagggtcagagtggttcagtggcctgcctgaggccttccagccagaacatcagccaggacttaaattcagacctactggtccctttaccacatcatgctgacatcaagaatagagaagggtgctatgagtattttatttttctttcagacttcctcttctgttgccattattggaaatttctaaggaaaagaagctttgggggctcatttgagggtgtgactccccaggaccagggagatgtttatgtccaactgataacatattttactctcttctccaggatgacatggaagcttaccggacccagaactgcttcctcaactccgagatccaccaggtcacaaagatctggagaaaggtggctgagaaggagaaggcccttctgacgaagtgcgcctacctccaagccagaaactgccaggtggaaagcaagtacctggccggtctgagaaggctgcaggaggccctgggggacgaagccagcgagtgctcagagctgctgaggcagcttgtccaggaggcactgcagtgggaagctggggaggcctcatctgacagcatcgagctgagccccatcagtaagtatgatgagtacggcttcctgacggtgcccgactatgaggtggaagacctgaagctgctggccaagatccaggcattggagtcacgatcccaccacctgctgggcctcgaggctgtggatcggccgctgagggagcgctgggctgccctgggcgatcttgtgccctcagccgagctcaagcagctactgcgggcaggagtaccccgtgaacaccggcctcgtgtctggaggtggctggtccacctccgtgtccagcacctgcacactccaggctgctaccaggaactgctgagccggggccaggcccgcgagcaccctgctgcccgccagattgagctggacctgaaccggaccttccccaacaacaaacacttcacctgccccacctccagcttccccgacaagctccgccgggtgctgctggccttctcctggcagaaccccaccatcggctactgccagggcctgaacaggctggcggccattgccctgctggtcctagaggaggaggagagcgccttctggtgcctggtggccattgtggagaccatcatgcccgctgattactactgcaacacgctgacggcatcccaggtggaccagcgggtgctccaggacctgctctcggagaagctgcccaggctgatggcccatctggggcagcaccacgtggatctctccctcgtcaccttcaactggttcctcgtggtctttgcggacagtctcattagcaacatcctccttcgggtctgggatgccttcctgtacgaggggacgaaggtggtgtttcgctatgccttggccattttcaagtacaacgagaaggagatcttgaggctacagaatggcctggaaatctaccagtacctgcgcttcttcaccaagaccatctccaacagccggaagctgatgaacatcgccttcaatgacatgaaccccttccgcatgaaacagctgcggcagctgcgcatggtccaccgggagcggctggaggctgagctgcgggagctggagcagcttaaggcagagtacctggagaggcgggcatcccggcgcagagctgtgtccgagggctgtgccagcgaggacgaggtggagggggaagcctgacttggccacctcccctccccacagccttcctcacccttggctggcagacccactggaggtcaggcacggaccagtggcccagccctgggtgtcccatcaccatgtgaccttggacatgtcccttcccctctctggccctcagtttccccactgggacattgtgtgctgcaaagccattggttgggctacttcttcataggcacttacttacccagggatgccaccctttcgtcacctcttccacagagcactttggcatgtaaacaagcaagagcactgcctctatagggtaacctggaacattctctaggttatatcaatataaaacaatgtaaatggtggaaatc

SEQ ID NO: 427639 - DNA, 3193 bp, Homo sapiens
ctccctttgggaagctgcccgccgagtctccgagatttgtccctggtggtcccgcggacccctcgtccctccgcagtctccggctggcagcgatggagggcgctggggagaacgccccggagtccagctcctctgcccctgggtccgaagagtctgccagggatccacaggtgccgcctccggaggaagaatcgggggactgcgcccggtccctggaggcggtccccaagaaactctgtgggtatttaagtaagttcggcggcaaagggcccatccggggctggaaatcccgctggttcttctacgacgaaaggaaatgtcagctgtattactcgcggaccgctcaggatgccaatcccttggacagcatcgacctctccagtgcagtgtttgactgtaaggcggacgctgaggaggggatcttcgaaatcaagactcccagccgggttattaccctgaaggccgccaccaagcaagcgatgctgtactggctgcagcagctgcagatgaagcgctgggaattccacaacagcccgccggcacctcctgccacccctgatgccgccctggctgggaatgggcccgtcctgcacctcgagctagggcaagaagaggcagagctggaggagttcctgtgccctgtgaaaacaccccctgggctagtgggcgtggcagctgccttgcagcccttccctgcccttcagaatatttccctcaagcacctggggactgaaatacagaacacaatgcacaacatccgtggcaacaagcaggcccagggaacaggccatgaacctccaggggaagattctccacagagtggggagcctcagagggaggagcagcccttggcctctgacgccagcaccccagggagagagccagaggattctccaaagcctgcacccaagccttctctgaccatcagtttcgctcagaaagccaagcgccagaacaacaccttcccattcttttctgaaggaatcacacggaaccgaactgcccaggagaaagtggcagccttggagcaacaggttctgatgctcaccaaggagttaaagtctcagaaggagctagtgaagatcctgcacaaggcactggaggccgcccagcaggagaagcgggcgtccagcgcatacctggcggcggctgaggacaaggaccggctggagctggtgcggcacaaagtgcggcagatcgcggagctgggccggcgggtggaggccctggagcaggagcgggagagcctggcgcacacagcgagcctgcgggagcagcaggtgcaggagctacagcagcacgtgcagctgcttatggacaagaaccacgccaagcagcaggtcatctgcaagctctctgagaaggtcacccaggacttcacgcacccccctgaccagtctcctttgcgccccgacgctgccaacagggacttcctgagccagcaggggaagatagagcacctgaaggatgacatggaagcttaccggacccagaactgcttcctcaactccgagatccaccaggtcacaaagatctggagaaaggtggctgagaaggagaaggcccttctgacgaagtgcgcctacctccaagccagaaactgccaggtggaaagcaagtacctggccggtctgagaaggctgcaggaggccctgggggacgaagccagcgagtgctcagagctgctgaggcagcttgtccaggaggcactgcagtgggaagctggggaggcctcatctgacagcatcgagctgagccccatcagtaagtatgatgagtacggcttcctgacggtgcccgactatgaggtggaagacctgaagctgctggccaagatccaggcattggagtcacgatcccaccacctgctgggcctcgaggctgtggatcggccgctgagggagcgctgggctgccctgggcgatcttgtgccctcagccgagctcaagcagctactgcgggcaggagtaccccgtgaacaccggcctcgtgtctggaggtggctggtccacctccgtgtccagcacctgcacactccaggctgctaccaggaactgctgagccggggccaggcccgcgagcaccctgctgcccgccagattgagctggacctgaaccggaccttccccaacaacaaacacttcacctgccccacctccagcttccccgacaagctccgccgggtgctgctggccttctcctggcagaaccccaccatcggctactgccagggcctgaacaggctggcggccattgccctgctggtcctagaggaggaggagagcgccttctggtgcctggtggccattgtggagaccatcatgcccgctgattactactgcaacacgctgacggcatcccaggtggaccagcgggtgctccaggacctgctctcggagaagctgcccaggctgatggcccatctggggcagcaccacgtggatctctccctcgtcaccttcaactggttcctcgtggtctttgcggacagtctcattagcaacatcctccttcgggtctgggatgccttcctgtacgaggggacgaagtacaacgagaaggagatcttgaggctacagaatggcctggaaatctaccagtacctgcgcttcttcaccaagaccatctccaacagccggaagctgatgaacatcgccttcaatgacatgaaccccttccgcatgaaacagctgcggcagctgcgcatggtccaccgggagcggctggaggctgagctgcgggagctggagcagcttaaggcagagtacctggagaggcgggcatcccggcgcagagctgtgtccgagggctgtgccagcgaggacgaggtggagggggaagcctgacttggccacctcccctccccacagccttcctcacccttggctggcagacccactggaggtcaggcacggaccagtggcccagccctgggtgtcccatcaccatgtgaccttggacatgtcccttcccctctctggccctcagtttccccactgggacattgtgtgctgcaaagccattggttgggctacttcttcataggcacttacttacccagggatgccaccctttcgtcacctcttccacagagcactttggcatgtaaacaagcaagagcactgcctctatagggtaacctggaacattctctaggttatatcaatataaaacaatgtaaatggtggaaatc

SEQ ID NO: 427640 - DNA, 3084 bp, Homo sapiens
ctccctttgggaagctgcccgccgagtctccgagatttgtccctggtggtcccgcggacccctcgtccctccgcagtctccggctggcagcgatggagggcgctggggagaacgccccggagtccagctcctctgcccctgggtccgaagagtctgccagggatccacaggtgccgcctccggaggaagaatcgggggactgcgcccggtccctggaggcggtccccaagaaactctgtgggtatttaagtaagttcggcggcaaagggcccatccggggctggaaatcccgctggttcttctacgacgaaaggaaatgtcagctgtattactcgcggaccgctcaggatgccaatcccttggacagcatcgacctctccagtgcagtgtttgactgtaaggcggacgctgaggaggggatcttcgaaatcaagactcccagccgggttattaccctgaagggcaagaagaggcagagctggaggagttcctgtgccctgtgaaaacaccccctgggctagtgggcgtggcagctgccttgcagcccttccctgcccttcagaatatttccctcaagcacctggggactgaaatacagaacacaatgcacaacatccgtggcaacaagcaggcccagggaacaggccatgaacctccaggggaagattctccacagagtggggagcctcagagggaggagcagcccttggcctctgacgccagcaccccagggagagagccagaggattctccaaagcctgcacccaagccttctctgaccatcagtttcgctcagaaagccaagcgccagaacaacaccttcccattcttttctgaaggaatcacacggaaccgaactgcccaggagaaagtggcagccttggagcaacaggttctgatgctcaccaaggagttaaagtctcagaaggagctagtgaagatcctgcacaaggcactggaggccgcccagcaggagaagcgggcgtccagcgcatacctggcggcggctgaggacaaggaccggctggagctggtgcggcacaaagtgcggcagatcgcggagctgggccggcgggtggaggccctggagcaggagcgggagagcctggcgcacacagcgagcctgcgggagcagcaggtgcaggagctacagcagcacgtgcagctgcttatggacaagaaccacgccaagcagcaggtcatctgcaagctctctgagaaggtcacccaggacttcacgcacccccctgaccagtctcctttgcgccccgacgctgccaacagggacttcctgagccagcaggggaagatagagcacctgaaggatgacatggaagcttaccggacccagaactgcttcctcaactccgagatccaccaggtcacaaagatctggagaaaggtggctgagaaggagaaggcccttctgacgaagtgcgcctacctccaagccagaaactgccaggtggaaagcaagtacctggccggtctgagaaggctgcaggaggccctgggggacgaagccagcgagtgctcagagctgctgaggcagcttgtccaggaggcactgcagtgggaagctggggaggcctcatctgacagcatcgagctgagccccatcagtaagtatgatgagtacggcttcctgacggtgcccgactatgaggtggaagacctgaagctgctggccaagatccaggcattggagtcacgatcccaccacctgctgggcctcgaggctgtggatcggccgctgagggagcgctgggctgccctgggcgatcttgtgccctcagccgagctcaagcagctactgcgggcaggagtaccccgtgaacaccggcctcgtgtctggaggtggctggtccacctccgtgtccagcacctgcacactccaggctgctaccaggaactgctgagccggggccaggcccgcgagcaccctgctgcccgccagattgagctggacctgaaccggaccttccccaacaacaaacacttcacctgccccacctccagcttccccgacaagctccgccgggtgctgctggccttctcctggcagaaccccaccatcggctactgccagggcctgaacaggctggcggccattgccctgctggtcctagaggaggaggagagcgccttctggtgcctggtggccattgtggagaccatcatgcccgctgattactactgcaacacgctgacggcatcccaggtggaccagcgggtgctccaggacctgctctcggagaagctgcccaggctgatggcccatctggggcagcaccacgtggatctctccctcgtcaccttcaactggttcctcgtggtctttgcggacagtctcattagcaacatcctccttcgggtctgggatgccttcctgtacgaggggacgaaggtggtgtttcgctatgccttggccattttcaagtacaacgagaaggagatcttgaggctacagaatggcctggaaatctaccagtacctgcgcttcttcaccaagaccatctccaacagccggaagctgatgaacatcgccttcaatgacatgaaccccttccgcatgaaacagctgcggcagctgcgcatggtccaccgggagcggctggaggctgagctgcgggagctggagcagcttaaggcagagtacctggagaggcgggcatcccggcgcagagctgtgtccgagggctgtgccagcgaggacgaggtggagggggaagcctgacttggccacctcccctccccacagccttcctcacccttggctggcagacccactggaggtcaggcacggaccagtggcccagccctgggtgtcccatcaccatgtgaccttggacatgtcccttcccctctctggccctcagtttccccactgggacattgtgtgctgcaaagccattggttgggctacttcttcataggcacttacttacccagggatgccaccctttcgtcacctcttccacagagcactttggcatgtaaacaagcaagagcactgcctctatagggtaacctggaacattctctaggttatatcaatataaaacaatgtaaatggtggaaatc

SEQ ID NO: 427641 - DNA, 657 bp, Homo sapiens
ggggggacgaggtgaagaggaaggagagagaagatacagtgggggaaaggagtgagatgagaaagacgtaagtataaagatagaggaaggagcgagaagagaaagggagagaagagtaaagaagcacggcaaggggaagagaggaggcagaaggggagaaagacagaggagggaggaggagagcgggagcgagtaggaggaaggcagcgggaagggaggagagagagggaggatcgaacagagagggagacgggaaagaaaaggagggcggaagacgaaaaagacgggaagaggggaaaggggccacgggaggagagacctcccctccccacagccttcctcacccttggctggcagacccactggaggtcaggcacggaccagtggcccagccctgggtgtcccatcaccatgtgaccttggacatgtcccttcccctctctggccctcagtttccccactgggacattgtgtgctgcaaagccattggttgggctacttcttcataggcacttacttacccagggatgccaccctttcgtcacctcttccacagagcactttggcatgtaaacaagcaagagcactgcctctatagggtaacctggaacattctctaggttatatcaatataaaacaatgtaaatggtggaaatc

SEQ ID NO: 427642 - DNA, 3262 bp, Homo sapiens
ctccctttgggaagctgcccgccgagtctccgagatttgtccctggtggtcccgcggacccctcgtccctccgcagtctccggctggcagcgatggagggcgctggggagaacgccccggagtccagctcctctgcccctgggtccgaagagtctgccagggatccacaggtgccgcctccggaggaagaatcgggggactgcgcccggtccctggaggcggtccccaagaaactctgtgggtatttaagtaagttcggcggcaaagggcccatccggggctggaaatcccgctggttcttctacgacgaaaggaaatgtcagctgtattactcgcggaccgctcaggatgccaatcccttggacagcatcgacctctccagtgcagtgtttgactgtaaggcggacgctgaggaggggatcttcgaaatcaagactcccagccgggttattaccctgaaggccgccaccaagcaagcgatgctgtactggctgcagcagctgcagatgaagcgctgggaattccacaacagcccgccggcacctcctgccacccctgatgccgccctggctgggaatgggcccgtcctgcacctcgagctagggcaagaagaggcagagctggaggagttcctgtgccctgtgaaaacaccccctgggctagtgggcgtggcagctgccttgcagcccttccctgcccttcagaatatttccctcaagcacctggggactgaaatacagaacacaatgcacaacatccgtggcaacaagcaggcccagggaacaggccatgaacctccaggggaagattctccacagagtggggagcctcagagggaggagcagcccttggcctctgacgccagcaccccagggagagagccagaggattctccaaagcctgcacccaagccttctctgaccatcagtttcgctcagaaagccaagcgccagaacaacaccttcccattcttttctgaaggaatcacacggaaccgaactgcccaggagaaagtggcagccttggagcaacaggttctgatgctcaccaaggagttaaagtctcagaaggagctagtgaagatcctgcacaaggcactggaggccgcccagcaggagaagcgggcgtccagcgcatacctggcggcggctgaggacaaggaccggctggagctggtgcggcacaaagtgcggcagatcgcggagctgggccggcgggtggaggccctggagcaggagcgggagagcctggcgcacacagcgagcctgcgggagcagcaggtgcaggagctacagcagcacgtgcagctgcttatggacaagaaccacgccaagcagcaggtcatctgcaagctctctgagaaggtcacccaggacttcacgcacccccctgaccagtctcctttgcgccccgacgctgccaacagggacttcctgagccagcaggggaagatagagcacctgaaggatgacatggaagcttaccggacccagaactgcttcctcaactccgagatccaccaggtcacaaagatctggagaaaggtggctgagaaggagaaggcccttctgacgaagtgcgcctacctccaagccagaaactgccaggtggaaagcaagtacctggccggtctgagaaggctgcaggaggccctgggggacgaagccagcgagtgctcagagctgctgaggcagcttgtccaggaggcactgcagtgggaagctggggaggcctcatctgacagcatcgagctgagccccatcagtaagtatgatgagtacggcttcctgacggtgcccgactatgaggtggaagacctgaagctgctggccaagatccaggcattggagtcacgatcccaccacctgctgggcctcgaggctgtggatcggccgctgagggagcgctgggctgccctgggcgatcttgtgccctcagccgagctcaagcagctactgcgggcaggagtaccccgtgaacaccggcctcgtgtctggaggtggctggtccacctccgtgtccagcacctgcacactccaggctgctaccaggaactgctgagccggggccaggcccgcgagcaccctgctgcccgccagattgagctggacctgaaccggaccttccccaacaacaaacacttcacctgccccacctccagcttccccgacaagctccgccgggtgctgctggccttctcctggcagaaccccaccatcggctactgccagggcctgaacaggctggcggccattgccctgctggtcctagaggaggaggagagcgccttctggtgcctggtggccattgtggagaccatcatgcccgctgattactactgcaacacgctgacggcatcccaggtggaccagcgggtgctccaggacctgctctcggagaagctgcccaggctgatggcccatctggggcagcaccacgtggatctctccctcgtcaccttcaactggttcctcgtggtctttgcggacagtctcattagcaacatcctccttcgggtctgggatgccttcctgtacgaggggacgaaggtggtgtttcgctatgccttggccattttcaagtacaacgagaaggagatcttgaggctacagaatggcctggaaatctaccagtacctgcgcttcttcaccaagaccatctccaacagccggaagctgatgaacatcgccttcaatgacatgaaccccttccgcatgaaacagctgcggcagctgcgcatggtccaccgggagcggctggaggctgagctgcgggagctggagcagcttaaggcagagtacctggagaggcgggcatcccggcgcagagctgtgtccgagggctgtgccagcgaggacgaggtggagggggaagcctgacttggccacctcccctccccacagccttcctcacccttggctggcagacccactggaggtcaggcacggaccagtggcccagccctgggtgtcccatcaccatgtgaccttggacatgtcccttcccctctctggccctcagtttccccactgggacattgtgtgctgcaaagccattggttgggctacttcttcataggcacttacttacccagggatgccaccctttcgtcacctcttccacagagcactttggcatgtaaacaagcaagagcactgcctctatagggtaacctggaacattctctaggttatatcaatataaaacaatgtaaatggtggaaatcattcataagctttggaacttaaacagttctcagtta

SEQ ID NO: 427643 - DNA, 3118 bp, Homo sapiens
ctccctttgggaagctgcccgccgagtctccgagatttgtccctggtggtcccgcggacccctcgtccctccgcagtctccggctggcagcgatggagggcgctggggagaacgccccggagtccagctcctctgcccctgggtccgaagagtctgccagggatccacaggtgccgcctccggaggaagaatcgggggactgcgcccggtccctggaggcggtccccaagaaactctgtgggtatttaagtaagttcggcggcaaagggcccatccggggctggaaatcccgctggttcttctacgacgaaaggaaatgtcagctgtattactcgcggaccgctcaggatgccaatcccttggacagcatcgacctctccagtgcagtgtttgactgtaaggcggacgctgaggaggggatcttcgaaatcaagactcccagccgggttattaccctgaaggccgccaccaagcaagcgatgctgtactggctgcagcagctgcagatgaagcgctgggaattccacaacagcccgccggcacctcctgccacccctgatgccgccctggctgggaatgggcccgtcctgcacctcgagctagggcaagaagaggcagagctggaggagttcctgtgccctgtgaaaacaccccctgggctagtgggcgtggcagctgccttgcagcccttccctgcccttcagaatatttccctcaagcacctggggactgaaatacagaacacaatgcacaacatccgtggcaacaagcaggcccagggaacaggccatgaacctccaggggaagattctccacagagtggggagcctcagagggaggagcagcccttggcctctgacgccagcaccccaggaatcacacggaaccgaactgcccaggagaaagtggcagccttggagcaacaggttctgatgctcaccaaggagttaaagtctcagaaggagctagtgaagatcctgcacaaggcactggaggccgcccagcaggagaagcgggcgtccagcgcatacctggcggcggctgaggacaaggaccggctggagctggtgcggcacaaagtgcggcagatcgcggagctgggccggcgggtggaggccctggagcaggagcgggagagcctggcgcacacagcgagcctgcgggagcagcaggtgcaggagctacagcagcacgtgcagctgcttatggacaagaaccacgccaagcagcaggtcatctgcaagctctctgagaaggtcacccaggacttcacgcacccccctgaccagtctcctttgcgccccgacgctgccaacagggacttcctgagccagcaggggaagatagagcacctgaaggatgacatggaagcttaccggacccagaactgcttcctcaactccgagatccaccaggtcacaaagatctggagaaaggtggctgagaaggagaaggcccttctgacgaagtgcgcctacctccaagccagaaactgccaggtggaaagcaagtacctggccggtctgagaaggctgcaggaggccctgggggacgaagccagcgagtgctcagagctgctgaggcagcttgtccaggaggcactgcagtgggaagctggggaggcctcatctgacagcatcgagctgagccccatcagtaagtatgatgagtacggcttcctgacggtgcccgactatgaggtggaagacctgaagctgctggccaagatccaggcattggagtcacgatcccaccacctgctgggcctcgaggctgtggatcggccgctgagggagcgctgggctgccctgggcgatcttgtgccctcagccgagctcaagcagctactgcgggcaggagtaccccgtgaacaccggcctcgtgtctggaggtggctggtccacctccgtgtccagcacctgcacactccaggctgctaccaggaactgctgagccggggccaggcccgcgagcaccctgctgcccgccagattgagctggacctgaaccggaccttccccaacaacaaacacttcacctgccccacctccagcttccccgacaagctccgccgggtgctgctggccttctcctggcagaaccccaccatcggctactgccagggcctgaacaggctggcggccattgccctgctggtcctagaggaggaggagagcgccttctggtgcctggtggccattgtggagaccatcatgcccgctgattactactgcaacacgctgacggcatcccaggtggaccagcgggtgctccaggacctgctctcggagaagctgcccaggctgatggcccatctggggcagcaccacgtggatctctccctcgtcaccttcaactggttcctcgtggtctttgcggacagtctcattagcaacatcctccttcgggtctgggatgccttcctgtacgaggggacgaaggtggtgtttcgctatgccttggccattttcaagtacaacgagaaggagatcttgaggctacagaatggcctggaaatctaccagtacctgcgcttcttcaccaagaccatctccaacagccggaagctgatgaacatcgccttcaatgacatgaaccccttccgcatgaaacagctgcggcagctgcgcatggtccaccgggagcggctggaggctgagctgcgggagctggagcagcttaaggcagagtacctggagaggcgggcatcccggcgcagagctgtgtccgagggctgtgccagcgaggacgaggtggagggggaagcctgacttggccacctcccctccccacagccttcctcacccttggctggcagacccactggaggtcaggcacggaccagtggcccagccctgggtgtcccatcaccatgtgaccttggacatgtcccttcccctctctggccctcagtttccccactgggacattgtgtgctgcaaagccattggttgggctacttcttcataggcacttacttacccagggatgccaccctttcgtcacctcttccacagagcactttggcatgtaaacaagcaagagcactgcctctatagggtaacctggaacattctctaggttatatcaatataaaacaatgtaaatggtggaaatc

SEQ ID NO: 427644 - DNA, 2750 bp, Homo sapiens
ctccctttgggaagctgcccgccgagtctccgagatttgtccctggtggtcccgcggacccctcgtccctccgcagtctccggctggcagcgatggagggcgctggggagaacgccccggagtccagctcctctgcccctgggtccgaagagtctgccagggatccacaggtgccgcctccggaggaagaatcgggggactgcgcccggtccctggaggcggtccccaagaaactctgtgggtatttaagtaagttcggcggcaaagggcccatccggggctggaaatcccgctggttcttctacgacgaaaggaaatgtcagctgtattactcgcggaccgctcaggatgccaatcccttggacagcatcgacctctccagtgcagtgtttgactgtaaggcggacgctgaggaggggatcttcgaaatcaagactcccagccgggttattaccctgaaggccgccaccaagcaagcgatgctgtactggctgcagcagctgcagatgaagcgctgggaattccacaacagcccgccggcacctcctgccacccctgatgccgccctggctgggaatgggcccgtcctgcacctcgagctagggcaagaagaggcagagctggaggagttcctgtgccctgtgaaaacaccccctgggctagtgggcgtggcagctgccttgcagcccttccctgcccttcagaatatttccctcaagcacctggggactgaaatacagaacacaatgcacaacatccgtggcaacaagcaggcccagggaacaggccatgaacctccaggggaagattctccacagagtggggagcctcagagggaggagcagcccttggcctctgacgccagcaccccagggagagagccagaggattctccaaagcctgcacccaagccttctctgaccatcagtttcgctcagaaagccaagcgccagaacaacaccttcccattcttttctgaaggaatcacacggaaccgaactgcccaggagaaagtggcagccttggagcaacaggttctgatgctcaccaaggagttaaagtctcagaaggagctagtgaagatcctgcacaaggcactggaggccgcccagcaggagaagcgggcgtccagcgcatacctggcggcggctgaggacaaggaccggctggagctggtgcggcacaaagtgcggcagatcgcggaagctgctgaggcagcttgtccaggaggcactgcagtgggaagctggggaggcctcatctgacagcatcgagctgagccccatcagtaagtatgatgagtacggcttcctgacggtgcccgactatgaggtggaagacctgaagctgctggccaagatccaggcattggagtcacgatcccaccacctgctgggcctcgaggctgtggatcggccgctgagggagcgctgggctgccctgggcgatcttgtgccctcagccgagctcaagcagctactgcgggcaggagtaccccgtgaacaccggcctcgtgtctggaggtggctggtccacctccgtgtccagcacctgcacactccaggctgctaccaggaactgctgagccggggccaggcccgcgagcaccctgctgcccgccagattgagctggacctgaaccggaccttccccaacaacaaacacttcacctgccccacctccagcttccccgacaagctccgccgggtgctgctggccttctcctggcagaaccccaccatcggctactgccagggcctgaacaggctggcggccattgccctgctggtcctagaggaggaggagagcgccttctggtgcctggtggccattgtggagaccatcatgcccgctgattactactgcaacacgctgacggcatcccaggtggaccagcgggtgctccaggacctgctctcggagaagctgcccaggctgatggcccatctggggcagcaccacgtggatctctccctcgtcaccttcaactggttcctcgtggtctttgcggacagtctcattagcaacatcctccttcgggtctgggatgccttcctgtacgaggggacgaaggtggtgtttcgctatgccttggccattttcaagtacaacgagaaggagatcttgaggctacagaatggcctggaaatctaccagtacctgcgcttcttcaccaagaccatctccaacagccggaagctgatgaacatcgccttcaatgacatgaaccccttccgcatgaaacagctgcggcagctgcgcatggtccaccgggagcggctggaggctgagctgcgggagctggagcagcttaaggcagagtacctggagaggcgggcatcccggcgcagagctgtgtccgagggctgtgccagcgaggacgaggtggagggggaagcctgacttggccacctcccctccccacagccttcctcacccttggctggcagacccactggaggtcaggcacggaccagtggcccagccctgggtgtcccatcaccatgtgaccttggacatgtcccttcccctctctggccctcagtttccccactgggacattgtgtgctgcaaagccattggttgggctacttcttcataggcacttacttacccagggatgccaccctttcgtcacctcttccacagagcactttggcatgtaaacaagcaagagcactgcctctatagggtaacctggaacattctctaggttatatcaatataaaacaatgtaaatggtggaaatc

SEQ ID NO: 427645 - DNA, 3113 bp, Homo sapiens
ctccctttgggaagctgcccgccgagtctccgagatttgtccctggtggtcccgcggacccctcgtccctccgcagtctccggctggcagcgatggagggcgctggggagaacgccccggagtccagctcctctgcccctgggtccgaagagtctgccagggatccacaggtgccgcctccggaggaagaatcgggggactgcgcccggtccctggaggcggtccccaagaaactctgtgggtatttaagtaagttcggcggcaaagggcccatccggggctggaaatcccgctggttcttctacgacgaaaggaaatgtcagctgtattactcgcggaccgctcaggatgccaatcccttggacagcatcgacctctccagtgcagtgtttgactgtaaggcggacgctgaggaggggatcttcgaaatcaagactcccagccgggttattaccctgaaggccgccaccaagcaagcgatgctgtactggctgcagcagctgcagatgaagcgctgggaattccacaacagcccgccggcacctcctgccacccctgatgccgccctggctgggaatgggcccgtcctgcacctcgagctagggcaagaagaggcagagctggaggagttcctgtgccctgtgaaaacaccccctgggctagtgggcgtggcagctgccttgcagcccttccctgcccttcagaatatttccctcaagcacctggggactgaaatacagaacacaatgcacaacatccgtggcaacaagcaggcccagggaacaggccatgaacctccaggggaagattctccacagagtggggagcctcagagggaggagcagcccttggcctctgacgccagcaccccagggagagagccagaggattctccaaagcctgcacccaagccttctctgaccatcagtttcgctcagaaagccaagcgccagaacaacaccttcccattcttttctgaaggaatcacacggaaccgaactgcccaggagaaagtggcagccttggagcaacaggttctgatgctcaccaaggagttaaagtctcagaaggagctagtgaagatcctgcacaaggcactggaggccgcccagcaggagaagcgggcgtccagcgcatacctggcggcggctgaggacaaggaccggctggagctggtgcggcacaaagtgcggcagatcgcggagctgggccggcgggtggaggccctggagcaggagcgggagagcctggcgcacacagcgagcctgcgggagcagcaggtgcaggagctacagcagcacgtgcagctgcttatggacaagaaccacgccaagcagcaggtcatctgcaagctctctgagaaggtcacccaggacttcacgcacccccctgaccagtctcctttgcgccccgacgctgccaacagggacttcctgagccagcaggggaagatagagcacctgaaggatgacatggaagcttaccggacccagaactgcttcctcaactccgagatccaccaggtcacaaagatctggagaaaggtggctgagaaggagaaggcccttctgacgaagtgcgcctacctccaagccagaaactgccaggtggaaagcaagtacctggccggtctgagaaggctgcaggaggccctgggggacgaagccagcgagtgctcagagctgctgaggcagcttgtccaggaggcactgcagtgggaagctggggaggcctcatctgacagcatcgagctgagccccatcagtaagtatgatgagtacggcttcctgacggtgcccgactatgaggtggaagacctgaagctgctggccaagatccaggcattggagtcacgatcccaccacctgctgggcctcgaggctgtggatcggccgctgagggagcgctgggctgccctgggcgatcttgtgccctcagccgagctcaagcagctactgcgggcaggagtaccccgtgaacaccggcctcgtgtctggaggtggctggtccacctccgtgtccagcacctgcacactccaggctgctaccaggaactgctgagccggggccaggcccgcgagcaccctgctgcccgccagattgagctggacctgaaccggaccttccccaacaacaaacacttcacctgccccacctccagcttccccgacaagctccgccgggtgctgctggccttctcctggcagaaccccaccatcggctactgccagggcctgaacaggctggcggccattgccctgctggtcctagaggaggaggagagcgccttctggtgcctggtggccattgtggagaccatcatgcccgctgattactactgcaacacgctgacggcatcccaggtggaccagcgggtgctccaggacctgctctcggagaagctgcccaggctgatggcccatctggggcagcaccacgtggatctctccctcgtcaccttcaactggttcctcgtggtctttgcggacagtctcattagcaacatcctccttcgggtctgggatgccttcctgtacgaggggacgaaggtggtgtttcgctatgccttggccattttcaagtacaacgagaaggagatcttgaggctacagaatggcctggaaatctaccagtacctgcgcttcttcaccaagaccatctccaacagccggaagctgatgaacatcgccttcaatgacatgaaccccttccgcatgaaacagctgcggcagctgcgcatggtccaccgggagcggctggaggctgagctgcgggagctggagcagcttaaggcagagtacctggagaggcgggcatcccggcgcagagctgtgtccgagggctgtgccagcgaggacgaggtggagggggaagcctgacttggccacctcccctccccacagccttcctcacccttggctggcagacccactggaggtcaggcacggaccagtggcccagccctgggtgtcccatcaccatgtgaccttggacatgtcccttcccctctctggccctcagtttccccactgggacattgtgtgctgcaaagccattggttgggctacttcttcataggcactgtttggactctgggcactgtttggactctg

SEQ ID NO: 427646 - DNA, 2350 bp, Homo sapiens
ctccctttgggaagctgcccgccgagtctccgagatttgtccctggtggtcccgcggacccctcgtccctccgcagtctccggctggcagcgatggagggcgctggggagaacgccccggagtccagctcctctgcccctgggtccgaagagtctgccagggatccacaggtgccgcctccggaggaagaatcgggggactgcgcccggtccctggaggcggtccccaagaaactctgtgggtatttaagtaagttcggcggcaaagggcccatccggggctggaaatcccgctggttcttctacgacgaaaggaaatgtcagctgtattactcgcggaccgctcaggatgccaatcccttggacagcatcgacctctccagtgcagtgtttgactgtaaggcggacgctgaggaggggatcttcgaaatcaagactcccagccgggttattaccctgaaggccgccaccaagcaagcgatgctgtactggctgcagcagctgcagatgaagcgctgggaattccacaacagcccgccggcacctcctgccacccctgatgccgccctggctgggaatgggcccgtcctgcacctcgagctagggcaagaagaggcagagctggaggagttcctgtgccctgtgaaaacaccccctgggctagtgggcgtggcagctgccttgcagcccttccctgcccttcagaatatttccctcaagcacctggggactgaaatacagaacacaatgcacaacatccgtggcaacaagcaggcccagggaacaggccatgaacctccaggggaagattctccacagagtggggagcctcagagggaggagcagcccttggcctctgacgccagcaccccagggagagagccagaggattctccaaagcctgcacccaagccttctctgaccatcagtttcgctcagaaagccaagcgccagaacaacaccttcccattcttttctgaaggaatcacacggaaccgaactgcccaggagaaagtggcagccttggagcaacaggttctgatgctcaccaaggagttaaagtctcagaaggagctagtgaagatcctgcacaaggcactggaggccgcccagcaggagaagcgggcgtccagcgcatacctggcggcggctgaggacaaggaccggctggagctggtgcggcacaaagtgcggcagatcgcggagctgggccggcgggtggaggccctggagcaggagcgggagagcctggcgcacacagcgagcctgcgggagcagcaggtgcaggagctacagcagcacgtgcagctgcttatggacaagaaccacgccaagcagcaggtcatctgcaagctctctgagaaggtcacccaggacttcacgcacccccctgaccagtctcctttgcgccccgacgctgccaacagggacttcctgagccagcaggggaagatagagcacctgaaggatgacatggaagcttaccggacccagaactgcttcctcaactccgagatccaccaggtcacaaagatctggagaaaggtggctgagaaggagaaggcccttctgacgaagtgcgcctacctccaagccagaaactgccaggtggaaagcaagtacctggccggtctgagaaggctgcaggaggccctgggggacgaagccagcgagtgctcagagctgctgaggcagcttgtccaggaggcactgcagtgggaagctggggaggcctcatctgacagcatcgagctgagccccatcagtaagtatgatgagtacggcttcctgacggtgcccgactatgaggtggaagacctgaagctgctggccaagatccaggcattggagtcacgatcccaccacctgctgggcctcgaggctgtggatcggccgctgagggagcgctgggctgccctgggcgatcttgtgccctcagccgagctcaagcagctactgcgggcaggagtaccccgtgaacaccggcctcgtgtctggaggtggctggtccacctccgtgtccagcacctgcacactccaggctgctaccaggaactgctgagccggggccaggcccgcgagcaccctgctgcccgccagattgagctggacctgaaccggaccttccccaacaacaaacacttcacctgccccacctccagcttccccgacaagctccgccgggtgctgctggccttctcctggcagaaccccaccatcggctactgccagggcctgaacaggtaagccaccaaagcccagtgaaggtgtgatctttaccttttggagcgcaggtccccaaccctcagactgtggacaggcagccatctgtggcctgttaaggggccgca

SEQ ID NO: 427647 - DNA, 2201 bp, Homo sapiens
ctccctttgggaagctgcccgccgagtctccgagatttgtccctggtggtcccgcggacccctcgtccctccgcagtctccggctggcagcgatggagggcgctggggagaacgccccggagtccagctcctctgcccctgggtccgaagagtctgccagggatccacaggtgccgcctccggaggaagaatcgggggactgcgcccggtccctggaggcggtccccaagaaactctgtgggtatttaagtaagttcggcggcaaagggcccatccggggctggaaatcccgctggttcttctacgacgaaaggaaatgtcagctgtattactcgcggaccgctcaggatgccaatcccttggacagcatcgacctctccagtgcagtgtttgactgtaaggcggacgctgaggaggggatcttcgaaatcaagactcccagccgggttattaccctgaaggccgccaccaagcaagcgatgctgtactggctgcagcagctgcagatgaagcgctgggaattccacaacagcccgccggcacctcctgccacccctgatgccgccctggctgggaatgggcccgtcctgcacctcgagctagggcaagaagaggcagagctggaggagttcctgtgccctgtgaaaacaccccctgggctagtgggcgtggcagctgccttgcagcccttccctgcccttcagaatatttccctcaagcacctggggactgaaatacagaacacaatgcacaacatccgtggcaacaagcaggcccagggaacaggccatgaacctccaggggaagattctccacagagtggggagcctcagagggaggagcagcccttggcctctgacgccagcaccccagggagagagccagaggattctccaaagcctgcacccaagccttctctgaccatcagtttcgctcagaaagccaagcgccagaacaacaccttcccattcttttctgaaggaatcacacggaaccgaactgcccaggagaaagtggcagccttggagcaacaggttctgatgctcaccaaggagttaaagtctcagaaggagctagtgaagatcctgcacaaggcactggaggccgcccagcaggagaagcgggcgtccagcgcatacctggcggcggctgaggacaaggaccggctggagctggtgcggcacaaagtgcggcagatcgcggagctgggccggcgggtggaggccctggagcaggagcgggagagcctggcgcacacagcgagcctgcgggagcagcaggtgcaggagctacagcagcacgtgcagctgcttatggacaagaaccacgccaagcagcaggtcatctgcaagctctctgagaaggtcacccaggacttcacgcacccccctgaccagtctcctttgcgccccgacgctgccaacagggacttcctgagccagcaggggaagatagagcacctgaaggatgacatggaagcttaccggacccagaactgcttcctcaactccgagatccaccaggtcacaaagatctggagaaaggtggctgagaaggagaaggcccttctgacgaagtgcgcctacctccaagccagaaactgccaggtggaaagcaagtacctggccggtctgagaaggctgcaggaggccctgggggacgaagccagcgagtgctcagagctgctgaggcagcttgtccaggaggcactgcagtgggaagctggggaggcctcatctgacagcatcgagctgagccccatcagtaagtatgatgagtacggcttcctgacggtgcccgactatgaggtggaagacctgaagctgctggccaagatccaggcattggagtcacgatcccaccacctgctgggcctcgaggctgtggatcggccgctgagggagcgctgggctgccctgggcgatcttgtgccctcagccgagctcaagcagctactgcgggcaggagtaccccgtgaacaccggcctcgtgtctggaggtggctggtccacctccgtgtccagcacctgcacactccaggctgctaccaggaactgctgagccggggccaggcccgcgagcaccctgctgcccgccagattgagctggacctgaaccggaccttccccaacaacaaacacttagtctgcccacagcttcacctatagaaggatttcacgagaacaagtatacgtcctcta

SEQ ID NO: 427648 - DNA, 562 bp, Homo sapiens
ccgtttaggcattgtaggtgcatcagttaacaaaacggacaatacctccgcctcatggcatttatattccagctgcaggggtgggggttaaggaagtcaagcttgtattacttataagccacatagtgtgtggaagatgagaatgcgaaagagataggtaaaggagattgggagtgccatgcatggggaggcatcatgtagggtgcctggagtctgggagaccagtcaggatgacagggtgtggggatgagacctgagctccagcagtggtggcgggaaggacagaagggcagaaaggcagggttcagcctcatgctcctctgttcttgtctcctttcaggaacacaatgcacaacatccgtggcaacaagcaggcccagggaacaggccatgaacctccaggggaagattctccacagagtggggagcctcagagggaggagcagcccttggcctctgacgccagcaccccaggtgagcctctgtccagggctgagctgccttcagggaccagctcctcacggctggcacaagtgccttctttccttccagcgaaccagca

SEQ ID NO: 427649 - DNA, 3614 bp, Homo sapiens
cacgaggggcttccgggcccggacgccatttccagcggttgctggttctgacgggttgtagtctgccaggacaatgagttatgactaccatcagaactggggccgtgatgggggtccccgcagctccggtgggggctatggaggggggccagcagggggtcatggaggtaaccgaggctccggaggaggcggcggcggcggagggggtggtcgaggcggcaggggccggcatcccgggcacctgaaaggccgcgaaatcggcatgtggtacgcgaaaaaacaggggcagaagaacaaggaagcggagaggcaagagagagctgtagtacacatggatgaacgacgagaagaacaaattgtacagttactgaattctgttcaagcgaagaatgataaagagtcagaagcacagatatcctggtttgctcctgaggatcatggatacggtactgaagtttctactaagaacacaccatgctcagagaacaaacttgacatccaggaaaagaagttgataaatcaagaaaaaaaaatgtttagaatcaggaacagatcatatattgaccgagattctgagtatctcttgcaagaaaatgaaccagatggaactttagaccaaaaattattggaagatttacaaaagaaaaaaaatgaccttcggtatattgaaatgcagcatttcagagaaaagctgccttcgtatggaatgcaaaaggaattggtaaatttaattgataaccatcaggtaacagtaataagtggtgaaactggttgtggcaaaaccactcaagttactcagttcattttggataactacattgaaagaggaaaaggatctgcttgcagaatagtttgtactcagccaagaagaattagtgccatttcagttgcggaaagagtagctgcagaaagggcagaatcttgtggcagtggtaatagtactggatatcaaattcgtctccagagtcggttgccaaggaaacagggttctatcttatactgtacaacaggaatcatccttcagtggctccagtcagacccgtatttgtccagtgttagtcatatcgtacttgatgaaatccatgaaagaaatctgcagtcagatgttttaatgactgttgttaaagaccttctcaattttcgatctgacttgaaagtaatattgatgagtgcaacattgaatgcagaaaagttttcagaatattttggtaactgtccaatgatacatatacctggttttacctttccggttgtggaatatcttttggaagatgtaattgaaaaaataaggtatgttccagaacaaaaagaacacagatcccagtttaagaggggtttcatgcaagggcatgtaaatagacaagaaaaagaagaaaaagaagcaatatataaagaacgttggccagattatgtaagggaactgcgaagaaggtattctgcaagtactgtagatgttatagaaatgatggaggatgataaagttgatctgaatttgattgttgccctcatccgatacattgttttggaagaagaggatggtgcgatactggtctttctgccaggctgggacaatatcagcactttacatgatctcttgatgtcacaagtaatgtttaaatcagataaatttttaattatacctttacattcactgatgcctacagttaaccagacacaggtgtttaaaagaacccctcctggtgttcggaaaatagtaattgctaccaacattgcggagactagcattaccatagatgatgtcgtttatgtgatagatggaggaaaaataaaagagacgcattttgatactcagaacaatatcagtacaatgtccgctgagtgggttagtaaagctaatgccaaacagagaaaaggtcgagctggaagagttcaacctggtcattgctatcatctgtataatggtcttagagcaagtcttctagatgactatcaactgccagaaattttgagaactcctttggaagaactttgtttacaaataaagattttaaggctaggtggaattgcttattttctgagtagattaatggacccaccatcaaatgaggcagtgttactctccataagacacctgatggagctgaacgctttggataaacaagaagaattgacacctcttggagtccacttggcacgattacccgttgagccacatattggaaaaatgattctttttggagcactgttctgctgcttagacccagtactcactattgctgctagtctcagtttcaaagatccatttgtcattccactgggaaaagaaaagattgcagatgcaagaagaaaggaattggcaaaggatactagaagtgatcacttaacagttgtgaatgcgtttgagggctgggaagaggctaggcgacgtggtttcagatacgaaaaggactattgctgggaatattttctgtcttcaaacacactgcagatgctgcataacatgaaaggacagtttgctgagcatcttcttggagctggatttgtaagcagtagaaatcctaaagatccagaatctaatataaattcagataatgagaagataattaaagctgtcatctgtgctggtttatatcccaaagttgctaaaattcgactaaatttgggtaaaaaaagaaaaatggtaaaagtttacacaaaaaccgatggcctggttgctgttcatcctaaatctgttaatgtggagcaaacagactttcactacaactggcttatctatcacctaaagatgagaacaagcagtatatacttgtatgactgcacagaggtttccccatactgtctcttgttttttggaggtgacatttccatccagaaggataacgatcaggaaactattgctgtagatgagtggattgtatttcagtctccagcaagaattgcccatcttgttaaggaattaagaaaggaactagatattcttctgcaagagaagattgaaagtcctcatcctgtagactggaatgacactaaatccagagactgtgcagtactgtcagctattatagacttgatcaaaacacaggaaaaggcaactcccaggaactttccgccacgattccaggatggatattacagctgacagcttttcaggggtggtctgaaaagccagtttgacagccattcttcatcattgtttaaattttggctggatgccaaaccctgggacatgaacaattttcatgtgtaaggtagaagccttcagtaggtagtaaagacttaatgtgcatgacttgatgttatatgtagagatatatatatatatatatatataccataaaagcaatatgttctctgatcatatactctgctgtggtcatgcccactctttgggagtatattccctttatatatattgagtattgtaccacttgagaaattcctttgttctgttatacaaaattaatctttctgctcataatgattgatgataccaccagtaaaaataggatgtttaccccaaaacaagtgtcaattaagaatttgaacacaaccacattttttaaaatgaaacttctatcggaagtaaattaatttgttgtaataaagtccagtatttaataaaatgtacaatgttaaatctcaaaaaaaaaaaa

SEQ ID NO: 427650 - DNA, 3358 bp, Homo sapiens
tcgcgaacgtgttatccatgtgtactacagcagaagaacaaggaagcggagaggcaagagagagctgtagtacacatggatgaacgacgagaagaacaaattgtacagttactgaattctgttcaagcgaagaatgataaagagtcagaagcacagatatcctggtttgctcctgaggatcatggatacggtactgaagtttctactaagaacacaccatgctcagagaacaaacttgacatccaggaaaagaagttgataaatcaagaaaaaaaaatgtttagaatcaggaacagatcatatattgaccgagattctgagtatctcttgcaagaaaatgaaccagatggaactttagaccaaaaattattggaagatttacaaaagaaaaaaaatgaccttcggtatattgaaatgcagcatttcagagaaaagctgccttcgtatggaatgcaaaaggaattggtaaatttaattgataaccatcaggtaacagtaataagtggtgaaactggttgtggcaaaaccactcaagttactcagttcattttggataactacattgaaagaggaaaaggatctgcttgcagaatagtttgtactcagccaagaagaattagtgccatttcagttgcggaaagagtagctgcagaaagggcagaatcttgtggcagtggtaatagtactggatatcaaattcgtctccagagtcggttgccaaggaaacagggttctatcttatactgtacaacaggaatcatccttcagtggctccagtcagacccgtatttgtccagtgttagtcatatcgtacttgatgaaatccatgaaagaaatctgcagtcagatgttttaatgactgttgttaaagaccttctcaattttcgatctgacttgaaagtaatattgatgagtgcaacattgaatgcagaaaagttttcagaatattttggtaactgtccaatgatacatatacctggttttacctttccggttgtggaatatcttttggaagatgtaattgaaaaaataaggtatgttccagaacaaaaagaacacagatcccagtttaagaggggtttcatgcaagggcatgtaaatagacaagaaaaagaagaaaaagaagcaatatataaagaacgttggccagattatgtaagggaactgcgaagaaggtattctgcaagtactgtagatgttatagaaatgatggaggatgataaagttgatctgaatttgattgttgccctcatccgatacattgttttggaagaagaggatggtgcgatactggtctttctgccaggctgggacaatatcagcactttacatgatctcttgatgtcacaagtaatgtttaaatcagataaatttttaattatacctttacattcactgatgcctacagttaaccagacacaggtgtttaaaagaacccctcctggtgttcggaaaatagtaattgctaccaacattgcggagactagcattaccatagatgatgtcgtttatgtgatagatggaggaaaaataaaagagacgcattttgatactcagaacaatatcagtacaatgtccgctgagtgggttagtaaagctaatgccaaacagagaaaaggtcgagctggaagagttcaacctggtcattgctatcatctgtataatggtcttagagcaagtcttctagatgactatcaactgccagaaattttgagaactcctttggaagaactttgtttacaaataaagattttaaggctaggtggaattgcttattttctgagtagattaatggacccaccatcaaatgaggcagtgttactctccataagacacctgatggagctgaacgctttggataaacaagaagaattgacacctcttggagtccacttggcacgattacccgttgagccacatattggaaaaatgattctttttggagcactgttctgctgcttagacccagtactcactattgctgctagtctcagtttcaaagatccatttgtcattccactgggaaaagaaaagattgcagatgcaagaagaaaggaattggcaaaggatactagaagtgatcacttaacagttgtgaatgcgtttgagggctgggaagaggctaggcgacgtggtttcagatacgaaaaggactattgctgggaatattttctgtcttcaaacacactgcagatgctgcataacatgaaaggacagtttgctgagcatcttcttggagctggatttgtaagcagtagaaatcctaaagatccagaatctaatataaattcagataatgagaagataattaaagctgtcatctgtgctggtttatatcccaaagttgctaaaattcgactaaatttgggtaaaaaaagaaaaatggtaaaagtttacacaaaaaccgatggcctggttgctgttcatcctaaatctgttaatgtggagcaaacagactttcactacaactggcttatctatcacctaaagatgagaacaagcagtatatacttgtatgactgcacagaggtttccccatactgtctcttgttttttggaggtgacatttccatccagaaggataacgatcaggaaactattgctgtagatgagtggattgtatttcagtctccagcaagaattgcccatcttgttaaggaattaagaaaggaactagatattcttctgcaagagaagattgaaagtcctcatcctgtagactggaatgacactaaatccagagactgtgcagtactgtcagctattatagacttgatcaaaacacaggaaaaggcaactcccaggaactttccgccacgattccaggatggatattacagctgacagcttttcaggggtggtctgaaaagccagtttgacagccattcttcatcattgtttaaattttggctggatgccaaaccctgggacatgaacaattttcatgtgtaaggtagaagccttcagtaggtagtaaagacttaatgtgcatgacttgatgttatatgtagagatatatatatatatatatatataccataaaagcaatatgttctctgatcatatactctgctgtggtcatgcccactctttgggagtatattccctttatatatattgagtattgtaccacttgagaaattcctttgttctgttatacaaaattaatctttctgctcataatgattgatgataccaccagtaaaaataggatgtttaccccaaaacaagtgtcaattaagaatttgaacacaaccacattttttaaaatgaaacttctatcggaagtaaattaatttgttgtaataaagtccagtatttaataaaatgtacaatgttaaatctcaaaaaaaaaaaa

SEQ ID NO: 427651 - DNA, 3758 bp, Homo sapiens
cacgaggggcttccgggcccggacgccatttccagcggttgctggttctgacgggttgtagtctgccaggacaatgagttatgactaccatcagaactggggccgtgatgggggtccccgcagctccggtgggggctatggaggggggccagcagggggtcatggaggtaaccgaggctccggaggaggcggcggcggcggagggggtggtcgaggcggcaggggccggcatcccgggcacctgaaaggccgcgaaatcggcatgtggtacgcgaaaaaacaggggcagaagaacaaggaagcggagaggcaagagagagctgtagtacacatggatgaacgacgagaagaacaaattgtacagttactgaattctgttcaagcgaagaatgataaagagtcagaagcacagatatcctggtttgctcctgaggatcatggatacggtactgaagtttctactaagaacacaccatgctcagagaacaaacttgacatccaggaaaagaagttgataaatcaagaaaaaaaaatgtttagaatcaggaacagatcatatattgaccgagattctgagtatctcttgcaagaaaatgaaccagatggaactttagaccaaaaattattggaagatttacaaaagaaaaaaaatgaccttcggtatattgaaatgcagcatttcagagaaaagctgccttcgtatggaatgcaaaaggaattggtaaatttaattgataaccatcaggtaacagtaataagtggtgaaactggttgtggcaaaaccactcaagttactcagttcattttggataactacattgaaagaggaaaaggatctgcttgcagaatagtttgtactcagccaagaagaattagtgccatttcagttgcggaaagagtagctgcagaaagggcagaatcttgtggcagtggtaatagtactggatatcaaattcgtctccagagtcggttgccaaggaaacagggttctatcttatactgtacaacaggaatcatccttcagtggctccagtcagacccgtatttgtccagtgttagtcatatcgtacttgatgaaatccatgaaagaaatctgcagtcagatgttttaatgactgttgttaaagaccttctcaattttcgatctgacttgaaagtaatattgatgagtgcaacattgaatgcagaaaagttttcagaatattttggtaactgtccaatgatacatatacctggttttacctttccggttgtggaatatcttttggaagatgtaattgaaaaaataaggtatgttccagaacaaaaagaacacagatcccagtttaagaggggtttcatgcaagggcatgtaaatagacaagaaaaagaagaaaaagaagcaatatataaagaacgttggccagattatgtaagggaactgcgaagaaggtattctgcaagtactgtagatgttatagaaatgatggaggatgataaagttgatctgaatttgattgttgccctcatccgatacattgttttggaagaagaggatggtgcgatactggtctttctgccaggctgggacaatatcagcactttacatgatctcttgatgtcacaagtaatgtttaaatcagataaatttttaattatacctttacattcactgatgcctacagttaaccagacacaggtgtttaaaagaacccctcctggtgttcggaaaatagtaattgctaccaacattgcggagactagcattaccatagatgatgtcgtttatgtgatagatggaggaaaaataaaagagacgcattttgatactcagaacaatatcagtacaatgtccgctgagtgggttagtaaagctaatgccaaacagagaaaaggtcgagctggaagagttcaacctggtcattgctatcatctgtataatggtcttagagcaagtcttctagatgactatcaactgccagaaattttgagaactcctttggaagaactttgtttacaaataaagattttaaggctaggtggaattgcttattttctgagtagattaatggacccaccatcaaatgaggcagtgttactctccataagacacctgatggagctgaacgctttggataaacaagaagaattgacacctcttggagtccacttggcacgattacccgttgagccacatattggaaaaatgattctttttggagcactgttctgctgcttagacccagtactcactattgctgctagtctcagtttcaaagatccatttgtcattccactggtaagaaaaatggaaataaaaccgagttattttagatgtgaacaggagttgcttagatatatttttcattagcgttttattagaatgtcattctccattatagcatcagagcaatttaaattggctatgtctgctatttttaagggaaaagaaaagattgcagatgcaagaagaaaggaattggcaaaggatactagaagtgatcacttaacagttgtgaatgcgtttgagggctgggaagaggctaggcgacgtggtttcagatacgaaaaggactattgctgggaatattttctgtcttcaaacacactgcagatgctgcataacatgaaaggacagtttgctgagcatcttcttggagctggatttgtaagcagtagaaatcctaaagatccagaatctaatataaattcagataatgagaagataattaaagctgtcatctgtgctggtttatatcccaaagttgctaaaattcgactaaatttgggtaaaaaaagaaaaatggtaaaagtttacacaaaaaccgatggcctggttgctgttcatcctaaatctgttaatgtggagcaaacagactttcactacaactggcttatctatcacctaaagatgagaacaagcagtatatacttgtatgactgcacagaggtttccccatactgtctcttgttttttggaggtgacatttccatccagaaggataacgatcaggaaactattgctgtagatgagtggattgtatttcagtctccagcaagaattgcccatcttgttaaggaattaagaaaggaactagatattcttctgcaagagaagattgaaagtcctcatcctgtagactggaatgacactaaatccagagactgtgcagtactgtcagctattatagacttgatcaaaacacaggaaaaggcaactcccaggaactttccgccacgattccaggatggatattacagctgacagcttttcaggggtggtctgaaaagccagtttgacagccattcttcatcattgtttaaattttggctggatgccaaaccctgggacatgaacaattttcatgtgtaaggtagaagccttcagtaggtagtaaagacttaatgtgcatgacttgatgttatatgtagagatatatatatatatatatatataccataaaagcaatatgttctctgatcatatactctgctgtggtcatgcccactctttgggagtatattccctttatatatattgagtattgtaccacttgagaaattcctttgttctgttatacaaaattaatctttctgctcataatgattgatgataccaccagtaaaaataggatgtttaccccaaaacaagtgtcaattaagaatttgaacacaaccacattttttaaaatgaaacttctatcggaagtaaattaatttgttgtaataaagtccagtatttaataaaatgtacaatgttaaatctcaaaaaaaaaaaa

SEQ ID NO: 427652 - DNA, 3560 bp, Homo sapiens
cacgaggggcttccgggcccggacgccatttccagcggttgctggttctgacgggttgtagtctgccaggacaatgagttatgactaccatcagaactggggccgtgatgggggtccccgcagctccggtgggggctatggaggggggccagcagggggtcatggaggtaaccgaggctccggaggaggcggcggcggcggagggggtggtcgaggcggcaggggccggcatcccgggcacctgaaaggccgcgaaatcggcatgtggtacgcgaaaaaacaggggcagaagaacaaggaagcggagaggcaagagagagctgtagtacacatggatgaacgacgagaagaacaaattgtacagttactgaattctgttcaagcgaagaatgataaagagtcagaagcacagatatcctggtttgctcctgaggatcatggatacggtactgaagtttctactaagaacacaccatgctcagagaacaaacttgacatccaggaaaagaagttgataaatcaagaaaaaaaaatgtttagaatcaggaacagatcatatattgaccgagattctgagtatctcttgcaagaaaatgaaccagatggaactttagaccaaaaattattggaagatttacaaaagaaaaaaaatgaccttcggtatattgaaatgcagcatttcagagaaaagctgccttcgtatggaatgcaaaaggaattggtaaatttaattgataaccatcaggtaacagtaataagtggtgaaactggttgtggcaaaaccactcaagttactcagttcattttggataactacattgaaagaggaaaaggatctgcttgcagaatagtttgtactcagccaagaagaattagtgccatttcagttgcggaaagagtagctgcagaaagggcagaatcttgtggcagtggtaatagtactggatatcaaattcgtctccagagtcggttgccaaggaaacagggttctatcttatactgtacaacaggaatcatccttcagtggctccagtcagacccgtatttgtccagtgttagtcatatcgtacttgatgaaatccatgaaagaaatctgcagtcagatgttttaatgactgttgttaaagaccttctcaattttcgatctgacttgaaagtaatattgatgagtgcaacattgaatgcagaaaagttttcagaatattttggtaactgtccaatgatacatatacctggttttacctttccggttgtggaatatcttttggaagatgtaattgaaaaaataaggtatgttccagaacaaaaagaacacagatcccagtttaagaggggtttcatgcaagggcatgtaaatagacaagaaaaagaagaaaaagaagcaatatataaagaacgttggccagattatgtaagggaactgcgaagaaggtattctgcaagtactgtagatgttatagaaatgatggaggatgataaagttgatctgaatttgattgttgccctcatccgatacattgttttggaagaagaggatggtgcgatactggtctttctgccaggctgggacaatatcagcactttacatgatctcttgatgtcacaagtaatgtttaaatcagataaatttttaattatacctttacattcactgatgcctacagttaaccagacacaggtgtttaaaagaacccctcctggtgttcggaaaatagtaattgctaccaacattgcggagactagcattaccatagatgatgtcgtttatgtgatagatggaggaaaaataaaagagacgcattttgatactcagaacaatatcagtacaatgtccgctgagtgggttagtaaagctaatgccaaacagagtcttagagcaagtcttctagatgactatcaactgccagaaattttgagaactcctttggaagaactttgtttacaaataaagattttaaggctaggtggaattgcttattttctgagtagattaatggacccaccatcaaatgaggcagtgttactctccataagacacctgatggagctgaacgctttggataaacaagaagaattgacacctcttggagtccacttggcacgattacccgttgagccacatattggaaaaatgattctttttggagcactgttctgctgcttagacccagtactcactattgctgctagtctcagtttcaaagatccatttgtcattccactgggaaaagaaaagattgcagatgcaagaagaaaggaattggcaaaggatactagaagtgatcacttaacagttgtgaatgcgtttgagggctgggaagaggctaggcgacgtggtttcagatacgaaaaggactattgctgggaatattttctgtcttcaaacacactgcagatgctgcataacatgaaaggacagtttgctgagcatcttcttggagctggatttgtaagcagtagaaatcctaaagatccagaatctaatataaattcagataatgagaagataattaaagctgtcatctgtgctggtttatatcccaaagttgctaaaattcgactaaatttgggtaaaaaaagaaaaatggtaaaagtttacacaaaaaccgatggcctggttgctgttcatcctaaatctgttaatgtggagcaaacagactttcactacaactggcttatctatcacctaaagatgagaacaagcagtatatacttgtatgactgcacagaggtttccccatactgtctcttgttttttggaggtgacatttccatccagaaggataacgatcaggaaactattgctgtagatgagtggattgtatttcagtctccagcaagaattgcccatcttgttaaggaattaagaaaggaactagatattcttctgcaagagaagattgaaagtcctcatcctgtagactggaatgacactaaatccagagactgtgcagtactgtcagctattatagacttgatcaaaacacaggaaaaggcaactcccaggaactttccgccacgattccaggatggatattacagctgacagcttttcaggggtggtctgaaaagccagtttgacagccattcttcatcattgtttaaattttggctggatgccaaaccctgggacatgaacaattttcatgtgtaaggtagaagccttcagtaggtagtaaagacttaatgtgcatgacttgatgttatatgtagagatatatatatatatatatatataccataaaagcaatatgttctctgatcatatactctgctgtggtcatgcccactctttgggagtatattccctttatatatattgagtattgtaccacttgagaaattcctttgttctgttatacaaaattaatctttctgctcataatgattgatgataccaccagtaaaaataggatgtttaccccaaaacaagtgtcaattaagaatttgaacacaaccacattttttaaaatgaaacttctatcggaagtaaattaatttgttgtaataaagtccagtatttaataaaatgtacaatgttaaatctcaaaaaaaaaaaa

SEQ ID NO: 427653 - DNA, 3514 bp, Homo sapiens
cacgaggggcttccgggcccggacgccatttccagcggttgctggttctgacgggttgtagtctgccaggacaatgagttatgactaccatcagaactggggccgtgatgggggtccccgcagctccggtgggggctatggaggggggccagcagggggtcatggaggtaaccgaggctccggaggaggcggcggcggcggagggggtggtcgaggcggcaggggccggcatcccgggcacctgaaaggccgcgaaatcggcatgtggtacgcgaaaaaacaggggcagaagaacaaggaagcggagaggcaagagagagctgtagtacacatggatgaacgacgagaagaacaaattgtacagttactgaattctgttcaagcgaagaatgataaagagtcagaagcacagatatcctggtttgctcctgaggatcatggatacggtactgaagtttctactaagaacacaccatgctcagagaacaaacttgacatccaggaaaagaagttgataaatcaagaaaaaaaaatgtttagaatcaggaacagatcatatattgaccgagattctgagtatctcttgcaagaaaatgaaccagatggaactttagaccaaaaattattggaagatttacaaaagaaaaaaaatgaccttcggtatattgaaatgcagcatttcagagaaaagctgccttcgtatggaatgcaaaaggaattggtaaatttaattgataaccatcaggtaacagtaataagtggtgaaactggttgtggcaaaaccactcaagttactcagttcattttggataactacattgaaagaggaaaaggatctgcttgcagaatagtttgtactcagccaagaagaattagtgccatttcagttgcggaaagagtagctgcagaaagggcagaatcttgtggcagtggtaatagtactggatatcaaattcgtctccagagtcggttgccaaggaaacagggttctatcttatactgtacaacaggaatcatccttcagtggctccagtcagacccgtatttgtccagtgttagtcatatcgtacttgatgaaatccatgaaagaaatctgcagtcagatgttttaatgactgttgttaaagaccttctcaattttcgatctgacttgaaagtaatattgatgagtgcaacattgaatgcagaaaagttttcagaatattttggtaactgtccaatgatacatatacctggttttacctttccggttgtggaatatcttttggaagatgtaattgaaaaaataaggtatgttccagaacaaaaagaacacagatcccagtttaagaggggtttcatgcaagggcatgtaaatagacaagaaaaagaagaaaaagaagcaatatataaagaacgttggccagattatgtaagggaactgcgaagaaggtattctgcaagtactgtagatgttatagaaatgatggaggatgataaagttgatctgaatttgattgttgccctcatccgatacattgttttggaagaagaggatggtgcgatactggtctttctgccaggctgggacaatatcagcactttacatgatctcttgatgtcacaagtaatgtttaaatcagataaatttttaattatacctttacattcactgatgcctacagttaaccagacacaggtgtttaaaagaacccctcctggtgttcggaaaatagtaattgctaccaacattgcggagactagcattaccatagatgatgtcgtttatgtgatagatggaggaaaaataaaagagacgcattttgatactcagaacaatatcagtacaatgtccgctgagtgggttagtaaagctaatgccaaacagagaaaaggtcgagctggaagagttcaacctggtcattgctatcatctgtataatggtcttagagcaagtcttctagatgactatcaactgccagaaattttgagaactcctttggaagaactttgtttacaaataaagattttaaggctaggtggaattgcttattttctgagtagattaatggacccaccatcaaatgaggcagtgttactctccataagacacctgatggagctgaacgctttggataaacaagaagaattgacacctcttggagtccacttggcacgattacccgttgagccacatattggaaaaatgattctttttggagcactgttctgctgcttagacccagtactcactattgctgctagtctcagtttcaaagatccatttgtcattccactgggaaaagaaaagattgcagatgcaagaagaaaggaattggcaaaggatactagaagtgatcacttaacagttgtgaatgcgtttgagggctgggaagaggctaggcgacgtggtttcagatacgaaaaggactattgctgggaatattttctgtcttcaaacacactgcagataatgagaagataattaaagctgtcatctgtgctggtttatatcccaaagttgctaaaattcgactaaatttgggtaaaaaaagaaaaatggtaaaagtttacacaaaaaccgatggcctggttgctgttcatcctaaatctgttaatgtggagcaaacagactttcactacaactggcttatctatcacctaaagatgagaacaagcagtatatacttgtatgactgcacagaggtttccccatactgtctcttgttttttggaggtgacatttccatccagaaggataacgatcaggaaactattgctgtagatgagtggattgtatttcagtctccagcaagaattgcccatcttgttaaggaattaagaaaggaactagatattcttctgcaagagaagattgaaagtcctcatcctgtagactggaatgacactaaatccagagactgtgcagtactgtcagctattatagacttgatcaaaacacaggaaaaggcaactcccaggaactttccgccacgattccaggatggatattacagctgacagcttttcaggggtggtctgaaaagccagtttgacagccattcttcatcattgtttaaattttggctggatgccaaaccctgggacatgaacaattttcatgtgtaaggtagaagccttcagtaggtagtaaagacttaatgtgcatgacttgatgttatatgtagagatatatatatatatatatatataccataaaagcaatatgttctctgatcatatactctgctgtggtcatgcccactctttgggagtatattccctttatatatattgagtattgtaccacttgagaaattcctttgttctgttatacaaaattaatctttctgctcataatgattgatgataccaccagtaaaaataggatgtttaccccaaaacaagtgtcaattaagaatttgaacacaaccacattttttaaaatgaaacttctatcggaagtaaattaatttgttgtaataaagtccagtatttaataaaatgtacaatgttaaatctcaaaaaaaaaaaa

SEQ ID NO: 427654 - DNA, 1562 bp, Homo sapiens
ctttactcttacgaacacataagcgataacacaaggtaagtgggggtcgtcgaacgctttggataaacaagaagaattgacacctcttggagtccacttggcacgattacccgttgagccacatattggaaaaatgattctttttggagcactgttctgctgcttagacccagtactcactattgctgctagtctcagtttcaaagatccatttgtcattccactgggaaaagaaaagattgcagatgcaagaagaaaggaattggcaaaggatactagaagtgatcacttaacagttgtgaatgcgtttgagggctgggaagaggctaggcgacgtggtttcagatacgaaaaggactattgctgggaatattttctgtcttcaaacacactgcagatgctgcataacatgaaaggacagtttgctgagcatcttcttggagctggatttgtaagcagtagaaatcctaaagatccagaatctaatataaattcagataatgagaagataattaaagctgtcatctgtgctggtttatatcccaaagttgctaaaattcgactaaatttgggtaaaaaaagaaaaatggtaaaagtttacacaaaaaccgatggcctggttgctgttcatcctaaatctgttaatgtggagcaaacagactttcactacaactggcttatctatcacctaaagatgagaacaagcagtatatacttgtatgactgcacagaggtttccccatactgtctcttgttttttggaggtgacatttccatccagaaggataacgatcaggaaactattgctgtagatgagtggattgtatttcagtctccagcaagaattgcccatcttgttaaggaattaagaaaggaactagatattcttctgcaagagaagattgaaagtcctcatcctgtagactggaatgacactaaatccagagactgtgcagtactgtcagctattatagacttgatcaaaacacaggaaaaggcaactcccaggaactttccgccacgattccaggatggatattacagctgacagcttttcaggggtggtctgaaaagccagtttgacagccattcttcatcattgtttaaattttggctggatgccaaaccctgggacatgaacaattttcatgtgtaaggtagaagccttcagtaggtagtaaagacttaatgtgcatgacttgatgttatatgtagagatatatatatatatatatatataccataaaagcaatatgttctctgatcatatactctgctgtggtcatgcccactctttgggagtatattccctttatatatattgagtattgtaccacttgagaaattcctttgttctgttatacaaaattaatctttctgctcataatgattgatgataccaccagtaaaaataggatgtttaccccaaaacaagtgtcaattaagaatttgaacacaaccacattttttaaaatgaaacttctatcggaagtaaattaatttgttgtaataaagtccagtatttaataaaatgtacaatgttaaatctcaaaaaaaaaaaa

SEQ ID NO: 427655 - DNA, 2573 bp, Homo sapiens
  misc_feature (2367)..(2367): n is a, c, g, or t
  misc_feature (2377)..(2377): n is a, c, g, or t
  misc_feature (2379)..(2379): n is a, c, g, or t
  misc_feature (2385)..(2385): n is a, c, g, or t
cacgaggggcttccgggcccggacgccatttccagcggttgctggttctgacgggttgtagtctgccaggacaatgagttatgactaccatcagaactggggccgtgatgggggtccccgcagctccggtgggggctatggaggggggccagcagggggtcatggaggtaaccgaggctccggaggaggcggcggcggcggagggggtggtcgaggcggcaggggccggcatcccgggcacctgaaaggccgcgaaatcggcatgtggtacgcgaaaaaacaggggcagaagaacaaggaagcggagaggcaagagagagctgtagtacacatggatgaacgacgagaagaacaaattgtacagttactgaattctgttcaagcgaagaatgataaagagtcagaagcacagatatcctggtttgctcctgaggatcatggatacggtactgaagtttctactaagaacacaccatgctcagagaacaaacttgacatccaggaaaagaagttgataaatcaagaaaaaaaaatgtttagaatcaggaacagatcatatattgaccgagattctgagtatctcttgcaagaaaatgaaccagatggaactttagaccaaaaattattggaagatttacaaaagaaaaaaaatgaccttcggtatattgaaatgcagcatttcagagaaaagctgccttcgtatggaatgcaaaaggaattggtaaatttaattgataaccatcaggtaacagtaataagtggtgaaactggttgtggcaaaaccactcaagttactcagttcattttggataactacattgaaagaggaaaaggatctgcttgcagaatagtttgtactcagccaagaagaattagtgccatttcagttgcggaaagagtagctgcagaaagggcagaatcttgtggcagtggtaatagtactggatatcaaattcgtctccagagtcggttgccaaggaaacagggttctatcttatactgtacaacaggaatcatccttcagtggctccagtcagacccgtatttgtccagtgttagtcatatcgtacttgatgaaatccatgaaagaaatctgcagtcagatgttttaatgactgttgttaaagaccttctcaattttcgatctgacttgaaagtaatattgatgagtgcaacattgaatgcagaaaagttttcagaatattttggtaactgtccaatgatacatatacctggttttacctttccggttgtggaatatcttttggaagatgtaattgaaaaaataaggtatgttccagaacaaaaagaacacagatcccagtttaagaggggtttcatgcaagggcatgtaaatagacaagaaaaagaagaaaaagaagcaatatataaagaacgttggccagattatgtaagggaactgcgaagaaggtattctgcaagtactgtagatgttatagaaatgatggaggatgataaagttgatctgaatttgattgttgccctcatccgatacattgttttggaagaagaggatggtgcgatactggtctttctgccaggctgggacaatatcagcactttacatgatctcttgatgtcacaagtaatgtttaaatcagataaatttttaattatacctttacattcactgatgcctacagttaaccagacacaggtgtttaaaagaacccctcctggtgttcggaaaatagtaattgctaccaacattgcggagactagcattaccatagatgatgtcgtttatgtgatagatggaggaaaaataaaagagacgcattttgatactcagaacaatatcagtacaatgtccgctgagtgggttagtaaagctaatgccaaacagagaaaaggtcgagctggaagagttcaacctggtcattgctatcatctgtataatggtcttagagcaagtcttctagatgactatcaactgccagaaattttgagaactcctttggaagaactttgtttacaaataaagattttaaggctaggtggaattgcttattttctgagtagattaatggacccaccatcaaatgaggcagtgttactctccataagacacctgatggagctgaacgctttggataaacaagaagaattgacacctcttggagtccacttggcacgattacccgttgagccacatattggaaaaatgattctttttggagcactgttctgctgcttagacccagtactcactattgctgctagtctcagtttcaaagatccatttgtcattccactgggaaaagaaaagattgcagatgcaagaagaaaggaattggcaaaggatactagaagtgatcacttaacagttgtgaatgcgtttgaggnctgggaagangntaggcnacgtggtttaagacacggaaaggacgactgcagggcgcctactcgaggatgccgacacacacctagacactgcaaaacagaacaggacagcatgttcgagctcagagtggatggctcgtagagatacgtacaacaatgaggggaagctgaggagataccgcaatctcagcatgaatagaagcataatg

SEQ ID NO: 427656 - DNA, 320 bp, Homo sapiens
atacggtactgaagtttctactaagaacacaccatgctcagagaacaaacttgacatccaggaaaagaagttgataaatcaagaaaaaaaaatgtttagaatcaggaacagatcatatattgaccgagattctgagtatctcttgcaagaaaatgaaccagatggaactttagaccaaaaattattggaagatttacaaaagaaaaaaaatgaccttcggtatattgaaatgcaggtagtagaaagatgtcaaaaaatattttgtcatttttttcttacactttataaaaatgtatgtatggttagaggtagctgcatgg

SEQ ID NO: 427657 - DNA, 223 bp, Homo sapiens
gtagaaatcctaaagatccagaatctaatataaattcaggtacagcaggaaacacagtgtaaataagtatcttttgtctattgtatcagtattttacttttcttttcccctctaccttctcaccccccatagataatgagaagataattaaagctgtcatctgtgctggtttatatcccaaagttgctaaaattcgactaaatttgggtaaaaaaagaaaaat

SEQ ID NO: 427658 - DNA, 607 bp, Homo sapiens
cagaaactgcttgctcgtatatttattcatccattcattcaacaagcattccaggtacaatcctaggttctaaagatacagtcctaaataatatatatttttgttctcaaggagcttaattttatagtattttatgcattaccaaattattgtgggatttttgtttttacactaacaaaatacaacacgaataccctctgcccccccccgaatgaaatctttcttgtttcccagtgacagcagtactgtggtgcacctgctggaaggaaacctggtaaccttctcctcaggctcagatcccaccaccctttcatgaaacagttgctttggcctatttgataacctttccatttcatagacttaatatcacttgttttagatgagtactccgctttctgtaaaaggaaggataattttggaaatcattgaaggaatgtgctacttacatggaaaaggcgtgatacacaaggacctgaagcctgaaaatatccttgttgataatgacttccacattaaggtaaaccatcatcggtaggcttccagaaagttgggtgattttagttttaattctccaatgtaaatccattctcgtacattggagaagcta

SEQ ID NO: 427659 - DNA, 542 bp, Homo sapiens
  misc_feature (6)..(6): n is a, c, g, or t
ctcgtncaaattcggcagcggcccacgtaggccgctcagtgtccactggcattttgctaaaccgacaaggaaggctgtgtgcttagctctccccagagggagggcgagaagggtgtggtgatggtcaatctggctgtcggaacagattctggtgtcttgggctgataacagtgttgttgattctgattgtgaatcccctcaactctagcagacacatacacacccctgaaatggggctgcagagcaggctgtctcagccttgccactgtcggcatctcgggctgggtaattctgttgtggggactgtcctgttccttgtaggatgtttagtagcatccctgcccccacctactagatgccaggggcactgttctccccagccccccgccccagttgtgacaatagttctccccccgccctcgcccccccgcccccacccccccccccccccccaattgcccccccggttgaagaagcagcccctggctgttaaagttaaatgaaggccttccggcttctccctggtctagaaacaaatgtaa

SEQ ID NO: 427660 - DNA, 767 bp, Homo sapiens
ctggcatatgtgcctgtctttatgccagtcctacgctgttttgaatactgtagctttgtagtaagttttgaaatcaggaagtgtgagtcctacaaccttgttctttttaaagatcattttggctatttgggaaaaacattaattttaaaaaattactacttgtaagatctgtgtgaaatttctaccttctgaaaatatgaattcttctcgttaaaattttctgggactctatttcctgctgttcactaaagtgtgtatttatgctcttaattatagaaagagtattcaaacgaaaatgcagttgtgaagagaatgcagtctcttcaacttgattgtgtggcagtaccttcaagccggtcaaattcaggtaaattacactatggtcaaaatctattcatttatttgtttggttactcattcactccactctctaaaagactattcaggaccatatgggaaacagaagaaactataaaagtgaacacctgccttacaggaatttataataatattcgagagtcaagttacatgtatttgaaatatgaagtaacagtgtgctcaccagtcatagagtgttctgaacaaaaggcctaatatatctgatggggagaagtgacagttcagaagaaggaaggggacatatgtgagagcaaagtccctgaggagctcggagtgacttacagccagggtacaagcagagaggctggtctcaggtcaagtagggatacttttttcactgtaacaaaagggatggcagagtataggat

SEQ ID NO: 427661 - DNA, 3874 bp, Homo sapiens
atgcaaccagacatgtccttgaatgtcattaagatgaaatccagtgacttcctggagagtgcagaactggacagcggaggctttgggaaggtgtctctgtgtttccacagaacccagggactcatgatcatgaaaacagtgtacaaggggcccaactgcattgagcacaacgaggccctcttggaggaggcgaagatgatgaacagactgagacacagccgggtggtgaagctcctgggcgtcatcatagaggaagggaagtactccctggtgatggagtacatggagaagggcaacctgatgcacgtgctgaaagccgagatgagtactccgctttctgtaaaaggaaggataattttggaaatcattgaaggaatgtgctacttacatggaaaaggcgtgatacacaaggacctgaagcctgaaaatatccttgttgataatgacttccacattaagatcgcagacctcggccttgcctcctttaagatgtggagcaaactgaataatgaagagcacaatgagctgagggaagtggacggcaccgctaagaagaatggcggcaccctctactacatggcgcccgagcacctgaatgacgtcaacgcaaagcccacagagaagtcggatgtgtacagctttgctgtagtactctgggcgatatttgcaaataaggagccatatgaaaatgctatctgtgagcagcagttgataatgtgcataaaatctgggaacaggccagatgtggatgacatcactgagtactgcccaagagaaattatcagtctcatgaagctctgctgggaagcgaatccggaagctcggccgacatttcctggcattgaagaaaaatttaggcctttttatttaagtcaattagaagaaagtgtagaagaggacgtgaagagtttaaagaaagagtattcaaacgaaaatgcagttgtgaagagaatgcagtctcttcaacttgattgtgtggcagtaccttcaagccggtcaaattcagccacagaacagcctggttcactgcacagttcccagggacttgggatgggtcctgtggaggagtcctggtttgctccttccctggagcacccacaagaagagaatgagcccagcctgcagagtaaactccaagacgaagccaactaccatctttatggcagccgcatggacaggcagacgaaacagcagcccagacagaatgtggcttacaacagagaggaggaaaggagacgcagggtctcccatgacccttttgcacagcaaagaccttacgagaattttcagaatacagagggaaaaggcactgcttattccagtgcagccagtcatggtaatgcagtgcaccagccctcagggctcaccagccaacctcaagtactgtatcagaacaatggattatatagctcacatggctttggaacaagaccactggatccaggaacagcaggtcccagagtttggtacaggccaattccaagtcatatgcctagtctgcataatatcccagtgcctgagaccaactatctaggaaatacacccaccatgccattcagctccttgccaccaacagatgaatctataaaatataccatatacaatagtactggcattcagattggagcctacaattatatggagattggtgggacgagttcatcactactagacagcacaaatacgaacttcaaagaagagccagctgctaagtaccaagctatctttgataataccactagtctgacggataaacacctggacccaatcagggaaaatctgggaaagcactggaaaaactgtgcccgtaaactgggcttcacacagtctcagattgatgaaattgaccatgactatgagcgagatggactgaaagaaaaggtttaccagatgctccaaaagtgggtgatgagggaaggcataaagggagccacggtggggaagctggcccaggcgctccaccagtgttccaggatcgaccttctgagcagcttgatttacgtcagccagaactaaccctggatgggctacggcagctgaagtggacgcctcacttagtggataaccccagaaagttggctgcctcagagcattcagaattctgtcctcactgataggggttctgtgtctgcagaaattttgtttcctgtacttcatagctggagaatggggaaagaaatctgcagcaaaggggtctcactctgttgccaggctggtctcaaacttctggactcaagtgatcctcccgcctcggccttccaaagtgctgggatatcaggcactgagccactgcgcccagccaacaatccgctctgaggaaagcgtaagcaggaagacctcttaatggcatagcaccaataaaaaaatgactcctagttgtgtttggaaagggagagaagagatgtctgaggaaggtcatgttctttcagcttatggcatttcctagagttttgttgaagcaagaagaaaaactcagagaatataaaatcaacttttaaaattgtgtgctctcttcttcacgtaggctcctgttaaaaacaaagtgcagtcagattctaagccctgttcagagacttcgtggatcacagctgcagctcaccgccacatcacaggatccgttaacgttaatacccaatactctgtcagccactgtaggctctaagaaccacgtgcagtcttcagcccattaaattatcgattattttttaatgaattgaatttatattgagtcttcaaattaactgaatggatttaaaggggtaccaaggaggggggaaacatcagaatttcccaggcagttgttgcaaggaattggtactaaccgtgactacaacaaaaattcttgattgacttttaaagttatttcctggcattctggtaccttcacccagcctgagtgccctggagagggaacaggaaatgctgatctctacccctgggtgagaccagaacctcagggctgatactgttgagtggcttcctcggtttactctgtgtactgtgaaagtattttcatattttttctgtgtgccagagtgaaaaaggacagcttctgagtgtggtaattgtgcctctagcacccagcctttcaaagcccacctgaaacctgggggtggatgaaagaactagaatagaagactgaagctgggtaggccgctcagtgtccactggcattttgctaaaccgacaaggaaggctgtgtgcttagctctccccagagggagggcgagaagggtgtggtgatggtcaatctggctgtcggaacagattctggtgtcttgggctgataacagtgttgttgattctgattgtgaatcccctcaactctagcagacacatacacacccctgaaatggggctgcagagcaggctgtctcagccttgccactgtcggcatctcgggctgggtaattctgttgtggggactgtcctgttccttgtaggatgtttagtagcatccctgcccccacctactagatgccaggggcactgttctccccagccccccgccccagttgtgacaatagtctctaaacattgtcaaatggtccaaggaaaggggaaaattgccccggttgagaagagcactgctgtaaagtaatgagcctcggctctcctgtctgcacctgtccggttactacttggccaccacgcagccttggctcctacagcccaaaagggagaatggagggaggctccaggctttgctggaggggcctgggtgagttctgtttgctccttgtaccaccatccaaatggtgttatcaaatctcttagattccaaagaggttgaataattaatgttcaaaggcaagagggcaaggcattttttaacactttttaaaataaaaatttataccccaactttaggcta

SEQ ID NO: 427662 - DNA, 3335 bp, Homo sapiens
atgcaaccagacatgtccttgaatgtcattaagatgaaatccagtgacttcctggagagtgcagaactggacagcggaggctttgggaaggtgtctctgtgtttccacagaacccagggactcatgatcatgaaaacagtgtacaaggggcccaactgcattgagcacaacgaggccctcttggaggaggcgaagatgatgaacagactgagacacagccgggtggtgaagctcctgggcgtcatcatagaggaagggaagtactccctggtgatggagtacatggagaagggcaacctgatgcacgtgctgaaagccgagatgagtactccgctttctgtaaaaggaaggataattttggaaatcattgaaggaatgtgctacttacatggaaaaggcgtgatacacaaggacctgaagcctgaaaatatccttgttgataatgacttccacattaagatcgcagacctcggccttgcctcctttaagatgtggagcaaactgaataatgaagagcacaatgagctgagggaagtggacggcaccgctaagaagaatggcggcaccctctactacatggcgcccgagcacctgaatgacgtcaacgcaaagcccacagagaagtcggatgtgtacagctttgctgtagtactctgggcgatatttgcaaataaggagccatatgaaaatgctatctgtgagcagcagttgataatgtgcataaaatctgggaacaggccagatgtggatgacatcactgagtactgcccaagagaaattatcagtctcatgaagctctgctgggaagcgaatccggaagctcggccgacatttcctggcattgaagaaaaatttaggcctttttatttaagtcaattagaagaaagtgtagaagaggacgtgaagagtttaaagaaagagtattcaaacgaaaatgcagttgtgaagagaatgcagtctcttcaacttgattgtgtggcagtaccttcaagccggtcaaattcagccacagaacagcctggttcactgcacagttcccagggacttgggatgggtcctgtggaggagtcctggtttgctccttccctggagcacccacaagaagagaatgagcccagcctgcagagtaaactccaagacgaagccaactaccatctttatggcagccgcatggacaggcagacgaaacagcagcccagacagaatgtggcttacaacagagaggaggaaaggagacgcagggtctcccatgacccttttgcacagcaaagaccttacgagaattttcagaatacagagggaaaaggcactgcttattccagtgcagccagtcatggtaatgcagtgcaccagccctcagggctcaccagccaacctcaagtactgtatcagaacaatggattatatagctcacatggctttggaacaagaccactggatccaggaacagcaggtcccagagtttggtacaggccaattccaagtcatatgcctagtctgcataatatcccagtgcctgagaccaactatctaggaaatacacccaccatgccattcagctccttgccaccaacagatgaatctataaaatataccatatacaatagtactggcattcagattggagcctacaattatatggagattggtgggacgagttcatcactactagacagcacaaatacgaacttcaaagaagagccagctgctaagtaccaagctatctttgataataccactagtctgacggataaacacctggacccaatcagggaaaatctgggaaagcactggaaaaactgtgcccgtaaactgggcttcacacagtctcagattgatgaaattgaccatgactatgagcgagatggactgaaagaaaaggtttaccagatgctccaaaagtgggtgatgagggaaggcataaagggagccacggtggggaagctggcccaggcgctccaccagtgttccaggatcgaccttctgagcagcttgatttacgtcagccagaactaaccctggatgggctacggcagctgaagtggacgcctcacttagtggataaccccagaaagttggctgcctcagagcattcagaattctgtcctcactgataggggttctgtgtctgcagaaattttgtttcctgtacttcatagctggagaatggggaaagaaatctgcagcaaaggggtctcactctgttgccaggctggtctcaaacttctggactcaagtgatcctcccgcctcggccttccaaagtgctgggatatcaggcactgagccactgcgcccagccaacaatccgctctgaggaaagcgtaagcaggaagacctcttaatggcatagcaccaataaaaaaatgactcctagttgtgtttggaaagggagagaagagatgtctgaggaaggtcatgttctttcagcttatggcatttcctagagttttgttgaagcaagaagaaaaactcagagaatataaaatcaacttttaaaattgtgtgctctcttcttcacgtaggctcctgttaaaaacaaagtgcagtcagattctaagccctgttcagagacttcgtggatcacagctgcagctcaccgccacatcacaggatccgttaacgttaatacccaatactctgtcagccactgtaggctctaagaaccacgtgcagtcttcagcccattaaattatcgattattttttaatgaattgaatttatattgagtcttcaaattaactgaatggatttaaaggggtaccaaggaggggggaaacatcagaatttcccaggcagttgttgcaaggaattggtactaaccgtgactacaacaaaaattcttgattgacttttaaagttatttcctggcattctgttgtggggactgtcctgttccttgtaggatgtttagtagcatccctgcccccacctactagatgccaggggcactgttctccccagccccccgccccagttgtgacaatagtctctaaacattgtcaaatggtccaaggaaaggggaaaattgccccggttgagaagagcactgctgtaaagtaatgagcctcggctctcctgtctgcacctgtccggttactacttggccaccacgcagccttggctcctacagcccaaaagggagaatggagggaggctccaggctttgctggaggggcctgggtgagttctgtttgctccttgtaccaccatccaaatggtgttatcaaatctcttagattccaaagaggttgaataattaatgttcaaaggcaagagggcaaggcattttttaacactttttaaaataaaaatttataccccaactttaggcta

SEQ ID NO: 427663 - DNA, 3538 bp, Homo sapiens
atgcaaccagacatgtccttgaatgtcattaagatgaaatccagtgacttcctggagagtgcagaactggacagcggaggctttgggaaggtgtctctgtgtttccacagaacccagggactcatgatcatgaaaacagtgtacaaggggcccaactgcattgagcacaacgaggccctcttggaggaggcgaagatgatgaacagactgagacacagccgggtggtgaagctcctgggcgtcatcatagaggaagggaagtactccctggtgatggagtacatggagaagggcaacctgatgcacgtgctgaaagccgagatgagtactccgctttctgtaaaaggaaggataattttggaaatcattgaaggaatgtgctacttacatggaaaaggcgtgatacacaaggacctgaagcctgaaaatatccttgttgataatgacttccacattaagatcgcagacctcggccttgcctcctttaagatgtggagcaaactgaataatgaagagcacaatgagctgagggaagtggacggcaccgctaagaagaatggcggcaccctctactacatggcgcccgagcacctgaatgacgtcaacgcaaagcccacagagaagtcggatgtgtacagctttgctgtagtactctgggcgatatttgcaaataaggagccatatgaaaatgctatctgtgagcagcagttgataatgtgcataaaatctgggaacaggccagatgtggatgacatcactgagtactgcccaagagaaattatcagtctcatgaagctctgctgggaagcgaatccggaagctcggccgacatttcctggcattgaagaaaaatttaggcctttttatttaagtcaattagaagaaagtgtagaagaggacgtgaagagtttaaagaaagagtattcaaacgaaaatgcagttgtgaagagaatgcagtctcttcaacttgattgtgtggcagtaccttcaagccggtcaaattcagccacagaacagcctggttcactgcacagttcccagggacttgggatgggtcctgtggaggagtcctggtttgctccttccctggagcacccacaagaagagaatgagcccagcctgcagagtaaactccaagacgaagccaactaccatctttatggcagccgcatggacaggcagacgaaacagcagcccagacagaatgtggcttacaacagagaggaggaaaggagacgcagggtctcccatgacccttttgcacagcaaagaccttacgagaattttcagaatacagagggaaaaggcactgcttattccagtgcagccagtcatggtaatgcagtgcaccagccctcagggctcaccagccaacctcaagtactgtatcagaacaatggattatatagctcacatggctttggaacaagaccactggatccaggaacagcaggtcccagagtttggtacaggccaattccaagtcatatgcctagtctgcataatatcccagtgcctgagaccaactatctaggaaatacacccaccatgccattcagctccttgccaccaacagatgaatctataaaatataccatatacaatagtactggcattcagattggagcctacaattatatggagattggtgggacgagttcatcactactagacagcacaaatacgaacttcaaagaagagccagctgctaagtaccaagctatctttgataataccactagtctgacggataaacacctggacccaatcagggaaaatctgggaaagcactggaaaaactgtgcccgtaaactgggcttcacacagtctcagattgatgaaattgaccatgactatgagcgagatggactgaaagaaaaggtttaccagatgctccaaaagtgggtgatgagggaaggcataaagggagccacggtggggaagctggcccaggcgctccaccagtgttccaggatcgaccttctgagcagcttgatttacgtcagccagaactaaccctggatgggctacggcagctgaagtggacgcctcacttagtggataaccccagaaagttggctgcctcagagcattcagaattctgtcctcactgataggggttctgtgtctgcagaaattttgtttcctgtacttcatagctggagaatggggaaagaaatctgcagcaaaggggtctcactctgttgccaggctggtctcaaacttctggactcaagtgatcctcccgcctcggccttccaaagtgctgggatatcaggcactgagccactgcgcccagccaacaatccgctctgaggaaagcgtaagcaggaagacctcttaatggcatagcaccaataaaaaaatgactcctagttgtgtttggaaagggagagaagagatgtctgaggaaggtcatgttctttcagcttatggcatttcctagagttttgttgaagcaagaagaaaaactcagagaatataaaatcaacttttaaaattgtgtgctctcttcttcacgtaggctcctgttaaaaacaaagtgcagtcagattctaagccctgttcagagacttcgtggatcacagctgcagctcaccgccacatcacaggatccgttaacgttaatacccaatactctgtcagccactgtaggctctaagaaccacgtgcagtcttcagcccattaaattatcgattattttttaatgaattgaatttatattgagtcttcaaattaactgaatggatttaaaggggtaccaaggaggggggaaacatcagaatttcccaggcagttgttgcaaggaattggtactaaccgtgactacaacaaaaattcttgattgacttttaaagttatttcctggcattctggtaccttcacccagcctgagtgccctggagagggaacaggaaatgctgatctctacccctgggtgagaccagaacctcagggctgatactgttgagtggcttcctcggtttactctgtgtactgtgaaagtattttcatattttttctgtgtgccagagtgaaaaaggacagcttctgagtgtggtaattgtgcctctagcacccagcctttcaaagcccacctgaaacctgggggtggatgaaagaactagaatagaagactgaagctgggggcactgttctccccagccccccgccccagttgtgacaatagtctctaaacattgtcaaatggtccaaggaaaggggaaaattgccccggttgagaagagcactgctgtaaagtaatgagcctcggctctcctgtctgcacctgtccggttactacttggccaccacgcagccttggctcctacagcccaaaagggagaatggagggaggctccaggctttgctggaggggcctgggtgagttctgtttgctccttgtaccaccatccaaatggtgttatcaaatctcttagattccaaagaggttgaataattaatgttcaaaggcaagagggcaaggcattttttaacactttttaaaataaaaatttataccccaactttaggcta

SEQ ID NO: 427664 - DNA, 3914 bp, Homo sapiens
cccggctagtcccggcaggcggagccccagttagactgctcgtcaagtgtgggaaaagctccgtggcgtcacaagctactatataaaaggcggtgcccgccggggccgagtgggagtccgcggcgagcgcagcagcagggcccggtcctgcgcctcgggagtcggcgtccaggctcggagcgcgacacggagactaggtggcaggcacaacgaggccctcttggaggaggcgaagatgatgaacagactgagacacagccgggtggtgaagctcctgggcgtcatcatagaggaagggaagtactccctggtgatggagtacatggagaagggcaacctgatgcacgtgctgaaagccgagatgagtactccgctttctgtaaaaggaaggataattttggaaatcattgaaggaatgtgctacttacatggaaaaggcgtgatacacaaggacctgaagcctgaaaatatccttgttgataatgacttccacattaagatcgcagacctcggccttgcctcctttaagatgtggagcaaactgaataatgaagagcacaatgagctgagggaagtggacggcaccgctaagaagaatggcggcaccctctactacatggcgcccgagcacctgaatgacgtcaacgcaaagcccacagagaagtcggatgtgtacagctttgctgtagtactctgggcgatatttgcaaataaggagccatatgaaaatgctatctgtgagcagcagttgataatgtgcataaaatctgggaacaggccagatgtggatgacatcactgagtactgcccaagagaaattatcagtctcatgaagctctgctgggaagcgaatccggaagctcggccgacatttcctggcattgaagaaaaatttaggcctttttatttaagtcaattagaagaaagtgtagaagaggacgtgaagagtttaaagaaagagtattcaaacgaaaatgcagttgtgaagagaatgcagtctcttcaacttgattgtgtggcagtaccttcaagccggtcaaattcagccacagaacagcctggttcactgcacagttcccagggacttgggatgggtcctgtggaggagtcctggtttgctccttccctggagcacccacaagaagagaatgagcccagcctgcagagtaaactccaagacgaagccaactaccatctttatggcagccgcatggacaggcagacgaaacagcagcccagacagaatgtggcttacaacagagaggaggaaaggagacgcagggtctcccatgacccttttgcacagcaaagaccttacgagaattttcagaatacagagggaaaaggcactgcttattccagtgcagccagtcatggtaatgcagtgcaccagccctcagggctcaccagccaacctcaagtactgtatcagaacaatggattatatagctcacatggctttggaacaagaccactggatccaggaacagcaggtcccagagtttggtacaggccaattccaagtcatatgcctagtctgcataatatcccagtgcctgagaccaactatctaggaaatacacccaccatgccattcagctccttgccaccaacagatgaatctataaaatataccatatacaatagtactggcattcagattggagcctacaattatatggagattggtgggacgagttcatcactactagacagcacaaatacgaacttcaaagaagagccagctgctaagtaccaagctatctttgataataccactagtctgacggataaacacctggacccaatcagggaaaatctgggaaagcactggaaaaactgtgcccgtaaactgggcttcacacagtctcagattgatgaaattgaccatgactatgagcgagatggactgaaagaaaaggtttaccagatgctccaaaagtgggtgatgagggaaggcataaagggagccacggtggggaagctggcccaggcgctccaccagtgttccaggatcgaccttctgagcagcttgatttacgtcagccagaactaaccctggatgggctacggcagctgaagtggacgcctcacttagtggataaccccagaaagttggctgcctcagagcattcagaattctgtcctcactgataggggttctgtgtctgcagaaattttgtttcctgtacttcatagctggagaatggggaaagaaatctgcagcaaaggggtctcactctgttgccaggctggtctcaaacttctggactcaagtgatcctcccgcctcggccttccaaagtgctgggatatcaggcactgagccactgcgcccagccaacaatccgctctgaggaaagcgtaagcaggaagacctcttaatggcatagcaccaataaaaaaatgactcctagttgtgtttggaaagggagagaagagatgtctgaggaaggtcatgttctttcagcttatggcatttcctagagttttgttgaagcaagaagaaaaactcagagaatataaaatcaacttttaaaattgtgtgctctcttcttcacgtaggctcctgttaaaaacaaagtgcagtcagattctaagccctgttcagagacttcgtggatcacagctgcagctcaccgccacatcacaggatccgttaacgttaatacccaatactctgtcagccactgtaggctctaagaaccacgtgcagtcttcagcccattaaattatcgattattttttaatgaattgaatttatattgagtcttcaaattaactgaatggatttaaaggggtaccaaggaggggggaaacatcagaatttcccaggcagttgttgcaaggaattggtactaaccgtgactacaacaaaaattcttgattgacttttaaagttatttcctggcattctggtaccttcacccagcctgagtgccctggagagggaacaggaaatgctgatctctacccctgggtgagaccagaacctcagggctgatactgttgagtggcttcctcggtttactctgtgtactgtgaaagtattttcatattttttctgtgtgccagagtgaaaaaggacagcttctgagtgtggtaattgtgcctctagcacccagcctttcaaagcccacctgaaacctgggggtggatgaaagaactagaatagaagactgaagctgggtaggccgctcagtgtccactggcattttgctaaaccgacaaggaaggctgtgtgcttagctctccccagagggagggcgagaagggtgtggtgatggtcaatctggctgtcggaacagattctggtgtcttgggctgataacagtgttgttgattctgattgtgaatcccctcaactctagcagacacatacacacccctgaaatggggctgcagagcaggctgtctcagccttgccactgtcggcatctcgggctgggtaattctgttgtggggactgtcctgttccttgtaggatgtttagtagcatccctgcccccacctactagatgccaggggcactgttctccccagccccccgccccagttgtgacaatagtctctaaacattgtcaaatggtccaaggaaaggggaaaattgccccggttgagaagagcactgctgtaaagtaatgagcctcggctctcctgtctgcacctgtccggttactacttggccaccacgcagccttggctcctacagcccaaaagggagaatggagggaggctccaggctttgctggaggggcctgggtgagttctgtttgctccttgtaccaccatccaaatggtgttatcaaatctcttagattccaaagaggttgaataattaatgttcaaaggcaagagggcaaggcattttttaacactttttaaaataaaaatttataccccaactttaggcta

SEQ ID NO: 427665 - DNA, 3932 bp, Homo sapiens
cagaaactgcttgctcgtatatttattcatccattcattcaacaagcattccaggtacaatcctaggttctaaagatacagtcctaaataatatatatttttgttctcaaggagcttaattttatagtattttatgcattaccaaattattgtgggatttttgtttttacactaacaaaatacaacacgaataccctctgcccccccccgaatgaaatctttcttgtttcccagtgacagcagtactgtggtgcacctgctggaaggaaacctggtaaccttctcctcaggctcagatcccaccaccctttcatgaaacagttgctttggcctatttgataacctttccatttcatagacttaatatcacttgttttagatgagtactccgctttctgtaaaaggaaggataattttggaaatcattgaaggaatgtgctacttacatggaaaaggcgtgatacacaaggacctgaagcctgaaaatatccttgttgataatgacttccacattaagatcgcagacctcggccttgcctcctttaagatgtggagcaaactgaataatgaagagcacaatgagctgagggaagtggacggcaccgctaagaagaatggcggcaccctctactacatggcgcccgagcacctgaatgacgtcaacgcaaagcccacagagaagtcggatgtgtacagctttgctgtagtactctgggcgatatttgcaaataaggagccatatgaaaatgctatctgtgagcagcagttgataatgtgcataaaatctgggaacaggccagatgtggatgacatcactgagtactgcccaagagaaattatcagtctcatgaagctctgctgggaagcgaatccggaagctcggccgacatttcctggcattgaagaaaaatttaggcctttttatttaagtcaattagaagaaagtgtagaagaggacgtgaagagtttaaagaaagagtattcaaacgaaaatgcagttgtgaagagaatgcagtctcttcaacttgattgtgtggcagtaccttcaagccggtcaaattcagccacagaacagcctggttcactgcacagttcccagggacttgggatgggtcctgtggaggagtcctggtttgctccttccctggagcacccacaagaagagaatgagcccagcctgcagagtaaactccaagacgaagccaactaccatctttatggcagccgcatggacaggcagacgaaacagcagcccagacagaatgtggcttacaacagagaggaggaaaggagacgcagggtctcccatgacccttttgcacagcaaagaccttacgagaattttcagaatacagagggaaaaggcactgcttattccagtgcagccagtcatggtaatgcagtgcaccagccctcagggctcaccagccaacctcaagtactgtatcagaacaatggattatatagctcacatggctttggaacaagaccactggatccaggaacagcaggtcccagagtttggtacaggccaattccaagtcatatgcctagtctgcataatatcccagtgcctgagaccaactatctaggaaatacacccaccatgccattcagctccttgccaccaacagatgaatctataaaatataccatatacaatagtactggcattcagattggagcctacaattatatggagattggtgggacgagttcatcactactagacagcacaaatacgaacttcaaagaagagccagctgctaagtaccaagctatctttgataataccactagtctgacggataaacacctggacccaatcagggaaaatctgggaaagcactggaaaaactgtgcccgtaaactgggcttcacacagtctcagattgatgaaattgaccatgactatgagcgagatggactgaaagaaaaggtttaccagatgctccaaaagtgggtgatgagggaaggcataaagggagccacggtggggaagctggcccaggcgctccaccagtgttccaggatcgaccttctgagcagcttgatttacgtcagccagaactaaccctggatgggctacggcagctgaagtggacgcctcacttagtggataaccccagaaagttggctgcctcagagcattcagaattctgtcctcactgataggggttctgtgtctgcagaaattttgtttcctgtacttcatagctggagaatggggaaagaaatctgcagcaaaggggtctcactctgttgccaggctggtctcaaacttctggactcaagtgatcctcccgcctcggccttccaaagtgctgggatatcaggcactgagccactgcgcccagccaacaatccgctctgaggaaagcgtaagcaggaagacctcttaatggcatagcaccaataaaaaaatgactcctagttgtgtttggaaagggagagaagagatgtctgaggaaggtcatgttctttcagcttatggcatttcctagagttttgttgaagcaagaagaaaaactcagagaatataaaatcaacttttaaaattgtgtgctctcttcttcacgtaggctcctgttaaaaacaaagtgcagtcagattctaagccctgttcagagacttcgtggatcacagctgcagctcaccgccacatcacaggatccgttaacgttaatacccaatactctgtcagccactgtaggctctaagaaccacgtgcagtcttcagcccattaaattatcgattattttttaatgaattgaatttatattgagtcttcaaattaactgaatggatttaaaggggtaccaaggaggggggaaacatcagaatttcccaggcagttgttgcaaggaattggtactaaccgtgactacaacaaaaattcttgattgacttttaaagttatttcctggcattctggtaccttcacccagcctgagtgccctggagagggaacaggaaatgctgatctctacccctgggtgagaccagaacctcagggctgatactgttgagtggcttcctcggtttactctgtgtactgtgaaagtattttcatattttttctgtgtgccagagtgaaaaaggacagcttctgagtgtggtaattgtgcctctagcacccagcctttcaaagcccacctgaaacctgggggtggatgaaagaactagaatagaagactgaagctgggtaggccgctcagtgtccactggcattttgctaaaccgacaaggaaggctgtgtgcttagctctccccagagggagggcgagaagggtgtggtgatggtcaatctggctgtcggaacagattctggtgtcttgggctgataacagtgttgttgattctgattgtgaatcccctcaactctagcagacacatacacacccctgaaatggggctgcagagcaggctgtctcagccttgccactgtcggcatctcgggctgggtaattctgttgtggggactgtcctgttccttgtaggatgtttagtagcatccctgcccccacctactagatgccaggggcactgttctccccagccccccgccccagttgtgacaatagtctctaaacattgtcaaatggtccaaggaaaggggaaaattgccccggttgagaagagcactgctgtaaagtaatgagcctcggctctcctgtctgcacctgtccggttactacttggccaccacgcagccttggctcctacagcccaaaagggagaatggagggaggctccaggctttgctggaggggcctgggtgagttctgtttgctccttgtaccaccatccaaatggtgttatcaaatctcttagattccaaagaggttgaataattaatgttcaaaggcaagagggcaaggcattttttaacactttttaaaataaaaatttataccccaactttaggcta

SEQ ID NO: 427666 - DNA, 3187 bp, Homo sapiens
cccggctagtcccggcaggcggagccccagttagactgctcgtcaagtgtgggaaaagctccgtggcgtcacaagctactatataaaaggcggtgcccgccggggccgagtgggagtccgcggcgagcgcagcagcagggcccggtcctgcgcctcgggagtcggcgtccaggctcggagcgcgacacggagactaggtggcagggtacagctctgccggggggggaaaaagtggtaccattttgggcgttcttgagcttcagaatgcagtctcttcaacttgattgtgtggcagtaccttcaagccggtcaaattcagccacagaacagcctggttcactgcacagttcccagggacttgggatgggtcctgtggaggagtcctggtttgctccttccctggagcacccacaagaagagaatgagcccagcctgcagagtaaactccaagacgaagccaactaccatctttatggcagccgcatggacaggcagacgaaacagcagcccagacagaatgtggcttacaacagagaggaggaaaggagacgcagggtctcccatgacccttttgcacagcaaagaccttacgagaattttcagaatacagagggaaaaggcactgcttattccagtgcagccagtcatggtaatgcagtgcaccagccctcagggctcaccagccaacctcaagtactgtatcagaacaatggattatatagctcacatggctttggaacaagaccactggatccaggaacagcaggtcccagagtttggtacaggccaattccaagtcatatgcctagtctgcataatatcccagtgcctgagaccaactatctaggaaatacacccaccatgccattcagctccttgccaccaacagatgaatctataaaatataccatatacaatagtactggcattcagattggagcctacaattatatggagattggtgggacgagttcatcactactagacagcacaaatacgaacttcaaagaagagccagctgctaagtaccaagctatctttgataataccactagtctgacggataaacacctggacccaatcagggaaaatctgggaaagcactggaaaaactgtgcccgtaaactgggcttcacacagtctcagattgatgaaattgaccatgactatgagcgagatggactgaaagaaaaggtttaccagatgctccaaaagtgggtgatgagggaaggcataaagggagccacggtggggaagctggcccaggcgctccaccagtgttccaggatcgaccttctgagcagcttgatttacgtcagccagaactaaccctggatgggctacggcagctgaagtggacgcctcacttagtggataaccccagaaagttggctgcctcagagcattcagaattctgtcctcactgataggggttctgtgtctgcagaaattttgtttcctgtacttcatagctggagaatggggaaagaaatctgcagcaaaggggtctcactctgttgccaggctggtctcaaacttctggactcaagtgatcctcccgcctcggccttccaaagtgctgggatatcaggcactgagccactgcgcccagccaacaatccgctctgaggaaagcgtaagcaggaagacctcttaatggcatagcaccaataaaaaaatgactcctagttgtgtttggaaagggagagaagagatgtctgaggaaggtcatgttctttcagcttatggcatttcctagagttttgttgaagcaagaagaaaaactcagagaatataaaatcaacttttaaaattgtgtgctctcttcttcacgtaggctcctgttaaaaacaaagtgcagtcagattctaagccctgttcagagacttcgtggatcacagctgcagctcaccgccacatcacaggatccgttaacgttaatacccaatactctgtcagccactgtaggctctaagaaccacgtgcagtcttcagcccattaaattatcgattattttttaatgaattgaatttatattgagtcttcaaattaactgaatggatttaaaggggtaccaaggaggggggaaacatcagaatttcccaggcagttgttgcaaggaattggtactaaccgtgactacaacaaaaattcttgattgacttttaaagttatttcctggcattctggtaccttcacccagcctgagtgccctggagagggaacaggaaatgctgatctctacccctgggtgagaccagaacctcagggctgatactgttgagtggcttcctcggtttactctgtgtactgtgaaagtattttcatattttttctgtgtgccagagtgaaaaaggacagcttctgagtgtggtaattgtgcctctagcacccagcctttcaaagcccacctgaaacctgggggtggatgaaagaactagaatagaagactgaagctgggtaggccgctcagtgtccactggcattttgctaaaccgacaaggaaggctgtgtgcttagctctccccagagggagggcgagaagggtgtggtgatggtcaatctggctgtcggaacagattctggtgtcttgggctgataacagtgttgttgattctgattgtgaatcccctcaactctagcagacacatacacacccctgaaatggggctgcagagcaggctgtctcagccttgccactgtcggcatctcgggctgggtaattctgttgtggggactgtcctgttccttgtaggatgtttagtagcatccctgcccccacctactagatgccaggggcactgttctccccagccccccgccccagttgtgacaatagtctctaaacattgtcaaatggtccaaggaaaggggaaaattgccccggttgagaagagcactgctgtaaagtaatgagcctcggctctcctgtctgcacctgtccggttactacttggccaccacgcagccttggctcctacagcccaaaagggagaatggagggaggctccaggctttgctggaggggcctgggtgagttctgtttgctccttgtaccaccatccaaatggtgttatcaaatctcttagattccaaagaggttgaataattaatgttcaaaggcaagagggcaaggcattttttaacactttttaaaataaaaatttataccccaactttaggcta

SEQ ID NO: 427667 - DNA, 3081 bp, Homo sapiens
aattttcctagtactctcttactgccagcgaggagctcctattattatttgtaaagcttgtgggaagaggaccatctcctaaatgctttggactggtctcgtacttgttttctgtgtgttactttgagatacagattcatgacggcgctcagattttattttactttttaatgtttcatgacacccattctaatgttgatcatttcttctcagccacagaacagcctggttcactgcacagttcccagggacttgggatgggtcctgtggaggagtcctggtttgctccttccctggagcacccacaagaagagaatgagcccagcctgcagagtaaactccaagacgaagccaactaccatctttatggcagccgcatggacaggcagacgaaacagcagcccagacagaatgtggcttacaacagagaggaggaaaggagacgcagggtctcccatgacccttttgcacagcaaagaccttacgagaattttcagaatacagagggaaaaggcactgcttattccagtgcagccagtcatggtaatgcagtgcaccagccctcagggctcaccagccaacctcaagtactgtatcagaacaatggattatatagctcacatggctttggaacaagaccactggatccaggaacagcaggtcccagagtttggtacaggccaattccaagtcatatgcctagtctgcataatatcccagtgcctgagaccaactatctaggaaatacacccaccatgccattcagctccttgccaccaacagatgaatctataaaatataccatatacaatagtactggcattcagattggagcctacaattatatggagattggtgggacgagttcatcactactagacagcacaaatacgaacttcaaagaagagccagctgctaagtaccaagctatctttgataataccactagtctgacggataaacacctggacccaatcagggaaaatctgggaaagcactggaaaaactgtgcccgtaaactgggcttcacacagtctcagattgatgaaattgaccatgactatgagcgagatggactgaaagaaaaggtttaccagatgctccaaaagtgggtgatgagggaaggcataaagggagccacggtggggaagctggcccaggcgctccaccagtgttccaggatcgaccttctgagcagcttgatttacgtcagccagaactaaccctggatgggctacggcagctgaagtggacgcctcacttagtggataaccccagaaagttggctgcctcagagcattcagaattctgtcctcactgataggggttctgtgtctgcagaaattttgtttcctgtacttcatagctggagaatggggaaagaaatctgcagcaaaggggtctcactctgttgccaggctggtctcaaacttctggactcaagtgatcctcccgcctcggccttccaaagtgctgggatatcaggcactgagccactgcgcccagccaacaatccgctctgaggaaagcgtaagcaggaagacctcttaatggcatagcaccaataaaaaaatgactcctagttgtgtttggaaagggagagaagagatgtctgaggaaggtcatgttctttcagcttatggcatttcctagagttttgttgaagcaagaagaaaaactcagagaatataaaatcaacttttaaaattgtgtgctctcttcttcacgtaggctcctgttaaaaacaaagtgcagtcagattctaagccctgttcagagacttcgtggatcacagctgcagctcaccgccacatcacaggatccgttaacgttaatacccaatactctgtcagccactgtaggctctaagaaccacgtgcagtcttcagcccattaaattatcgattattttttaatgaattgaatttatattgagtcttcaaattaactgaatggatttaaaggggtaccaaggaggggggaaacatcagaatttcccaggcagttgttgcaaggaattggtactaaccgtgactacaacaaaaattcttgattgacttttaaagttatttcctggcattctggtaccttcacccagcctgagtgccctggagagggaacaggaaatgctgatctctacccctgggtgagaccagaacctcagggctgatactgttgagtggcttcctcggtttactctgtgtactgtgaaagtattttcatattttttctgtgtgccagagtgaaaaaggacagcttctgagtgtggtaattgtgcctctagcacccagcctttcaaagcccacctgaaacctgggggtggatgaaagaactagaatagaagactgaagctgggtaggccgctcagtgtccactggcattttgctaaaccgacaaggaaggctgtgtgcttagctctccccagagggagggcgagaagggtgtggtgatggtcaatctggctgtcggaacagattctggtgtcttgggctgataacagtgttgttgattctgattgtgaatcccctcaactctagcagacacatacacacccctgaaatggggctgcagagcaggctgtctcagccttgccactgtcggcatctcgggctgggtaattctgttgtggggactgtcctgttccttgtaggatgtttagtagcatccctgcccccacctactagatgccaggggcactgttctccccagccccccgccccagttgtgacaatagtctctaaacattgtcaaatggtccaaggaaaggggaaaattgccccggttgagaagagcactgctgtaaagtaatgagcctcggctctcctgtctgcacctgtccggttactacttggccaccacgcagccttggctcctacagcccaaaagggagaatggagggaggctccaggctttgctggaggggcctgggtgagttctgtttgctccttgtaccaccatccaaatggtgttatcaaatctcttagattccaaagaggttgaataattaatgttcaaaggcaagagggcaaggcattttttaacactttttaaaataaaaatttataccccaactttaggcta

SEQ ID NO: 427668 - DNA, 2373 bp, Homo sapiens
gcatatgacttggaattggcctgtaccaaactctgggacctgctgttcctggatccagtggtcttgttccaacagatgaatctataaaatataccatatacaatagtactggcattcagattggagcctacaattatatggagattggtgggacgagttcatcactactagacagcacaaatacgaacttcaaagaagagccagctgctaagtaccaagctatctttgataataccactagtctgacggataaacacctggacccaatcagggaaaatctgggaaagcactggaaaaactgtgcccgtaaactgggcttcacacagtctcagattgatgaaattgaccatgactatgagcgagatggactgaaagaaaaggtttaccagatgctccaaaagtgggtgatgagggaaggcataaagggagccacggtggggaagctggcccaggcgctccaccagtgttccaggatcgaccttctgagcagcttgatttacgtcagccagaactaaccctggatgggctacggcagctgaagtggacgcctcacttagtggataaccccagaaagttggctgcctcagagcattcagaattctgtcctcactgataggggttctgtgtctgcagaaattttgtttcctgtacttcatagctggagaatggggaaagaaatctgcagcaaaggggtctcactctgttgccaggctggtctcaaacttctggactcaagtgatcctcccgcctcggccttccaaagtgctgggatatcaggcactgagccactgcgcccagccaacaatccgctctgaggaaagcgtaagcaggaagacctcttaatggcatagcaccaataaaaaaatgactcctagttgtgtttggaaagggagagaagagatgtctgaggaaggtcatgttctttcagcttatggcatttcctagagttttgttgaagcaagaagaaaaactcagagaatataaaatcaacttttaaaattgtgtgctctcttcttcacgtaggctcctgttaaaaacaaagtgcagtcagattctaagccctgttcagagacttcgtggatcacagctgcagctcaccgccacatcacaggatccgttaacgttaatacccaatactctgtcagccactgtaggctctaagaaccacgtgcagtcttcagcccattaaattatcgattattttttaatgaattgaatttatattgagtcttcaaattaactgaatggatttaaaggggtaccaaggaggggggaaacatcagaatttcccaggcagttgttgcaaggaattggtactaaccgtgactacaacaaaaattcttgattgacttttaaagttatttcctggcattctggtaccttcacccagcctgagtgccctggagagggaacaggaaatgctgatctctacccctgggtgagaccagaacctcagggctgatactgttgagtggcttcctcggtttactctgtgtactgtgaaagtattttcatattttttctgtgtgccagagtgaaaaaggacagcttctgagtgtggtaattgtgcctctagcacccagcctttcaaagcccacctgaaacctgggggtggatgaaagaactagaatagaagactgaagctgggtaggccgctcagtgtccactggcattttgctaaaccgacaaggaaggctgtgtgcttagctctccccagagggagggcgagaagggtgtggtgatggtcaatctggctgtcggaacagattctggtgtcttgggctgataacagtgttgttgattctgattgtgaatcccctcaactctagcagacacatacacacccctgaaatggggctgcagagcaggctgtctcagccttgccactgtcggcatctcgggctgggtaattctgttgtggggactgtcctgttccttgtaggatgtttagtagcatccctgcccccacctactagatgccaggggcactgttctccccagccccccgccccagttgtgacaatagtctctaaacattgtcaaatggtccaaggaaaggggaaaattgccccggttgagaagagcactgctgtaaagtaatgagcctcggctctcctgtctgcacctgtccggttactacttggccaccacgcagccttggctcctacagcccaaaagggagaatggagggaggctccaggctttgctggaggggcctgggtgagttctgtttgctccttgtaccaccatccaaatggtgttatcaaatctcttagattccaaagaggttgaataattaatgttcaaaggcaagagggcaaggcattttttaacactttttaaaataaaaatttataccccaactttaggcta

SEQ ID NO: 427669 - DNA, 752 bp, Homo sapiens
  misc_feature (6)..(6): n is a, c, g, or t
ctcgtncaaattcggcagcggcccacgtaggccgctcagtgtccactggcattttgctaaaccgacaaggaaggctgtgtgcttagctctccccagagggagggcgagaagggtgtggtgatggtcaatctggctgtcggaacagattctggtgtcttgggctgataacagtgttgttgattctgattgtgaatcccctcaactctagcagacacatacacacccctgaaatggggctgcagagcaggctgtctcagccttgccactgtcggcatctcgggctgggtaattctgttgtggggactgtcctgttccttgtaggatgtttagtagcatccctgcccccacctactagatgccaggggcactgttctccccagccccccgccccagttgtgacaatagtctctaaacattgtcaaatggtccaaggaaaggggaaaattgccccggttgagaagagcactgctgtaaagtaatgagcctcggctctcctgtctgcacctgtccggttactacttggccaccacgcagccttggctcctacagcccaaaagggagaatggagggaggctccaggctttgctggaggggcctgggtgagttctgtttgctccttgtaccaccatccaaatggtgttatcaaatctcttagattccaaagaggttgaataattaatgttcaaaggcaagagggcaaggcattttttaacactttttaaaataaaaatttataccccaactttaggcta

SEQ ID NO: 427670 - DNA, 2252 bp, Homo sapiens
cccggctagtcccggcaggcggagccccagttagactgctcgtcaagtgtgggaaaagctccgtggcgtcacaagctactatataaaaggcggtgcccgccggggccgagtgggagtccgcggcgagcgcagcagcagggcccggtcctgcgcctcgggagtcggcgtccaggctcggagcgcgacacggagactaggtggcaggcacaacgaggccctcttggaggaggcgaagatgatgaacagactgagacacagccgggtggtgaagctcctgggcgtcatcatagaggaagggaagtactccctggtgatggagtacatggagaagggcaacctgatgcacgtgctgaaagccgagatgagtactccgctttctgtaaaaggaaggataattttggaaatcattgaaggaatgtgctacttacatggaaaaggcgtgatacacaaggacctgaagcctgaaaatatccttgttgataatgacttccacattaagatcgcagacctcggccttgcctcctttaagatgtggagcaaactgaataatgaagagcacaatgagctgagggaagtggacggcaccgctaagaagaatggcggcaccctctactacatggcgcccgagcacctgaatgacgtcaacgcaaagcccacagagaagtcggatgtgtacagctttgctgtagtactctgggcgatatttgcaaataaggagccatatgaaaatgctatctgtgagcagcagttgataatgtgcataaaatctgggaacaggccagatgtggatgacatcactgagtactgcccaagagaaattatcagtctcatgaagctctgctgggaagcgaatccggaagctcggccgacatttcctggcattgaagaaaaatttaggcctttttatttaagtcaattagaagaaagtgtagaagaggacgtgaagagtttaaagaaagagtattcaaacgaaaatgcagttgtgaagagaatgcagtctcttcaacttgattgtgtggcagtaccttcaagccggtcaaattcagccacagaacagcctggttcactgcacagttcccagggacttgggatgggtcctgtggaggagtcctggtttgctccttccctggagcacccacaagaagagaatgagcccagcctgcagagtaaactccaagacgaagccaactaccatctttatggcagccgcatggacaggcagacgaaacagcagcccagacagaatgtggcttacaacagagaggaggaaaggagacgcagggtctcccatgacccttttgcacagcaaagaccttacgagaattttcagaatacagagggaaaaggcactgcttattccagtgcagccagtcatggtaatgcagtgcaccagccctcagggctcaccagccaacctcaagtactgtatcagaacaatggattatatagctcacatggctttggaacaagaccactggatccaggaacagcaggtcccagagtttggtacaggccaattccaagtcatatgcctagtctgcataatatcccagtgcctgagaccaactatctaggaaatacacccaccatgccattcagctccttgccaccaacagatgaatctataaaatataccatatacaatagtactggcattcagattggagcctacaattatatggagattggtgggacgagttcatcactactagacagcacaaatacgaacttcaaagaagagccagctgctaagtaccaagctatctttggtaagataccctggaaggactcaacgcctagcaaccttgaactttcttacttgtgagaaggacatagtggaatcttaaaatttctctgataattcttcttgaaagttttcttatgttacttctgcaaaatatctttgtaatttccatataattcctttgtcatttatttatttttaatatggagataatcacagtatttaatttatggatttgttgtgaaaattaaatgagttgatatgtataaaaagcttagaacactgcctggcacatagtaagttctataaaaagtgttaaactttcatcatcatcatcatcagtattacttctcagacccagaagaaatagctgtgtcaggccctcatcgaaggagatcctgtaaaagatagaagactgtgccctccacagcacttctgtaataaaatcaagagggctatctcttatagggttctatggtgcagcccataatgctaatcccaaagtaca

SEQ ID NO: 427671 - DNA, 909 bp, Homo sapiens
cagaaactgcttgctcgtatatttattcatccattcattcaacaagcattccaggtacaatcctaggttctaaagatacagtcctaaataatatatatttttgttctcaaggagcttaattttatagtattttatgcattaccaaattattgtgggatttttgtttttacactaacaaaatacaacacgaataccctctgcccccccccgaatgaaatctttcttgtttcccagtgacagcagtactgtggtgcacctgctggaaggaaacctggtaaccttctcctcaggctcagatcccaccaccctttcatgaaacagttgctttggcctatttgataacctttccatttcatagacttaatatcacttgttttagatgagtactccgctttctgtaaaaggaaggataattttggaaatcattgaaggaatgtgctacttacatggaaaaggcgtgatacacaaggacctgaagcctgaaaatatccttgttgataatgacttccacattaagatcgcagacctcggccttgcctcctttaagatgtggagcaaactgaataatgaagagcacaatgagtccaaggaaaggggaaaattgccccggttgagaagagcactgctgtaaagtaatgagcctcggctctcctgtctgcacctgtccggttactacttggccaccacgcagccttggctcctacagcccaaaagggagaatggagggaggctccaggctttgctggaggggcctgggtgagttctgtttgctccttgtaccaccatccaaatggtgttatcaaatctcttagattccaaagaggttgaataattaatgttcaaaggcaagagggcaaggcattttttaacactttttaaaataaaaatttataccccaactttaggcta

SEQ ID NO: 427672 - DNA, 1002 bp, Homo sapiens
cagaaactgcttgctcgtatatttattcatccattcattcaacaagcattccaggtacaatcctaggttctaaagatacagtcctaaataatatatatttttgttctcaaggagcttaattttatagtattttatgcattaccaaattattgtgggatttttgtttttacactaacaaaatacaacacgaataccctctgcccccccccgaatgaaatctttcttgtttcccagtgacagcagtactgtggtgcacctgctggaaggaaacctggtaaccttctcctcaggctcagatcccaccaccctttcatgaaacagttgctttggcctatttgataacctttccatttcatagacttaatatcacttgttttagatgagtactccgctttctgtaaaaggaaggataattttggaaatcattgaaggaatgtgctacttacatggaaaaggcgtgatacacaaggacctgaagcctgaaaatatccttgttgataatgacttccacattaagatcgcagacctcggccttgcctcctttaagatgtggagcaaactgaataatgaagagcacaatgagctgagggaagtggacggcaccgctaagaagaatggcggcaccctctactacatggcgcccgagcacctgaatgacgtcaacgcaaagcccacagagaagtcggatgtgtacagctttgctgtagtactctgggcgatatttgcaaataaggagccatatgaaaatgctatctgtgagcagcagttgataatgtgcataaaatctgggaacaggccagatgtggatgacatcactgagtactgcccaagagaaattatcagtctcatgaagctctgctgggaagcgaatccggaagctcggccgacatttcctggcattgaagaaaaatttaggcctttttatttaagtcaattagaagaaagtgtagaagaggacgtgaagagtttaaaggtaggcaatatagcagatgctcaaaatat

SEQ ID NO: 427673 - DNA, 433 bp, Homo sapiens
ggcccctccgcacggggatccccagcgcttgggccctggctgtctgttatggctccccttggggtgtttgtttgcagctcgttagcatcaaatttgcaaattgcttggtagtttgaattttcttttcctttttttatagagacaaggtcttgctatgttgcccaggctgaactccaacacctggtctcaagtgatcctcccacctcagcctctcaagtagctgggattacaggctggatttcctgaagtcagtttctccttaaaacatctatgccttgattgggctccgtgggtcacttctgtaatctcagcacttttggcaggaggatcacttgagccttggtgctcaagaccagcctggataacacagtgaaatcccctctctacaaaaaataaaaggtgcatgtgaacagagcaagaccctgtctctgaa

SEQ ID NO: 427674 - DNA, 347 bp, Homo sapiens
gaagagatcggtacagacccaagcatgaccccagcacgtgggagtgatgtgttggaggtgtgcaccaggctcttgaggcgctggctctgccagcctcagcatagcacctttcctgcccacaggcacaacgaggccctcttggaggaggcgaagatgatgaacagactgagacacagccgggtggtgaagctcctgggcgtcatcatagaggaagggaagtactccctggtgatggagtacatggagaagggcaacctgatgcacgtgctgaaagccgaggtagagagggcccctccgcacggggatccccagcgcttgggccctggctgtctgttatggctcccctt

SEQ ID NO: 427675 - DNA, 854 bp, Homo sapiens
cagaaaggcacatgggcggggctgcgaggagcaggcggggcgggggcgccgaggagagcggcgcggcgtgcgcgggcacgaggcgtagtggtctcccctaaggctgaggcggcggcgggcgcgcggcggcggcgggcgtgcgaggctgttgtgctcccggctctcgtgtttcccctcctgagcgggtggaggaggcccaagcggtgctgggcgcgctcccccttcctttccctccggcgtcctctcccggccctctcgcgctgcactgtctctccgacgcaagactgtcccggcccggatatggctcgtggacagcagaaaattcagtctcagcagaaaaatgccaaaaagcaagctggacaaaagaagaaacaaggacatgaccaaaaggctgctgccaaagctgccttaatatatacctgcactgtctgtaggacacaaatgccagaccctaagaccttcaagcagcactttgagagcaagcatcctaagactccacttcctccagaattagctgatgttcaggcataaggttgtttacaggtgaattcatgacacctttgactcttctactgtctcagaccttaggtaacatacctgcagctgcttttctaacaaactgttgatcagcaaaaataaaggggctacagaaacactcatttttatgctgttccctcttgggcttcatgcaaagacaattctgtgtaaatgtacagttgactctgatttggaaatatgaaaatcagtccatccttgttataaaaaatttttttacaattgtaattatattgatgttcatattgtgtaaaataactcatttaataaaatagtactttgatttacgacatcacagg

SEQ ID NO: 427676 - DNA, 969 bp, Homo sapiens
cagaaaggcacatgggcggggctgcgaggagcaggcggggcgggggcgccgaggagagcggcgcggcgtgcgcgggcacgaggcgtagtggtctcccctaaggctgaggcggcggcgggcgcgcggcggcggcgggcgtgcgaggctgttgtgctcccggctctcgtgtttcccctcctgagcgggtggaggaggcccaagcggtgctgggcgcgctcccccttcctttccctccggcgtcctctcccggccctctcgcgctgcactgtctctccgacgcaagactgtcccggcccggagtctcactgtcgcccaggctgcagtgcagtggtgccatcacgcgtcactgcaacctctgcctcccggattcaagcaattctccacctcagcctcccaagtagctggaattacagatatggctcgtggacagcagaaaattcagtctcagcagaaaaatgccaaaaagcaagctggacaaaagaagaaacaaggacatgaccaaaaggctgctgccaaagctgccttaatatatacctgcactgtctgtaggacacaaatgccagaccctaagaccttcaagcagcactttgagagcaagcatcctaagactccacttcctccagaattagctgatgttcaggcataaggttgtttacaggtgaattcatgacacctttgactcttctactgtctcagaccttaggtaacatacctgcagctgcttttctaacaaactgttgatcagcaaaaataaaggggctacagaaacactcatttttatgctgttccctcttgggcttcatgcaaagacaattctgtgtaaatgtacagttgactctgatttggaaatatgaaaatcagtccatccttgttataaaaaatttttttacaattgtaattatattgatgttcatattgtgtaaaataactcatttaataaaatagtactttgatttacgacatcacagg

SEQ ID NO: 427677 - DNA, 747 bp, Homo sapiens
gaagaggaagaattctacctgagttgcgccataaagtgcctgccctctagcctctactcttccagttgcggcttattgcatcacagtaattgctgtacgaaggtcagaatcgctacctattgcccaaagcagtcgtaagaagaggtcccaatcccccactctttccgccctaatggaggtctgcagtttcgatatggctcgtggacagcagaaaattcagtctcagcagaaaaatgccaaaaagcaagctggacaaaagaagaaacaaggacatgaccaaaaggctgctgccaaagctgccttaatatatacctgcactgtctgtaggacacaaatgccagaccctaagaccttcaagcagcactttgagagcaagcatcctaagactccacttcctccagaattagctgatgttcaggcataaggttgtttacaggtgaattcatgacacctttgactcttctactgtctcagaccttaggtaacatacctgcagctgcttttctaacaaactgttgatcagcaaaaataaaggggctacagaaacactcatttttatgctgttccctcttgggcttcatgcaaagacaattctgtgtaaatgtacagttgactctgatttggaaatatgaaaatcagtccatccttgttataaaaaatttttttacaattgtaattatattgatgttcatattgtgtaaaataactcatttaataaaatagtactttgatttacgacatcacagg

SEQ ID NO: 427678 - DNA, 815 bp, Homo sapiens
gttaaaataaggtcttgggcaaattaaactctgggttttagtttccttatcaggtaaaatgatgctagtaggagctaaagattactttgaaggttctgtgggaattaaggtaacatgcttaatataataagggttcagtaaatgttacctattgtttgctgttaatcagataagcagaatacattctatgtgacctacctttctttataggtgaaatgtgggaacgttaggaatttctttaccacaaagtccctcttcatatgccagtcactaagttgtaggaatttaaaggtgtttttgggataattgtctatactgagaaggttcaggattctaaaaagtaacacatttttattttataaataaagtctagctctcttttgcacaattttttgtacacaaatgccagaccctaagaccttcaagcagcactttgagagcaagcatcctaagactccacttcctccagaattagctgatgttcaggcataaggttgtttacaggtgaattcatgacacctttgactcttctactgtctcagaccttaggtaacatacctgcagctgcttttctaacaaactgttgatcagcaaaaataaaggggctacagaaacactcatttttatgctgttccctcttgggcttcatgcaaagacaattctgtgtaaatgtacagttgactctgatttggaaatatgaaaatcagtccatccttgttataaaaaatttttttacaattgtaattatattgatgttcatattgtgtaaaataactcatttaataaaatagtactttgatttacgacatcacagg

SEQ ID NO: 427679 - DNA, 452 bp, Homo sapiens
tcagagttctgtatataaagtcgagttgacaagtttaccagatattatcttcatagtgtttcttcttagttatttgaaatgcatgtaagttgcatttgtgcaatggtaacattcattgaaaattttgcttatgttttataggtgaattcatgacacctttgactcttctactgtctcagaccttaggtaacatacctgcagctgcttttctaacaaactgttgatcagcaaaaataaaggggctacagaaacactcatttttatgctgttccctcttgggcttcatgcaaagacaattctgtgtaaatgtacagttgactctgatttggaaatatgaaaatcagtccatccttgttataaaaaatttttttacaattgtaattatattgatgttcatattgtgtaaaataactcatttaataaaatagtactttgatttacgacatcacagg

SEQ ID NO: 427680 - DNA, 1242 bp, Homo sapiens
cagaaaggcacatgggcggggctgcgaggagcaggcggggcgggggcgccgaggagagcggcgcggcgtgcgcgggcacgaggcgtagtggtctcccctaaggctgaggcggcggcgggcgcgcgaggctgttgtgctcccggctctcgtgtttcccctcctgagcgggtggaggaggcccaagcggtgctgggcgcgctcccccttcctttccctccggcgtcctctcccggccctctcgcgctgcactgtctctccgacgcaagactgtcccggcccggatatggctcgtggacagcagaaaattcagtctcagcagaaaaatgccaaaaagcaagctggacaaaagaagaaacaaggacatgaccaaaaggctgctgccaaagctgccttaatatatacctgcactgtctgtagggtaaggggaattgaattgaaagatacagctctcccgtgggcagttttggcttgaatagattaaaattttgaaaccatggcaaaatagatgctttacatgaaatagtaggtttgagagctgattattttaggtatctattttcattcaccctttaaacaaatattttttgaatggctcctgtggccaggcaaaaatctctaggtgctgggaaaacagagtgaacaaaacaaaattgctttcctcatataaaataaagatgtcttcataagggcatataatacacttcactagcacatcatataactctacactcttagagctatataatatgctagtaagtatacctctagttatataattggttttttcttcactaaatttataattaggatgtctgtaaaaccatatagagtataatcacgttgagagcttttcctagaattaatgtgttgtattagatttgaagaactgtaataataacagctacttttgagtgcttaccatatgccacacatagagccaggtgttttacatgtattcacctatttaatccacataacaaccctataagataaagtacttttattgttctcattttacagaagagtaaactgactaatggaaattaaacaatttgtgtggggtctcccagctggttagtagaagagctggaatctgaactcaggcagttcagctccagagtccaccctctggaccactactgtactgcctctcaaagaagtacttctgaaattccaaatcagagcctcttgcctgtttgtttaagctcattacccttgaagttagtgagtggcagtaccaaa

SEQ ID NO: 427681 - DNA, 865 bp, Homo sapiens
cccggggcgggccgcgggaaggggatgagttcgggcgcctgccaggccctgcaggtggccgggtcgcaggccagccgcggaagcggagcggtaaccttacccccggcgacagccgccggtcagctgccagagtgtggcgctcccggtggacgcaggggccgggtttcgggcagtctcggcctccaggaggcgcgtcttggtccagggtccgtgaggactggctagatgggggctgcgtggcctttggtggcagggaggaggagggggtctccgaggcgggagaggcgggtttgggaaggaaggtgcgccaggctgaagctggggtcggagaagtgttgggtggagacctcactgtgggtgcgttcctcctctcctctccccaaaacgatggtgttaaaagctagggtcaggatgtggagcgctgcctgggcctcttcctttccgatggttatggagaatgagcctacttcctggacccaaaatccttttcttctgttactcatttatgttggttttaaaaggagctttggggcagagcttacttgttgcctcctacgagagcgcctcattttagaactcgtttcttccactacttccctctttgcagccccctcggaaaaccacactgagagttgcattaaaaaccagcatgtaggtatttgtaagtgactttttccctccagtttgtcgcatttaatcaaggagcggttgtagctgcctacgattttgtagaaaattgtgttggcttgagagcaagatcctatagttgagctgtccggcgtgttgtcagaagttaggggcctacctcatgcatttagcttattttattccatttcctttacctggtgttaagttttctgtcttc

SEQ ID NO: 427682 - DNA, 837 bp, Homo sapiens
cagaaaggcacatgggcggggctgcgaggagcaggcggggcgggggcgccgaggagagcggcgcggcgtgcgcgggcacgaggcgtagtggtctcccctaaggctgaggcggcggcgggcgcgcgaggctgttgtgctcccggctctcgtgtttcccctcctgagcgggtggaggaggcccaagcggtgctgggcgcgctcccccttcctttccctccggcgtcctctcccggccctctcgcgctgcactgtctctccgacgcaagactgtcccggcccggatatggctcgtggacagcagaaaattcagtctcagcagaaaaatgccaaaaagcaagctggacaaaagaagaaacaaggacatgaccaaaaggctgctgccaaagctgccttaatatatacctgcactgtctgtaggacacaaatgccagaccctaagaccttcaagcagcactttgagagcaagcatcctaagactccacttcctccagaattagctgatgttcaggcataaggttgtttacaggtgaattcatgacacctttgactcttctactgtctcagaccttaggtaacatacctgcagctgcttttctaacaaactgttgatcagcaaaaataaaggggctacagaaacactcatttttatgctgttccctcttgggcttcatgcaaagacaattctgtgtaaatgtacagttgactctgatttggaaatatgaaaatcagtccatccttgttataaaaaatttttttacaattgtaattatattgatgttcatattgtgtaaaataactcatttaataaaatagtactttgatttacgacatcacagg

SEQ ID NO: 427683 - DNA, 2078 bp, Homo sapiens
tttaaaaaaaatgtgccatttggcttagaattaataattttttttaaagcaaaaatggaagcttagtcttcaaggactgataacagctggtaatatttaccattgtttggtgggaatggggttctcatattaggctagcacgctaaacattttcaattacgaaaatgtattaggctcgtgtgctaccctaatataaaaaccccatatttcctcagttgaaatagtcagctgactatcctgaaaagcattgaccctcttttatattttatctgactttcagttcatttttttaatgctagtgggaacttctccaatcagtgtatttttttagtttccttttttggggaacaggaggagctcagtaatttttatgaaatgctttgacctcatatccattaactaattatggtcctagtcagaagaagctagcacccttccctggtgaagttgatacaaatccattgtatgttcctgtcctgcaatgatttacattcagttacagtactagtcaaaactatatatatatgaattctacttaggatccaattttgatatatttaaaaagcaattgagactcatgatagactttatgagcaggtttaacttgtgtggtcgaataaaagcctttaatttaaatggaaaagtaaaagtaacttttttcagtgacttgattttttttttttgttttaatccatttgggttcacgtcagatcatcggtaacaaaaagtggtatctttcagctttgtaaaagaaccctcttaaccaagttcattccctcaaatgggaactaacgtctagagagcaaagaaacttctggaattagtggcttgctgataatctcattttataatttgttcagcaatccagcaagaccaactttttaaaaaaattaataacagtagttttatgaaaactaagtaagaaaacagtttccacctatttctgaggtctcctttagaaggagtaacagacagcttttatttctcttaaagttataaaaatcacaatcgcaagtcacaatgaatactgggaagggaaattacttttgcagagtgatcaagtaaatgatagcgggggctaaacttttttagtaaacttgtgaagattacatacagtaaagtgcataaatcttgagtgtacaattcaatgaatttttataagtaaacacacttgattcaagaacattttcaggaccccataagtccccttcatgtcctgtcttcccagtcattacccataacccccaaggtgacccctttcactatagattagctttgcctgttttgaactttaaataatgtatattccccacaactggcttctttcctttaacattgagatacaaccaagttgttacttgtaacaattttttgtttgtgtgtttgtttatttatttttgagaccagagtctcactgtcgcccaggctgcagtgcagtggtgccatcacgcgtcactgcaacctctgcctcccggattcaagcaattctccacctcagcctcccaagtagctggaattacagatatggctcgtggacagcagaaaattcagtctcagcagaaaaatgccaaaaagcaagctggacaaaagaagaaacaaggacatgaccaaaaggctgctgccaaagctgccttaatatatacctgcactgtctgtaggacacaaatgccagaccctaagaccttcaagcagcactttgagagcaagcatcctaagactccacttcctccagaattagctgatgttcaggcataaggttgtttacaggtgaattcatgacacctttgactcttctactgtctcagaccttaggtaacatacctgcagctgcttttctaacaaactgttgatcagcaaaaataaaggggctacagaaacactcatttttatgctgttccctcttgggcttcatgcaaagacaattctgtgtaaatgtacagttgactctgatttggaaatatgaaaatcagtccatccttgttataaaaaatttttttacaattgtaattatattgatgttcatattgtgtaaaataactcatttaataaaatagtactttgatttacgacatcacagg

SEQ ID NO: 427684 - DNA, 1013 bp, Homo sapiens
cagaaaggcacatgggcggggctgcgaggagcaggcggggcgggggcgccgaggagagcggcgcggcgtgcgcgggcacgaggcgtagtggtctcccctaaggctgaggcggcggcgggcgcgcggcggcggcgggcgtgcgaggctgttgtgctcccggctctcgtgtttcccctcctgagcgggtggaggaggcccaagcggtgctgggcgcgctcccccttcctttccctccggcgtcctctcccggccctctcgcgctgcactgtctctccgacgcaagactgtcccggcccggccccctcggaaaaccacactgagagttgcattaaaaaccagcatagtctcactgtcgcccaggctgcagtgcagtggtgccatcacgcgtcactgcaacctctgcctcccggattcaagcaattctccacctcagcctcccaagtagctggaattacagatatggctcgtggacagcagaaaattcagtctcagcagaaaaatgccaaaaagcaagctggacaaaagaagaaacaaggacatgaccaaaaggctgctgccaaagctgccttaatatatacctgcactgtctgtaggacacaaatgccagaccctaagaccttcaagcagcactttgagagcaagcatcctaagactccacttcctccagaattagctgatgttcaggcataaggttgtttacaggtgaattcatgacacctttgactcttctactgtctcagaccttaggtaacatacctgcagctgcttttctaacaaactgttgatcagcaaaaataaaggggctacagaaacactcatttttatgctgttccctcttgggcttcatgcaaagacaattctgtgtaaatgtacagttgactctgatttggaaatatgaaaatcagtccatccttgttataaaaaatttttttacaattgtaattatattgatgttcatattgtgtaaaataactcatttaataaaatagtactttgatttacgacatcacagg

SEQ ID NO: 427685 - DNA, 869 bp, Homo sapiens
tccagttttggaatgggcactcagaacattttgtacatgtcttggtgtacataacatttgcatttctattgggtatataccaagagtggaattgctggctcatagaataaacagctaccaactagttttccacagggttgtgtcaattgatacttttgtagcatttatatgtgggaattttaatacctataaatttttatttgccagatatttctataaaacttaaggcttcaattctaagaacgttcttatgctttgattactctgtattagagtaaataagccactctaatgcttcaccttctgtttttagatatggctcgtggacagcagaaaattcagtctcagcagaaaaatgccaaaaagcaagctggacaaaagaagaaacaaggacatgaccaaaaggctgctgccaaagctgccttaatatatacctgcactgtctgtaggacacaaatgccagaccctaagaccttcaagcagcactttgagagcaagcatcctaagactccacttcctccagaattagctgatgttcaggcataaggttgtttacaggtgaattcatgacacctttgactcttctactgtctcagaccttaggtaacatacctgcagctgcttttctaacaaactgttgatcagcaaaaataaaggggctacagaaacactcatttttatgctgttccctcttgggcttcatgcaaagacaattctgtgtaaatgtacagttgactctgatttggaaatatgaaaatcagtccatccttgttataaaaaatttttttacaattgtaattatattgatgttcatattgtgtaaaataactcatttaataaaatagtactttgatttacgacatcacagg

SEQ ID NO: 427686 - DNA, 2914 bp, Homo sapiens
cagaaaggcacatgggcggggctgcgaggagcaggcggggcgggggcgccgaggagagcggcgcggcgtgcgcgggcacgaggcgtagtggtctcccctaaggctgaggcggcggcgggcgcgcggcggcggcgggcgtgcgaggctgttgtgctcccggctctcgtgtttcccctcctgagcgggtggaggaggcccaagcggtgctgggcgcgctcccccttcctttccctccggcgtcctctcccggccctctcgcgctgcactgtctctccgacgcaagactgtcccggcccggatatggctcgtggacagcagaaaattcagtctcagcagaaaaatgccaaaaagcaagctggacaaaagaagaaacaaggacatgaccaaaaggctgctgccaaagctgccttaatatatacctgcactgtctgtaggacacaaatgccagaccctaagaccttcaagcagcactttgagagcaagcatcctaagactccacttcctccagaattagctgatgttcaggcataaggttgtttacaggtgaattcatgacacctttgactcttctactgtctcagaccttaggtaacatacctgcagctgcttttctaacaaactgttgatcagcaaaaataaaggggctacagaaacactcatttttatgctgttccctcttgggcttcatgcaaagacaattctgtgtaaatgtacagttgactctgatttggaaatatgaaaatcagtccatccttgttataaaaaatttttttacaattgtaattatattgatgttcatattgtgtaaaataactcatttaataaaatagtactttgatttacgacatcacaggataaatggttttagaaattctgttctaactttccacattatttgccttataaaaatctaatgaattcatcagctagaattgcaagtgcaattcttatatccctttctctgctcagtggcaggttcctcagttaaactagagcagactgattcattaaaattgtgcatacgattttatgggcagctgatgatctaggtgaaaaatgacttatctgctgccttagtatattgcggttatgtgtcattgtacccctctgatcatttcctgtgtttgagttggaatatttaaaattgcagtatgacctggctctaactgccagtcaggtgtaccctgtagataactgatagcttcctaaaagcggttggattgtcagtgagcccttgtgaaaggttaggttctaatgtatatgccgtaatgaaataatcattaagcctattgtttaatgcaaaatatggaacaaatgtgaactggtaaaggtcgatcttgatactatattctttgaaaattcttgaagttctttaatttgaaattgaaacattaatttttgaggtttttggaagttactatttggccatttttacaaatggattttgcattaacaggaagattggaatgacttgtggctggattaattcccagaaccctctccctcctttcttttctaagtgagttgttgattttaggagtttgctttgtgctgttacctaaaatcagagactggtgtacagtatgacttccatctgaacttgaaaagtattaaaatgggtcaatattcacattcttttagatctcaggatgggaaaatgggtttgttcagatggatatggtaaatcttacccaattaaggaaggctaattttagagttcttctaatttgcttgtgtcaactcttaacttgtaaaactgctgttaactcggtttaaatttttaaattaatataatagaaagaacactaaaatacttactggtaactgcttagagccatttatctgatcctgtggattacagaatgcattccctcttctgctgtagcttatcattgctttgttttgtagctctgcatattttgcccaccttgtcttccctgtaagtttaagacgtttccaaggaaaagcttcagggctgatagtttcttagcaattcctattcttatgcccttactttaaaatagtccttttattttgtgtattttatttcctaagtttcagatgtaatatctgttgtttcctaacatgtcgattaccagaacgttagaattttacctaatttcttgtggatattgcagaagttctggttaaatcacaacttaaaagtttttaaaagtgctttgagcatatgtatatgtttagtgacaaatcatataaaaccattcacaagttttggttttttttttttcgtttgttttagtgactaattcaggatgaaagtttttttgttcttgtatttaacccttttttataagcagctgaagacaccatatttaacactatatctcagtgatagggaaatagctgcattgatcttacatgagcataatcatccttatacttcatgaggggattattagtacaatccccattttactgtgtttgagttaaaaaccaaacatccctgtaatttaatttgaagattctttaacagattgcagcaaagttcattataaaactgttatggtgtcttcaaagacttgataaaataacactgagagagaattggtccatttgtatgctgtatttctattacttgccaaaaggaatggggttaagattaaacttgtttccattctcttcacatggatatacatccccatgtttaactgacacactgggggctcagttgtgtgctgtaatgtcttattaaagaagatattaaagaaaaaaaaaaaaaaaaaaaaaattgtgggggccgggcccggaaaagtttaaacactcgttgggccgggccaatgtaagaaagggcaaggtgccaagaaaccggccgcagaggggggtccccaaaaaaccgggacgggttgaacccaaggccgggcacggctcaggcggaccccccggcggggggtct

SEQ ID NO: 427687 - DNA, 2532 bp, Homo sapiens
  misc_feature (12)..(12): n is a, c, g, or t
  misc_feature (15)..(15): n is a, c, g, or t
  misc_feature (19)..(19): n is a, c, g, or t
  misc_feature (33)..(33): n is a, c, g, or t
  misc_feature (37)..(38): n is a, c, g, or t
aaagagacaggnagncaangtgtgcaagtgctnaatnnactgatgctgtaggcacacaaatgccagaccctaagaccttcaagcagcactttgagagcaagcatcctaagactccacttcctccagaattagctgatgttcaggcataaggttgtttacaggtgaattcatgacacctttgactcttctactgtctcagaccttaggtaacatacctgcagctgcttttctaacaaactgttgatcagcaaaaataaaggggctacagaaacactcatttttatgctgttccctcttgggcttcatgcaaagacaattctgtgtaaatgtacagttgactctgatttggaaatatgaaaatcagtccatccttgttataaaaaatttttttacaattgtaattatattgatgttcatattgtgtaaaataactcatttaataaaatagtactttgatttacgacatcacaggataaatggttttagaaattctgttctaactttccacattatttgccttataaaaatctaatgaattcatcagctagaattgcaagtgcaattcttatatccctttctctgctcagtggcaggttcctcagttaaactagagcagactgattcattaaaattgtgcatacgattttatgggcagctgatgatctaggtgaaaaatgacttatctgctgccttagtatattgcggttatgtgtcattgtacccctctgatcatttcctgtgtttgagttggaatatttaaaattgcagtatgacctggctctaactgccagtcaggtgtaccctgtagataactgatagcttcctaaaagcggttggattgtcagtgagcccttgtgaaaggttaggttctaatgtatatgccgtaatgaaataatcattaagcctattgtttaatgcaaaatatggaacaaatgtgaactggtaaaggtcgatcttgatactatattctttgaaaattcttgaagttctttaatttgaaattgaaacattaatttttgaggtttttggaagttactatttggccatttttacaaatggattttgcattaacaggaagattggaatgacttgtggctggattaattcccagaaccctctccctcctttcttttctaagtgagttgttgattttaggagtttgctttgtgctgttacctaaaatcagagactggtgtacagtatgacttccatctgaacttgaaaagtattaaaatgggtcaatattcacattcttttagatctcaggatgggaaaatgggtttgttcagatggatatggtaaatcttacccaattaaggaaggctaattttagagttcttctaatttgcttgtgtcaactcttaacttgtaaaactgctgttaactcggtttaaatttttaaattaatataatagaaagaacactaaaatacttactggtaactgcttagagccatttatctgatcctgtggattacagaatgcattccctcttctgctgtagcttatcattgctttgttttgtagctctgcatattttgcccaccttgtcttccctgtaagtttaagacgtttccaaggaaaagcttcagggctgatagtttcttagcaattcctattcttatgcccttactttaaaatagtccttttattttgtgtattttatttcctaagtttcagatgtaatatctgttgtttcctaacatgtcgattaccagaacgttagaattttacctaatttcttgtggatattgcagaagttctggttaaatcacaacttaaaagtttttaaaagtgctttgagcatatgtatatgtttagtgacaaatcatataaaaccattcacaagttttggttttttttttttcgtttgttttagtgactaattcaggatgaaagtttttttgttcttgtatttaacccttttttataagcagctgaagacaccatatttaacactatatctcagtgatagggaaatagctgcattgatcttacatgagcataatcatccttatacttcatgaggggattattagtacaatccccattttactgtgtttgagttaaaaaccaaacatccctgtaatttaatttgaagattctttaacagattgcagcaaagttcattataaaactgttatggtgtcttcaaagacttgataaaataacactgagagagaattggtccatttgtatgctgtatttctattacttgccaaaaggaatggggttaagattaaacttgtttccattctcttcacatggatatacatccccatgtttaactgacacactgggggctcagttgtgtgctgtaatgtcttattaaagaagatattaaagaaaaaaaaaaaaaaaaaaaaaattgtgggggccgggcccggaaaagtttaaacactcgttgggccgggccaatgtaagaaagggcaaggtgccaagaaaccggccgcagaggggggtccccaaaaaaccgggacgggttgaacccaaggccgggcacggctcaggcggaccccccggcggggggtct

SEQ ID NO: 427688 - DNA, 2815 bp, Homo sapiens
gttaaaataaggtcttgggcaaattaaactctgggttttagtttccttatcaggtaaaatgatgctagtaggagctaaagattactttgaaggttctgtgggaattaaggtaacatgcttaatataataagggttcagtaaatgttacctattgtttgctgttaatcagataagcagaatacattctatgtgacctacctttctttataggtgaaatgtgggaacgttaggaatttctttaccacaaagtccctcttcatatgccagtcactaagttgtaggaatttaaaggtgtttttgggataattgtctatactgagaaggttcaggattctaacacaaatgccagaccctaagaccttcaagcagcactttgagagcaagcatcctaagactccacttcctccagaattagctgatgttcaggcataaggttgtttacaggtgaattcatgacacctttgactcttctactgtctcagaccttaggtaacatacctgcagctgcttttctaacaaactgttgatcagcaaaaataaaggggctacagaaacactcatttttatgctgttccctcttgggcttcatgcaaagacaattctgtgtaaatgtacagttgactctgatttggaaatatgaaaatcagtccatccttgttataaaaaatttttttacaattgtaattatattgatgttcatattgtgtaaaataactcatttaataaaatagtactttgatttacgacatcacaggataaatggttttagaaattctgttctaactttccacattatttgccttataaaaatctaatgaattcatcagctagaattgcaagtgcaattcttatatccctttctctgctcagtggcaggttcctcagttaaactagagcagactgattcattaaaattgtgcatacgattttatgggcagctgatgatctaggtgaaaaatgacttatctgctgccttagtatattgcggttatgtgtcattgtacccctctgatcatttcctgtgtttgagttggaatatttaaaattgcagtatgacctggctctaactgccagtcaggtgtaccctgtagataactgatagcttcctaaaagcggttggattgtcagtgagcccttgtgaaaggttaggttctaatgtatatgccgtaatgaaataatcattaagcctattgtttaatgcaaaatatggaacaaatgtgaactggtaaaggtcgatcttgatactatattctttgaaaattcttgaagttctttaatttgaaattgaaacattaatttttgaggtttttggaagttactatttggccatttttacaaatggattttgcattaacaggaagattggaatgacttgtggctggattaattcccagaaccctctccctcctttcttttctaagtgagttgttgattttaggagtttgctttgtgctgttacctaaaatcagagactggtgtacagtatgacttccatctgaacttgaaaagtattaaaatgggtcaatattcacattcttttagatctcaggatgggaaaatgggtttgttcagatggatatggtaaatcttacccaattaaggaaggctaattttagagttcttctaatttgcttgtgtcaactcttaacttgtaaaactgctgttaactcggtttaaatttttaaattaatataatagaaagaacactaaaatacttactggtaactgcttagagccatttatctgatcctgtggattacagaatgcattccctcttctgctgtagcttatcattgctttgttttgtagctctgcatattttgcccaccttgtcttccctgtaagtttaagacgtttccaaggaaaagcttcagggctgatagtttcttagcaattcctattcttatgcccttactttaaaatagtccttttattttgtgtattttatttcctaagtttcagatgtaatatctgttgtttcctaacatgtcgattaccagaacgttagaattttacctaatttcttgtggatattgcagaagttctggttaaatcacaacttaaaagtttttaaaagtgctttgagcatatgtatatgtttagtgacaaatcatataaaaccattcacaagttttggttttttttttttcgtttgttttagtgactaattcaggatgaaagtttttttgttcttgtatttaacccttttttataagcagctgaagacaccatatttaacactatatctcagtgatagggaaatagctgcattgatcttacatgagcataatcatccttatacttcatgaggggattattagtacaatccccattttactgtgtttgagttaaaaaccaaacatccctgtaatttaatttgaagattctttaacagattgcagcaaagttcattataaaactgttatggtgtcttcaaagacttgataaaataacactgagagagaattggtccatttgtatgctgtatttctattacttgccaaaaggaatggggttaagattaaacttgtttccattctcttcacatggatatacatccccatgtttaactgacacactgggggctcagttgtgtgctgtaatgtcttattaaagaagatattaaagaaaaaaaaaaaaaaaaaaaaaattgtgggggccgggcccggaaaagtttaaacactcgttgggccgggccaatgtaagaaagggcaaggtgccaagaaaccggccgcagaggggggtccccaaaaaaccgggacgggttgaacccaaggccgggcacggctcaggcggaccccccggcggggggtct

SEQ ID NO: 427689 - DNA, 2789 bp, Homo sapiens
cagaaaggcacatgggcggggctgcgaggagcaggcggggcgggggcgccgaggagagcggcgcggcgtgcgcgggcacgaggcgtagtggtctcccctaaggctgaggcggcggcgggcgcgcgaggctgttgtgctcccggctctcgtgtttcccctcctgagcgggtggaggaggcccaagcggtgctgggcgcgctcccccttcctttccctccggcgtcctctcccggccctctcgcgctgcactgtctctccgacgcaagactgtcccggcccggatatggctcgtggacagcagaaaattcagtctcagcagaaaaatgccaaaaagcaagctggacaaaagaagaaacaaggacatgaccaaaaggctgctgccaaagctgccttaatatatacctgcactgtctgtagggtgaattcatgacacctttgactcttctactgtctcagaccttaggtaacatacctgcagctgcttttctaacaaactgttgatcagcaaaaataaaggggctacagaaacactcatttttatgctgttccctcttgggcttcatgcaaagacaattctgtgtaaatgtacagttgactctgatttggaaatatgaaaatcagtccatccttgttataaaaaatttttttacaattgtaattatattgatgttcatattgtgtaaaataactcatttaataaaatagtactttgatttacgacatcacaggataaatggttttagaaattctgttctaactttccacattatttgccttataaaaatctaatgaattcatcagctagaattgcaagtgcaattcttatatccctttctctgctcagtggcaggttcctcagttaaactagagcagactgattcattaaaattgtgcatacgattttatgggcagctgatgatctaggtgaaaaatgacttatctgctgccttagtatattgcggttatgtgtcattgtacccctctgatcatttcctgtgtttgagttggaatatttaaaattgcagtatgacctggctctaactgccagtcaggtgtaccctgtagataactgatagcttcctaaaagcggttggattgtcagtgagcccttgtgaaaggttaggttctaatgtatatgccgtaatgaaataatcattaagcctattgtttaatgcaaaatatggaacaaatgtgaactggtaaaggtcgatcttgatactatattctttgaaaattcttgaagttctttaatttgaaattgaaacattaatttttgaggtttttggaagttactatttggccatttttacaaatggattttgcattaacaggaagattggaatgacttgtggctggattaattcccagaaccctctccctcctttcttttctaagtgagttgttgattttaggagtttgctttgtgctgttacctaaaatcagagactggtgtacagtatgacttccatctgaacttgaaaagtattaaaatgggtcaatattcacattcttttagatctcaggatgggaaaatgggtttgttcagatggatatggtaaatcttacccaattaaggaaggctaattttagagttcttctaatttgcttgtgtcaactcttaacttgtaaaactgctgttaactcggtttaaatttttaaattaatataatagaaagaacactaaaatacttactggtaactgcttagagccatttatctgatcctgtggattacagaatgcattccctcttctgctgtagcttatcattgctttgttttgtagctctgcatattttgcccaccttgtcttccctgtaagtttaagacgtttccaaggaaaagcttcagggctgatagtttcttagcaattcctattcttatgcccttactttaaaatagtccttttattttgtgtattttatttcctaagtttcagatgtaatatctgttgtttcctaacatgtcgattaccagaacgttagaattttacctaatttcttgtggatattgcagaagttctggttaaatcacaacttaaaagtttttaaaagtgctttgagcatatgtatatgtttagtgacaaatcatataaaaccattcacaagttttggttttttttttttcgtttgttttagtgactaattcaggatgaaagtttttttgttcttgtatttaacccttttttataagcagctgaagacaccatatttaacactatatctcagtgatagggaaatagctgcattgatcttacatgagcataatcatccttatacttcatgaggggattattagtacaatccccattttactgtgtttgagttaaaaaccaaacatccctgtaatttaatttgaagattctttaacagattgcagcaaagttcattataaaactgttatggtgtcttcaaagacttgataaaataacactgagagagaattggtccatttgtatgctgtatttctattacttgccaaaaggaatggggttaagattaaacttgtttccattctcttcacatggatatacatccccatgtttaactgacacactgggggctcagttgtgtgctgtaatgtcttattaaagaagatattaaagaaaaaaaaaaaaaaaaaaaaaattgtgggggccgggcccggaaaagtttaaacactcgttgggccgggccaatgtaagaaagggcaaggtgccaagaaaccggccgcagaggggggtccccaaaaaaccgggacgggttgaacccaaggccgggcacggctcaggcggaccccccggcggggggtct

SEQ ID NO: 427690 - DNA, 727 bp, Homo sapiens
cagaaaggcacatgggcggggctgcgaggagcaggcggggcgggggcgccgaggagagcggcgcggcgtgcgcgggcacgaggcgtagtggtctcccctaaggctgaggcggcggcgggcgcgcgaggctgttgtgctcccggctctcgtgtttcccctcctgagcgggtggaggaggcccaagcggtgctgggcgcgctcccccttcctttccctccggcgtcctctcccggccctctcgcgctgcactgtctctccgacgcaagactgtcccggcccggatatggctcgtggacagcagaaaattcagtctcagcagaaaaatgccaaaaagcaagctggacaaaagaagaaacaaggacatgaccaaaaggctgctgccaaagctgccttaatatatacctgcactgtctgtaggacacaaatgccagaccctaagaccttcaagcagcactttgagagcaagcatcctaagactccacttcctccagaattagctgatgttcaggcataaggttgtttacaggtaactcacctctttttctattggtttgttaataacagggttgtatacaagaccaaaactgtcttcacttattgtgaaattaatttctgccttctgagattttattgcttcccctttttaagttaatgtgtaactgaaaagtccctttttctcagactatttcctttcaatgcctttgaaacatccaaatttttactactg

SEQ ID NO: 427691 - DNA, 2483 bp, Homo sapiens
tttaaaaaaaatgtgccatttggcttagaattaataattttttttaaagcaaaaatggaagcttagtcttcaaggactgataacagctggtaatatttaccattgtttggtgggaatggggttctcatattaggctagcacgctaaacattttcaattacgaaaatgtattaggctcgtgtgctaccctaatataaaaaccccatatttcctcagttgaaatagtcagctgactatcctgaaaagcattgaccctcttttatattttatctgactttcagttcatttttttaatgctagtgggaacttctccaatcagtgtatttttttagtttccttttttggggaacaggaggagctcagtaatttttatgaaatgctttgacctcatatccattaactaattatggtcctagtcagaagaagctagcacccttccctggtgaagttgatacaaatccattgtatgttcctgtcctgcaatgatttacattcagttacagtactagtcaaaactatatatatatgaattctacttaggatccaattttgatatatttaaaaagcaattgagactcatgatagactttatgagcaggtttaacttgtgtggtcgaataaaagcctttaatttaaatggaaaagtaaaagtaacttttttcagtgacttgattttttttttttgttttaatccatttgggttcacgtcagatcatcggtaacaaaaagtggtatctttcagctttgtaaaagaaccctcttaaccaagttcattccctcaaatgggaactaacgtctagagagcaaagaaacttctggaattagtggcttgctgataatctcattttataatttgttcagcaatccagcaagaccaactttttaaaaaaattaataacagtagttttatgaaaactaagtaagaaaacagtttccacctatttctgaggtctcctttagaaggagtaacagacagcttttatttctcttaaagttataaaaatcacaatcgcaagtcacaatgaatactgggaagggaaattacttttgcagagtgatcaagtaaatgatagcgggggctaaacttttttagtaaacttgtgaagattacatacagtaaagtgcataaatcttgagtgtacaattcaatgaatttttataagtaaacacacttgattcaagaacattttcaggaccccataagtccccttcatgtcctgtcttcccagtcattacccataacccccaaggtgacccctttcactatagattagctttgcctgttttgaactttaaataatgtatattccccacaactggcttctttcctttaacattgagatacaaccaagttgttacttgtaacaattttttgtttgtgtgtttgtttatttatttttgagaccagagtctcactgtcgcccaggctgcagtgcagtggtgccatcacgcgtcactgcaacctctgcctcccggattcaagcaattctccacctcagcctcccaagtagctggaattacagatatggctcgtggacagcagaaaattcagtctcagcagaaaaatgccaaaaagcaagctggacaaaagaagaaacaaggacatgaccaaaaggctgctgccaaagctgccttaatatatacctgcactgtctgtagggtaaggggaattgaattgaaagatacagctctcccgtgggcagttttggcttgaatagattaaaattttgaaaccatggcaaaatagatgctttacatgaaatagtaggtttgagagctgattattttaggtatctattttcattcaccctttaaacaaatattttttgaatggctcctgtggccaggcaaaaatctctaggtgctgggaaaacagagtgaacaaaacaaaattgctttcctcatataaaataaagatgtcttcataagggcatataatacacttcactagcacatcatataactctacactcttagagctatataatatgctagtaagtatacctctagttatataattggttttttcttcactaaatttataattaggatgtctgtaaaaccatatagagtataatcacgttgagagcttttcctagaattaatgtgttgtattagatttgaagaactgtaataataacagctacttttgagtgcttaccatatgccacacatagagccaggtgttttacatgtattcacctatttaatccacataacaaccctataagataaagtacttttattgttctcattttacagaagagtaaactgactaatggaaattaaacaatttgtgtggggtctcccagctggttagtagaagagctggaatctgaactcaggcagttcagctccagagtccaccctctggaccactactgtactgcctctcaaagaagtacttctgaaattccaaatcagagcctcttgcctgtttgtttaagctcattacccttgaagttagtgagtggcagtaccaaa

SEQ ID NO: 427692 - DNA, 1322 bp, Homo sapiens
cccggggcgggccgcgggaaggggatgagttcgggcgcctgccaggccctgcaggtggccgggtcgcaggccagccgcggaagcggagcggtaaccttacccccggcgacagccgccggtcagctgccagagtgtggcgctcccggtggacgcaggggccgggtttcgggcagtctcggcctccaggaggcgcgtcttggtccagggtccgtgaggactggctagatgggggctgcgtggcctttggtggcagggaggaggagggggtctccgaggcgggagaggcgggtttgggaaggaaggtgcgccaggctgaagctggggtcggagaagtgttgggtggagacctcactgtgggtgcgttcctcctctcctctccccaaaacgatggtgttaaaagctagggtcaggatgtggagcgctgcctgggcctcttcctttccgatggttatggagaatgagcctacttcctggacccaaaatccttttcttctgttactcatttatgttggttttaaaaggagctttggggcagagcttacttgttgcctcctacgagagcgcctcattttagaactcgtttcttccactacttccctctttgcagccccctcggaaaaccacactgagagttgcattaaaaaccagcatagtctcactgtcgcccaggctgcagtgcagtggtgccatcacgcgtcactgcaacctctgcctcccggattcaagcaattctccacctcagcctcccaagtagctggaattacagatatggctcgtggacagcagaaaattcagtctcagcagaaaaatgccaaaaagcaagctggacaaaagaagaaacaaggacatgaccaaaaggctgctgccaaagctgccttaatatatacctgcactgtctgtaggacacaaatgccagaccctaagaccttcaagcagcactttgagagcaagcatcctaagactccacttcctccagaattagctgatgttcaggcataaggttgtttacaggtgaattcatgacacctttgactcttctactgtctcagaccttaggtaacatacctgcagctgcttttctaacaaactgttgatcagcaaaaataaaggggctacagaaacactcatttttatgctgttccctcttgggcttcatgcaaagacaattctgtgtaaatgtacagttgactctgatttggaaatatgaaaatcagtccatccttgttataaaaaatttttttacaattgtaattatattgatgttcatattgtgtaaaataactcatttaataaaatagtactttgatttacgacatcacagg

SEQ ID NO: 427693 - DNA, 769 bp, Homo sapiens
cagaaaggcacatgggcggggctgcgaggagcaggcggggcgggggcgccgaggagagcggcgcggcgtgcgcgggcacgaggcgtagtggtctcccctaaggctgaggcggcggcgggcgcgcgaggctgttgtgctcccggctctcgtgtttcccctcctgagcgggtggaggaggcccaagcggtgctgggcgcgctcccccttcctttccctccggcgtcctctcccggccctctcgcgctgcactgtctctccgacgcaagactgtcccggcccggatatggctcgtggacagcagaaaattcagtctcagcagaaaaatgccaaaaagcaagctggacaaaagaagaaacaaggacatgaccaaaaggctgctgccaaagctgccttaatatatacctgcactgtctgtaggacacaaatgccagaccctaagaccttcaagcagcactttgagagcaagcatcctaagactccacttcctccagaattagctgatgttcaggcataaggttgtttacagctaacaaactgttgatcagcaaaaataaaggggctacagaaacactcatttttatgctgttccctcttgggcttcatgcaaagacaattctgtgtaaatgtacagttgactctgatttggaaatatgaaaatcagtccatccttgttataaaaaatttttttacaattgtaattatattgatgttcatattgtgtaaaataactcatttaataaaatagtactttgatttacgacatcacagg

SEQ ID NO: 427694 - DNA, 547 bp, Homo sapiens
  misc_feature (19)..(19): n is a, c, g, or t
acccgtgatgttatccccnacacttctccgaccccagcttcagcctggcgcaccttccttcccaaaacgatggtgttaaaagctagggtcaggatgtggagcgctgcctgggcctcttcctttccgatggttatggagaatgagcctacttcctggacccaaaatccttttcttctgttactcatttatgttggttttaaaaggagctttggggcagagcttacttgttgcctcctacgagagcgcctcattttagaactcgtttcttccactacttccctctttgcagccccctcggaaaaccacactgagagttgcattaaaaaccagcatgtaggtatttgtaagtgactttttccctccagtttgtcgcatttaatcaaggagcggttgtagctgcctacgattttgtagaaaattgtgttggcttgagagcaagatcctatagttgagctgtccggcgtgttgtcagaagttaggggcctacctcatgcatttagcttattttattccatttcctttacctggtgttaagttttctgtcttc

SEQ ID NO: 427695 - DNA, 885 bp, Homo sapiens
ccaggttctcagtgaggttcaaggagaacagtgtggctgtcaaggtcgtccagggccctgcaggtggtgacaacagcaagctacgctacaaaaaaaaggggagtcattgcttgcaggagcaccggcagcaccagtgtgtgaggggagcaggcagcggtcctagccagttccttgatcctgccagaccacccagcccccggcacagagctgctccacaggcaccatgaggatcatgctgctattcacagccatcctggccttcagcctagctcagagctttggggctgtctgtaaggagccacaggaggaggtggttcctggcgggggccgcagcaagagggatccagatctctaccagctgctccagagactcttcaaaagccactcatctctggagggattgctcaaagccctgagccaggctagcacagatcctaaggaatcaacatctcccgagaaacgtgacatgcatgacttctttgtgggacttatgggcaagaggagcgtccagccagactctcctacggatgtgaatcaagagaacgtccccagctttggcatcctcaagtatcccccgagagcagaataggtactccacttccggactcctggactgcattaggaagacctctttccctgtcccaatccccaggtgcgcacgctcctgttaccctttctcttccctgttcttgtaacattcttgtgctttgactccttctccatcttttctacctgaccctggtgtggaaactgcatagtgaatatccccaaccccaatgggcattgactgtagaataccctagagttcctgtagtgtcctacattaaaaatataatgtctctctctattcctcaacaataaaggatttttgcatatgaatgatgt

SEQ ID NO: 427696 - DNA, 824 bp, Homo sapiens
gactgagtgactgcagccttcctagatcccctccactcggtttctctctttgcaggagcaccggcagcaccagtgtgtgaggggagcaggcagcggtcctagccagttccttgatcctgccagaccacccagcccccggcacagagctgctccacaggcaccatgaggatcatgctgctattcacagccatcctggccttcagcctagctcagagctttggggctgtctgtaaggagccacaggaggaggtggttcctggcgggggccgcagcaagagggatccagatctctaccagctgctccagagactcttcaaaagccactcatctctggagggattgctcaaagccctgagccaggctagcacagatcctaaggaatcaacatctcccgagaaacgtgacatgcatgacttctttgtgggacttatgggcaagaggagcgtccagccagactctcctacggatgtgaatcaagagaacgtccccagctttggcatcctcaagtatcccccgagagcagaataggtactccacttccggactcctggactgcattaggaagacctctttccctgtcccaatccccaggtgcgcacgctcctgttaccctttctcttccctgttcttgtaacattcttgtgctttgactccttctccatcttttctacctgaccctggtgtggaaactgcatagtgaatatccccaaccccaatgggcattgactgtagaataccctagagttcctgtagtgtcctacattaaaaatataatgtctctctctattcctcaacaataaaggatttttgcatatgaatgatgt

SEQ ID NO: 427697 - DNA, 195 bp, Homo sapiens
aattgtgtatttatagggataccttcctcttctcacatattaattgtatgtcattaaaatcagttggctatgtcagtgtatattattctatttacttgctcattttcatgatttaaatgttaatatagcatctcaaaccttgctagcaaaagaggtgaataatacgtcgacgcggacgggaatttagtagtagta

SEQ ID NO: 427698 - DNA, 459 bp, Homo sapiens
aattgtgtatttatagggataccttcctcttctcacatattaattgtatgtcattaaaatcagttggctatgtcagtgtatattattcacctcttttgctagcaaggtttgagatgctatattaacatttaaatcatgaaaatgagcaagtaaatagaataatattttattaatgtatgatatgtaatacttattgtctaaatcaagtttcctatttttggtttatttattttagaagaaaaataaaattatttgggcatttttgtttatagctcattacaaactagagtgatgaatatatatatttactaaagctaattgaaagagtcatgcaactcagttgggaattaaccactcaattcaatagtaaaagccatgcttggatgtttcttttgcatgttgcctagcattttatagatatttattatttaaaaaaataaagatatgtttttaatgaag

SEQ ID NO: 427699 - DNA, 3393 bp, Homo sapiens
tgggatatgggatattgtaatgggagagcaggaaatttaaggtcggaggtatttgtttaggatacctcagtattctagagctatgggatttattttgctttgaagtccagaggtatttagctttattctaaaagcgatgaagttcctcttaattaaagacgctcctggaaaaaaaaaaaggaaaaatttaatgctgtcttttaaaaggaaacatgccaaaggccaggatttgtttgatcagattgtgtaccacttggaccttgtggaaacagattactttggcctccagttcctcgactctgcccaggttgcgcactggctggatcatgccaaacccataaaaaagcagatgaaaattggacctgcttatgctttacactttcgagttaaatactattcttcagaaccaaacaaccttcgtgaggagtttacaaggtacctgtttgttttacaactcaggcatgacattctttctggaaaattgaaatgcccttatgaaacagctgtggaattagctgctctctgtctacaagcggagcttggggagtgcgagcttccagaacacacaccagagcttgtgtctgagtttcggttcattccaaatcagacagaagcaatggaatttgatatcttccagagatggaaagagtgcaggggaaagagccctgcccaggcggaactctcctatctgaataaagcgaagtggctggaaatgtatggggtagacatgcacgttgtcaggggaagagatggctgtgaatattctcttggactgaccccgacaggcatattaatctttgaaggagctaacaaaataggcttattcttttggcctaaaattaccaaaatggattttaaaaagagcaaattgacactcgtggtggtcgaggatgatgatcagggacgtgagcaagagcacacgtttgtgttccggttagacagtgccaggacctgcaaacacctttggaagtgtgcagttgagcaccacgcattcttccgactgcggacgccaggaaacagcaaatccaatagatccgactttatcaggctgggctctcgcttcagattcagtgggcggacagaatatcaagctacacatggctccaggttacgaagaaccagcacctttgagaggaagcctagtaaacgttatccatcccggagacattcaacgttcaaagcaagcaacccagtgatagcagcccagctctgctctaaaacaaatccagaagtccataattaccagcctcaatatcatcctaatatccatcccagccagccccggtggcatcctcactctccaaatgtcaggccatcctttcaggatgacaggtcgcattggaaagcatcggccagtggagatgacagccattttgattatgtccacgaccagaaccagaagaacttaggagggatgcaaagtatgatgtatcgagataaactcatgactgcactttgagagactgaagcatctctcttccattcaccttcatagtttcattgcattccatgaaaagtgtcttggcctcagatggatggatgtgtttggacgagtgtctttaaggagtagtcctgaaaggtgtttttggtgtccatgtaaatatttgaagataaaaccactatagcttgtcataatttactgttgactgcattctcattaaaatgaaggtaaaggctcaggaatcatattgatgttctgattttaaaattggagtcaaagtctatgtttatcattttactatgttcctgatgttctttgttatttaattaatgggagcaaataaaaccagaagagcttgggaagattgctcagcatatattcctgtcgtagaagttgagattgctagggtccagtttccctagtgtggcctggacgagtcatttccccttcattgacctcattttccccatctgaaaagagagggttggactaagtgatctccaaggtcctttccaactctaaaattctgcaatttgttaacatttcattttgtttaggttgaggacatacattcaaactaattttatcacaaggaaaactgcaatacccacttccttgacagagttactcctttcagaagctaaataaagtatataacttattagatgttatatagatacagggggactttgaatttcacatcttaaagcagttgagctactttgaatttaagcagtcgtactaatcttaaattgcatagcatttgttttgatcgaatttgctgctcaagtatgggaataatttttaatgtcttaatgattggtgctgctaacttgcgtgatttcagaagacataattgtgaatacacactgtcagaattgggggattggtttttaccctagacttcactcttaaaaagcaacgtgcaatcaagatcatttatggctcaaatgaaagcatataaggttttcttgaagttgtgccaaagcattctgtagagtaggatgagatggttgttgccctagtctgttggtagaaccagaaatcaatatgttgtcttttaggttaaagcttgtaccaaaatatttatttcccccatttcaagccctgagtcaaacatttttttctcttaataatagacctgaaatgttttattagtatttctgtgaaatcagttgattcttgtgccatttttgtatatgtaattgtaattttgcccatgttaggccctctaaaaaatgtttgacatcctttgagatattttattactaaaatctgatcttttttggctactgcaaaaatctattcagcaagaaggtatcagctgcataccttgcacagtggagctgactacctataaactctccctaaggcatttgtttacaggtgtattccattttagcagacgttctgatgctcagtgtatgtgctgcatacaaataaatgtgttctgaatcttttcatcttattgatagcatttttacaaatgtgtttccaaggaataaagattattcttgctttttttttgactccatcttcattttttttaaattgattcttgttgctatgcagaagtctcatttgtgaatgaccttggtaacagaacagttggcttttggaagtctgaaggtgagcattcagttaggtgggtggagcaagatcatcctagaatgaggctgctcttggcaagagtggatcttataggcacagcagctgatgcctttcttcatctggggcaactctggtgaaggttgtcctgcctgtcacaggtgctgagtagagagaagtggtggcagtgggatttcctcagtaatagtcctgtaaaggtacgtgtttgtcctggctacttgtgctcttcctggcaggaaggcatccaaacccttatctgtgggctcctggaaattgtgtatgccatataataccctctaataaatacctctctgcttaaagta

SEQ ID NO: 427700 - DNA, 3272 bp, Homo sapiens
cacatctccgccgccggcgccgccaaggccaccctctactgccgcgtcttcctgctcgacgggaccgaagtgagcgtggacctgccgaaacatgccaaaggccaggatttgtttgatcagattgtgtaccacttggaccttgtggaaacagattactttggcctccagttcctcgactctgcccaggttgcgcactggctggatcatgccaaacccataaaaaagcagatgaaaattggacctgcttatgctttacactttcgagttaaatactattcttcagaaccaaacaaccttcgtgaggagtttacaaggtacctgtttgttttacaactcaggcatgacattctttctggaaaattgaaatgcccttatgaaacagctgtggaattagctgctctctgtctacaagcggagcttggggagtgcgagcttccagaacacacaccagagcttgtgtctgagtttcggttcattccaaatcagacagaagcaatggaatttgatatcttccagagatggaaagagtgcaggggaaagagccctgcccaggcggaactctcctatctgaataaagcgaagtggctggaaatgtatggggtagacatgcacgttgtcaggggaagagatggctgtgaatattctcttggactgaccccgacaggcatattaatctttgaaggagctaacaaaataggcttattcttttggcctaaaattaccaaaatggattttaaaaagagcaaattgacactcgtggtggtcgaggatgatgatcagggacgtgagcaagagcacacgtttgtgttccggttagacagtgccaggacctgcaaacacctttggaagtgtgcagttgagcaccacgcattcttccgactgcggacgccaggaaacagcaaatccaatagatccgactttatcaggctgggctctcgcttcagattcagtgggcggacagaatatcaagctacacatggctccaggttacgaagaaccagcacctttgagaggaagcctagtaaacgttatccatcccggagacattcaacgttcaaagcaagcaacccagtgatagcagcccagctctgctctaaaacaaatccagaagtccataattaccagcctcaatatcatcctaatatccatcccagccagccccggtggcatcctcactctccaaatgtcaggccatcctttcaggatgacaggtcgcattggaaagcatcggccagtggagatgacagccattttgattatgtccacgaccagaaccagaagaacttaggagggatgcaaagtatgatgtatcgagataaactcatgactgcactttgagagactgaagcatctctcttccattcaccttcatagtttcattgcattccatgaaaagtgtcttggcctcagatggatggatgtgtttggacgagtgtctttaaggagtagtcctgaaaggtgtttttggtgtccatgtaaatatttgaagataaaaccactatagcttgtcataatttactgttgactgcattctcattaaaatgaaggtaaaggctcaggaatcatattgatgttctgattttaaaattggagtcaaagtctatgtttatcattttactatgttcctgatgttctttgttatttaattaatgggagcaaataaaaccagaagagcttgggaagattgctcagcatatattcctgtcgtagaagttgagattgctagggtccagtttccctagtgtggcctggacgagtcatttccccttcattgacctcattttccccatctgaaaagagagggttggactaagtgatctccaaggtcctttccaactctaaaattctgcaatttgttaacatttcattttgtttaggttgaggacatacattcaaactaattttatcacaaggaaaactgcaatacccacttccttgacagagttactcctttcagaagctaaataaagtatataacttattagatgttatatagatacagggggactttgaatttcacatcttaaagcagttgagctactttgaatttaagcagtcgtactaatcttaaattgcatagcatttgttttgatcgaatttgctgctcaagtatgggaataatttttaatgtcttaatgattggtgctgctaacttgcgtgatttcagaagacataattgtgaatacacactgtcagaattgggggattggtttttaccctagacttcactcttaaaaagcaacgtgcaatcaagatcatttatggctcaaatgaaagcatataaggttttcttgaagttgtgccaaagcattctgtagagtaggatgagatggttgttgccctagtctgttggtagaaccagaaatcaatatgttgtcttttaggttaaagcttgtaccaaaatatttatttcccccatttcaagccctgagtcaaacatttttttctcttaataatagacctgaaatgttttattagtatttctgtgaaatcagttgattcttgtgccatttttgtatatgtaattgtaattttgcccatgttaggccctctaaaaaatgtttgacatcctttgagatattttattactaaaatctgatcttttttggctactgcaaaaatctattcagcaagaaggtatcagctgcataccttgcacagtggagctgactacctataaactctccctaaggcatttgtttacaggtgtattccattttagcagacgttctgatgctcagtgtatgtgctgcatacaaataaatgtgttctgaatcttttcatcttattgatagcatttttacaaatgtgtttccaaggaataaagattattcttgctttttttttgactccatcttcattttttttaaattgattcttgttgctatgcagaagtctcatttgtgaatgaccttggtaacagaacagttggcttttggaagtctgaaggtgagcattcagttaggtgggtggagcaagatcatcctagaatgaggctgctcttggcaagagtggatcttataggcacagcagctgatgcctttcttcatctggggcaactctggtgaaggttgtcctgcctgtcacaggtgctgagtagagagaagtggtggcagtgggatttcctcagtaatagtcctgtaaaggtacgtgtttgtcctggctacttgtgctcttcctggcaggaaggcatccaaacccttatctgtgggctcctggaaattgtgtatgccatataataccctctaataaatacctctctgcttaaagta

SEQ ID NO: 427701 - DNA, 3069 bp, Homo sapiens
gacgaagcaaaataacgcttcgtggacggagttgtaccagatggtgatcctgttgatagtttggacaatcagtcatggtcgatcatcaacttacgtttcctggtatacagatagataagtgcccttgtaatgacatacaggctgtaggaaatatcacgctgcgtctctagtctacacaggtcggaggcattgggtgcggtgctgagcgttccaggaaagtactcaccaggagtcttgttcgtctgagaggtttcagagttcgattccagaatttacagacatgaacgcaaccggaactgtgagtatcttccagagatggaaagagtgcaggggaaagagccctgcccaggcggaactctcctatctgaataaagcgaagtggctggaaatgtatggggtagacatgcacgttgtcaggggaagagatggctgtgaatattctcttggactgaccccgacaggcatattaatctttgaaggagctaacaaaataggcttattcttttggcctaaaattaccaaaatggattttaaaaagagcaaattgacactcgtggtggtcgaggatgatgatcagggacgtgagcaagagcacacgtttgtgttccggttagacagtgccaggacctgcaaacacctttggaagtgtgcagttgagcaccacgcattcttccgactgcggacgccaggaaacagcaaatccaatagatccgactttatcaggctgggctctcgcttcagattcagtgggcggacagaatatcaagctacacatggctccaggttacgaagaaccagcacctttgagaggaagcctagtaaacgttatccatcccggagacattcaacgttcaaagcaagcaacccagtgatagcagcccagctctgctctaaaacaaatccagaagtccataattaccagcctcaatatcatcctaatatccatcccagccagccccggtggcatcctcactctccaaatgtcaggccatcctttcaggatgacaggtcgcattggaaagcatcggccagtggagatgacagccattttgattatgtccacgaccagaaccagaagaacttaggagggatgcaaagtatgatgtatcgagataaactcatgactgcactttgagagactgaagcatctctcttccattcaccttcatagtttcattgcattccatgaaaagtgtcttggcctcagatggatggatgtgtttggacgagtgtctttaaggagtagtcctgaaaggtgtttttggtgtccatgtaaatatttgaagataaaaccactatagcttgtcataatttactgttgactgcattctcattaaaatgaaggtaaaggctcaggaatcatattgatgttctgattttaaaattggagtcaaagtctatgtttatcattttactatgttcctgatgttctttgttatttaattaatgggagcaaataaaaccagaagagcttgggaagattgctcagcatatattcctgtcgtagaagttgagattgctagggtccagtttccctagtgtggcctggacgagtcatttccccttcattgacctcattttccccatctgaaaagagagggttggactaagtgatctccaaggtcctttccaactctaaaattctgcaatttgttaacatttcattttgtttaggttgaggacatacattcaaactaattttatcacaaggaaaactgcaatacccacttccttgacagagttactcctttcagaagctaaataaagtatataacttattagatgttatatagatacagggggactttgaatttcacatcttaaagcagttgagctactttgaatttaagcagtcgtactaatcttaaattgcatagcatttgttttgatcgaatttgctgctcaagtatgggaataatttttaatgtcttaatgattggtgctgctaacttgcgtgatttcagaagacataattgtgaatacacactgtcagaattgggggattggtttttaccctagacttcactcttaaaaagcaacgtgcaatcaagatcatttatggctcaaatgaaagcatataaggttttcttgaagttgtgccaaagcattctgtagagtaggatgagatggttgttgccctagtctgttggtagaaccagaaatcaatatgttgtcttttaggttaaagcttgtaccaaaatatttatttcccccatttcaagccctgagtcaaacatttttttctcttaataatagacctgaaatgttttattagtatttctgtgaaatcagttgattcttgtgccatttttgtatatgtaattgtaattttgcccatgttaggccctctaaaaaatgtttgacatcctttgagatattttattactaaaatctgatcttttttggctactgcaaaaatctattcagcaagaaggtatcagctgcataccttgcacagtggagctgactacctataaactctccctaaggcatttgtttacaggtgtattccattttagcagacgttctgatgctcagtgtatgtgctgcatacaaataaatgtgttctgaatcttttcatcttattgatagcatttttacaaatgtgtttccaaggaataaagattattcttgctttttttttgactccatcttcattttttttaaattgattcttgttgctatgcagaagtctcatttgtgaatgaccttggtaacagaacagttggcttttggaagtctgaaggtgagcattcagttaggtgggtggagcaagatcatcctagaatgaggctgctcttggcaagagtggatcttataggcacagcagctgatgcctttcttcatctggggcaactctggtgaaggttgtcctgcctgtcacaggtgctgagtagagagaagtggtggcagtgggatttcctcagtaatagtcctgtaaaggtacgtgtttgtcctggctacttgtgctcttcctggcaggaaggcatccaaacccttatctgtgggctcctggaaattgtgtatgccatataataccctctaataaatacctctctgcttaaagta

SEQ ID NO: 427702 - DNA, 2841 bp, Homo sapiens
cacatctccgccgccggcgccgccaaggccaccctctactgccgcgtcttcctgctcgacgggaccgaagtgagcgtggacctgccgaaacatgccaaaggccaggatttgtttgatcagattgtgtaccacttggaccttgtggaaacagattactttggcctccagttcctcgactctgcccaggttgcgcactggctggatcatgccaaacccataaaaaagcagatgaaaattggacctgcttatgctttacactttcgagttaaatactattcttcagaaccaaacaaccttcgtgaggagtttacaaggtacctgtttgttttacaactcaggcatgacattctttctggaaaattgaaatgcccttatgaaacagctgtggaattagctgctctctgtctacaagcggagcttggggagtgcgagcttccagaacacacaccagagcttgtgtctgagtttcggttcattccaaatcagacagaagcaatggaatttgatatcttccagagatggaaagagtgcaggggaaagagccctgcccaggcggaactctcctatctgaataaagcgaagtggctggaaatgtatggggtagacatgcacgttgtcaggggaagagatggctgtgaatattctcttggactgaccccgacaggcatattaatctttgaaggagctaacaaaataggcttattcttttggcctaaaattaccaaaatggattttaaaaagagcaaattgacactcgtggtggtcgaggatgatgatcagggacgtgagcaagagcacacgtttgtgttccggttagacagtgccaggacctgcaaacacctttggaagtgtgcagttgagcaccacgcattcttccgactgcggacgccaggaaacagcaaatccaatagatccgactttatcaggctgggctctcgcttcagattcagtgggcggacagaatatcaagctacacatggctccaggttacgaagaaccagcacctttgagaggaagcctagtaaacgttatccatcccggagacattcaacgttcaaagcaagcaacccagtgatagcagcccagctctgctctaaaacaaatccagaagtccataattaccagcctcaatatcatcctaatatccatcccagccagccccggtggcatcctcactctccaaatgtcaggccatcctttcaggatgacaggtcgcattggaaagcatcggccagtggagatgacagccattttgattatgtccacgaccagaaccagaagaacttaggagggatgcaaagtatgatgtatcgagataaactcatgactgcactttgagagactgaagcatctctcttccattcaccttcatagtttcattgcattccatgaaaagtgtcttggcctcagatggatggatgtgtttggacgagtgtctttaaggagtagtcctgaaaggtgtttttggtgtccatgtaaatatttgaagataaaaccactatagcttgtcataatttactgttgactgcattctcattaaaatgaaggtaaaggctcaggaatcatattgatgttctgattttaaaattggagtcaaagtctatgtttatcattttactatgttcctgatgttctttgttatttaattaatgggagcaaataaaaccagaagagcttgggaagattgctcagcatatattcctgtcgtagaagttgagattgctagggtccagtttccctagtgtggcctggacgagtcatttccccttcattgacctcattttccccatctgaaaagagagggttggactaagtgatctccaaggtcctttccaactctaaaattctgcaatttgttaacatttcattttgtttaggttgaggacatacattcaaactaattttatcacaaggaaaactgcaatacccacttccttgacagagttactcctttcagaagctaaataaagtatataacttattagatgttatatagatacagggggactttgaatttcacatcttaaagcagttgagctactttgaatttaagcagtcgtactaatcttaaattgcatagcatttgttttgatcgaatttgctgctcaagtatgggaataatttttaatgtcttaatgattggtgctgctaacttgcgtgatttcagaagacataattgtgaatacacactgtcagaattgggggattggtttttaccctagacttcactcttaaaaagcaacgtgcaatcaagatcatttatggctcaaatgaaagcatataaggttttcttgaagttgtgccaaagcattctgtagagtaggatgagatggttgttgccctagtctgttggtagaaccagaaatcaatatgttgtcttttaggttaaagcttgtaccaaaatatttatttcccccatttcaagccctgagtcaaacatttttttctcttaataatagacctgaaatgttttattagtatttctgtgaaatcagttgattcttgtgccatttttgtatatgtaattgtaattttgcccatgttaggccctctaaaaaatgtttgacatcctttgagatattttattactaaaatctgatcttttttggctactgcaaaaatctattcagcaagaaggtatcagctgcataccttgcacagtggagctgactacctataaactctccctaaggcatttgtttacaggtgtattccattttagcagacgttctgatgctcagtgtatgtgctgcatacaaataaatgtgttctgaatcttttcatcttattgatagcatttttacaaatgtgtttccaaggaataaagattattcttgcttt

SEQ ID NO: 427703 - DNA, 3352 bp, Homo sapiens
cacatctccgccgccggcgccgccaaggccaccctctactgccgcgtcttcctgctcgacgggaccgaagtgagcgtggacctgccgaaacatgccaaaggccaggatttgtttgatcagattgtgtaccacttggaccttgtggaaacagattactttggcctccagttcctcgactctgcccaggttgcgcactggctggatcatgccaaacccataaaaaagcagatgaaaattggacctgcttatgctttacactttcgagttaaatactattcttcagaaccaaacaaccttcgtgaggagtttacaaggtacctgtttgttttacaactcaggcatgacattctttctggaaaattgaaatgcccttatgaaacagctgtggaattagctgctctctgtctacaagcggagcttggggagtgcgagcttccagaacacacaccagagcttgtgtctgagtttcggttcattccaaatcagacagaagcaatggaatttgatatcttccagagatggaaagagtgcaggggaaagagccctgcccaggcggaactctcctatctgaataaagcgaagtggctggaaatgtatggggtagacatgcacgttgtcaggggaagagatggctgtgaatattctcttggactgaccccgacaggcatattaatctttgaaggagctaacaaaataggcttattcttttggcctaaaattaccaaaatggattttaaaaagagcaaattgacactcgtggtggtcgaggatgatgatcagggacgtgagcaagagcacacgtttgtgttccggttagacagtgccaggacctgcaaacacctttggaagtgtgcagttgagcaccacgcattcttccgactgcggacgccaggaaacagcaaatccaatagatccgactttatcaggctgggctctcgcttcagattcaggtagggagccatttctgcaacacggatcacgtcttctgaaggagggcaactgtgatttctttcttgtatgcgaatagagtagtggatttgagtccagaaacttaggttgtgtgtcccatccccacgtttcttaagtgggcggacagaatatcaagctacacatggctccaggttacgaagaaccagcacctttgagaggaagcctagtaaacgttatccatcccggagacattcaacgttcaaagcaagcaacccagtgatatgcagcccagctctggtcttccagacaggcccggtggcatactcactcttcaaatgtcgccatcctttcaggatgacaggtcgcattggaaagcatcggccagtggagatgacagccattttgattatgtccacgaccagaaccagaagaacttaggagggatgcaaagtatgatgtatcgagataaactcatgactgcactttgagagactgaagcatctctcttccattcaccttcatagtttcattgcattccatgaaaagtgtcttggcctcagatggatggatgtgtttggacgagtgtctttaaggagtagtcctgaaaggtgtttttggtgtccatgtaaatatttgaagataaaaccactatagcttgtcataatttactgttgactgcattctcattaaaatgaaggtaaaggctcaggaatcatattgatgttctgattttaaaattggagtcaaagtctatgtttatcattttactatgttcctgatgttctttgttatttaattaatgggagcaaataaaaccagaagagcttgggaagattgctcagcatatattcctgtcgtagaagttgagattgctagggtccagtttccctagtgtggcctggacgagtcatttccccttcattgacctcattttccccatctgaaaagagagggttggactaagtgatctccaaggtcctttccaactctaaaattctgcaatttgttaacatttcattttgtttaggttgaggacatacattcaaactaattttatcacaaggaaaactgcaatacccacttccttgacagagttactcctttcagaagctaaataaagtatataacttattagatgttatatagatacagggggactttgaatttcacatcttaaagcagttgagctactttgaatttaagcagtcgtactaatcttaaattgcatagcatttgttttgatcgaatttgctgctcaagtatgggaataatttttaatgtcttaatgattggtgctgctaacttgcgtgatttcagaagacataattgtgaatacacactgtcagaattgggggattggtttttaccctagacttcactcttaaaaagcaacgtgcaatcaagatcatttatggctcaaatgaaagcatataaggttttcttgaagttgtgccaaagcattctgtagagtaggatgagatggttgttgccctagtctgttggtagaaccagaaatcaatatgttgtcttttaggttaaagcttgtaccaaaatatttatttcccccatttcaagccctgagtcaaacatttttttctcttaataatagacctgaaatgttttattagtatttctgtgaaatcagttgattcttgtgccatttttgtatatgtaattgtaattttgcccatgttaggccctctaaaaaatgtttgacatcctttgagatattttattactaaaatctgatcttttttggctactgcaaaaatctattcagcaagaaggtatcagctgcataccttgcacagtggagctgactacctataaactctccctaaggcatttgtttacaggtgtattccattttagcagacgttctgatgctcagtgtatgtgctgcatacaaataaatgtgttctgaatcttttcatcttattgatagcatttttacaaatgtgtttccaaggaataaagattattcttgctttttttttgactccatcttcattttttttaaattgattcttgttgctatgcagaagtctcatttgtgaatgaccttggtaacagaacagttggcttttggaagtctgaaggtgagcattcagttaggtgggtggagcaagatcatcctagaatgaggctgctcttggcaagagtggatcttataggcacagcagctgatgcctttcttcatctggggcaactctggtgaaggttgtcctgcctgtcacaggtgctgagtagagagaagtggtggcagtgggatttcctcagtaatagtcctgtaaaggtacgtgtttgtcctggctacttgtgctcttcctggcaggaaggcatccaaacccttatctgtgggctcctggaaattgtgtatgccatataataccctctaataaatacctctctgcttaaagta

SEQ ID NO: 427704 - DNA, 1810 bp, Homo sapiens
cacatctccgccgccggcgccgccaaggccaccctctactgccgcgtcttcctgctcgacgggaccgaagtgagcgtggacctgccgaaacatgccaaaggccaggatttgtttgatcagattgtgtaccacttggaccttgtggaaacagattactttggcctccagttcctcgactctgcccaggttgcgcactggctggatcatgccaaacccataaaaaagcagatgaaaattggacctgcttatgctttacactttcgagttaaatactattcttcagaaccaaacaaccttcgtgaggagtttacaaggtacctgtttgttttacaactcaggcatgacattctttctggaaaattgaaatgcccttatgaaacagctgtggaattagctgctctctgtctacaagcggagcttggggagtgcgagcttccagaacacacaccagagcttgtgtctgagtttcggttcattccaaatcagacagaagcaatggaatttgatatcttccagagatggaaagagtgcaggggaaagagccctgcccaggcggaactctcctatctgaataaagcgaagtggctggaaatgtatggggtagacatgcacgttgtcaggggaagagatggctgtgaatattctcttggactgaccccgacaggcatattaatctttgaaggagctaacaaaataggcttattcttttggcctaaaattaccaaaatggattttaaaaagagcaaattgacactcgtggtggtcgaggatgatgatcagggacgtgagcaagagcacacgtttgtgttccggttagacagtgccaggacctgcaaacacctttggaagtgtgcagttgagcaccacgcattcttccgactgcggacgccaggaaacagcaaatccaatagatccgactttatcaggctgggctctcgcttcagattcagtgggcggacagaatatcaagctacacatggctccaggttacgaagaaccagcacctttgagaggaagcctagtaaacgttatccatcccggagacattcaacgttcaaagcaagcaacccagtgatagcagcccagctctgctctaaaacaaatccagaagtccataattaccagcctcaatatcatcctaatatccatcccagccagccccggtggcatcctcactctccaaatgtcaggccatcctttcaggatgacaggtcgcattggaaagcatcggccagtggagatgacagccattttgattatgtccacgaccagaaccagaagaacttaggagggatgcaaagtatgatgtatcgagataaactcatgactgcactttgagagactgaagcatctctcttccattcaccttcatagtttcattgcattccatgaaaagtgtcttggcctcagatggatggatgtgtttggacgagtgtctttaaggagtagtcctgaaaggtgtttttggtgtccatgtaaatatttgaagataaaaccactatagcttgtcataatttactgttgactgcattctcattaaaatgaaggtaaaggctcaggaatcatattgatgttctgattttaaaattggagtcaaagtctatgtttatcattttactatgttcctgatgttctttgttatttaattaatgggagcaaataaaaccagaagagcttgggaagattgctcagcatatattcctgtcgtagaagttgagattgctagggtccagtttccctagtgtggcctggtcgtggagtatccccttaacacaggtattttacaccgcaataagaatagcgagtcgtg

SEQ ID NO: 427705 - DNA, 361 bp, Homo sapiens
ccaggcggaactctcctatctgaataaagcgaagtggctggaaatgtatggggtagacatgcacgttgtcagggtaagaactgtgtgcgtttaagtaatttggttttgctgttactgaaaaatgtatgaacattatgcaaacaaaataacttgtggtgaggaaactgtttttgcattttgcattctgctgtgtgacgacctgttagaaccctctaccgattgtcacttcgtttgtttgtagggaagagatggctgtgaatattctcttggactgaccccgacaggcatattaatctttgaaggagctaacaaaataggcttattcttttggtaatttagttttgtctaatattaaaaatgt

SEQ ID NO: 427706 - DNA, 271 bp, Homo sapiens
gaagtccagaggtatttagctttattctaaaagcgatgaagttcctcttaattaaagacgctcctggaaaaaaaaaaaggaaaaatttaatgctgtcttttaaaagggaaaggattgtatgtactataatagaattactgtaacatgtcgtttattaactcgcttcagggaatgagctcttccacataggtaagttttccagatagttacagttgcatccatttactgacaagaactgttttatttcagctatttcatttatttcttgaag

SEQ ID NO: 427707 - DNA, 3194 bp, Homo sapiens
cctctgcactcccagcctcctggccccttctgtacatgatttccttgtggccactccatgcatttttcttggctcaagacttagtgggcctccatgggacttggtacctctacttgttcccttctggaatctgtaactttgtgttccccaccattctttcctttatgaaccgatggtgcaacagcatgactacctgaaattcttagtcacccccagctgctttagtggagggaaaatgcccacagcacaggaaatagtcctgcccttcgagagaggccaggggatgggagcgtgtccagagaagggcgatgggttgatgaagggtggccacagcgcccgggaggaaggggccagaacgctctctgttctgttccatgaggaggattatgctggtgtgtgtagtccactggttcagagttgtccagaaatagctcagtgtaaggaacaattttccaaagatcaaaagagctgtctcaagatagcagtgcgttcccagcccctacaggtgtatacagcacaaagggagggaccccctggtgtggctgtcacagagggaagtggacgtcctgtggtttgaccccaccagatggctttagagatctgggccccagggtctgtgattctttttcccctccctcttttctctcccttatttcactgacttttttccagccagagttctagcatcttctttgtcaagcttttaatgattttccctgccacatctatccttttaaaaacaaaatggagtgtaagcggctaagctgtacctcattcccagggctctgtccatgcaggccctcacggcgtccccgaggcccctcagtccagacccatgcttatattgcatccctgatcaccgtgtgctgttttcccttttacccacttctctgtatctgcctttctctgtctctagacagggaacttcttgagagcagagactgtgtctctttgtccctgcctcccagagcgcccagccctgggaacctgctgagtggatggttgctgagtgaatcagagggaggggtagtttactctccctgaggaaaggagaagtagccaccatgcagttctgcctgggttggagttggaaaggctctgtgatggtagaagtctcgcatggccattatctgtcattgcatggtgaaagcgataaagtcctctaagatgtcataactttctgtttttcctttatagcaagcaacccagtgatagcagcccagctctggtgagtgtccttgagctctagagcacagctctcctctctaaggatcgtatttatttgcaatgttgactttttccttactacagtgaaatcaggaagtgtgtcatctggtaatttttttcccctttttctgctgcctggctattccatgctcatggctttcaataagtacacaatataatgttccaagacagtttggtttttttggcaaacacagctgctttgtttgagtagctgtgtgctttgtttatgataacagtgggtgggaaaggtagaggcctgtgcgcagcacactgtgctcatggcgtggcaggcagtgctgggagaggaaggccttgctcgcgagcaaaagctggacgagagcagatgctagatttgctcagtgacgtgcaggttttacatcatagaagacattaaacacctttactgaaattcctgcaggaaaatgaacttatcacaagagtgaaaattgccagcacaggattcagcaaacattttctgtaaagggccacatagtccatgtttgagactttgcaggctctgctgtgtctttcacagctactcacctctgctgttgtagctagagagccgctgtggaaaatatgtaaatgagcgaacgtgactgcattccaataaaactttacttataaatatcagtggaccagatttggcccaaggggtatagtttttgcaggcctcttccctggcacaggtgtccagggtcttgcctgtatagtagaatgatctggtgagcataattatctgaaacatcctccgcagccacaccccaggcgcattgaatcagtctctcagggtgggacccatatagcttgtttttaaagctgcccaggtgagtctgcccggcatataccgctcttgctctctctgaaacaactgcctgtcttatgtgagttttggcttgttgagtagacaagctgtcatgtgagagaaccacagacttgcattgtttggacctttggtctgaactgcagccgctggtaggtaggccaggttcattaggctctcagtcatcccaggcgcaggtctcaaggcggctgagagggtggtctttgagatgggcacagcttgactgtgccatgcactatcagtcaggacagttggcaaaacgtggcacggggtggagcgggttgcagataccccggtgagcgaggagagccctggctgaggcatcaggaaccctccctccaggtaccagctgtgttctaacccagctctggagacttaggccttcctacttctgggcctccgttttctgttttgcaaatcaggaggttgggctagatcagtgtttttccaaactgttttaccctctgattttcaccctctagaagaaacctgatgtcaaagcccaaaatacagaacagacaaatgtggaggtcctccggatgaagccgagtggggagggagaggccagttcctgcctgctcttctgccactcctcccaccccgtagctccagggcaccttcaaggaacccagggttctagagaacacagctggtccctcatattacacagctggaaactcaacctcgcatctctgattccaaatcctactttcagcgtcattctgccttttgtctctgggttttgttctcagcatctgatgaaggggctcaggggtcctgttgaactgctctgtgtcgccccctgccccggagggtgggaggaggttgcagtattctggatgggttagttgtaggtccctagattcaccccatttttaggatccttctggcagatagtatgccaaatggtatctgtacctttcttagcttgtcggggtgtcttgcttttaattctctggggcttgtaagttacagccccaatttctttactttgctctctaaggtagtgattgttttgcttgtttctccctaataaaattacattttcctcccagcatctagtggagattatatattgggaaccaaaacaaactaaaaaaaa

SEQ ID NO: 427708 - DNA, 3218 bp, Homo sapiens
cacatctccgccgccggcgccgccaaggccaccctctactgccgcgtcttcctgctcgacgggaccgaagtgagcgtggacctgccgaaacatgccaaaggccaggatttgtttgatcagattgtgtaccacttggaccttgtggaaacagattactttggcctccagttcctcgactctgcccaggttgcgcactggctggatcatgccaaacccataaaaaagcagatgaaaattggacctgcttatgctttacactttcgagttaaatactattcttcagaaccaaacaaccttcgtgaggagtttacaaggtacctgtttgttttacaactcaggcatgacattctttctggaaaattgaaatgcccttatgaaacagctgtggaattagctgctctctgtctacaagcggagcttggggagtgcgagcttccagaacacacaccagagcttgtgtctgagtttcggttcattccaaatcagacagaagcaatggaatttgatatcttccagagatggaaagagtgcaggggaaagagccctgcccaggcggaactctcctatctgaataaagcgaagtggctggaaatgtatggggtagacatgcacgttgtcaggggaagagatggctgtgaatattctcttggactgaccccgacaggcatattaatctttgaaggagctaacaaaataggcttattcttttggcctaaaattaccaaaatggattttaaaaagagcaaattgacactcgtggtggtcgaggatgatgatcagggacgtgagcaagagcacacgtttgtgttccggttagacagtgccaggacctgcaaacacctttggaagtgtgcagttgagcaccacgcattcttccgactgcggacgccaggaaacagcaaatccaatagatccgactttatcaggctgggctctcgcttcagattcagtgggcggacagaatatcaagctacacatggctccaggttacgaagaaccagcacctttgagaggaagcctagtaaacgttatccatcccggagacattcaacgttcaaagcaagcaacccagtgatagcagcccagctctgccatcccagccagccccggtggcatcctcactctccaaatgtcaggccatcctttcaggatgacaggtcgcattggaaagcatcggccagtggagatgacagccattttgattatgtccacgaccagaaccagaagaacttaggagggatgcaaagtatgatgtatcgagataaactcatgactgcactttgagagactgaagcatctctcttccattcaccttcatagtttcattgcattccatgaaaagtgtcttggcctcagatggatggatgtgtttggacgagtgtctttaaggagtagtcctgaaaggtgtttttggtgtccatgtaaatatttgaagataaaaccactatagcttgtcataatttactgttgactgcattctcattaaaatgaaggtaaaggctcaggaatcatattgatgttctgattttaaaattggagtcaaagtctatgtttatcattttactatgttcctgatgttctttgttatttaattaatgggagcaaataaaaccagaagagcttgggaagattgctcagcatatattcctgtcgtagaagttgagattgctagggtccagtttccctagtgtggcctggacgagtcatttccccttcattgacctcattttccccatctgaaaagagagggttggactaagtgatctccaaggtcctttccaactctaaaattctgcaatttgttaacatttcattttgtttaggttgaggacatacattcaaactaattttatcacaaggaaaactgcaatacccacttccttgacagagttactcctttcagaagctaaataaagtatataacttattagatgttatatagatacagggggactttgaatttcacatcttaaagcagttgagctactttgaatttaagcagtcgtactaatcttaaattgcatagcatttgttttgatcgaatttgctgctcaagtatgggaataatttttaatgtcttaatgattggtgctgctaacttgcgtgatttcagaagacataattgtgaatacacactgtcagaattgggggattggtttttaccctagacttcactcttaaaaagcaacgtgcaatcaagatcatttatggctcaaatgaaagcatataaggttttcttgaagttgtgccaaagcattctgtagagtaggatgagatggttgttgccctagtctgttggtagaaccagaaatcaatatgttgtcttttaggttaaagcttgtaccaaaatatttatttcccccatttcaagccctgagtcaaacatttttttctcttaataatagacctgaaatgttttattagtatttctgtgaaatcagttgattcttgtgccatttttgtatatgtaattgtaattttgcccatgttaggccctctaaaaaatgtttgacatcctttgagatattttattactaaaatctgatcttttttggctactgcaaaaatctattcagcaagaaggtatcagctgcataccttgcacagtggagctgactacctataaactctccctaaggcatttgtttacaggtgtattccattttagcagacgttctgatgctcagtgtatgtgctgcatacaaataaatgtgttctgaatcttttcatcttattgatagcatttttacaaatgtgtttccaaggaataaagattattcttgctttttttttgactccatcttcattttttttaaattgattcttgttgctatgcagaagtctcatttgtgaatgaccttggtaacagaacagttggcttttggaagtctgaaggtgagcattcagttaggtgggtggagcaagatcatcctagaatgaggctgctcttggcaagagtggatcttataggcacagcagctgatgcctttcttcatctggggcaactctggtgaaggttgtcctgcctgtcacaggtgctgagtagagagaagtggtggcagtgggatttcctcagtaatagtcctgtaaaggtacgtgtttgtcctggctacttgtgctcttcctggcaggaaggcatccaaacccttatctgtgggctcctggaaattgtgtatgccatataataccctctaataaatacctctctgcttaaagta

SEQ ID NO: 427709 - DNA, 3217 bp, Homo sapiens
cacatctccgccgccggcgccgccaaggccaccctctactgccgcgtcttcctgctcgacgggaccgaagtgagcgtggacctgccgaaacatgccaaaggccaggatttgtttgatcagattgtgtaccacttggaccttgtggaaacagattactttggcctccagttcctcgactctgcccaggttgcgcactggctggatcatgccaaacccataaaaaagcagatgaaaattggacctgcttatgctttacactttcgagttaaatactattcttcagaaccaaacaaccttcgtgaggagtttacaaggtacctgtttgttttacaactcaggcatgacattctttctggaaaattgaaatgcccttatgaaacagctgtggaattagctgctctctgtctacaagcggagcttggggagtgcgagcttccagaacacacaccagagcttgtgtctgagtttcggttcattccaaatcagacagaagcaatggaatttgatatcttccagagatggaaagagtgcaggggaaagagccctgcccaggcggaactctcctatctgaataaagcgaagtggctggaaatgtatggggtagacatgcacgttgtcaggggaagagatggctgtgaatattctcttggactgaccccgacaggcatattaatctttgaaggagctaacaaaataggcttattcttttggcctaaaattaccaaaatggattttaaaaagagcaaattgacactcgtggtggtcgaggatgatgatcagggacgtgagcaagagcacacgtttgtgttccggttagacagtgccaggacctgcaaacacctttggaagtgtgcagttgagcaccacgcattcttccgactgcggacgccaggaaacagcaaatccaatagatccgactttatcaggctgggctctcgcttcagattcagtgggcggacagaatatcaagctacacatggctccaggttacgaagaaccagcacctttgagaggaagcctagtaaacgttatccatcccggagacattcaacgttcaaagcaagcaacccagtgatagcagcccagctctgctctaaaacaaatccagaagtccataattaccagcctcaatatcatcctaatatccatcccagccagccccggtggcatcctcactctccaaatgtcaggccatcctttcaggatgacaggtcgcattggaaagcatcggccagtggagatgacagccattttgattatgtccacgaccagaaccagaagaacttaggagggatgcaaagtatgatgtatcgagataaactcatgactgcactttgagagactgaagcatctctcttccattcaccttcatagtttcattgcattccatgaaaagtgtcttggcctcagatggatggatgtgtttggacgagtgtctttaaggagtagtcctgaaaggtgtttttggtgtccatgtaaatatttgaagataaaaccactatagcttgtcataatttactgttgactgcattctcattaaaatgaaggtaaaggctcaggaatcatattgatgttctgattttaaaattggagtcaaagtctatgtttatcattttactatgttcctgatgttctttgttatttaattaatgggagcaaataaaaccagaagagcttgggaagattgctcagcatatattcctgtcgtagaagttgagattgctagggtccagtttccctagtgtggcctggacgagtcatttccccttcattgacctcattttccccatctgaaaagagagggttggactaagtgatctccaaggtcctttccaactctaaaattctgcaatttgttaacatttcattttgtttaggttgaggacatacattcaaactaattttatcacaaggaaaactgcaatacccacttccttgacagagttactcctttcagaagctaaataaagtatataacttattagatgttatatagatacagggggactttgaatttcacatcttaaagcagttgagctactttgaatttaagcagtcgtactaatcttaaattgcatagcatttgttttgatcgaatttgctgctcaagtatgggaataatttttaatgtcttaatgattggtgctgctaacttgcgtgatttcagaagacataattgtgaatacacactgtcagaattgggggattggtttttaccctagacttcactcttaaaaagcaacgtgcaatcaagatcatttatggctcaaatgaaagcatataaggttttcttgaagttgtgccaaagcattctgtagagtaggatgagatggttgttgccctagtctgttggtagaaccagaaatcaatatgttgtcttttaggttaaagcttgtaccaatagacctgaaatgttttattagtatttctgtgaaatcagttgattcttgtgccatttttgtatatgtaattgtaattttgcccatgttaggccctctaaaaaatgtttgacatcctttgagatattttattactaaaatctgatcttttttggctactgcaaaaatctattcagcaagaaggtatcagctgcataccttgcacagtggagctgactacctataaactctccctaaggcatttgtttacaggtgtattccattttagcagacgttctgatgctcagtgtatgtgctgcatacaaataaatgtgttctgaatcttttcatcttattgatagcatttttacaaatgtgtttccaaggaataaagattattcttgctttttttttgactccatcttcattttttttaaattgattcttgttgctatgcagaagtctcatttgtgaatgaccttggtaacagaacagttggcttttggaagtctgaaggtgagcattcagttaggtgggtggagcaagatcatcctagaatgaggctgctcttggcaagagtggatcttataggcacagcagctgatgcctttcttcatctggggcaactctggtgaaggttgtcctgcctgtcacaggtgctgagtagagagaagtggtggcagtgggatttcctcagtaatagtcctgtaaaggtacgtgtttgtcctggctacttgtgctcttcctggcaggaaggcatccaaacccttatctgtgggctcctggaaattgtgtatgccatataataccctctaataaatacctctctgcttaaagta

SEQ ID NO: 427710 - DNA, 642 bp, Homo sapiens
cacatctccgccgccggcgccgccaaggccaccctctactgccgcgtcttcctgctcgacgggaccgaagtgagcgtggacctgccgaaacatgccaaaggccaggatttgtttgatcagattgtgtaccacttggaccttgtggaaacagattactttggcctccagttcctcgactctgcccaggttgcgcactggctggatcatgccaaacccataaaaaagcagatgaaaattggacctgcttatgctttacactttcgagttaaatactattcttcagaaccaaacaaccttcgtgaggagtttacaaggtacctgtttgttttacaactcaggcatgacattctttctggaaaattgaaatgcccttatgaaacagctgtggaattagctgctctctgtctacaagcggagcttggggagtgcgagcttccagaacacacaccagagcttgtgtctgagtttcggttcattccaaatcagacagaagcaatggaatttgatatcttccagagatggaaagagtgcaggggaaagagccctgcccaggcggaactctcctatctgaataaagcgaagtggctggaaatgtatggggtagacatgcacgttgtcagggtaagaactgtgtgcgtttaa

SEQ ID NO: 427711 - DNA, 3947 bp, Homo sapiens
ggcccgctccagccgccgcgcatcctcggcccgcgccccgagacccgcgcccagctagccccggccccgctcggcgccccaggcagctcggctgcgctcgccgcgggacggcgcggccatgaggctgcggggatgcggaccccgggccgcccctgcctccagcgcaggggccagcgacgctcggctgctggcgcccccggggcggaaccccttcgtgcacgagctgcgcctcagcgccctgcagaaggcccaggtggccctcatgacactgacgctcttcccggtccggctcctggttgccgctgccatgatgctgctggcctggcccctcgcacttgtcgcatccctgggctctgcggagaaggaacccgagcagcccccggccctgtggaggaaggttgtggacttcctgctgaaggccatcatgcgcaccatgtggttcgccggcggcttccaccgggtggccgtgaaggggcggcaggcgctgcccaccgaggcggccatcctcacgctcgcgcctcactcgtcctacttcgacgccatccctgtgaccatgacgatgtcctccatcgtgatgaaggcagagagcagagacatcccgatctggggaactctgatccagtatatacggcctgtgttcgtgtcccggtcagaccaggattctcgcaggaaaacagtagaagaaatcaagagacgggcgcagtccaacggaaagtggccacagataatgatttttccagaaggaacttgtacaaacaggacctgcctaattaccttcaaacctggtgcattcatccctggagcgcccgtccagcctgtggttttacgatatccaaataaactggacaccatcacatggacgtggcaaggacctggagcgctggaaatcctgtggctcacgctgtgtcagtttcacaaccaagtggaaatcgagttccttcctgtgtacagcccttctgaggaggagaagaggaaccccgcgctgtatgccagcaacgtgcggcgagtcatggccgaggccttgggtgtctccgtgactgactacacgttcgaggactgccagctggccctggcggaaggacagctccgtctccccgctgacacttgccttttagaatttgccaggctcgtgcggggcctcgggctaaaaccagaaaagcttgaaaaagatctggacagatactcagaaagagccaggatgaagggaggagagaagataggtattgcggagtttgccgcctccctggaagtccccgtttctgacttgctggaagacatgttttcactgttcgacgagagcggcagcggcgaggtggacctgcgagagtgtgtggttgccctgtctgtcgtctgccggccggcccggaccctggacaccatccagctggctttcaagacgtacggagcgcaagaggacggcagcgtcggcgaaggtgacctgtcctgcatcctcaagacggccctgggggtggcagagctcaccgtgaccgacctattccgagccattgaccaagaggagaaggggaagatcacattcgctgacttccacaggtttgcagaaatgtaccctgccttcgcagaggaatacctgtacccggatcagacacatttcgaaagctgtgcagagacctcacctgcgccaatcccaaacggcttctgtgccgatttcagcccggaaaactcagacgctgggcggaagcctgttcgcaagaagctggattaggacccagggttgcggagagacgcggcccctcccgcgtggacatcaccgccatgagcctctttgcgagtgacctctgggctccgctcctcactcctgctgtacaggcactgtcttcagcccgagttccaggggcctcgggggctgtttgtatcttgttcctttgtgaagtgtgttgcagaaccgacgcttactgtgcgagaatcggagggcgcgcacgcggatcccccgcctggcctggaccccgtggggtcaggttccctgccgggcggggggcaccggtgccgccccgtgttctcccacggggccctggtttcgagtctctgtcacagcctcttccggcggcagcgtgcaccgggcgggcctccgtgcacactcagcacacgcctgccacacagcgtgcgcttgcgtgtcactctggcacgaaacctgtctgcctctgtggatccacagcctggcagagccgagccgtcacctgatttttcagtgtttctacctgtgtgctggagctcatgagtattttataaactccatttaggtacttcaggaaacatgcagcattttttaaaaaatgaaaattgtttttctacttcatttttccttttagagtcaaaggatatttatttataggcctttttttttttaatatagaatctgaggctgtttgggctttgacttaaatttccatcaggcctctctccagcaggtaatccctctccttccgctgggtcccctggggaggtgtgaactcaagggcctagccccaaaacactttttctgcttttcttaatccttttccagtcccctctttttttataaacgttggcagtttgatgtttctgtttcggcataacgtaatccatttcactgtagcctaaactccagtccgaggttggatattgttcaaatgagcagggcccgagctggaagcgcaaggcagccgccgccgtgccgctcctcccttgccctcaggccaggtccctgctggaagcggctgcatcttcctgtcagccctggtttccatggtgactggcgtgacgcagccacctgagtatggctgaccttcctgcagagagaggagccgcagtcttttgcttgtggaaggagacgctgggctgtgcggtgcggagggtgatgaggatgtctggtgacagccgtgcggacaccactcctctctgcagcactgcctcccagcgccagggtcgcgggcacatcccactgagagcgggggtcctgccccatcttagagtcaaaggcagaggggcttccaggccctggatggggtattttggtgtcacctgaagtccctctgacatcaccttgtttcatcattttttatgacagaattagaaacccatccttcaagcacaataatcatcacagacttgagtttgcttcctaaagcaaaggctccgggtttgtttggaaaatttttttgatttctgaaatgaattgatttttatatttggggcatctctatagaaagtgaccaccaaggccagtaagtacgggaaaaaatgtttactaacttcctcagagattcgtgatacgcgtttctccactgacagacatttaaaaacaaccttcagctccgtttcaatcaatcacctcgacttgttttttagcatggacactgccagcaggacagacagggatggagtaaaccgaagtcaatttcagggctcttggcgtgttggacacagaagaaatcctagtgcagcctttggtagctaacagtcactgattttataattggagaatgcgtaaagattcatttttcaaggagaagagcctgcaaatggccaatgaaggaggtaaataaactaagatattccgagggaagggacccaggccacctcccttccgcaggtctgcagatgaagggttttttgaatgaaatgccactgtgcattttcagaaaaaaaaatctctgataaacagactttgaatggatgtttgttcctcctgattctcttttctcttcgtggcgacttagagttggcggatattcggaactgtgaatgtacatagcgttgagttaaaccccttgtgtgtgagacaggacgcagcgggcccctggtggcctgggggccagacccgtgggcaggtggggcatgggccctggcctgcggggacctgctggggtgtgagggcagagggagggttgccatgaaggaacttgggattttcaatggaataaataaaacataaagtctatacttgggaa

SEQ ID NO: 427712 - DNA, 4081 bp, Homo sapiens
ggcccgctccagccgccgcgcatcctcggcccgcgccccgagacccgcgcccagctagccccggccccgctcggcgccccaggcagctcggctgcgctcgccgcgggacggcgcggccatgaggctgcggggatgcggaccccgggccgcccctgcctccagcgcaggggccagcgacgctcggctgctggcgcccccggggcggaaccccttcgtgcacgagctgcgcctcagcgccctgcagaaggcccagtttccacagagtgaaatagcctgtctttcaagccaagaaagccttcttccccaaagaaagaaatgggtccagtagtggctgacacactcaagaacccgcagaaacccagctaagttcccagttgagataaaccagtggccctcatgacactgacgctcttcccggtccggctcctggttgccgctgccatgatgctgctggcctggcccctcgcacttgtcgcatccctgggctctgcggagaaggaacccgagcagcccccggccctgtggaggaaggttgtggacttcctgctgaaggccatcatgcgcaccatgtggttcgccggcggcttccaccgggtggccgtgaaggggcggcaggcgctgcccaccgaggcggccatcctcacgctcgcgcctcactcgtcctacttcgacgccatccctgtgaccatgacgatgtcctccatcgtgatgaaggcagagagcagagacatcccgatctggggaactctgatccagtatatacggcctgtgttcgtgtcccggtcagaccaggattctcgcaggaaaacagtagaagaaatcaagagacgggcgcagtccaacggaaagtggccacagataatgatttttccagaaggaacttgtacaaacaggacctgcctaattaccttcaaacctggtgcattcatccctggagcgcccgtccagcctgtggttttacgatatccaaataaactggacaccatcacatggacgtggcaaggacctggagcgctggaaatcctgtggctcacgctgtgtcagtttcacaaccaagtggaaatcgagttccttcctgtgtacagcccttctgaggaggagaagaggaaccccgcgctgtatgccagcaacgtgcggcgagtcatggccgaggccttgggtgtctccgtgactgactacacgttcgaggactgccagctggccctggcggaaggacagctccgtctccccgctgacacttgccttttagaatttgccaggctcgtgcggggcctcgggctaaaaccagaaaagcttgaaaaagatctggacagatactcagaaagagccaggatgaagggaggagagaagataggtattgcggagtttgccgcctccctggaagtccccgtttctgacttgctggaagacatgttttcactgttcgacgagagcggcagcggcgaggtggacctgcgagagtgtgtggttgccctgtctgtcgtctgccggccggcccggaccctggacaccatccagctggctttcaagacgtacggagcgcaagaggacggcagcgtcggcgaaggtgacctgtcctgcatcctcaagacggccctgggggtggcagagctcaccgtgaccgacctattccgagccattgaccaagaggagaaggggaagatcacattcgctgacttccacaggtttgcagaaatgtaccctgccttcgcagaggaatacctgtacccggatcagacacatttcgaaagctgtgcagagacctcacctgcgccaatcccaaacggcttctgtgccgatttcagcccggaaaactcagacgctgggcggaagcctgttcgcaagaagctggattaggacccagggttgcggagagacgcggcccctcccgcgtggacatcaccgccatgagcctctttgcgagtgacctctgggctccgctcctcactcctgctgtacaggcactgtcttcagcccgagttccaggggcctcgggggctgtttgtatcttgttcctttgtgaagtgtgttgcagaaccgacgcttactgtgcgagaatcggagggcgcgcacgcggatcccccgcctggcctggaccccgtggggtcaggttccctgccgggcggggggcaccggtgccgccccgtgttctcccacggggccctggtttcgagtctctgtcacagcctcttccggcggcagcgtgcaccgggcgggcctccgtgcacactcagcacacgcctgccacacagcgtgcgcttgcgtgtcactctggcacgaaacctgtctgcctctgtggatccacagcctggcagagccgagccgtcacctgatttttcagtgtttctacctgtgtgctggagctcatgagtattttataaactccatttaggtacttcaggaaacatgcagcattttttaaaaaatgaaaattgtttttctacttcatttttccttttagagtcaaaggatatttatttataggcctttttttttttaatatagaatctgaggctgtttgggctttgacttaaatttccatcaggcctctctccagcaggtaatccctctccttccgctgggtcccctggggaggtgtgaactcaagggcctagccccaaaacactttttctgcttttcttaatccttttccagtcccctctttttttataaacgttggcagtttgatgtttctgtttcggcataacgtaatccatttcactgtagcctaaactccagtccgaggttggatattgttcaaatgagcagggcccgagctggaagcgcaaggcagccgccgccgtgccgctcctcccttgccctcaggccaggtccctgctggaagcggctgcatcttcctgtcagccctggtttccatggtgactggcgtgacgcagccacctgagtatggctgaccttcctgcagagagaggagccgcagtcttttgcttgtggaaggagacgctgggctgtgcggtgcggagggtgatgaggatgtctggtgacagccgtgcggacaccactcctctctgcagcactgcctcccagcgccagggtcgcgggcacatcccactgagagcgggggtcctgccccatcttagagtcaaaggcagaggggcttccaggccctggatggggtattttggtgtcacctgaagtccctctgacatcaccttgtttcatcattttttatgacagaattagaaacccatccttcaagcacaataatcatcacagacttgagtttgcttcctaaagcaaaggctccgggtttgtttggaaaatttttttgatttctgaaatgaattgatttttatatttggggcatctctatagaaagtgaccaccaaggccagtaagtacgggaaaaaatgtttactaacttcctcagagattcgtgatacgcgtttctccactgacagacatttaaaaacaaccttcagctccgtttcaatcaatcacctcgacttgttttttagcatggacactgccagcaggacagacagggatggagtaaaccgaagtcaatttcagggctcttggcgtgttggacacagaagaaatcctagtgcagcctttggtagctaacagtcactgattttataattggagaatgcgtaaagattcatttttcaaggagaagagcctgcaaatggccaatgaaggaggtaaataaactaagatattccgagggaagggacccaggccacctcccttccgcaggtctgcagatgaagggttttttgaatgaaatgccactgtgcattttcagaaaaaaaaatctctgataaacagactttgaatggatgtttgttcctcctgattctcttttctcttcgtggcgacttagagttggcggatattcggaactgtgaatgtacatagcgttgagttaaaccccttgtgtgtgagacaggacgcagcgggcccctggtggcctgggggccagacccgtgggcaggtggggcatgggccctggcctgcggggacctgctggggtgtgagggcagagggagggttgccatgaaggaacttgggattttcaatggaataaataaaacataaagtctatacttgggaa

SEQ ID NO: 427713 - DNA, 4160 bp, Homo sapiens
ggcccgctccagccgccgcgcatcctcggcccgcgccccgagacccgcgcccagctagccccggccccgctcggcgccccaggcagctcggctgcgctcgccgcgggacggcgcggccatgaggctgcggggatgcggaccccgggccgcccctgcctccagcgcaggggccagcgacgctcggctgctggcgcccccggggcggaaccccttcgtgcacgagctgcgcctcagcgccctgcagaaggcccaggtggccctcatgacactgacgctcttcccggtccggctcctggttgccgctgccatgatgctgctggcctggcccctcgcacttgtcgcatccctgggctctgcggagaaggaacccgagcagcccccggccctgtggaggaaggttgtggacttcctgctgaaggccatcatgcgcaccatgtggttcgccggcggcttccaccgggtggccgtgaaggggcggcaggcgctgcccaccgaggcggccatcctcacgctcgcgcctcactcgtcctacttcgacgccatccctgtgaccatgacgatgtcctccatcgtgatgaaggcagagagcagagacatcccgatctggggaactctgatccagtatatacggcctgtgttcgtgtcccggtcagaccaggattctcgcaggaaaacagtagaagaaatcaagagacgggcgcagtccaacggaaagtggccacagataatgatttttccagaaggaacttgtacaaacaggacctgcctaattaccttcaaacctggtgcattcatccctggagcgcccgtccagcctgtggttttacgatatccaaataaactggacaccatcacatggacgtggcaaggacctggagcgctggaaatcctgtggctcacgctgtgtcagtttcacaaccaagtggaaatcgagttccttcctgtgtacagcccttctgaggaggagaagaggaaccccgcgctgtatgccagcaacgtgcggcgagtcatggccgaggccttgggtgtctccgtgactgactacacgttcgaggactgccagctggccctggcggaaggacagctccgtctccccgctgacacttgccttttagaatttgccaggctcgtgcggggcctcgggctaaaaccagaaaagcttgaaaaagatctggacagatactcagaaagagccaggatgaagggaggagagaagataggtattgcggagtttgccgcctccctggaagtccccgtttctgacttgctggaagacatgttttcactgttcgacgagagcggcagcggcgaggtggacctgcgagagtgtgtggttgccctgtctgtcgtctgccggccggcccggaccctggacaccatccagctggctttcaagacgtacggagcgcaagaggacggcagcgtcggcgaaggtgacctgtcctgcatcctcaagacggccctgggggtggcagagctcaccgtgaccgacctattccgagccattgaccaagaggagaaggggaagatcacattcgctgacttccacaggtttgcagaaatgtaccctgccttcgcagaggaatacctgtacccggatcagacacatttcgaaagctgtgcagagacctcacctgcgccaatcccaaacggcttctgtgccgatttcagcccggaaaactcagacgctgggcggaagcctgttcgcaagaagctggattaggacccagggttgcggagagacgcggcccctcccgcgtggacatcaccgccatgagcctctttgcgagtgacctctgggctccgctcctcactcctgctgtacaggcactgtcttcagcccgagttccaggggcctcgggggctgtttgtatcttgttcctttgtgaagtgtgttgcagaaccgacgcttactgtgcgagaatcggagggcgcgcacgcggatcccccgcctggcctggaccccgtggggtcaggttccctgccgggcggggggcaccggtgccgccccgtgttctcccacggggccctggtttcgagtctctgtcacagcctcttccggcggcagcgtgcaccgggcgggcctccgtgcacactcagcacacgcctgccacacagcgtgcgcttgcgtgtcactctggcacgaaacctgtctgcctctgtggatccacagcctggcagagccgagccgtcacctgatttttcagtgtttctacctgtgtgctggagctcatgagtattttataaactccatttaggtacttcaggaaacatgcagcattttttaaaaaatgaaaattgtttttctacttcatttttccttttagagtcaaaggatatttatttataggcctttttttttttaatatagaatctgaggctgtttgggctttgacttaaatttccatcaggcctctctccagcaggtaatccctctccttccgctgggtcccctggggaggtgtgaactcaagggcctagccccaaaacactttttctgcttttcttaatccttttccagtcccctctttttttataaacgttggcagtttgatgtttctgtttcggcataacgtaatccatttcactgtagcctaaactccagtccgaggttggatattgttcaaatgagcagggcccgagctggaagcgcaaggcagccgccgccgtgccgctcctcccttgccctcaggccaggtccctgctggaagcggctgcatcttcctgtcagccctggtttccatggtgactggcgtgacgcagccacctgagtatggctgaccttcctgcagagagaggagccgcagtcttttgcttgtggaaggagacgctgggctgtgcggtgcggagggtgatgaggatgtctggtgacagccgtgcggacaccactcctctctgcagcactgcctcccagcgccagggtcgcgggcacatcccactgagagcgggggtcctgccccatcttagagtcaaaggcagaggggcttccaggccctggatggggtattttggtgtcacctgaagtccctctgacatcaccttgtttcatcattttttatgacagaattagaaacccatccttcaagcacaataatcatcacagacttgagtttgcttcctaaagcaaaggctccgggtttgtttggaaaatttttttgatttctgaaatgaattgatttttatatttggggcatctctatagaaagtgaccaccaaggccagtaagtacgggaaaaaatgtttactaacttcctcagagattcgtgatacgcgtttctccactgacagacatttaaaaacaaccttcagctccgtttcaatcaatcacctcgacttgttttttagcatggacactgccagcaggacagacagggatggagtaaaccgaagtcaatttcagggctcttggcgtgttggacacagaagaaatcctagtgcagcctttggtagctaacagtcactgattttataattggagaatgcgtaaagattcatttttcaaggagaagagcctgcaaatggccaatgaaggaggtaaataaactaagatattccgagggaagggacccaggccacctcccttccgcaggtctgcagatgaagggttttttgaatgaaatgccactgtgcattttcagaaaaaaaaatctctgataaacagactttgaatggatgtttgttcctcctgattctcttttctcttcgtggcgacttagagttggcggatattcggaactgtgaatgtacatagcgttgagttaaaccccttgtgtgtgagacaggacgcagcgggcccctggtggcctgggggccagacccgtgggcaggtggggcatgggccctggcctgcggggacctgctggggtgtgagggcagagggagggttgccatgaaggaacttgggattttcaatggaataaataaaacataaagtctatacttgggaaaaaaaaaaaacaacaacacaaaaaacaacaaaaaaacacaacactaaaaaaaaaaaaaaaagagaacaaaagaggagaggaccacaacaaacacacgcacccaagcacgcagggcgcacaaaagcaaaagaaaacaaaaggagagcgagagaagccaacaactaacagaggaggaacgagaaacaccaaaaggcgaggccgggacagaggaca

SEQ ID NO: 427714 - DNA, 3893 bp, Homo sapiens
ggcccgctccagccgccgcgcatcctcggcccgcgccccgagacccgcgcccagctagccccggccccgctcggcgccccaggcagctcggctgcgctcgccgcgggacggcgcggccatgaggctgcggggatgcggaccccgggccgcccctgcctccagcgcaggggccagcgacgctcggctgctggcgcccccggggcggaaccccttcgtgcacgagctgcgcctcagcgccctgcagaaggcccaggtggccctcatgacactgacgctcttcccggtccggctcctggttgccgctgccatgatgctgctggcctggcccctcgcacttgtcgcatccctgggctctgcggagaaggaacccgagcagcccccggccctgtggaggaaggttgtggacttcctgctgaaggccatcatgcgcaccatgtggttcgccggcggcttccaccgggtggccgtgaaggggcggcaggcgctgcccaccgaggcggccatcctcacgctcgcgcctcactcgtcctacttcgacgccatccctgtgaccatgacgatgtcctccatcgtgatgaaggcagagagcagagacatcccgatctggggaactctgatccagtatatacggcctgtgttcgtgtcccggtcagaccaggattctcgcaggaaaacagtagaagaaatcaagagacgggcgcagtccaacggaaagtggccacagataatgatttttccagaaggaacttgtacaaacaggacctgcctaattaccttcaaacctggtgcattcatccctggagcgcccgtccagcctgtggttttacgatatccaaataaactggacaccatcacatggacgtggcaaggacctggagcgctggaaatcctgtggctcacgctgtgtcagtttcacaaccaagtggaaatcgagttccttcctgtgtacagcccttctgaggaggagaagaggaaccccgcgctgtatgccagcaacgtgcggcgagtcatggccgaggccttgggtgtctccgtgactgactacacgttcgaggactgccagctggccctggcggaaggacagctccgtctccccgctgacacttgccttttagaatttgccaggctcgtgcggggcctcgggctaaaaccagaaaagcttgaaaaagatctggacagatactcagaaagagccaggatgaagggaggagagaagataggtattgcggagtttgccgcctccctggaagtccccgtttctgacttgctggaagacatgttttcactgttcgacgagagcggcagcggcgaggtggacctgcgagagtgtgtggttgccctgtctgtcgtctgccggccggcccggaccctggacaccatccagctggctttcaagacgtacggagcgcaagaggacggcagcgtcggcgaaggtgacctgtcctgcatcctcaagacggccctgggggtggcagagctcaccgtgaccgacctattccgagccattgaccaagaggagaaggggaagatcacattcgctgacttccacaggtttgcagaaatgtaccctgccttcgcagaggaatacctgtacccggatcagacacatttcgaaagctgtgcagagacctcacctgcgccaatcccaaacggcttctgtgccgatttcagcccggaaaactcagacgctgggcggaagcctgttcgcaagaagctggattaggacccagggttgcggagagacgcggcccctcccgcgtggacatcaccgccatgagcctctttgcgagtgacctctgggctccgctcctcactcctgctgtacaggcactgtcttcagcccgagttccaggggcctcgggggctgtttgtatcttgttcctttgtgaagtgtgttgcagaaccgacgcttactgtgcgagaatcggagggcgcgcacgcggatcccccgcctggcctggaccccgtggggtcaggttccctgccgggcggggggcaccggtgccgccccgtgttctcccacggggccctggtttcgagtctctgtcacagcctcttccggcggcagcgtgcaccgggcgggcctccgtgcacactcagcacacgcctgccacacagcgtgcgcttgcgtgtcactctggcacgaaacctgtctgcctctgtggatccacagcctggcagagccgagccgtcacctgatttttcagtgtttctacctgtgtgctggagctcatgagtattttataaactccatttaggtacttcaggaaacatgcagcattttttaaaaaatgaaaattgtttttctacttcatttttccttttagagtcaaaggatatttatttataggcctttttttttttaatatagaatctgaggctgtttgggctttgacttaaatttccatcaggcctctctccagcaggtaatccctctccttccgctgggtcccctggggaggtgtgaactcaagggcctagccccaagttggcagtttgatgtttctgtttcggcataacgtaatccatttcactgtagcctaaactccagtccgaggttggatattgttcaaatgagcagggcccgagctggaagcgcaaggcagccgccgccgtgccgctcctcccttgccctcaggccaggtccctgctggaagcggctgcatcttcctgtcagccctggtttccatggtgactggcgtgacgcagccacctgagtatggctgaccttcctgcagagagaggagccgcagtcttttgcttgtggaaggagacgctgggctgtgcggtgcggagggtgatgaggatgtctggtgacagccgtgcggacaccactcctctctgcagcactgcctcccagcgccagggtcgcgggcacatcccactgagagcgggggtcctgccccatcttagagtcaaaggcagaggggcttccaggccctggatggggtattttggtgtcacctgaagtccctctgacatcaccttgtttcatcattttttatgacagaattagaaacccatccttcaagcacaataatcatcacagacttgagtttgcttcctaaagcaaaggctccgggtttgtttggaaaatttttttgatttctgaaatgaattgatttttatatttggggcatctctatagaaagtgaccaccaaggccagtaagtacgggaaaaaatgtttactaacttcctcagagattcgtgatacgcgtttctccactgacagacatttaaaaacaaccttcagctccgtttcaatcaatcacctcgacttgttttttagcatggacactgccagcaggacagacagggatggagtaaaccgaagtcaatttcagggctcttggcgtgttggacacagaagaaatcctagtgcagcctttggtagctaacagtcactgattttataattggagaatgcgtaaagattcatttttcaaggagaagagcctgcaaatggccaatgaaggaggtaaataaactaagatattccgagggaagggacccaggccacctcccttccgcaggtctgcagatgaagggttttttgaatgaaatgccactgtgcattttcagaaaaaaaaatctctgataaacagactttgaatggatgtttgttcctcctgattctcttttctcttcgtggcgacttagagttggcggatattcggaactgtgaatgtacatagcgttgagttaaaccccttgtgtgtgagacaggacgcagcgggcccctggtggcctgggggccagacccgtgggcaggtggggcatgggccctggcctgcggggacctgctggggtgtgagggcagagggagggttgccatgaaggaacttgggattttcaatggaataaataaaacataaagtctatacttgggaa

SEQ ID NO: 427715 - DNA, 4252 bp, Homo sapiens
ggcccgctccagccgccgcgcatcctcggcccgcgccccgagacccgcgcccagctagccccggccccgctcggcgccccaggcagctcggctgcgctcgccgcgggacggcgcggccatgaggctgcggggatgcggaccccgggccgcccctgcctccagcgcaggggccagcgacgctcggctgctggcgcccccggggcggaaccccttcgtgcacgagctgcgcctcagcgccctgcagaaggcccaggtggccctcatgacactgacgctcttcccggtccggctcctggttgccgctgccatgatgctgctggcctggcccctcgcacttgtcgcatccctgggctctgcggagaaggaacccgagcagcccccggccctgtggaggaaggttgtggacttcctgctgaaggccatcatgcgcaccatgtggttcgccggcggcttccaccgggtggccgtgaaggggcggcaggcgctgcccaccgaggcggccatcctcacgctcgcgcctcactcgtcctacttcgacgccatccctgtgaccatgacgatgtcctccatcgtgatgaaggcagagagcagagacatcccgatctggggaactctgatccagtatatacggcctgtgttcgtgtcccggtcagaccaggattctcgcaggaaaacagtagaagaaatcaagagacgggcgcagtccaacggaaagtggccacagataatgatttttccagaaggaacttgtacaaacaggacctgcctaattaccttcaaacctggtgcattcatccctggagcgcccgtccagcctgtggttttacgatatccaaataaactggacaccatcacatggacgtggcaaggacctggagcgctggaaatcctgtggctcacgctgtgtcagtttcacaaccaagtggaaatcgagttccttcctgtgtacagcccttctgaggaggagaagaggaaccccgcgctgtatgccagcaacgtgcggcgagtcatggccgaggccttgggtgtctccgtgactgactacacgttcgaggactgccagctggccctggcggaaggacagctccgtctccccgctgacacttgccttttagaatttgccaggctcgtgcggggcctcgggctaaaaccagaaaagcttgaaaaagatctggacagatactcagaaagagccaggatgaagggaggagagaagataggtattgcggagtttgccgcctccctggaagtccccgtttctgacttgctggaagacatgttttcactgttcgacgagagcggcagcggcgaggtggacctgcgagagtgtgtggttgccctgtctgtcgtctgccggccggcccggaccctggacaccatccagctggctttcaagacgtacggagcgcaagaggacggcagcgtcggcgaaggtgacctgtcctgcatcctcaagacggccctgggggtggcagagctcaccgtgaccgacctattccgagccattgaccaagaggagaaggggaagatcacattcgctgacttccacaggtttgcagaaatgtaccctgccttcgcagaggaatacctgtacccggatcagacacatttcgaaagctgtgcagagacctcacctgcgccaatcccaaacggcttctgtgccgatttcagcccggaaaactcagacgctgggcggaagcctgttcgcaagaagctggattaggacccagggttgcggagagacgcggcccctcccgcgtggacatcaccgccatgagcctctttgcgagtgacctctgggctccgctcctcactcctgctgtacaggcactgtcttcagcccgagttccaggggcctcgggggctgtttgtatcttgttcctttgtgaagtgtgttgcagaaccgacgcttactgtgcgagaatcggagggcgcgcacgcggatcccccgcctggcctggaccccgtggggtcaggttccctgccgggcggggggcaccggtgccgccccgtgttctcccacggggccctggtttcgagtctctgtcacagcctcttccggcggcagcgtgcaccgggcgggcctccgtgcacactcagcacacgcctgccacacagcgtgcgcttgcgtgtcactctggcacgaaacctgtctgcctctgtggatccacagcctggcagagccgagccgtcacctgatttttcagtgtttctacctgtgtgctggagctcatgagtattttataaactccatttaggtacttcaggaaacatgcagcattttttaaaaaatgaaaattgtttttctacttcatttttccttttagagtcaaaggatatttatttataggcctttttttttttaatatagaatctgaggctgtttgggctttgacttaaatttccatcaggcctctctccagcaggtaatccctctccttccgctgggtcccctggggaggtgtgaactcaagggcctagccccaaaacactttttctgcttttcttaatccttttccagtcccctctttttttataaacgttggcagtttgatgtttctgtttcggcataacgtaatccatttcactgtagcctaaactccagtccgaggttggatattgttcaaatgagcagggcccgagctggaagcgcaaggcagccgccgccgtgccgctcctcccttgccctcaggccaggtccctgctggaagcggctgcatcttcctgtcagccctggtttccatggtgactggcgtgacgcagccacctgagtatggctgaccttcctgcagagagaggagccgcagtcttttgcttgtggaaggagacgctgggctgtgcggtgcggagggtgatgaggatgtctggtgacagccgtgcggacaccactcctctctgcagcactgcctcccagcgccagggtcgcgggcacatcccactgagagcgggggtcctgccccatcttagagtcaaaggcagaggggcttccaggccctggatggggtattttggtgtcacctgaagtccctctgacatcaccttgtttcatcattttttatgacagaattagaaacccatccttcaagcacaataatcatcacagacttgagtttgcttcctaaagcaaaggctccgggtttgtttggaaaatttttttgatttctgaaatgaattgatttttatatttggggcatctctatagaaagtgaccaccaaggccagtaagtacgggaaaaaatgtttactaacttcctcagagattcgtgatacgcgtttctccactgacagacatttaaaaacaaccttcagctccgtttcaatcaatcacctcgacttgttttttagcatggacactgccagcaggacagacagggatggagtaaaccgaagtcaatttcagggctcttggcgtgttggacacagaagaaatcctagtgcagcctttggtagctaacagtcactgattttataattggagaatgcgtaaagattcatttttcaaggagaagagcctgcaaatggccaatgaaggaggtaaataaactaagatattccgagggaagggacccaggccacctcccttccgcaggtctgcagatgaagggttttttgaatgaaatgccactgtgcattttcagaaaaaaaaatctctgataaacagactttgaatggatgtttgttcctcctgattctcttttctcttcgtggcgacttagagttggcggatattcggaactgtgaatgtacatagcgttgagttaaaccccttgtgtgtgagacaggacgcagcgggcccctggtggcctgggggccagacccgtgggcaggtggggcatgggccctggcctgcggggacctgctggggtgtgagggcagagggagggttgccatgaaggaacttgggattttcaatggaataaataaaacataaagtctatacttgggaaaaaaaccaccacacaacgagggcggcgcccttattatttgtgtctaacaagaatgtttgttgtcaaaccattaaggggaaaattattcctggaaattacgtggaattgataggtcttcgagtgggcatcaaacaaggaattaccaatttaggggataaaatacaatgtggaagaaggtcttaagaaaagaagaccagttgtgaaaacacggtatacatgaatctgaaggaggaacaaggttgagaaaaaagtgtgttggatgtaaggtgaggccaacaagatataagaggagaacatgcattcag

SEQ ID NO: 427716 - DNA, 3672 bp, Homo sapiens
ggcccgctccagccgccgcgcatcctcggcccgcgccccgagacccgcgcccagctagccccggccccgctcggcgccccaggcagctcggctgcgctcgccgcgggacggcgcggccatgaggctgcggggatgcggaccccgggccgcccctgcctccagcgcaggggccagcgacgctcggctgctggcgcccccggggcggaaccccttcgtgcacgagctgcgcctcagcgccctgcagaaggcccaggtggccctcatgacactgacgctcttcccggtccggctcctggttgccgctgccatgatgctgctggcctggcccctcgcacttgtcgcatccctgggctctgcggagaaggaacccgagcagcccccggccctgtggaggaaggttgtggacttcctgctgaaggccatcatgcgcaccatgtggttcgccggcggcttccaccgggtggccgtgaaggggcggcaggcgctgcccaccgaggcggccatcctcacgctcgcgcctcactcgtcctacttcgacgccatccctgtgaccatgacgatgtcctccatcgtgatgaaggcagagagcagagacatcccgatctggggaactctgatccagtatatacggcctgtgttcgtgtcccggtcagaccaggattctcgcaggaaaacagtagaagaaatcaagagacgggcgcagtccaacggaaagtggccacagataatgatttttccagaaggaacttgtacaaacaggacctgcctaattaccttcaaacctggtgcattcatccctggagcgcccgtccagcctgtggttttacgatatccaaataaactggacaccatcacatggacgtggcaaggacctggagcgctggaaatcctgtggctcacgctgtgtcagtttcacaaccaagtggaaatcgagttccttcctgtgtacagcccttctgaggaggagaagaggaaccccgcgctgtatgccagcaacgtgcggcgagtcatggccgaggccttgggtgtctccgtgactgactacacgttcgaggactgccagctggccctggcggaaggacagctccgtctccccgctgacacttgccttttagaatttgccaggctcgtgcggggcctcgggctaaaaccagaaaagcttgaaaaagatctggacagatactcagaaagagccaggatgaagggaggagagaagataggtattgcggagtttgccgcctccctggaagtccccgtttctgacttgctggaagacatgttttcactgttcgacgagagcggcagcggcgaggtggacctgcgagagtgtgtggttgccctgtctgtcgtctgccggccggcccggaccctggacaccatccagctggctttcaagacgtacggagcgcaagaggacggcagcgtcggcgaaggtgacctgtcctgcatcctcaagacggccctgggggtggcagagctcaccgtgaccgacctattccgagccattgaccaagaggagaaggggaagatcacattcgctgacttccacaggtttgcagaaatgtaccctgccttcgcagaggaatacctgtacccggatcagacacatttcgaaagctgtgcagagacctcacctgcgccaatcccaaacggcttctgtgccgatttcagcccggaaaactcagacgctgggcggaagcctgttcgcaagaagctggattaggacccagggttgcggagagacgcggcccctcccgcgtggacatcaccgccatgagcctctttgcgagtgacctctgggctccgctcctcactcctgctgtacaggcactgtcttcagcccgagttccaggggcctcgggggctgtttgtatcttgttcctttgtgaagtgtgttgcagaaccgacgcttactgtgcgagaatcggagggcgcgcacgcggatcccccgcctggcctggaccccgtggggtcaggttccctgccgggcggggggcaccggtgccgccccgtgttctcccacggggccctggtttcgagtctctgtcacagcctcttccggcggcagcgtgcaccgggcgggcctccgtgcacactcagcacacgcctgccacacagcgtgcgcttgcgtgtcactctggcacgaaacctgtctgcctctgtggatccacagcctggcagagccgagccgtcacctgatttttcagtgtttctacctgtgtgctggagctcatgagtattttataaactccatttaggtacttcaggaaacatgcagcattttttaaaaaatgaaaattgtttttctacttcatttttccttttagagtcaaaggatatttatttataggcctttttttttttaatatagaatctgaggctgtttgggctttgacttaaatttccatcaggcctctctccagcaggtaatccctctccttccgctgggtcccctggggaggtgtgaactcaagggcctagccccaaaacactttttctgcttttcttaatccttttccagtcccctctttttttataaacgttggcagtttgatgtttctgtttcggcataacgtaatccatttcactgtagcctaaactccagtccgaggttggatattgttcaaatgagcagggcccgagctggaagcgcaaggcagccgccgccgtgccgctcctcccttgccctcaggccaggtccctgctggaagcggctgcatcttcctgtcagccctggtttccatggtgactggcgtgacgcagccacctgagtatggctgaccttcctgcagagagaggagccgcagtcttttgcttgtggaaggagacgctgggctgtgcggtgcggagggtgatgaggatgtctggtgacagccgtgcggacaccactcctctctgcagcactgcctcccagcgccagggtcgcgggcacatcccactgagagcgggggtcctgccccatcttagagtcaaaggcagaggggcttccaggccctggatggggtattttggtgtcacctgaagtccctctgacatcaccttgtttcatcattttttatgacagaattagaaacccatccttcaagcacaataatcatcacagacttgagtttgcttcctaaagcaaaggctccgggtttgtttggaaaatttttttgatttctgaaatgaattgatttttatatttggggcatctctatagaaagtgaccaccaaggccagtaagtacgggaaaaaatgtttactaacttcctcagagattcgtgatacgcgtttctccactgacagacatttaaaaacaaccttcagctccgtttcaatcaatcacctcgacttgttttttagcatggacactgccagcaggacagacagggatggagtaaaccgaagtcaatttcagggctcttggcgtgttggacacagaagaaatcctagtgcagcctttggtagctaacagtcactgattttataattggagaatgcgtaaagattcatttttcaaggagaagagcctgcaaatggccaatgaaggaggtaaataaactaagatattccgagggaagggacccaggccacctcccttccgcaggtctgcagatgaagggttttttgaatgaaatgccactgtgcattttcagaaaaaaaaatctctgataaacagactttgaatgg

SEQ ID NO: 427717 - DNA, 3903 bp, Homo sapiens
ggcccgctccagccgccgcgcatcctcggcccgcgccccgagacccgcgcccagctagccccggccccgctcggcgccccaggcagctcggctgcgctcgccgcgggacggcgcggccatgaggctgcggggatgcggaccccgggccgcccctgcctccagcgcaggggccagcgacgctcggctgctggcgcccccggggcggaaccccttcgtgcacgagctgcgcctcagcgccctgcagaaggcccaggtggccctcatgacactgacgctcttcccggtccggctcctggttgccgctgccatgatgctgctggcctggcccctcgcacttgtcgcatccctgggctctgcggagaaggaacccgagcagcccccggccctgtggaggaaggttgtggacttcctgctgaaggccatcatgcgcaccatgtggttcgccggcggcttccaccgggtggccgtgaaggggcggcaggcgctgcccaccgaggcggccatcctcacgctcgcgcctcactcgtcctacttcgacgccatccctgtgaccatgacgatgtcctccatcgtgatgaaggcagagagcagagacatcccgatctggggaactctgatccagtatatacggcctgtgttcgtgtcccggtcagaccaggattctcgcaggaaaacagtagaagaaatcaagagacgggcgcagtccaacggaaagtggccacagataatgatttttccagaaggaacttgtacaaacaggacctgcctaattaccttcaaacctggtgcattcatccctggagcgcccgtccagcctgtggttttacgatatccaaataaactggacaccatcacatggacgtggcaaggacctggagcgctggaaatcctgtggctcacgctgtgtcagtttcacaaccaagtggaaatcgagttccttcctgtgtacagcccttctgaggaggagaagaggaaccccgcgctgtatgccagcaacgtgcggcgagtcatggccgaggccttgggtgtctccgtgactgactacacgttcgaggactgccagctggccctggcggaaggacagctccgtctccccgctgacacttgccttttagaatttgccaggctcgtgcggggcctcgggctaaaaccagaaaagcttgaaaaagatctggacagatactcagaaagagccaggatgaagggaggagagaagataggtattgcggagtttgccgcctccctggaagtccccgtttctgacttgctggaagacatgttttcactgttcgacgagagcggcagcggcgaggtggacctgcgagagtgtgtggttgccctgtctgtcgtctgccggccggcccggaccctggacaccatccagctggctttcaagacgtacggagcgcaagaggacggcagcgtcggcgaaggtgacctgtcctgcatcctcaagacggccctgggggtggcagagctcaccgtgaccgacctattccgagccattgaccaagaggagaaggggaagatcacattcgctgacttccacaggtttgcagaaatgtaccctgccttcgcagaggaatacctgtacccggatcagacacatttcgaaagctgtgcagagacctcacctgcgccaatcccaaacggcttctgtgccgatttcagcccggaaaactcagacgctgggcggaagcctgttcgcaagaagctggattaggacccagggttgcggagagacgcggcccctcccgcgtggacatcaccgccatgagcctctttgcgagtgacctctgggctccgctcctcactcctgctgtacaggcactgtcttcagcccgagttccaggggcctcgggggctgtttgtatcttgttcctttgtgaagtgtgttgcagaaccgacgcttactgtgcgagaatcggagggcgcgcacgcggatcccccgcctggcctggaccccgtggggtcaggttccctgccgggcggggggcaccggtgccgccccgtgttctcccacggggccctggtttcgagtctctgtcacagcctcttccggcggcagcgtgcaccgggcgggcctccgtgcacactcagcacacgcctgccacacagcgtgcgcttgcgtgtcactctggcacgaaacctgtctgcctctgtggatccacagcctggcagagccgagccgtcacctgatttttcagtgtttctacctgtgtgctggagctcatgagtattttataaactccatttaggtacttcaggaaacatgcagcattttttaaaaaatgaaaattgtttttctacttcatttttccttttagagtcaaaggatatttatttataggcctttttttttttaatatagaatctgaggctgtttgggctttgacttaaatttccatcaggcctctctccagcaggtaatccctctccttccgctgggtcccctggggaggtgtgaactcaagggcctagccccaaaacactttttctgcttttcttaatccttttccagtcccctctttttttataaacgttggcagtttgatgtttctgtttcggcataacgtaatccatttcactgtagcctaaactccagtccgaggttggatattgttcaaatgagcagggcccgagctggaagcgcaaggcagccgccgccgtgccgctcctcccttgccctcaggccaggtccctgctggaagcggctgcatcttcctgtcagccctggtttccatggtgactggcgtgacgcagccacctgagtatggctgaccttcctgcagagagaggagccgcagtcttttgcttgtggaaggagacgctgggctgtgcggtgcggagggtgatgaggatgtctggtgacagccgtgcggacaccactcctctctgcagcactgcctcccagcgccagggtcgcgggcacatcccactgagagcgggggtcctgccccatcttagagtcaaaggcagaggggcttccaggccctggatggggtattttggtgtcacctgaagtccctctgacatcaccttgtttcatcattttttatgacagaattagaaacccatccttcaagcacaataatcatcacagacttgagtttgcttcctaaagcaaaggctccgggtttgtttggaaaatttttttgatttctgaaatgaattgatttttatatttggggcatctctatagaaagtgaccaccaaggccagtaagtacgggaaaaaatgtttactaacttcctcagagattcgtgatacgcgtttctccactgacagacatttaaaaacaaccttcagctccgtttcaatcaatcacctcgacttgttttttagcatggacactgccagcaggacagacagggatggagtaaaccgaagtcaatttcagggctcttggcgtgttggacacagaagaaatcctagtgcagcctttggtagctaacagtcactgattttataattggagaatgcgtaaagattcatttttcaaggagaagagcctgcaaatggccaatgaaggaggtaaataaactaagatattccgagggaagggacccaggccacctcccttccgcaggtctgcagatgaagggttttttgaatgaaatgccactgtgcattttcagaaaaaaaaatctctgataaacagactttgaatggatgtttgttcctcctgattctcttttctcttcgtggcgacttagagttggcggatattcggaactgtgaatgtacatagcgttgagttaaaccccttgtgtgtgagacaggacgcagcgggcccctggtggcgcggggacctgctggggtgtgagggcagagggagggttgccatgaaggaacttgggattttcaatggaataaataaaacataaagtctatacttgggaa

SEQ ID NO: 427718 - DNA, 4132 bp, Homo sapiens
ggcccgctccagccgccgcgcatcctcggcccgcgccccgagacccgcgcccagctagccccggccccgctcggcgccccaggcagctcggctgcgctcgccgcgggacggcgcggccatgaggctgcggggatgcggaccccgggccgcccctgcctccagcgcaggggccagcgacgctcggctgctggcgcccccggggcggaaccccttcgtgcacgagctgcgcctcagcgccctgcagaaggcccaggtggccctcatgacactgacgctcttcccggtccggctcctggttgccgctgccatgatgctgctggcctggcccctcgcacttgtcgcatccctgggctctgcggagaaggaacccgagcagcccccggccctgtggaggaaggttgtggacttcctgctgaaggccatcatgcgcaccatgtggttcgccggcggcttccaccgggtggccgtgaaggggcggcaggcgctgcccaccgaggcggccatcctcacgctcgcgcctcactcgtcctacttcgacgccatccctgtgaccatgacgatgtcctccatcgtgatgaaggcagagagcagagacatcccgatctggggaactctgatccagtatatacggcctgtgttcgtgtcccggtcagaccaggattctcgcaggaaaacagtagaagaaatcaagagacgggcgcagtccaacggaaagtggccacagataatgatttttccagaaggaacttgtacaaacaggacctgcctaattaccttcaaacctggtgcattcatccctggagcgcccgtccagcctgtggttttacgatatccaaataaactggacaccatcacatggacgtggcaaggacctggagcgctggaaatcctgtggctcacgctgtgtcagtttcacaaccaagtggaaatcgagttccttcctgtgtacagcccttctgaggaggagaagaggaaccccgcgctgtatgccagcaacgtgcggcgagtcatggccgaggccttgggtgtctccgtgactgactacacgttcgaggactgccagctggccctggcggaaggacagctccgtctccccgctgacacttgccttttagaatttgccaggctcgtgcggggcctcgggctaaaaccagaaaagcttgaaaaagatctggacagatactcagaaagagccaggatgaagggaggagagaagataggtattgcggagtttgccgcctccctggaagtccccgtttctgacttgctggaagacatgttttcactgttcgacgagagcggcagcggcgaggtggacctgcgagagtgtgtggttgccctgtctgtcgtctgccggccggcccggaccctggacaccatccagctggctttcaagacgtacggagcgcaagaggacggcagcgtcggcgaaggtgacctgtcctgcatcctcaagacggccctgggggtggcagagctcaccgtgaccgacctattccgagccattgaccaagaggagaaggggaagatcacattcgctgacttccacaggtttgcagaaatgtaccctgccttcgcagaggaatacctgtacccggatcagacacatttcgaaagctgtgcagagacctcacctgcgccaatcccaaacggcttctgtgccgatttcagcccggaaaactcagacgctgggcggaagcctgttcgcaagaagctggattaggacccagggttgcggagagacgcggcccctcccgcgtggacatcaccgccatgagcctctttgcgagtgacctctgggctccgctcctcactcctgctgtacaggcactgtcttcagcccgagttccaggggcctcgggggctgtttgtatcttgttcctttgtgaagtgtgttgcagaaccgacgcttactgtgcgagaatcggagggcgcgcacgcggatcccccgcctggcctggaccccgtggggtcaggttccctgccgggcggggggcaccggtgccgccccgtgttctcccacggggccctggtttcgagtctctgtcacagcctcttccggcggcagcgtgcaccgggcgggcctccgtgcacactcagcacacgcctgccacacagcgtgcgcttgcgtgtcactctggcacgaaacctgtctgcctctgtggatccacagcctggcagagccgagccgtcacctgatttttcagtgtttctacctgtgtgctggagctcatgagtattttataaactccatttaggtacttcaggaaacatgcagcattttttaaaaaatgaaaattgtttttctacttcatttttccttttagagtcaaaggatatttatttataggcctttttttttttaatatagaatctgaggctgtttgggctttgacttaaatttccatcaggcctctctccagcaggtaatccctctccttccgctgggtcccctggggaggtgtgaactcaagggcctagccccaaaacactttttctgcttttcttaatccttttccagtcccctctttttttataaacgttggcagtttgatgtttctgtttcggcataacgtaatccatttcactgtagcctaaactccagtccgaggttggatattgttcaaatgagcagggcccgagctggaagcgcaaggcagccgccgccgtgccgctcctcccttgccctcaggccaggtccctgctggaagcggctgcatcttcctgtcagccctggtttccatggtgactggcgtgacgcagccacctgagtatggctgaccttcctgcagagagaggagccgcagtcttttgcttgtggaaggagacgctgggctgtgcggtgcggagggtgatgaggatgtctggtgacagccgtgcggacaccactcctctctgcagcactgcctcccagcgccagggtcgcgggcacatcccactgagagcgggggtcctgccccatcttagagtcaaaggcagaggggcttccaggccctggatggggtattttggtgtcacctgaagtccctctgacatcaccttgtttcatcattttttatgacagaattagaaacccatccttcaagcacaataatcatcacagacttgagtttgcttcctaaagcaaaggctccgggtttgtttggaaaatttttttgatttctgaaatgaattgatttttatatttggggcatctctatagaaagtgaccaccaaggccagtaagtacgggaaaaaatgtttactaacttcctcagagattcgtgatacgcgtttctccactgacagacatttaaaaacaaccttcagctccgtttcaatcaatcacctcgacttgttttttagcatggacactgccagcaggacagacagggatggagtaaaccgaagtcaatttcagggctcttggcgtgttggacacagaagaaatcctagtgcagcctttggtagctaacagtcactgattttataattggagaatgcgtaaagattcatttttcaaggagaagagcctgcaaatggccaatgaaggaggtaaataaactaagatattccgagggaagggacccaggccacctcccttccgcaggtctgcagatgaagggttttttgaatgaaatgccactgtgcattttcagaaaaaaaaatctctgataaacagactttgaatggatgtttgttcctcctgattctcttttctcttcgtggcgacttagagttggcggatattcggaactgtgaatgtacatagcgttgagttaaacccctagccccaaaacactttttctgcttttcttaatccttttccagtcccctctttttttataaacgttggcagtttgatgtttctgtttcggcataacgtaatccatttcactgtagcctaaactccagtccgaggttggatattgttcaaatgagcagggcccgagctggaagcgcaaggcagccgccgccgtgccgctcctcccttgccctcaggccaggtccctgctggaagcggctgcatcttcctgtcagccctggtttccacgcggggacctgctggggtgtgagggcagagggagggttgccatgaaggaacttgggattttcaatggaataaataaaacataaagtctatacttgggaa

SEQ ID NO: 427719 - DNA, 3875 bp, Homo sapiens
ggcccgctccagccgccgcgcatcctcggcccgcgccccgagacccgcgcccagctagccccggccccgctcggcgccccaggcagctcggctgcgctcgccgcgggacggcgcggccatgaggctgcggggatgcggaccccgggccgcccctgcctccagcgcaggggccagcgacgctcggctgctggcgcccccggggcggaaccccttcgtgcacgagctgcgcctcagcgccctgcagaaggcccaggtggccctcatgacactgacgctcttcccggtccggctcctggttgccgctgccatgatgctgctggcctggcccctcgcacttgtcgcatccctgggctctgcggagaaggaacccgagcagcccccggccctgtggaggaaggttgtggacttcctgctgaaggccatcatgcgcaccatgtggttcgccggcggcttccaccgggtggccgtgaaggggcggcaggcgctgcccaccgaggcggccatcctcacgctcgcgcctcactcgtcctacttcgacgccatccctgtgaccatgacgatgtcctccatcgtgatgaaggcagagagcagagacatcccgatctggggaactctgatccagtatatacggcctgtgttcgtgtcccggtcagaccaggattctcgcaggaaaacagtagaagaaatcaagagacgggcgcagtccaacggaaagtggccacagataatgatttttccagaaggaacttgtacaaacaggacctgcctaattaccttcaaacctggtgcattcatccctggagcgcccgtccagcctgtggttttacgatatccaaataaactggacaccatcacatggacgtggcaaggacctggagcgctggaaatcctgtggctcacgctgtgtcagtttcacaaccaagtggaaatcgagttccttcctgtgtacagcccttctgaggaggagaagaggaaccccgcgctgtatgccagcaacgtgcggcgagtcatggccgaggccttgggtgtctccgtgactgactacacgttcgaggactgccagctggccctggcggaaggacagctccgtctccccgctgacacttgccttttagaatttgccaggctcgtgcggggcctcgggctaaaaccagaaaagcttgaaaaagatctggacagatactcagaaagagccaggatgaagggaggagagaagataggtattgcggagtttgccgcctccctggaagtccccgtttctgacttgctggaagacatgttttcactgttcgacgagagcggcagcggcgaggtggacctgcgagagtgtgtggttgccctgtctgtcgtctgccggccggcccggaccctggacaccatccagctggctttcaagacgtacggagcgcaagaggacggcagcgtcggcgaaggtgacctgtcctgcatcctcaagacggccctgggggtggcagagctcaccgtgaccgacctattccgagccattgaccaagaggagaaggggaagatcacattcgctgacttccacaggtttgcagaaatgtaccctgccttcgcagaggaatacctgtacccggatcagacacatttcgaaagctgtgcagagacctcacctgcgccaatcccaaacggcttctgtgccgatttcagcccggaaaactcagacgctgggcggaagcctgttcgcaagaagctggattaggacccagggttgcggagagacgcggcccctcccgcgtggacatcaccgccatgagcctctttgcgagtgacctctgggctccgctcctcactcctgctgtacaggcactgtcttcagcccgagttccaggggcctcgggggctgtttgtatcttgttcctttgtgaagtgtgttgcagaaccgacgcttactgtgcgagaatcggagggcgcgcacgcggatcccccgcctggcctggaccccgtggggtcaggttccctgccgggcggggggcaccggtgccgccccgtgttctcccacggggccctggtttcgagtctctgtcacagcctcttccggcggcagcgtgcaccgggcgggcctccgtgcacactcagcacacgcctgccacacagcgtgcgcttgcgtgtcactctggcacgaaacctgtctgcctctgtggatccacagcctggcagagccgagccgtcacctgatttttcagtgtttctacctgtgtgctggagctcatgagtattttataaactccatttaggtacttcaggaaacatgcagcattttttaaaaaatgaaaattgtttttctacttcatttttccttttagagtcaaaggatatttatttataggcctttttttttttaatatagaatctgaggctgtttgggctttgacttaaatttccatcaggcctctctccagcaggtaatccctctccttccgctgggtcccctggggaggtgtgaactcaagggcctagccccaaaacactttttctgcttttcttaatccttttccagtcccctctttttttataaacgttggcagtttgatgtttctgtttcggcataacgtaatccatttcactgtagcctaaactccagtccgaggttggatattgttcaaatgagcagggcccgagctggaagcgcaaggcagccgccgccgtgccgctcctcccttgccctcaggccaggtccctgctggaagcggctgcatcttcctgtcagccctggtttccatggtgactggcgtgacgcagccacctgagtatggctgaccttcctgcagagagaggagccgcagtcttttgcttgtggaaggagacgctgggctgtgcggtgcggagggtgatgaggatgtctggtgacagccgtgcggacaccactcctctctgcagcactgcctcccagcgccagggtcgcgggcacatcccactgagagcgggggtcctgccccatcttagagtcaaaggcagaggggcttccaggccctggatggggtattttggtgtcacctgaagtccctctgacatcaccttgtttcatcattttttatgacagaattagaaacccatccttcaagcacaataatcatcacagacttgagtttgcttcctaaagcaaaggctccgggtttgtttggaaaatttttttgatttctgaaatgaattgatttttatatttggggcatctctatagaaagtgaccaccaaggccagtaagtacgggaaaaaatgtttactaacttcctcagagattcgtgatacgcgtttctccactgacagacatttaaaaacaaccttcagctccgtttcaatcaatcacctcgacttgttttttagcatggacactgccagcaggacagacagggatggagtaaaccgaagtcaatttcagggctcttggcgtgttggacacagaagaaatcctagtgcagcctttggtagctaacagtcactgattttataattggagaatgcgtaaagattcatttttcaaggagaagagcctgcaaatggccaatgaagggttttttgaatgaaatgccactgtgcattttcagaaaaaaaaatctctgataaacagactttgaatggatgtttgttcctcctgattctcttttctcttcgtggcgacttagagttggcggatattcggaactgtgaatgtacatagcgttgagttaaaccccttgtgtgtgagacaggacgcagcgggcccctggtggcctgggggccagacccgtgggcaggtggggcatgggccctggcctgcggggacctgctggggtgtgagggcagagggagggttgccatgaaggaacttgggattttcaatggaataaataaaacataaagtctatacttgggaa

SEQ ID NO: 427720 - DNA, 3584 bp, Homo sapiens
ggcccgctccagccgccgcgcatcctcggcccgcgccccgagacccgcgcccagctagccccggccccgctcggcgccccaggcagctcggctgcgctcgccgcgggacggcgcggccatgaggctgcggggatgcggaccccgggccgcccctgcctccagcgcaggggccagcgacgctcggctgctggcgcccccggggcggaaccccttcgtgcacgagctgcgcctcagcgccctgcagaaggcccaggtggccctcatgacactgacgctcttcccggtccggctcctggttgccgctgccatgatgctgctggcctggcccctcgcacttgtcgcatccctgggctctgcggagaaggaacccgagcagcccccggccctgtggaggaaggttgtggacttcctgctgaaggccatcatgcgcaccatgtggttcgccggcggcttccaccgggtggccgtgaaggggcggcaggcgctgcccaccgaggcggccatcctcacgctcgcgcctcactcgtcctacttcgacgccatccctgtgaccatgacgatgtcctccatcgtgatgaaggcagagagcagagacatcccgatctggggaactctgatccagtatatacggcctgtgttcgtgtcccggtcagaccaggattctcgcaggaaaacagtagaagaaatcaagagacgggcgcagtccaacggaaagtggccacagataatgatttttccagaaggaacttgtacaaacaggacctgcctaattaccttcaaacctggtgcattcatccctggagcgcccgtccagcctgtggttttacgatatccaaataaactggacaccatcacatggacgtggcaaggacctggagcgctggaaatcctgtggctcacgctgtgtcagtttcacaaccaagtggaaatcgagttccttcctgtgtacagcccttctgaggaggagaagaggaaccccgcgctgtatgccagcaacgtgcggcgagtcatggccgaggccttgggtgtctccgtgactgactacacgttcgaggactgccagctggccctggcggaaggacagctccgtctccccgctgacacttgccttttagaatttgccaggctcgtgcggggcctcgggctaaaaccagaaaagcttgaaaaagatctggacagatactcagaaagagccaggatgaagggaggagagaagataggtattgcggagtttgccgcctccctggaagtccccgtttctgacttgctggaagacatgttttcactgttcgacgagagcggcagcggcgaggtggacctgcgagagtgtgtggttgccctgtctgtcgtctgccggccggcccggaccctggacaccatccagctggctttcaagacgtacggagcgcaagaggacggcagcgtcggcgaaggtgacctgtcctgcatcctcaagacggccctgggggtggcagagctcaccgtgaccgacctattccgagccattgaccaagaggagaaggggaagatcacattcgctgacttccacaggtttgcagaaatgtaccctgccttcgcagaggaatacctgtacccggatcagacacatttcgaaagctgtgcagagacctcacctgcgccaatcccaaacggcttctgtgccgatttcagcccggaaaactcagacgctgggcggaagcctgttcgcaagaagctggattaggacccagggttgcggagagacgcggcccctcccgcgtggacatcaccgccatgagcctctttgcgagtgacctctgggctccgctcctcactcctgctgtacaggcactgtcttcagcccgagttccaggggcctcgggggctgtttgtatcttgttcctttgtgaagtgtgttgcagaaccgacgcttactgtgcgagaatcggagggcgcgcacgcggatcccccgcctggcctggaccccgtggggtcaggttccctgccgggcggggggcaccggtgccgccccgtgttctcccacggggccctggtttcgagtctctgtcacagcctcttccggcggcagcgtgcaccgggcgggcctccgtgcacactcagcacacgcctgccacacagcgtgcgcttgcgtgtcactctggcacgaaacctgtctgcctctgtggatccacagcctggcagagccgagccgtcacctgatttttcagtgtttctacctgtgtgctggagctcatgagtattttataaactccatttaggtacttcaggaaacatgcagcattttttaaaaaatgaaaattgtttttctacttcatttttccttttagagtcaaaggatatttatttataggcctttttttttttaatatagaatctgaggctgtttgggctttgacttaaatttccatcaggcctctctccagcaggtaatccctctccttccgctgggtcccctggggaggtgtgaactcaagggcctagccccaaaacactttttctgcttttcttaatccttttccagtcccctctttttttataaacgttggcagtttgatgtttctgtttcggcataacgtaatccatttcactgtagcctaaactccagtccgaggttggatattgttcaaatgagcagggcccgagctggaagcgcaaggcagccgccgccgtgccgctcctcccttgccctcaggccaggtccctgctggaagcggctgcatcttcctgtcagccctggtttccatggtgactggcgtgacgcagccacctgagtatggctgaccttcctgcagagagaggagccgcagtcttttgcttgtggaaggagacgctgggctgtgcggtgcggagggtgatgaggatgtctggtgacagccgtgcggacaccactcctctctgcagcactgcctcccagcgccagggtcgcgggcacatcccactgagagcgggggtcctgccccatcttagagtcaaaggcagaggggcttccaggccctggatggggtattttggtgtcacctgaagtccctctgacatcaccttgtttcatcattttttatgacagaattagaaacccatccttcaagcacaataatcatcacagacttgagtttgcttcctaaagcaaaggctccgggtttgtttggaaaatttttttgatttctgaaatgaattgatttttatatttggggcatctctatagaaagtgaccaccaaggccagtaagtacgggaaaaaatgtttactaacttcctcagagattcgtgatacgcgtttctccactgacagacatttaaaaacaaccttcagctccgtttcaatcaatcacctcgacttgttttttagcatggacactgccagcaggacagacagggatggagtaaaccgaagtcaatttcagggctcttggcgtgttggacacagaagaaatcctagtgcagcctttggtagctaacagtcactgattttataattggagaatgcgtaaagattcatttcagggaaagctgggatggcatgaggggtatacagaattcgggagggcccggcccccctcgcggttggaggaggggttgacaagcccc

SEQ ID NO: 427721 - DNA, 3409 bp, Homo sapiens
ggcccgctccagccgccgcgcatcctcggcccgcgccccgagacccgcgcccagctagccccggccccgctcggcgccccaggcagctcggctgcgctcgccgcgggacggcgcggccatgaggctgcggggatgcggaccccgggccgcccctgcctccagcgcaggggccagcgacgctcggctgctggcgcccccggggcggaaccccttcgtgcacgagctgcgcctcagcgccctgcagaaggcccaggtggccctcatgacactgacgctcttcccggtccggctcctggttgccgctgccatgatgctgctggcctggcccctcgcacttgtcgcatccctgggctctgcggagaaggaacccgagcagcccccggccctgtggaggaaggttgtggacttcctgctgaaggccatcatgcgcaccatgtggttcgccggcggcttccaccgggtggccgtgaaggggcggcaggcgctgcccaccgaggcggccatcctcacgctcgcgcctcactcgtcctacttcgacgccatccctgtgaccatgacgatgtcctccatcgtgatgaaggcagagagcagagacatcccgatctggggaactctgatccagtatatacggcctgtgttcgtgtcccggtcagaccaggattctcgcaggaaaacagtagaagaaatcaagagacgggcgcagtccaacggaaagtggccacagataatgatttttccagaaggaacttgtacaaacaggacctgcctaattaccttcaaacctggtgcattcatccctggagcgcccgtccagcctgtggttttacgatatccaaataaactggacaccatcacatggacgtggcaaggacctggagcgctggaaatcctgtggctcacgctgtgtcagtttcacaaccaagtggaaatcgagttccttcctgtgtacagcccttctgaggaggagaagaggaaccccgcgctgtatgccagcaacgtgcggcgagtcatggccgaggccttgggtgtctccgtgactgactacacgttcgaggactgccagctggccctggcggaaggacagctccgtctccccgctgacacttgccttttagaatttgccaggctcgtgcggggcctcgggctaaaaccagaaaagcttgaaaaagatctggacagatactcagaaagagccaggatgaagggaggagagaagataggtattgcggagtttgccgcctccctggaagtccccgtttctgacttgctggaagacatgttttcactgttcgacgagagcggcagcggcgaggtggacctgcgagagtgtgtggttgccctgtctgtcgtctgccggccggcccggaccctggacaccatccagctggctttcaagacgtacggagcgcaagaggacggcagcgtcggcgaaggtgacctgtcctgcatcctcaagacggccctgggggtggcagagctcaccgtgaccgacctattccgagccattgaccaagaggagaaggggaagatcacattcgctgacttccacaggtttgcagaaatgtaccctgccttcgcagaggaatacctgtacccggatcagacacatttcgaaagctgtgcagagacctcacctgcgccaatcccaaacggcttctgtgccgatttcagcccggaaaactcagacgctgggcggaagcctgttcgcaagaagctggattaggacccagggttgcggagagacgcggcccctcccgcgtggacatcaccgccatgagcctctttgcgagtgacctctgggctccgctcctcactcctgctgtacaggcactgtcttcagcccgagttccaggggcctcgggggctgtttgtatcttgttcctttgtgaagtgtgttgcagaaccgacgcttactgtgcgagaatcggagggcgcgcacgcggatcccccgcctggcctggaccccgtggggtcaggttccctgccgggcggggggcaccggtgccgccccgtgttctcccacggggccctggtttcgagtctctgtcacagcctcttccggcggcagcgtgcaccgggcgggcctccgtgcacactcagcacacgcctgccacacagcgtgcgcttgcgtgtcactctggcacgaaacctgtctgcctctgtggatccacagcctggcagagccgagccgtcacctgatttttcagtgtttctacctgtgtgctggagctcatgagtattttataaactccatttaggtacttcaggaaacatgcagcattttttaaaaaatgaaaattgtttttctacttcatttttccttttagagtcaaaggatatttatttataggcctttttttttttaatatagaatctgaggctgtttgggctttgacttaaatttccatcaggcctctctccagcaggtaatccctctccttccgctgggtcccctggggaggtgtgaactcaagggcctagccccaaaacactttttctgcttttcttaatccttttccagtcccctctttttttataaacgttggcagtttgatgtttctgtttcggcataacgtaatccatttcactgtagcctaaactccagtccgaggttggatattgttcaaatgagcagggcccgagctggaagcgcaaggcagccgccgccgtgccgctcctcccttgccctcaggccaggtccctgctggaagcggctgcatcttcctgtcagccctggtttccatggtgactggcgtgacgcagccacctgagtatggctgaccttcctgcagagagaggagccgcagtcttttgcttgtggaaggagacgctgggctgtgcggtgcggagggtgatgaggatgtctggtgacagccgtgcggacaccactcctctctgcagcactgcctcccagcgccagggtcgcgggcacatcccactgagagcgggggtcctgccccatcttagagtcaaaggcagaggggcttccaggccctggatggggtattttggtgtcacctgaagtccctctgacatcaccttgtttcatcattttttatgacagaattagaaacccatccttcaagcacaataatcatcacagacttgagtttgcttcctaaagcaaaggctccgggtttgtttggaaaatttttttgatttctgaaatgaattgatttttatatttggggcatctctatagaaagtgaccaccaaggccagtaagtacgggaaaaaatgtttactaacttcctcagagattcgtgatacgcgtttctccactgacagacatttaaaaacaaccttcagtccgttccatcactcctcgcctggttttagctgggctggccgcggacgccggggggggaccggccctcggcctgggtgggccagaactgggcctgggcag

SEQ ID NO: 427722 - DNA, 798 bp, Homo sapiens
ggcccgctccagccgccgcgcatcctcggcccgcgccccgagacccgcgcccagctagccccggccccgctcggcgccccaggcagctcggctgcgctcgccgcgggacggcgcggccatgaggctgcggggatgcggaccccgggccgcccctgcctccagcgcaggggccagcgacgctcggctgctggcgcccccggggcggaaccccttcgtgcacgagctgcgcctcagcgccctgcagaaggcccaggtggccctcatgacactgacgctcttcccggtccggctcctggttgccgctgccatgatgctgctggcctggcccctcgcacttgtcgcatccctgggctctgcggagaaggaacccgagcagcccccggccctgtggaggaaggttgtggacttcctgctgaaggccatcatgcgcaccatgtggttcgccggcggcttccaccgggtggccgtgaaggggcggcaggcgctgcccaccgaggcggccatcctcacgctcgcgcctcactcgtcctacttcgacgccatccctgtgaccatgacgatgtcctccatcgtgatgaaggcagagagcagagacatcccgatctggggaactctgatccagtatatacggcctgtgttcgtgtcccggtcagaccaggattctcgcaggaaaacagtagaagaaatcaagagacgggcgcagtccaacggaaagtggccacagataatgatttttccagaaggaacttgtacaaacagatgcgccttcgtgcgcttcggggatcctctagtacaggc

SEQ ID NO: 427723 - DNA, 717 bp, Homo sapiens
tcaaaagtgttcagaaacaaatatacagcctttaagtggaaatagagctatctggtactatttttaaaaaattctaaccatcaagaaacaaaagttcaggattttcttctcttatggaacttttatttgaaaggaaagtatagaaaagttggtctcactttccagtggacaaattcaccatatcgtcctgatctgtaccatatgaatgttaagaatatagattaagttatctttttccttgattaaggacaccagtcaattatatggatttcccaggactggtatatgtctgatagtcactggcatggctgtatctgttgttaaatgtggagagacttctgtattgggtagtccatagctgctaattggagccccaggtaatccctgactgacctggttcattccgctgtacccccttgatctggcaactaaagggttaacagctggaggcttctgggatccagcttgagctggtggttaagtacactgaacatcagccctggacctctgcagtgccacttattgttcctaaaattctagattaaggcaaaccctttttggttgtcaagaacatagtgctgtctccaaggaacagcttagtcggtcccaccagaagcatctgttgggagcaggttgggcaccaacccttgcaggactttgggatttgggacaatgtagatttgtgtgagtgcacattaagtctcattgcaaaataga

SEQ ID NO: 427724 - DNA, 800 bp, Homo sapiens
gtggagacagtcagagaagggggctcccggggccctccccagggaactggccctgggcccagaccagatggaggaccccgaaaagaacagggcagttttcaggtttggttggtggcctccagtctcttgtcctcaacgagggttttggcagctccctctcagtggcctctccgctctgcaccgaaggggatgggtccgacccagcctggcatcatcacagcctcgagtggcgtccagcctgccccgctccaccagtggctgctggagaagaacccgagcctggctgtgagccgtgagctttgaggcggtgggatgtgtcagcagaatgtctcctgcccccgagagcgaccccgaggccactgagaagagcagcgcggcctggccggcccgaacgcctgcgtctcagtagctgggagccacgggcccacgcccgcccaccggccgcagtgatgttctagccacagaggagccaagacctcaggtttccagagacttgggatttgcacggcagcagagtcaccgtggagaggccagggtatcacaaacttatggattttgacaagaaaggagggaaaggggagacggaggagggccggagaatgtccaaggccggcgggggccggagcagccacggcatccggagctcggggaccagctcgggggtcctgatggtgggccccaacttccgcgtcggcaagaagatcggctgcggcaacttcggggagctccgcctaggttggtttcagcgttgctggggcaaggctgagggtaaacatgagcgactccaaggccagggagcc

SEQ ID NO: 427725 - DNA, 428 bp, Homo sapiens
ggcagcagggagcatgtacgttggagcctgtctgggaggggaaggagctcagccacttccattagttgttacattgcttgcatgtgagtcacgactgtggaaactccgagatggaccagacagtctgtgtttagggaacttttcaggtttggttggtggcctccagtctcttgtcctcaacgagggttttggcagctccctctcagtggcctgtgagtgtccccactcccttgtctgggaaagggctggagctctggggctcacagagagggtgggtgtgatgtctttttcctgacgtggcatcggggtgtcttacctgcccggacacctgcctgcgcagggtagcacagaccctacaggctgcggctgagcccccagcacccacctgccatcgacagacgcccgccatcgggtcctctaagcagcca

SEQ ID NO: 427726 - DNA, 2941 bp, Homo sapiens
tggggcgcgtatggctgccgccccccgctggcagacgctggcggcgtaaggcgcgcgggccccggagcgggcgcggcggagcgcggcgagcccggcgcctcccgtcccgaacatgcggaggccggcccaggcggcgcgggagccggagcgggggcccaagcgggcaccggagccggagcgcgagggggcgcggggcccggagcgggggtccgcgctgcgctgctgaggccgggccggccgcccagacgctgcccgcgggcccggccacggcggagccaagctgtgagccgtgagctttgaggcggtgggatgtgtcagcagaatgtctcctgcccccgagagcgaccccgaggccactgagaagagcagcgcggcctggccggcccgaacgcctgcgtctcagtagctgggagccacgggcccacgcccgcccaccggccgcagtgatgttctagccacagaggagccaagacctcaggtttccagagacttgggatttgcacggcagcagagtcaccgtggagaggccagggtatcacaaacttatggattttgacaagaaaggagggaaaggggagacggaggagggccggagaatgtccaaggccggcgggggccggagcagccacggcatccggagctcggggaccagctcgggggtcctgatggtgggccccaacttccgcgtcggcaagaagatcggctgcggcaacttcggggagctccgcctaggaaagaatctctatacaaatgaatacgtggctatcaaattggagccgatcaagtcccgggccccgcagctgcacctggagtaccggttctacaagcagctcagcgccacagagggcgtccctcaggtctactacttcggtccgtgcgggaagtacaacgccatggtgctggagctgctggggcccagcctggaggacctgttcgacctgtgcgaccggaccttcacgctcaagacggtgctgatgatcgccatccagctgatcacgcgcatggagtatgtgcacaccaagagcctaatctaccgggacgtgaagcccgagaacttcctggtgggccgcccggggaccaagcggcagcatgccatccacatcatcgacttcgggctggccaaggagtacatcgaccccgagaccaagaagcacatcccgtaccgcgagcacaagagcctgacgggcacggcgcgctacatgagcatcaacacgcacctgggcaaggagcagagccgccgcgacgacctggaggcgctgggccacatgttcatgtacttcctgcgcggcagcctcccctggcaggggctcaaggccgacacgctcaaggagcggtaccagaagatcggggacaccaaacgcgccacgcccatcgaggtgctctgcgagaacttcccagaggagatggccacgtacctgcgctatgtgcggcgcctggacttcttcgagaagcccgactatgactacctgcggaagctcttcaccgacctcttcgaccgcagtggcttcgtgttcgactatgagtacgactgggccgggaagcccctgccgacccccatcggcaccgtccacaccgacctgccctcccagcctcagctccgggacaaaacccagccgcacagcaaaaaccaggcgttgaactccaccaacggggagctgaatgcggacgaccccacggccggccactccaacgccccgatcacagcgcctgcagaggtggaggtggccgatgaaaccaaatgctgctgtttcttcaagaggagaaagagaaaatcgctgcagcgacacaagtgaccctgggcgcgtgcagccccctgaatcttctccgtgcagccccttggggcgcgaccttgtgcgaggccctcggggcccacccacagcggcccagggccagaccctggctggaagccagaacgcagactgcaggggccgcgcctggctcaggcggccccacccccgggacgtggggtcacttccttcatgtaagactttggccgaaatttctacacctgtgtctagtcctcccctccaagagcattaactatttaaaacaaggaaaagaggaaaaaaaaaacagaggcccgccctaccccactcctgcccctccgtttctttgctgaagtgagtagtgtgatcctggaggccccccggcctggccccgccccgccagccgcccccgttagcgtcataaagtccagcttgtctccctcgatccaaaggccgttttctcgaggggagggcaggcccggcctggaggggtgctgtggagctgtcttgcccaggccctcctgggagggggacaggcattgttgccaggggtgaggccgtgccccaggcctccccgaaaccaaaggggaaggcaggggtggggccgtggctgaagccggctccccaaccaaaatgctgcaccaaagctcgggcgccgcgggcacggctgctgcagtctcttcccagcctggccctggcaaggggcgggtgggcgctgccaggcgggtgcttctcgacgcacttgctcccggaggctgcgccccggcgcctggaacccgaggtgggaggaccggttggtgtcaccctgctcggccctcagccctgccgcgtggggcgcgtgggcacggagcttcctgcctctctgctccgacacccggcaagcagccggagacaaaacgccttaaagcccccggcccagccctgcaggtatattgcaggggcctgggggcggccctggactggcgggcggttccccagtggggtgccctggaggctgccgggcagagtggagcagcttggggccgtgcccagggcggtggctgtgagtctagtttttgctttaccaagtgtacagaaatggcatttacgtttctctgatgctcccttgaagccatagaatttaggggcttttttaaaaaaataaaagaaaaatgaaaccaaaaacaaacgaacag

SEQ ID NO: 427727 - DNA, 3947 bp, Homo sapiens
tggggcgcgtatggctgccgccccccgctggcagacgctggcggcgtaaggcgcgcgggccccggagcgggcgcggcggagcgcggcgagcccggcgcctcccgtcccgaacatgcggaggccggcccaggcggcgcgggagccggagcgggggcccaagcgggcaccggagccggagcgcgagggggcgcggggcccggagcgggggtccgcgctgcgctgctgaggccgggccggccgcccagacgctgcccgcgggcccggccacggcggagccaagctgtgagccgtgagctttgaggcggtgggatgtgtcagcagaatgtctcctgcccccgagagcgaccccgaggccactgagaagagcagcgcggcctggccggcccgaacgcctgcgtctcagtagctgggagccacgggcccacgcccgcccaccggccgcagtgatgttctagccacagaggagccaagacctcaggtttccagagacttgggatttgcacggcagcagagtcaccgtggagaggccagggtatcacaaacttatggattttgacaagaaaggagggaaaggggagacggaggagggccggagaatgtccaaggccggcgggggccggagcagccacggcatccggagctcggggaccagctcgggggtcctgatggtgggccccaacttccgcgtcggcaagaagatcggctgcggcaacttcggggagctccgcctagtgcagagtagaagagccgggaaggaccccatcaccatcagatgcatcagagcttcaaaggcccgcccatcaagacgctgccaagagcatgaggccagccaggctggggaggacgttggcgagcatccgcctgcccgtcagggagccacagctggatgatacatcgacagacagcagagggacggtgtagcacacaggcgagggcttgtcctcctcagcctgggggagcgcagctcagtgcttggtggtcagcacgtgactgacactttgccggagaaggggacggctgcccgcaggaagagctacacagccgtgttcgccggaactccgctctggagagtcagaactggagacgggagggcgtgcctcaagggcagatgggcaaaccaaaccccatcctccctgtgagccgcggcacagcaccaggcgggcacacgcagcacgacacggcgaggagcccaccgcaggggcagccttttgggcggggaaggggggatgaatccactgtgaatcccacctccgaagggcagcgcaggaaggacacgcaaatgctggactgaacctgcagctgattcagggggcagtgtcctgagctctaaaacttcaaacctggggcagtgtcctgagctctaaaacttcgaaatctgaccaggcacagtggctcacgcctgtaatcccaacactttgggaggctgatgtgggcggatcacctgacgtcaggagttcgagaccagcctggacaacatggagaaagcccatctctagtaaaaatacaaaaattagccaggttgatggtgcctgcctgtaattccagctactcaggaggctgaggcaggagaatcgcttgaacccaggaggcagaggttccagtgagccgtgatcgcgccagtgcactccagcctgggcaacagaacgagactctgctccaaaaagaaaaaaactttgaaatccctctaaaaataaaatggaccggtggatggtagctgtgaggatggaccgtgtggcaggaaagaatctctatacaaatgaatacgtggctatcaaattggagccgatcaagtcccgggccccgcagctgcacctggagtaccggttctacaagcagctcagcgccacagagggcgtccctcaggtctactacttcggtccgtgcgggaagtacaacgccatggtgctggagctgctggggcccagcctggaggacctgttcgacctgtgcgaccggaccttcacgctcaagacggtgctgatgatcgccatccagctgatcacgcgcatggagtatgtgcacaccaagagcctaatctaccgggacgtgaagcccgagaacttcctggtgggccgcccggggaccaagcggcagcatgccatccacatcatcgacttcgggctggccaaggagtacatcgaccccgagaccaagaagcacatcccgtaccgcgagcacaagagcctgacgggcacggcgcgctacatgagcatcaacacgcacctgggcaaggagcagagccgccgcgacgacctggaggcgctgggccacatgttcatgtacttcctgcgcggcagcctcccctggcaggggctcaaggccgacacgctcaaggagcggtaccagaagatcggggacaccaaacgcgccacgcccatcgaggtgctctgcgagaacttcccagaggagatggccacgtacctgcgctatgtgcggcgcctggacttcttcgagaagcccgactatgactacctgcggaagctcttcaccgacctcttcgaccgcagtggcttcgtgttcgactatgagtacgactgggccgggaagcccctgccgacccccatcggcaccgtccacaccgacctgccctcccagcctcagctccgggacaaaacccagccgcacagcaaaaaccaggcgttgaactccaccaacggggagctgaatgcggacgaccccacggccggccactccaacgccccgatcacagcgcctgcagaggtggaggtggccgatgaaaccaaatgctgctgtttcttcaagaggagaaagagaaaatcgctgcagcgacacaagtgaccctgggcgcgtgcagccccctgaatcttctccgtgcagccccttggggcgcgaccttgtgcgaggccctcggggcccacccacagcggcccagggccagaccctggctggaagccagaacgcagactgcaggggccgcgcctggctcaggcggccccacccccgggacgtggggtcacttccttcatgtaagactttggccgaaatttctacacctgtgtctagtcctcccctccaagagcattaactatttaaaacaaggaaaagaggaaaaaaaaaacagaggcccgccctaccccactcctgcccctccgtttctttgctgaagtgagtagtgtgatcctggaggccccccggcctggccccgccccgccagccgcccccgttagcgtcataaagtccagcttgtctccctcgatccaaaggccgttttctcgaggggagggcaggcccggcctggaggggtgctgtggagctgtcttgcccaggccctcctgggagggggacaggcattgttgccaggggtgaggccgtgccccaggcctccccgaaaccaaaggggaaggcaggggtggggccgtggctgaagccggctccccaaccaaaatgctgcaccaaagctcgggcgccgcgggcacggctgctgcagtctcttcccagcctggccctggcaaggggcgggtgggcgctgccaggcgggtgcttctcgacgcacttgctcccggaggctgcgccccggcgcctggaacccgaggtgggaggaccggttggtgtcaccctgctcggccctcagccctgccgcgtggggcgcgtgggcacggagcttcctgcctctctgctccgacacccggcaagcagccggagacaaaacgccttaaagcccccggcccagccctgcaggtatattgcaggggcctgggggcggccctggactggcgggcggttccccagtggggtgccctggaggctgccgggcagagtggagcagcttggggccgtgcccagggcggtggctgtgagtctagtttttgctttaccaagtgtacagaaatggcatttacgtttctctgatgctcccttgaagccatagaatttaggggcttttttaaaaaaataaaagaaaaatgaaaccaaaaacaaacgaacag

SEQ ID NO: 427728 - DNA, 3037 bp, Homo sapiens
tggggcgcgtatggctgccgccccccgctggcagacgctggcggcgtaaggcgcgcgggccccggagcgggcgcggcggagcgcggcgagcccggcgcctcccgtcccgaacatgcggaggccggcccaggcggcgcgggagccggagcgggggcccaagcgggcaccggagccggagcgcgagggggcgcggggcccggagcgggggtccgcgctgcgctgctgaggccgggccggccgcccagacgctgcccgcgggcccggccacggcggagccaagctgtgagccgtgagctttgaggcggtgggatgtgtcagcagaatgtctcctgcccccgagagcgaccccgaggccactgagaagagcagcgcggcctggccggcccgaacgcctgcgtctcagtagctgggagccacgggcccacgcccgcccaccggccgcagtgatgttctagccacagaggagccaagacctcaggtttccagagacttgggatttgcacggcagcagagtcaccgtggagaggccagggtatcacaaacttatggattttgacaagaaaggagggaaaggggagacggaggagggccggagaatgtccaaggccggcgggggccggagcagccacggcatccggagctcggggaccagctcgggggtcctgatggtgggccccaacttccgcgtcggcaagaagatcggctgcggcaacttcggggagctccgcctaggaaagaatctctatacaaatgaatacgtggctatcaaattggtgagtcggcccctccaccccacccccgctgacgtgccccccagggatttcagggcagcgacccggtcccctggtgactcgctcttgtgcccccaggagccgatcaagtcccgggccccgcagctgcacctggagtaccggttctacaagcagctcagcgccacagagggcgtccctcaggtctactacttcggtccgtgcgggaagtacaacgccatggtgctggagctgctggggcccagcctggaggacctgttcgacctgtgcgaccggaccttcacgctcaagacggtgctgatgatcgccatccagctgatcacgcgcatggagtatgtgcacaccaagagcctaatctaccgggacgtgaagcccgagaacttcctggtgggccgcccggggaccaagcggcagcatgccatccacatcatcgacttcgggctggccaaggagtacatcgaccccgagaccaagaagcacatcccgtaccgcgagcacaagagcctgacgggcacggcgcgctacatgagcatcaacacgcacctgggcaaggagcagagccgccgcgacgacctggaggcgctgggccacatgttcatgtacttcctgcgcggcagcctcccctggcaggggctcaaggccgacacgctcaaggagcggtaccagaagatcggggacaccaaacgcgccacgcccatcgaggtgctctgcgagaacttcccagaggagatggccacgtacctgcgctatgtgcggcgcctggacttcttcgagaagcccgactatgactacctgcggaagctcttcaccgacctcttcgaccgcagtggcttcgtgttcgactatgagtacgactgggccgggaagcccctgccgacccccatcggcaccgtccacaccgacctgccctcccagcctcagctccgggacaaaacccagccgcacagcaaaaaccaggcgttgaactccaccaacggggagctgaatgcggacgaccccacggccggccactccaacgccccgatcacagcgcctgcagaggtggaggtggccgatgaaaccaaatgctgctgtttcttcaagaggagaaagagaaaatcgctgcagcgacacaagtgaccctgggcgcgtgcagccccctgaatcttctccgtgcagccccttggggcgcgaccttgtgcgaggccctcggggcccacccacagcggcccagggccagaccctggctggaagccagaacgcagactgcaggggccgcgcctggctcaggcggccccacccccgggacgtggggtcacttccttcatgtaagactttggccgaaatttctacacctgtgtctagtcctcccctccaagagcattaactatttaaaacaaggaaaagaggaaaaaaaaaacagaggcccgccctaccccactcctgcccctccgtttctttgctgaagtgagtagtgtgatcctggaggccccccggcctggccccgccccgccagccgcccccgttagcgtcataaagtccagcttgtctccctcgatccaaaggccgttttctcgaggggagggcaggcccggcctggaggggtgctgtggagctgtcttgcccaggccctcctgggagggggacaggcattgttgccaggggtgaggccgtgccccaggcctccccgaaaccaaaggggaaggcaggggtggggccgtggctgaagccggctccccaaccaaaatgctgcaccaaagctcgggcgccgcgggcacggctgctgcagtctcttcccagcctggccctggcaaggggcgggtgggcgctgccaggcgggtgcttctcgacgcacttgctcccggaggctgcgccccggcgcctggaacccgaggtgggaggaccggttggtgtcaccctgctcggccctcagccctgccgcgtggggcgcgtgggcacggagcttcctgcctctctgctccgacacccggcaagcagccggagacaaaacgccttaaagcccccggcccagccctgcaggtatattgcaggggcctgggggcggccctggactggcgggcggttccccagtggggtgccctggaggctgccgggcagagtggagcagcttggggccgtgcccagggcggtggctgtgagtctagtttttgctttaccaagtgtacagaaatggcatttacgtttctctgatgctcccttgaagccatagaatttaggggcttttttaaaaaaataaaagaaaaatgaaaccaaaaacaaacgaacag

SEQ ID NO: 427729 - DNA, 3121 bp, Homo sapiens
tggggcgcgtatggctgccgccccccgctggcagacgctggcggcgtaaggcgcgcgggccccggagcgggcgcggcggagcgcggcgagcccggcgcctcccgtcccgaacatgcggaggccggcccaggcggcgcgggagccggagcgggggcccaagcgggcaccggagccggagcgcgagggggcgcggggcccggagcgggggtccgcgctgcgctgctgaggccgggccggccgcccagacgctgcccgcgggcccggccacggcggagccaagctgtgagccgtgagctttgaggcggtgggatgtgtcagcagaatgtctcctgcccccgagagcgaccccgaggccactgagaagagcagcgcggcctggccggcccgaacgcctgcgtctcagtagctgggagccacgggcccacgcccgcccaccggccgcagtgatgttctagccacagaggagccaagacctcaggtttccagagacttgggatttgcacggcagcagagtcaccgtggagaggccagggtatcacaaacttatggattttgacaagaaaggagggaaaggggagacggaggagggccggagaatgtccaaggccggcgggggccggagcagccacggcatccggagctcggggaccagctcgggggtcctgatggtgggccccaacttccgcgtcggcaagaagatcggctgcggcaacttcggggagctccgcctaggaaagaatctctatacaaatgaatacgtggctatcaaattggagccgatcaagtcccgggccccgcagctgcacctggagtaccggttctacaagcagctcagcgccacagagggcgtccctcaggtctactacttcggtccgtgcgggaagtacaacgccatggtgctggagctgctggggcccagcctggaggacctgttcgacctgtgcgaccggaccttcacgctcaagacggtgctgatgatcgccatccagctgatcacgcgcatggagtatgtgcacaccaagagcctaatctaccgggacgtgaagcccgagaacttcctggtgggccgcccggggaccaagcggcagcatgccatccacatcatcgacttcgggctggccaaggagtacatcgaccccgagaccaagaagcacatcccgtaccgcgagcacaagagcctgacgggcacggcgcgctacatgagcatcaacacgcacctgggcaaggagcagagccgccgcgacgacctggaggcgctgggccacatgttcatgtacttcctgcgcggcagcctcccctggcaggggctcaaggccgacacgctcaaggagcggtaccagaagatcggggacaccaaacgcgccacgcccatcgaggtgctctgcgagaacttcccagaggagatggccacgtacctgcgctatgtgcggcgcctggacttcttcgagaagcccgactatgactacctgcggaagctcttcaccgacctcttcgaccgcagtggcttcgtgttcgactatgagtacgactgggccgggaagcccctgccgacccccatcggcaccgtccacaccgacctgccctcccagcctcagctccgggacaaaacccagccgcacagcaaaaaccaggcgttgaactccaccaacggggagctgaatgcggacgaccccacggccggccactccaacgccccgatcacagcgcctgcagaggtggaggtggccgatgaaaccaaatgctgctgtttcttcaagaggagaaagagaaaatcgctgcagcgacacaagtgaccctgggcgcgtgcagccccctgaatcttctccgtgcagccccttggggcgcgaccttgtgcgaggccctcggggcccacccacagcggcccagggccagaccctggctggaagccagaacgcagactgcaggggccgcgcctggctcaggcggccccacccccgggacgtggggtcacttccttcatgtaagactttggccgaaatttctacacctgtgtctagtcctcccctccaagagcattaactatttaaaacaaggaaaagaggaaaaaaaaaacagaggcccgccctaccccacaaaaaacaaaaaacacaaaaaaaaagaagaacaaaaaaaaaaaaacaaaaaaaaaaaaaaaaaaaacaacaccacgaacaagaaaaaaaaaaaaaacaacacggagacgacacgaaagaagaacaaaagaccacgaggcaccagacgccaacaagcgcagcaaaagatcatgacagagcagacagagcaggggcggcgtgaggcacgccacgccgcgcgccgacgaggggcgctcgccggaagcgagagcgcacgggagcgggaggcgagacgagaagcagagaaggaaagcgagagagaagagacaacaaagacagccggccgaaagaggcagaggacaccggcgaagagcagcgccaagacgacggaggggcgaagcgaaaaacaaactgagcgacaccgcgacgcaccctcagcggagggggacccgagaaagcgagcagagcgctaaactcgagacgagcagagcgcggagcaccggagcgctcagacccagatcactccacatgcgcggcctctggcagcagcgcgcggcgcgagcagccgagagcgaagcgccgagacgagagcaaggacgaagagaaggagagaccgagccggaacgacggggcgacttgaaccagcgccgacacgacagagacgcgacacaggaacagccaacaacacggaggagagcgcaagcggcgacgactgcgacgagcgaaggcagaggcagaacgcaggaggacacagaagcacggaagcgacgaggagagcgccgggagtgcaaaagaggggaggctgcgggagccagcgagaagggacgagacagcacaaccaaacaaagaaaacgcgcgacaagagagacaggagccagcagaaggagaaaaagaagcgaggagcaagaacacgaacacgcacacgacgagacacgagaagcaagaaggcagcagaaggaccaagcgcaggccataccgacggacgcaacccgaaaaagccaagaagaagacaacgacgtagggacagagaggacacaaagcacgagggg

SEQ ID NO: 427730 - DNA, 3009 bp, Homo sapiens
tggggcgcgtatggctgccgccccccgctggcagacgctggcggcgtaaggcgcgcgggccccggagcgggcgcggcggagcgcggcgagcccggcgcctcccgtcccgaacatgcggaggccggcccaggcggcgcgggagccggagcgggggcccaagcgggcaccggagccggagcgcgagggggcgcggggcccggagcgggggtccgcgctgcgctgctgaggccgggccggccgcccagacgctgcccgcgggcccggccacggcggagccaagctgtgagccgtgagctttgaggcggtgggatgtgtcagcagaatgtctcctgcccccgagagcgaccccgaggccactgagaagagcagcgcggcctggccggcccgaacgcctgcgtctcagtagctgggagccacgggcccacgcccgcccaccggccgcagtgatgttctagccacagaggagccaagacctcaggtttccagagacttgggatttgcacggcagcagagtcaccgtggagaggccagggtatcacaaacttatggattttgacaagaaaggagggaaaggggagacggaggagggccggagaatgtccaaggccggcgggggccggagcagccacggcatccggagctcggggaccagctcgggggtcctgatggtgggccccaacttccgcgtcggcaagaagatcggctgcggcaacttcggggagctccgcctaggaaagaatctctatacaaatgaatacgtggctatcaaattggagccgatcaagtcccgggccccgcagctgcacctggagtaccggttctacaagcagctcagcgccacagagggcgtccctcaggtctactacttcggtccgtgcgggaagtacaacgccatggtgctggagctgctggggcccagcctggaggacctgttcgacctgtgcgaccggaccttcacgctcaagacggtgctgatgatcgccatccagctgatcacgcgcatggagtatgtgcacaccaagagcctaatctaccgggacgtgaagcccgagaacttcctggtgggccgcccggggaccaagcggcagcatgccatccacatcatcgacttcgggctggccaaggagtacatcgaccccgagaccaagaagcacatcccgtaccgcgagcacaagagcctgacgggcacggcgcgctacatgagcatcaacacgcacctgggcaagggtgagctgcgcgcgcgcggcggggggcgggcgcccggaccccgctgaggctgcgcccctgtcccgcagagcagagccgccgcgacgacctggaggcgctgggccacatgttcatgtacttcctgcgcggcagcctcccctggcaggggctcaaggccgacacgctcaaggagcggtaccagaagatcggggacaccaaacgcgccacgcccatcgaggtgctctgcgagaacttcccagaggagatggccacgtacctgcgctatgtgcggcgcctggacttcttcgagaagcccgactatgactacctgcggaagctcttcaccgacctcttcgaccgcagtggcttcgtgttcgactatgagtacgactgggccgggaagcccctgccgacccccatcggcaccgtccacaccgacctgccctcccagcctcagctccgggacaaaacccagccgcacagcaaaaaccaggcgttgaactccaccaacggggagctgaatgcggacgaccccacggccggccactccaacgccccgatcacagcgcctgcagaggtggaggtggccgatgaaaccaaatgctgctgtttcttcaagaggagaaagagaaaatcgctgcagcgacacaagtgaccctgggcgcgtgcagccccctgaatcttctccgtgcagccccttggggcgcgaccttgtgcgaggccctcggggcccacccacagcggcccagggccagaccctggctggaagccagaacgcagactgcaggggccgcgcctggctcaggcggccccacccccgggacgtggggtcacttccttcatgtaagactttggccgaaatttctacacctgtgtctagtcctcccctccaagagcattaactatttaaaacaaggaaaagaggaaaaaaaaaacagaggcccgccctaccccactcctgcccctccgtttctttgctgaagtgagtagtgtgatcctggaggccccccggcctggccccgccccgccagccgcccccgttagcgtcataaagtccagcttgtctccctcgatccaaaggccgttttctcgaggggagggcaggcccggcctggaggggtgctgtggagctgtcttgcccaggccctcctgggagggggacaggcattgttgccaggggtgaggccgtgccccaggcctccccgaaaccaaaggggaaggcaggggtggggccgtggctgaagccggctccccaaccaaaatgctgcaccaaagctcgggcgccgcgggcacggctgctgcagtctcttcccagcctggccctggcaaggggcgggtgggcgctgccaggcgggtgcttctcgacgcacttgctcccggaggctgcgccccggcgcctggaacccgaggtgggaggaccggttggtgtcaccctgctcggccctcagccctgccgcgtggggcgcgtgggcacggagcttcctgcctctctgctccgacacccggcaagcagccggagacaaaacgccttaaagcccccggcccagccctgcaggtatattgcaggggcctgggggcggccctggactggcgggcggttccccagtggggtgccctggaggctgccgggcagagtggagcagcttggggccgtgcccagggcggtggctgtgagtctagtttttgctttaccaagtgtacagaaatggcatttacgtttctctgatgctcccttgaagccatagaatttaggggcttttttaaaaaaataaaagaaaaatgaaaccaaaaacaaacgaacag

SEQ ID NO: 427731 - DNA, 2855 bp, Homo sapiens
tggggcgcgtatggctgccgccccccgctggcagacgctggcggcgtaaggcgcgcgggccccggagcgggcgcggcggagcgcggcgagcccggcgcctcccgtcccgaacatgcggaggccggcccaggcggcgcgggagccggagcgggggcccaagcgggcaccggagccggagcgcgagggggcgcggggcccggagcgggggtccgcgctgcgctgctgaggccgggccggccgcccagacgctgcccgcgggcccggccacggcggagccaagctgtgagccgtgagctttgaggcggtgggatgtgtcagcagaatgtctcctgcccccgagagcgaccccgaggccactgagaagagcagcgcggcctggccggcccgaacgcctgcgtctcagtagctgggagccacgggcccacgcccgcccaccggccgcagtgatgttctagccacagaggagccaagacctcaggtttccagagacttgggatttgcacggcagcagagtcaccgtggagaggccagggtatcacaaacttatggattttgacaagaaaggagggaaaggggagacggaggagggccggagaatgtccaaggccggcgggggccggagcagccacggcatccggagctcggggaccagctcgggggtcctgatggtgggccccaacttccgcgtcggcaagaagatcggctgcggcaacttcggggagctccgcctaggaaagaatctctatacaaatgaatacgtggctatcaaattggagccgatcaagtcccgggccccgcagctgcacctggagtaccggttctacaagcagctcagcgccacagagggcgtccctcaggtctactacttcggtccgtgcgggaagtacaacgccatggtgctggagctgctggggcccagcctggaggacctgttcgacctgtgcgaccggaccttcacgctcaagacggtgctgatgatcgccatccagctgatcacgcgcatggagtatgtgcacaccaagagcctaatctaccgggacgtgaagcccgagaacttcctggtgggccgcccggggaccaagcggcagcatgccatccacatcatcgacttcgggctggccaaggagtacatcgaccccgagaccaagaagcacatcccgtaccgcgagcacaagagcctgacgggcacggcgcgctacatgagcatcaacacgcacctgggcaagggccgacacgctcaaggagcggtaccagaagatcggggacaccaaacgcgccacgcccatcgaggtgctctgcgagaacttcccagaggagatggccacgtacctgcgctatgtgcggcgcctggacttcttcgagaagcccgactatgactacctgcggaagctcttcaccgacctcttcgaccgcagtggcttcgtgttcgactatgagtacgactgggccgggaagcccctgccgacccccatcggcaccgtccacaccgacctgccctcccagcctcagctccgggacaaaacccagccgcacagcaaaaaccaggcgttgaactccaccaacggggagctgaatgcggacgaccccacggccggccactccaacgccccgatcacagcgcctgcagaggtggaggtggccgatgaaaccaaatgctgctgtttcttcaagaggagaaagagaaaatcgctgcagcgacacaagtgaccctgggcgcgtgcagccccctgaatcttctccgtgcagccccttggggcgcgaccttgtgcgaggccctcggggcccacccacagcggcccagggccagaccctggctggaagccagaacgcagactgcaggggccgcgcctggctcaggcggccccacccccgggacgtggggtcacttccttcatgtaagactttggccgaaatttctacacctgtgtctagtcctcccctccaagagcattaactatttaaaacaaggaaaagaggaaaaaaaaaacagaggcccgccctaccccactcctgcccctccgtttctttgctgaagtgagtagtgtgatcctggaggccccccggcctggccccgccccgccagccgcccccgttagcgtcataaagtccagcttgtctccctcgatccaaaggccgttttctcgaggggagggcaggcccggcctggaggggtgctgtggagctgtcttgcccaggccctcctgggagggggacaggcattgttgccaggggtgaggccgtgccccaggcctccccgaaaccaaaggggaaggcaggggtggggccgtggctgaagccggctccccaaccaaaatgctgcaccaaagctcgggcgccgcgggcacggctgctgcagtctcttcccagcctggccctggcaaggggcgggtgggcgctgccaggcgggtgcttctcgacgcacttgctcccggaggctgcgccccggcgcctggaacccgaggtgggaggaccggttggtgtcaccctgctcggccctcagccctgccgcgtggggcgcgtgggcacggagcttcctgcctctctgctccgacacccggcaagcagccggagacaaaacgccttaaagcccccggcccagccctgcaggtatattgcaggggcctgggggcggccctggactggcgggcggttccccagtggggtgccctggaggctgccgggcagagtggagcagcttggggccgtgcccagggcggtggctgtgagtctagtttttgctttaccaagtgtacagaaatggcatttacgtttctctgatgctcccttgaagccatagaatttaggggcttttttaaaaaaataaaagaaaaatgaaaccaaaaacaaacgaacag

SEQ ID NO: 427732 - DNA, 1276 bp, Homo sapiens
cttgcccaggccctcctgggagggggacaggcattgttgccaggggtgaggcagtgccccaggcctccccgaaaccaaaggggaaggcaggggtggggccgtggctgaagccggctccccaaccaaaatgctgcaccaaagcagccccctgaatcttctccgtgcagccccttggggcgcgaccttgtgcgaggccctcggggcccacccacagcggcccagggccagaccctggctggaagccagaacgcagactgcaggggccgcgcctggctcaggcggccccacccccgggacgtggggtcacttccttcatgtaagactttggccgaaatttctacacctgtgtctagtcctcccctccaagagcattaactatttaaaacaaggaaaagaggaaaaaaaaaacagaggcccgccctaccccactcctgcccctccgtttctttgctgaagtgagtagtgtgatcctggaggccccccggcctggccccgccccgccagccgcccccgttagcgtcataaagtccagcttgtctccctcgatccaaaggccgttttctcgaggggagggcaggcccggcctggaggggtgctgtggagctgtcttgcccaggccctcctgggagggggacaggcattgttgccaggggtgaggccgtgccccaggcctccccgaaaccaaaggggaaggcaggggtggggccgtggctgaagccggctccccaaccaaaatgctgcaccaaagctcgggcgccgcgggcacggctgctgcagtctcttcccagcctggccctggcaaggggcgggtgggcgctgccaggcgggtgcttctcgacgcacttgctcccggaggctgcgccccggcgcctggaacccgaggtgggaggaccggttggtgtcaccctgctcggccctcagccctgccgcgtggggcgcgtgggcacggagcttcctgcctctctgctccgacacccggcaagcagccggagacaaaacgccttaaagcccccggcccagccctgcaggtatattgcaggggcctgggggcggccctggactggcgggcggttccccagtggggtgccctggaggctgccgggcagagtggagcagcttggggccgtgcccagggcggtggctgtgagtctagtttttgctttaccaagtgtacagaaatggcatttacgtttctctgatgctcccttgaagccatagaatttaggggcttttttaaaaaaataaaagaaaaatgaaaccaaaaacaaacgaacag

SEQ ID NO: 427733 - DNA, 1114 bp, Homo sapiens
ataaaaaaaataaaaaaataataaaaaataatcaaaaataaaataaaaaagttaaataaatcatgataaagaaaataaataaaaattatgagtgtaaataaaatttaataaaatgcgcggccccacccccgggacgtggggtcacttccttcatgtaagactttggccgaaatttctacacctgtgtctagtcctcccctccaagagcattaactatttaaaacaaggaaaagaggaaaaaaaaaacagaggcccgccctaccccactcctgcccctccgtttctttgctgaagtgagtagtgtgatcctggaggccccccggcctggccccgccccgccagccgcccccgttagcgtcataaagtccagcttgtctccctcgatccaaaggccgttttctcgaggggagggcaggcccggcctggaggggtgctgtggagctgtcttgcccaggccctcctgggagggggacaggcattgttgccaggggtgaggccgtgccccaggcctccccgaaaccaaaggggaaggcaggggtggggccgtggctgaagccggctccccaaccaaaatgctgcaccaaagctcgggcgccgcgggcacggctgctgcagtctcttcccagcctggccctggcaaggggcgggtgggcgctgccaggcgggtgcttctcgacgcacttgctcccggaggctgcgccccggcgcctggaacccgaggtgggaggaccggttggtgtcaccctgctcggccctcagccctgccgcgtggggcgcgtgggcacggagcttcctgcctctctgctccgacacccggcaagcagccggagacaaaacgccttaaagcccccggcccagccctgcaggtatattgcaggggcctgggggcggccctggactggcgggcggttccccagtggggtgccctggaggctgccgggcagagtggagcagcttggggccgtgcccagggcggtggctgtgagtctagtttttgctttaccaagtgtacagaaatggcatttacgtttctctgatgctcccttgaagccatagaatttaggggcttttttaaaaaaataaaagaaaaatgaaaccaaaaacaaacgaacag

SEQ ID NO: 427734 - DNA, 1089 bp, Homo sapiens
ttcattcggggggtgtgagtgaaagtgaattttggaacgcaagtgcatgtcgttggaatactgaacacatagtgccagaaacttccctgaggcggccccacccccgggacgtggggtcacttccttcatgtaagactttggccgaaatttctacacctgtgtctagtcctcccctccaagagcattaactatttaaaacaaggaaaagaggaaaaaaaaaacagaggcccgccctaccccactcctgcccctccgtttctttgctgaagtgagtagtgtgatcctggaggccccccggcctggccccgccccgccagccgcccccgttagcgtcataaagtccagcttgtctccctcgatccaaaggccgttttctcgaggggagggcaggcccggcctggaggggtgctgtggagctgtcttgcccaggccctcctgggagggggacaggcattgttgccaggggtgaggccgtgccccaggcctccccgaaaccaaaggggaaggcaggggtggggccgtggctgaagccggctccccaaccaaaatgctgcaccaaagctcgggcgccgcgggcacggctgctgcagtctcttcccagcctggccctggcaaggggcgggtgggcgctgccaggcgggtgcttctcgacgcacttgctcccggaggctgcgccccggcgcctggaacccgaggtgggaggaccggttggtgtcaccctgctcggccctcagccctgccgcgtggggcgcgtgggcacggagcttcctgcctctctgctccgacacccggcaagcagccggagacaaaacgccttaaagcccccggcccagccctgcaggtatattgcaggggcctgggggcggccctggactggcgggcggttccccagtggggtgccctggaggctgccgggcagagtggagcagcttggggccgtgcccagggcggtggctgtgagtctagtttttgctttaccaagtgtacagaaatggcatttacgtttctctgatgctcccttgaagccatagaatttaggggcttttttaaaaaaataaaagaaaaatgaaaccaaaaacaaacgaacag

SEQ ID NO: 427735 - DNA, 2026 bp, Homo sapiens
tggggcgcgtatggctgccgccccccgctggcagacgctggcggcgtaaggcgcgcgggccccggagcgggcgcggcggagcgcggcgagcccggcgcctcccgtcccgaacatgcggaggccggcccaggcggcgcgggagccggagcgggggcccaagcgggcaccggagccggagcgcgagggggcgcggggcccggagcgggggtccgcgctgcgctgctgaggccgggccggccgcccagacgctgcccgcgggcccggccacggcggagccaagctgtgagccgtgagctttgaggcggtgggatgtgtcagcagaatgtctcctgcccccgagagcgaccccgaggccactgagaagagcagcgcggcctggccggcccgaacgcctgcgtctcagtagctgggagccacgggcccacgcccgcccaccggccgcagtgatgttctagccacagaggagccaagacctcaggtttccagagacttgggatttgcacggcagcagagtcaccgtggagaggccagggtatcacaaacttatggattttgacaagaaaggagggaaaggggagacggaggagggccggagaatgtccaaggccggcgggggccggagcagccacggcatccggagctcggggaccagctcgggggtcctgatggtgggccccaacttccgcgtcggcaagaagatcggctgcggcaacttcggggagctccgcctaggaaagaatctctatacaaatgaatacgtggctatcaaattggagccgatcaagtcccgggccccgcagctgcacctggagtaccggttctacaagcagctcagcgccacagagggcgtccctcaggtctactacttcggtccgtgcgggaagtacaacgccatggtgctggagctgctggggcccagcctggaggacctgttcgacctgtgcgaccggaccttcacgctcaagacggtgctgatgatcgccatccagctgatcacgcgcatggagtatgtgcacaccaagagcctaatctaccgggacgtgaagcccgagaacttcctggtgggccgcccggggaccaagcggcagcatgccatccacatcatcgacttcgggctggccaaggagtacatcgaccccgagaccaagaagcacatcccgtaccgcgagcacaagagcctgacgggcacggcgcgctacatgagcatcaacacgcacctgggcaaggagcagagccgccgcgacgacctggaggcgctgggccacatgttcatgtacttcctgcgcggcagcctcccctggcaggggctcaaggccgacacgctcaaggagcggtaccagaagatcggggacaccaaacgcgccacgcccatcgaggtgctctgcgagaacttcccagaggagatggccacgtacctgcgctatgtgcggcgcctggacttcttcgagaagcccgactatgactacctgcggaagctcttcaccgacctcttcgaccgcagtggcttcgtgttcgactatgagtacgactgggccgggaagcccctgccgacccccatcggcaccgtccacaccgacctgccctcccagcctcagctccgggacaaaacccagccgcacagcaaaaaccaggcgttgaactccaccaacggggagctgaatgcggacgaccccacggccggccactccaacgccccgatcacagcgcctgcagaggtggaggtggccgatgaaaccaaatgctgctgtttcttcaagaggagaaagagaaaatcgctgcagcgacacaagtgaccctgggcgcgtctggactggcgggcggttccccagtggggtgccctggaggctgccgggcagagtggagcagcttggggccgtgcccagggcggtggctgtgagtctagtttttgctttaccaagtgtacagaaatggcatttacgtttctctgatgctcccttgaagccatagaatttaggggcttttttaaaaaaataaaagaaaaatgaaaccaaaaacaaacgaacag

SEQ ID NO: 427736 - DNA, 703 bp, Homo sapiens
gtggagacagtcagagaagggggctcccggggccctccccagggaactggccctgggcccagaccagatggaggaccccgaaaagaacagggcagctgtgagccgtgagctttgaggcggtgggatgtgtcagcagaatgtctcctgcccccgagagcgaccccgaggccactgagaagagcagcgcggcctggccggcccgaacgcctgcgtctcagtagctgggagccacgggcccacgcccgcccaccggccgcagtgatgttctagccacagaggagccaagacctcaggtttccagagacttgggatttgcacggcagcagagtcaccctgctcggccctcagccctgccgcgtggggcgcgtgggcacggagcttcctgcctctctgctccgacacccggcaagcagccggagacaaaacgccttaaagcccccggcccagccctgcaggtatattgcaggggcctgggggcggccctggactggcgggcggttccccagtggggtgccctggaggctgccgggcagagtggagcagcttggggccgtgcccagggcggtggctgtgagtctagtttttgctttaccaagtgtacagaaatggcatttacgtttctctgatgctcccttgaagccatagaatttaggggcttttttaaaaaaataaaagaaaaatgaaaccaaaaacaaacgaacag

SEQ ID NO: 427737 - DNA, 523 bp, Homo sapiens
atgtggcttcccagtctgcatctccatctgctcccagggtgcgagttggtttttgtattaataactgaggtgtgacactcgggctgtacccgctagctgtgtaactcatgcagctcagtgcctttagctcatcatgaggctgtgtctctgtctgtgccatctaatagaggatattttcatcctcatggcgagaagggatggatttgttttcctcgtgaagtcggtgacgtttgcttttcaggtttggttggtggcctccagtctcttgtcctcaacgagggttttggcagctccctctcagtggcctgtgagtgtccccactcccttgtctgggaaagggctggagctctggggctcacagagagggtgggtgtgatgtctttttcctgacgtggcatcggggtgtcttacctgcccggacacctgcctgcgcagggtagcacagaccctacaggctgcggctgagcccccagcacccacctgccatcgacagacgcccgccatcgggtcctctaagcagcca

SEQ ID NO: 427738 - DNA, 2756 bp, Homo sapiens
gtggagacagtcagagaagggggctcccggggccctccccagggaactggccctgggcccagaccagatggaggaccccgaaaagaacagggcagctgtgagccgtgagctttgaggcggtgggatgtgtcagcagaatgtctcctgcccccgagagcgaccccgaggccactgagaagagcagcgcggcctggccggcccgaacgcctgcgtctcagtagctgggagccacgggcccacgcccgcccaccggccgcagtgatgttctagccacagaggagccaagacctcaggtttccagagacttgggatttgcacggcagcagagtcaccgtggagaggccagggtatcacaaacttatggattttgacaagaaaggagggaaaggggagacggaggagggccggagaatgtccaaggccggcgggggccggagcagccacggcatccggagctcggggaccagctcgggggtcctgatggtgggccccaacttccgcgtcggcaagaagatcggctgcggcaacttcggggagctccgcctaggaaagaatctctatacaaatgaatacgtggctatcaaattggagccgatcaagtcccgggccccgcagctgcacctggagtaccggttctacaagcagctcagcgccacagagggcgtccctcaggtctactacttcggtccgtgcgggaagtacaacgccatggtgctggagctgctggggcccagcctggaggacctgttcgacctgtgcgaccggaccttcacgctcaagacggtgctgatgatcgccatccagctgatcacgcgcatggagtatgtgcacaccaagagcctaatctaccgggacgtgaagcccgagaacttcctggtgggccgcccggggaccaagcggcagcatgccatccacatcatcgacttcgggctggccaaggagtacatcgaccccgagaccaagaagcacatcccgtaccgcgagcacaagagcctgacgggcacggcgcgctacatgagcatcaacacgcacctgggcaaggagcagagccgccgcgacgacctggaggcgctgggccacatgttcatgtacttcctgcgcggcagcctcccctggcaggggctcaaggccgacacgctcaaggagcggtaccagaagatcggggacaccaaacgcgccacgcccatcgaggtgctctgcgagaacttcccagaggagatggccacgtacctgcgctatgtgcggcgcctggacttcttcgagaagcccgactatgactacctgcggaagctcttcaccgacctcttcgaccgcagtggcttcgtgttcgactatgagtacgactgggccgggaagcccctgccgacccccatcggcaccgtccacaccgacctgccctcccagcctcagctccgggacaaaacccagccgcacagcaaaaaccaggcgttgaactccaccaacggggagctgaatgcggacgaccccacggccggccactccaacgccccgatcacagcgcctgcagaggtggaggtggccgatgaaaccaaatgctgctgtttcttcaagaggagaaagagaaaatcgctgcagcgacacaagtgaccctgggcgcgtgcagccccctgaatcttctccgtgcagccccttggggcgcgaccttgtgcgaggccctcggggcccacccacagcggcccagggccagaccctggctggaagccagaacgcagactgcaggggccgcgcctggctcaggcggccccacccccgggacgtggggtcacttccttcatgtaagactttggccgaaatttctacacctgtgtctagtcctcccctccaagagcattaactatttaaaacaaggaaaagaggaaaaaaaaaacagaggcccgccctaccccactcctgcccctccgtttctttgctgaagtgagtagtgtgatcctggaggccccccggcctggccccgccccgccagccgcccccgttagcgtcataaagtccagcttgtctccctcgatccaaaggccgttttctcgaggggagggcaggcccggcctggaggggtgctgtggagctgtcttgcccaggccctcctgggagggggacaggcattgttgccaggggtgaggccgtgccccaggcctccccgaaaccaaaggggaaggcaggggtggggccgtggctgaagccggctccccaaccaaaatgctgcaccaaagctcgggcgccgcgggcacggctgctgcagtctcttcccagcctggccctggcaaggggcgggtgggcgctgccaggcgggtgcttctcgacgcacttgctcccggaggctgcgccccggcgcctggaacccgaggtgggaggaccggttggtgtcaccctgctcggccctcagccctgccgcgtggggcgcgtgggcacggagcttcctgcctctctgctccgacacccggcaagcagccggagacaaaacgccttaaagcccccggcccagccctgcaggtatattgcaggggcctgggggcggccctggactggcgggcggttccccagtggggtgccctggaggctgccgggcagagtggagcagcttggggccgtgcccagggcggtggctgtgagtctagtttttgctttaccaagtgtacagaaatggcatttacgtttctctgatgctcccttgaagccatagaatttaggggcttttttaaaaaaataaaagaaaaatgaaaccaaaaacaaacgaacag

SEQ ID NO: 427739 - DNA, 4043 bp, Homo sapiens
tggggcgcgtatggctgccgccccccgctggcagacgctggcggcgtaaggcgcgcgggccccggagcgggcgcggcggagcgcggcgagcccggcgcctcccgtcccgaacatgcggaggccggcccaggcggcgcgggagccggagcgggggcccaagcgggcaccggagccggagcgcgagggggcgcggggcccggagcgggggtccgcgctgcgctgctgaggccgggccggccgcccagacgctgcccgcgggcccggccacggcggagccaagctgtgagccgtgagctttgaggcggtgggatgtgtcagcagaatgtctcctgcccccgagagcgaccccgaggccactgagaagagcagcgcggcctggccggcccgaacgcctgcgtctcagtagctgggagccacgggcccacgcccgcccaccggccgcagtgatgttctagccacagaggagccaagacctcaggtttccagagacttgggatttgcacggcagcagagtcaccgtggagaggccagggtatcacaaacttatggattttgacaagaaaggagggaaaggggagacggaggagggccggagaatgtccaaggccggcgggggccggagcagccacggcatccggagctcggggaccagctcgggggtcctgatggtgggccccaacttccgcgtcggcaagaagatcggctgcggcaacttcggggagctccgcctagtgcagagtagaagagccgggaaggaccccatcaccatcagatgcatcagagcttcaaaggcccgcccatcaagacgctgccaagagcatgaggccagccaggctggggaggacgttggcgagcatccgcctgcccgtcagggagccacagctggatgatacatcgacagacagcagagggacggtgtagcacacaggcgagggcttgtcctcctcagcctgggggagcgcagctcagtgcttggtggtcagcacgtgactgacactttgccggagaaggggacggctgcccgcaggaagagctacacagccgtgttcgccggaactccgctctggagagtcagaactggagacgggagggcgtgcctcaagggcagatgggcaaaccaaaccccatcctccctgtgagccgcggcacagcaccaggcgggcacacgcagcacgacacggcgaggagcccaccgcaggggcagccttttgggcggggaaggggggatgaatccactgtgaatcccacctccgaagggcagcgcaggaaggacacgcaaatgctggactgaacctgcagctgattcagggggcagtgtcctgagctctaaaacttcaaacctggggcagtgtcctgagctctaaaacttcgaaatctgaccaggcacagtggctcacgcctgtaatcccaacactttgggaggctgatgtgggcggatcacctgacgtcaggagttcgagaccagcctggacaacatggagaaagcccatctctagtaaaaatacaaaaattagccaggttgatggtgcctgcctgtaattccagctactcaggaggctgaggcaggagaatcgcttgaacccaggaggcagaggttccagtgagccgtgatcgcgccagtgcactccagcctgggcaacagaacgagactctgctccaaaaagaaaaaaactttgaaatccctctaaaaataaaatggaccggtggatggtagctgtgaggatggaccgtgtggcaggaaagaatctctatacaaatgaatacgtggctatcaaattggtgagtcggcccctccaccccacccccgctgacgtgccccccagggatttcagggcagcgacccggtcccctggtgactcgctcttgtgcccccaggagccgatcaagtcccgggccccgcagctgcacctggagtaccggttctacaagcagctcagcgccacagagggcgtccctcaggtctactacttcggtccgtgcgggaagtacaacgccatggtgctggagctgctggggcccagcctggaggacctgttcgacctgtgcgaccggaccttcacgctcaagacggtgctgatgatcgccatccagctgatcacgcgcatggagtatgtgcacaccaagagcctaatctaccgggacgtgaagcccgagaacttcctggtgggccgcccggggaccaagcggcagcatgccatccacatcatcgacttcgggctggccaaggagtacatcgaccccgagaccaagaagcacatcccgtaccgcgagcacaagagcctgacgggcacggcgcgctacatgagcatcaacacgcacctgggcaaggagcagagccgccgcgacgacctggaggcgctgggccacatgttcatgtacttcctgcgcggcagcctcccctggcaggggctcaaggccgacacgctcaaggagcggtaccagaagatcggggacaccaaacgcgccacgcccatcgaggtgctctgcgagaacttcccagaggagatggccacgtacctgcgctatgtgcggcgcctggacttcttcgagaagcccgactatgactacctgcggaagctcttcaccgacctcttcgaccgcagtggcttcgtgttcgactatgagtacgactgggccgggaagcccctgccgacccccatcggcaccgtccacaccgacctgccctcccagcctcagctccgggacaaaacccagccgcacagcaaaaaccaggcgttgaactccaccaacggggagctgaatgcggacgaccccacggccggccactccaacgccccgatcacagcgcctgcagaggtggaggtggccgatgaaaccaaatgctgctgtttcttcaagaggagaaagagaaaatcgctgcagcgacacaagtgaccctgggcgcgtgcagccccctgaatcttctccgtgcagccccttggggcgcgaccttgtgcgaggccctcggggcccacccacagcggcccagggccagaccctggctggaagccagaacgcagactgcaggggccgcgcctggctcaggcggccccacccccgggacgtggggtcacttccttcatgtaagactttggccgaaatttctacacctgtgtctagtcctcccctccaagagcattaactatttaaaacaaggaaaagaggaaaaaaaaaacagaggcccgccctaccccactcctgcccctccgtttctttgctgaagtgagtagtgtgatcctggaggccccccggcctggccccgccccgccagccgcccccgttagcgtcataaagtccagcttgtctccctcgatccaaaggccgttttctcgaggggagggcaggcccggcctggaggggtgctgtggagctgtcttgcccaggccctcctgggagggggacaggcattgttgccaggggtgaggccgtgccccaggcctccccgaaaccaaaggggaaggcaggggtggggccgtggctgaagccggctccccaaccaaaatgctgcaccaaagctcgggcgccgcgggcacggctgctgcagtctcttcccagcctggccctggcaaggggcgggtgggcgctgccaggcgggtgcttctcgacgcacttgctcccggaggctgcgccccggcgcctggaacccgaggtgggaggaccggttggtgtcaccctgctcggccctcagccctgccgcgtggggcgcgtgggcacggagcttcctgcctctctgctccgacacccggcaagcagccggagacaaaacgccttaaagcccccggcccagccctgcaggtatattgcaggggcctgggggcggccctggactggcgggcggttccccagtggggtgccctggaggctgccgggcagagtggagcagcttggggccgtgcccagggcggtggctgtgagtctagtttttgctttaccaagtgtacagaaatggcatttacgtttctctgatgctcccttgaagccatagaatttaggggcttttttaaaaaaataaaagaaaaatgaaaccaaaaacaaacgaacag

SEQ ID NO: 427740 - DNA, 2749 bp, Homo sapiens
tggggcgcgtatggctgccgccccccgctggcagacgctggcggcgtaaggcgcgcgggccccggagcgggcgcggcggagcgcggcgagcccggcgcctcccgtcccgaacatgcggaggccggcccaggcggcgcgggagccggagcgggggcccaagcgggcaccggagccggagcgcgagggggcgcggggcccggagcgggggtccgcgctgcgctgctgaggccgggccggccgcccagacgctgcccgcgggcccggccacggcggagccaagctgtgagccgtgagctttgaggcggtgggatgtgtcagcagaatgtctcctgcccccgagagcgaccccgaggccactgagaagagcagcgcggcctggccggcccgaacgcctgcgtctcagtagctgggagccacgggcccacgcccgcccaccggccgcagtgatgttctagccacagaggagccaagacctcaggtttccagagacttgggatttgcacggcagcagagtcaccgtggagaggccagggtatcacaaacttatggattttgacaagaaaggagggaaaggggagacggaggagggccggagaatgtccaaggccggcgggggccggagcagccacggcatccggagctcggggaccagctcgggggtcctgatggtgggccccaacttccgcgtcggcaagaagatcggctgcggcaacttcggggagctccgcctaggaaagaatctctatacaaatgaatacgtggctatcaaattggagccgatcaagtcccgggccccgcagctgcacctggagtaccggttctacaagcagctcagcgccacagagggcgtccctcaggtctactacttcggtccgtgcgggaagtacaacgccatggtgctggagctgctggggcccagcctggaggacctgttcgacctgtgcgaccggaccttcacgctcaagacggtgctgatgatcgccatccagctgatcacgcgcatggagtatgtgcacaccaagagcctaatctaccgggacgtgaagcccgagaacttcctggtgggccgcccggggaccaagcggcagcatgccatccacatcatcgacttcgggctggccaaggagtacatcgaccccgagaccaagaagcacatcccgtaccgcgagcacaagagcctgacgggcacggcgcgctacatgagcatcaacacgcacctgggcaaggagcagagccgccgcgacgacctggaggcgctgggccacatgttcatgtacttcctgcgcggcagcctcccctggcaggggctcaaggccgacacgctcaaggagcggtaccagaagatcggggacaccaaacgcgccacgcccatcgaggtgctctgcgagaacttcccagaggagatggccacgtacctgcgctatgtgcggcgcctggacttcttcgagaagcccgactatgactacctgcggaagctcttcaccgacctcttcgaccgcagtggcttcgtgttcgactatgagtacgactgggccgggaagcccctgccgacccccatcggcaccgtccacaccgacctgccctcccagcctcagctccgggacaaaacccaggcagccccctgaatcttctccgtgcagccccttggggcgcgaccttgtgcgaggccctcggggcccacccacagcggcccagggccagaccctggctggaagccagaacgcagactgcaggggccgcgcctggctcaggcggccccacccccgggacgtggggtcacttccttcatgtaagactttggccgaaatttctacacctgtgtctagtcctcccctccaagagcattaactatttaaaacaaggaaaagaggaaaaaaaaaacagaggcccgccctaccccactcctgcccctccgtttctttgctgaagtgagtagtgtgatcctggaggccccccggcctggccccgccccgccagccgcccccgttagcgtcataaagtccagcttgtctccctcgatccaaaggccgttttctcgaggggagggcaggcccggcctggaggggtgctgtggagctgtcttgcccaggccctcctgggagggggacaggcattgttgccaggggtgaggccgtgccccaggcctccccgaaaccaaaggggaaggcaggggtggggccgtggctgaagccggctccccaaccaaaatgctgcaccaaagctcgggcgccgcgggcacggctgctgcagtctcttcccagcctggccctggcaaggggcgggtgggcgctgccaggcgggtgcttctcgacgcacttgctcccggaggctgcgccccggcgcctggaacccgaggtgggaggaccggttggtgtcaccctgctcggccctcagccctgccgcgtggggcgcgtgggcacggagcttcctgcctctctgctccgacacccggcaagcagccggagacaaaacgccttaaagcccccggcccagccctgcaggtatattgcaggggcctgggggcggccctggactggcgggcggttccccagtggggtgccctggaggctgccgggcagagtggagcagcttggggccgtgcccagggcggtggctgtgagtctagtttttgctttaccaagtgtacagaaatggcatttacgtttctctgatgctcccttgaagccatagaatttaggggcttttttaaaaaaataaaagaaaaatgaaaccaaaaacaaacgaacag

SEQ ID NO: 427741 - DNA, 2916 bp, Homo sapiens
tggggcgcgtatggctgccgccccccgctggcagacgctggcggcgtaaggcgcgcgggccccggagcgggcgcggcggagcgcggcgagcccggcgcctcccgtcccgaacatgcggaggccggcccaggcggcgcgggagccggagcgggggcccaagcgggcaccggagccggagcgcgagggggcgcggggcccggagcgggggtccgcgctgcgctgctgaggccgggccggccgcccagacgctgcccgcgggcccggccacggcggagccaagctgtgagccgtgagctttgaggcggtgggatgtgtcagcagaatgtctcctgcccccgagagcgaccccgaggccactgagaagagcagcgcggcctggccggcccgaacgcctgcgtctcagtagctgggagccacgggcccacgcccgcccaccggccgcagtgatgttctagccacagaggagccaagacctcaggtttccagagacttgggatttgcacggcagcagagtcaccgtggagaggccagggtatcacaaacttatggattttgacaagaaaggagggaaaggggagacggaggagggccggagaatgtccaaggccggcgggggccggagcagccacggcatccggagctcggggaccagctcgggggtcctgatggtgggccccaacttccgcgtcggcaagaagatcggctgcggcaacttcggggagctccgcctaggaaagaatctctatacaaatgaatacgtggctatcaaattggagccgatcaagtcccgggccccgcagctgcacctggagtaccggttctacaagcagctcagcgccacagagggcgtccctcaggtctactacttcggtccgtgcgggaagtacaacgccatggtgctggagctgctggggcccagcctggaggacctgttcgacctgtgcgaccggaccttcacgctcaagacggtgctgatgatcgccatccagctgatcacgcgcatggagtatgtgcacaccaagagcctaatctaccgggacgtgaagcccgagaacttcctggtgggccgcccggggaccaagcggcagcatgccatccacatcatcgacttcgggctggccaaggagtacatcgaccccgagaccaagaagcacatcccgtaccgcgagcacaagagcctgacgggcacggcgcgctacatgagcatcaacacgcacctgggcaaggagcagagccgccgcgacgacctggaggcgctgggccacatgttcatgtacttcctgcgcggcagcctcccctggcaggggctcaaggccgacacgctcaaggagcggtaccagaagatcggggacaccaaacgcgccacgcccatcgaggtgctctgcgagaacttcccagaggagatggccacgtacctgcgctatgtgcggcgcctggacttcttcgagaagcccgactatgactacctgcggaagctcttcaccgacctcttcgaccgcagtggcttcgtgttcgactatgaccgacccccatcggcaccgtccacaccgacctgccctcccagcctcagctccgggacaaaacccagccgcacagcaaaaaccaggcgttgaactccaccaacggggagctgaatgcggacgaccccacggccggccactccaacgccccgatcacagcgcctgcagaggtggaggtggccgatgaaaccaaatgctgctgtttcttcaagaggagaaagagaaaatcgctgcagcgacacaagtgaccctgggcgcgtgcagccccctgaatcttctccgtgcagccccttggggcgcgaccttgtgcgaggccctcggggcccacccacagcggcccagggccagaccctggctggaagccagaacgcagactgcaggggccgcgcctggctcaggcggccccacccccgggacgtggggtcacttccttcatgtaagactttggccgaaatttctacacctgtgtctagtcctcccctccaagagcattaactatttaaaacaaggaaaagaggaaaaaaaaaacagaggcccgccctaccccactcctgcccctccgtttctttgctgaagtgagtagtgtgatcctggaggccccccggcctggccccgccccgccagccgcccccgttagcgtcataaagtccagcttgtctccctcgatccaaaggccgttttctcgaggggagggcaggcccggcctggaggggtgctgtggagctgtcttgcccaggccctcctgggagggggacaggcattgttgccaggggtgaggccgtgccccaggcctccccgaaaccaaaggggaaggcaggggtggggccgtggctgaagccggctccccaaccaaaatgctgcaccaaagctcgggcgccgcgggcacggctgctgcagtctcttcccagcctggccctggcaaggggcgggtgggcgctgccaggcgggtgcttctcgacgcacttgctcccggaggctgcgccccggcgcctggaacccgaggtgggaggaccggttggtgtcaccctgctcggccctcagccctgccgcgtggggcgcgtgggcacggagcttcctgcctctctgctccgacacccggcaagcagccggagacaaaacgccttaaagcccccggcccagccctgcaggtatattgcaggggcctgggggcggccctggactggcgggcggttccccagtggggtgccctggaggctgccgggcagagtggagcagcttggggccgtgcccagggcggtggctgtgagtctagtttttgctttaccaagtgtacagaaatggcatttacgtttctctgatgctcccttgaagccatagaatttaggggcttttttaaaaaaataaaagaaaaatgaaaccaaaaacaaacgaacag

SEQ ID NO: 427742 - DNA, 1689 bp, Homo sapiens
gaggccgggcaggcgggcggggacgcagggcgggagcaaggctgaccacagacccccgcaggccgacacgctcaaggagcggtaccagaagatcggggacaccaaacgcgccacgcccatcgaggtgctctgcgagaacttcccagaggagatggccacgtacctgcgctatgtgcggcgcctggacttcttcgagaagcccgactatgactacctgcggaagctcttcaccgacctcttcgaccgcagtggcttcgtgttcgactatgagtacgactgggccgggaagcccctgccgacccccatcggcaccgtccacaccgacctgccctcccagcctcagctccgggacaaaacccagccgcacagcaaaaaccaggcgttgaactccaccaacggggagctgaatgcggacgaccccacggccggccactccaacgccccgatcacagcgcctgcagaggtggaggtggccgatgaaaccaaatgctgctgtttcttcaagaggagaaagagaaaatcgctgcagcgacacaagtgaccctgggcgcgtgcagccccctgaatcttctccgtgcagccccttggggcgcgaccttgtgcgaggccctcggggcccacccacagcggcccagggccagaccctggctggaagccagaacgcagactgcaggggccgcgcctggctcaggcggccccacccccgggacgtggggtcacttccttcatgtaagactttggccgaaatttctacacctgtgtctagtcctcccctccaagagcattaactatttaaaacaaggaaaagaggaaaaaaaaaacagaggcccgccctaccccactcctgcccctccgtttctttgctgaagtgagtagtgtgatcctggaggccccccggcctggccccgccccgccagccgcccccgttagcgtcataaagtccagcttgtctccctcgatccaaaggccgttttctcgaggggagggcaggcccggcctggaggggtgctgtggagctgtcttgcccaggccctcctgggagggggacaggcattgttgccaggggtgaggccgtgccccaggcctccccgaaaccaaaggggaaggcaggggtggggccgtggctgaagccggctccccaaccaaaatgctgcaccaaagctcgggcgccgcgggcacggctgctgcagtctcttcccagcctggccctggcaaggggcgggtgggcgctgccaggcgggtgcttctcgacgcacttgctcccggaggctgcgccccggcgcctggaacccgaggtgggaggaccggttggtgtcaccctgctcggccctcagccctgccgcgtggggcgcgtgggcacggagcttcctgcctctctgctccgacacccggcaagcagccggagacaaaacgccttaaagcccccggcccagccctgcaggtatattgcaggggcctgggggcggccctggactggcgggcggttccccagtggggtgccctggaggctgccgggcagagtggagcagcttggggccgtgcccagggcggtggctgtgagtctagtttttgctttaccaagtgtacagaaatggcatttacgtttctctgatgctcccttgaagccatagaatttaggggcttttttaaaaaaataaaagaaaaatgaaaccaaaaacaaacgaacag

SEQ ID NO: 427743 - DNA, 1145 bp, Homo sapiens
agcaggaattcccggcacccaagggcttcagggggctttgtagattatccctcaggtacatgtccaaggagtctaattgagatatccacaggtttattataggtcggggagccagtaccgatttatacctggcaaactacagctgaagcggccccacccccgggacgtggggtcacttccttcatgtaagactttggccgaaatttctacacctgtgtctagtcctcccctccaagagcattaactatttaaaacaaggaaaagaggaaaaaaaaaacagaggcccgccctaccccactcctgcccctccgtttctttgctgaagtgagtagtgtgatcctggaggccccccggcctggccccgccccgccagccgcccccgttagcgtcataaagtccagcttgtctccctcgatccaaaggccgttttctcgaggggagggcaggcccggcctggaggggtgctgtggagctgtcttgcccaggccctcctgggagggggacaggcattgttgccaggggtgaggccgtgccccaggcctccccgaaaccaaaggggaaggcaggggtggggccgtggctgaagccggctccccaaccaaaatgctgcaccaaagctcgggcgccgcgggcacggctgctgcagtctcttcccagcctggccctggcaaggggcgggtgggcgctgccaggcgggtgcttctcgacgcacttgctcccggaggctgcgccccggcgcctggaacccgaggtgggaggaccggttggtgtcaccctgctcggccctcagccctgccgcgtggggcgcgtgggcacggagcttcctgcctctctgctccgacacccggcaagcagccggagacaaaacgccttaaagcccccggcccagccctgcaggtatattgcaggggcctgggggcggccctggactggcgggcggttccccagtggggtgccctggaggctgccgggcagagtggagcagcttggggccgtgcccagggcggtggctgtgagtctagtttttgctttaccaagtgtacagaaatggcatttacgtttctctgatgctcccttgaagccatagaatttaggggcttttttaaaaaaataaaagaaaaatgaaaccaaaaacaaacgaacag

SEQ ID NO: 427744 - DNA, 2081 bp, Homo sapiens
tggggcgcgtatggctgccgccccccgctggcagacgctggcggcgtaaggcgcgcgggccccggagcgggcgcggcggagcgcggcgagcccggcgcctcccgtcccgaacatgcggaggccggcccaggcggcgcgggagccggagcgggggcccaagcgggcaccggagccggagcgcgagggggcgcggggcccggagcgggggtccgcgctgcgctgctgaggccgggccggccgcccagacgctgcccgcgggcccggccacggcggagccaagctgtgagccgtgagctttgaggcggtgggatgtgtcagcagaatgtctcctgcccccgagagcgaccccgaggccactgagaagagcagcgcggcctggccggcccgaacgcctgcgtctcagtagctgggagccacgggcccacgcccgcccaccggccgcagtgatgttctagccacagaggagccaagacctcaggtttccagagacttgggatttgcacggcagcagagtcaccgtggagaggccagggtatcacaaacttatggattttgacaagaaaggagggaaaggggagacggaggagggccggagaatgtccaaggccggcgggggccggagcagccacggcatccggagctcggggaccagctcgggggtcctgatggtgggccccaacttccgcgtcggcaagaagatcggctgcggcaacttcggggagctccgcctaggaaagaatctctatacaaatgaatacgtggctatcaaattggagccgatcaagtcccgggccccgcagctgcacctggagtaccggttctacaagcagctcagcgccacagagggcgtccctcaggtctactacttcggtccgtgcgggaagtacaacgccatggtgctggagctgctggggcccagcctggaggacctgttcgacctgtgcgaccggaccttcacgctcaagacggtgctgatgatcgccatccagctgatcacgcgcatggagtatgtgcacaccaagagcctaatctaccgggacgtgaagcccgagaacttcctggtgggccgcccggggaccaagcggcagcatgccatccacatcatcgacttcgggctggccaaggagtacatcgaccccgagaccaagaagcacatcccgtaccgcgagcacaagagcctgacgggcacggcgcgctacatgagcatcaacacgcacctgggcaaggagcagagccgccgcgacgacctggaggcgctgggccacatgttcatgtacttcctgcgcggcagcctcccctggcaggggctcaaggccgacacgctcaaggagcggtaccagaagatcggggacaccaaacgcgccacgcccatcgaggtgctctgcgagaacttcccagaggagatggccacgtacctgcgctatgtgcggcgcctggacttcttcgagaagcccgactatgactacctgcggaagctcttcaccgacctcttcgaccgcagtggcttcgtgttcgactatgagtacgactgggccgggaagcccctgccgacccccatcggcaccgtccacaccgacctgccctcccagcctcagctccgggacaaaacccagccgcacagcaaaaaccaggcgttgaactccaccaacggggagctgaatgcggacgaccccacggccggccactccaacgccccgatcacagcgcctgcagaggtggaggtggccgatgaaaccaaatgctgctgtttcttcaagaggagaaagagaaaatcgctgcagcgacacaagtgaccctgggcgcgtgcagccccctgaatcttctccgtgcagccccttggggcgcgaccttgtgcgaggccctcggggcccacccacagcggcccagggccagaccctggctggaagccagaacgcagactgcaggggccgcgcctggctcaggcggccccacccccgggacgtggggtcacttccttcatgtaagactttggccgaaatttctacacctgtgtctagtcctcccctccaagagcattaacactagtaatctcgtttcgggttctctgtcgttgtgtggtc

SEQ ID NO: 427745 - DNA, 1636 bp, Homo sapiens
tggggcgcgtatggctgccgccccccgctggcagacgctggcggcgtaaggcgcgcgggccccggagcgggcgcggcggagcgcggcgagcccggcgcctcccgtcccgaacatgcggaggccggcccaggcggcgcgggagccggagcgggggcccaagcgggcaccggagccggagcgcgagggggcgcggggcccggagcgggggtccgcgctgcgctgctgaggccgggccggccgcccagacgctgcccgcgggcccggccacggcggagccaagctgtgagccgtgagctttgaggcggtgggatgtgtcagcagaatgtctcctgcccccgagagcgaccccgaggccactgagaagagcagcgcggcctggccggcccgaacgcctgcgtctcagtagctgggagccacgggcccacgcccgcccaccggccgcagtgatgttctagccacagaggagccaagacctcaggtttccagagacttgggatttgcacggcagcagagtcaccgtggagaggccagggtatcacaaacttatggattttgacaagaaaggagggaaaggggagacggaggagggccggagaatgtccaaggccggcgggggccggagcagccacggcatccggagctcggggaccagctcgggggtcctgatggtgggccccaacttccgcgtcggcaagaagatcggctgcggcaacttcggggagctccgcctaggaaagaatctctatacaaatgaatacgtggctatcaaattggagccgatcaagtcccgggccccgcagctgcacctggagtaccggttctacaagcagctcagcgccacagagggcgtccctcaggtctactacttcggtccgtgcgggaagtacaacgccatggtgctggagctgctggggcccagcctggaggacctgttcgacctgtgcgaccggaccttcacgctcaagacggtgctgatgatcgccatccagctgatcacgcgcatggagtatgtgcacaccaagagcctaatctaccgggacgtgaagcccgagaacttcctggtgggccgcccggggaccaagcggcagcatgccatccacatcatcgacttcgggctggccaaggagtacatcgaccccgagaccaagaagcacatcccgtaccgcgagcacaagagcctgacgggcacggcgcgctacatgagcatcaacacgcacctgggcaaggagcagagccgccgcgacgacctggaggcgctgggccacatgttcatgtacttcctgcgcggcagcctcccctggcaggggctcaaggccgacacgctcaaggagcggtaccagaagatcggggacaccaaacgcgccacgcccatcgaggtgctctgcgagaacttcccagaggagatggccacgtacctgaagaatattggggccctgcctgtggacatggtgcgtctatactttgcggaaactgtgctggccctggagtacttacacaactatggcatcgtgcaccgtgacctcaagcctgacaacctcctaattacatccatggggcacatcaagctcacggactttggactgtccaaaattggcctcatacaagttcgttgtcagactcatgaggccaattttgg

SEQ ID NO: 427746 - DNA, 494 bp, Homo sapiens
gctcttcaggataaatgatcaaggcctaagaccttttaaaaataggtaacacttcattaggtgctacttggccccggccatgttgctggaccgtaggagatactgatccacacttccttttcgccggctcacagtccgcctctcattgtcgaacatgcgctgcaactgcagagccaactgtcggtcttcttcctcttgctgaagcttctgctccatctctcgcaggactgggtctgttggggccagacccacctccccactggtttgtcgcagttttttaagggagccattttgttctaagtgcttggtcttgcagtgtcttttccggcctcgacgcaaagaaggaagtggctcttcacttaggctctcaactagaacaccattagtcagatcaaaatgatttaatgtcttcaattgttgctttgttttgaggactccacccaaaacactgttttggggtagcactgaattaactgtggtgattttcatggctc

SEQ ID NO: 427747 - DNA, 6551 bp, Homo sapiens
agcggagtcgtcccggccgtcggttgccgcctacactgtctgccgtcgcgtcgcagttactaaggcgtggggaagatagcggcaggcaccgcagtggagcggctccgagatccccggggggctcgcaggcgcgcatccctcctgactgggacgtcgcctccgcagacccctcggaggctgaagcgacgccggaggcaggccaaggacactggttagtggttcagaaaggtaacctcaagaagaagcccaagggtttggttggagcacaagctgaacgtcgggaaagcctgaaggcgacttcttttgagttcaaggggaagaaagagtctcggcgggaaaatcaggtggaccttcctggacatatcctggaccaggcttttctgctgaagcaccactgtgtgaggaagccatcagatctgtgcaccattaatgtgagtggcctgaagttctccaaggccaaggaaaatgacttcaagcattttcattctgtgatttatatcaatgcctcagaaaacctgctgcctctagaggcatttcacacgtttccagccctaaaggaactggatctcgcatttaatggcatcaaaactatctacgtgaaatatggagactttaagttattagaattcttggacctttccttcaacagcctgactgtggaggccatctgtgatttggggattctgccacacctccgtgtcctgctcctcacaggcaatggccttacctccctgccgcccaatttggccgtcgcagaacaggaggcatctgtaacatcgctgacaagcaagaggtacatcctgaggttcccagcgctggagacactgatgctggatgacaacagactctccaaccccagttgctttgccagcctggctgggctcaggagactgaagaagttaagcttggatgaaaacaggattatcaggatcccatacctacagcaagttcagctctatgacgagtcagtagactggaatggaggcaggggaagtccccataaagagccccaattcatgctgcagtccaagccaaggatgcttgaggactcagatgagcaactggattatactgtactgcccatgaaaaaggatgttgaccggacagatcgcaaaagaggatgctgtcctaccagtagctctcttcccatctctctgtgagttcgtctttcataacaaccctctggtggcccatacacgaggggtccctccactgctgaagagcttcctccaggagcgactgggaatccacttaattcgaaggaagatagtaaagcctaagcatcatgttttgatgtctcggaaggaatcatggaaggtgaaaagcgaaatcccaaaggtgccgaagcagcctctggtgctccatcacccgcgcatgacgacaaccaagtctccctcaaaggatatgctagagccagaggcagagctggctgaagatctgcccactaccaaaagcacttctgtggagtcagagatgcccactgagaacctggaaggccattccccgtcttgccggaccttcgtgccactgcctcccatctgctccaactccactgtgcatagtgaagagaccctgtcccacctgagtgacacaactgtccgcctcagcccagagcgcccatcagatgaggactccaagagcacagagtccatcttcctgacccaggtgagtgaactgccttcctccgtcatccataaggatgatttagagttaaaggagaaagaccaaaagaaaccaccaacggcacccagagaggtgaaagggactcggaggaaactcccaactgccttccttcccagcaagtaccacggctatgaagaactgctgacagccaagcctgatccagccttcattgagccaaagggaatccagaagaatgcacaagccctgcaacaaatgctgaagcacccactcctgtgccactcctccaagcccaagctggacactcttcagaaaccctatgttcacaaagagaaacgggcccagagaatcccgattccacccccaaagaagactagagcccaacttctggatgacatcttcattcgcttgcgggatccccggaacattacagaggctccactaggtgctgtcctgcaccagtggacagaacggcggctggtgaaccacaagcagtacctggaggccaagaggctgttgaaggagttccaggcacgttaccggcagctggtgagtggctctctgcgcacagtgttcgggactaccccgctccccatggcctgcccagcgctgagtgagagccagcccaagttcggccacttcctcgagttcatggatgagttctgccaggagcccacagccagtgactcacaaggctagagctgtgcatgggggctgtgtgcaccacccggcctgtgccccagctctccccgagggctctgtgccctggaccgcacctcaaggttgaccagccggccacaggcctcagagctcagctgggccccacttgctggccacaaggtggcatccccttgtcaggatctcccctccttggcccaggcatgacctggtgcctggcccagcggcaataaagagtgggtgcacagggcaatagactgggtgccacatgcattctttcttggaacccaggccacagcagcattgtcacacttccctctaaaaatggttttccagttcagatgcaacagggatacatttgttctctgttgtatgagaaactgacaccaaggggatcttaacaaattcctgaacaatggctccaaaaaaggatatttttaaaaaccagatcttgtgagtacagccctaatgtgcagggacagtgtcatcctgtatattcgttctttactcagactctttcttggttccttcattaggagcatgaatggttgaatgtgaacatgacagtaaattggagcaaactgtaaactggacataacttatgccaaaagacgtagttgtacaccatggaaaccccatccctgctcctaatctctactgccattctgaatgccaaagcaagacatccaacatggggcatctcccagagcacatacagcaccaaaaatccacacacagcctaagcttaacccatgtttttgtctgagattgttcaccagagacaagactctgactataaacagaacatccactttcatgagtttcctttactgtattctcaacttgggccttgcttcaagcaggcaaacatacattgaagaatgcactttggtactgtttaaataacaacacatcagcccacttgattccatgccatgtccttgctgacagaaacatccccaacagggcatgccctggtccaagtcctctgtctttgtcaaaatgctcttctgatgagttggagaggaggcagccagcagtggcagtccacaaggatccaggtaccttctccaatcctaaagcagacagcaggttgaataaaaccaatacacaacctattttctaggcaggaggggaaaaggcccttaggacaataatatttgtacaaagagttgagagtaaacaaacagtatatcaggttcaaaaaaaaaaaaactattcgttggcatttaaatttttttcccttgcatagtatctattctctcactaggacttttaagtgctctgctggaggctcagcgttggtaataccatgtttgatgcaaacttgaacccaatgctctcattggtggcacagctttggagggtggtggccccaagaaggggcaatctgcctgctgctatattaatctggaaccagggccaacagctactcttgaactatggtatttgaagagcgagttcattgcctgttttaccttaaatgacaggaaaggaagatgaacaaaccttgctttgccttggcttcaaactagttcttgatttaagacaccagaaagggagagagggagtctgcttagagtttgaggttgcctctcacaagatgacagttaaaagttgccaccttacttaaaaggcattaaggaggcatttactcacaaaggagagagagtaaatttttttcttaagagggaaaaaaatactgataatacatagaacaatctgcacatccagtcttggcactttttccaatttgactgatctctaaactggtgacccttgcatatatcttagtctcttttctacaatcttcttcagaaagctacagcagctaacaatcatgtataaagatgcatttcctagatcatcttcagaagaaaatctcttcagcactttccctagaatctgtctcctgaccaccccgccccagacctgctttctcttttgagaattcataaccaggtatgtttagataccagttcaaaagaccactctatgggttgatgaggaaaaggctgcctgaggacaatttaagaccataatgagtttccaatttttaaagaaaatttggctagctggcttttaattcttaattaaaatcattaaatttaattaaaattattccaatcaaaatatatcactttccaagattccacattcatattacttacttatactatggagactttctctacctgagcatgtattcaggggctataggtacatttaactctaactaactgaaaaaaatcaggaagaaaaaactattaaaataaaataacctcctaaatcatttgggggtatccccatcattggtgcgtgtgtctgcgtgtgtcaaactttaatgattatttattcagaccctggaaaaccacactataaaatagggcactggatcacaagttcgtttggttaaaaaaaaaaaaaaaaaaagtgggggcggggggcagagaagaagtttaacttggatgatttccatgcccattccagctgtaacattctatgactgtgacccagcctttgttctcttttctcactctcctactagacatttcaatgaaaagttaggcaggaaaaaggaaaggaatcccaagttgctgccagctctgatgagagatcaggttgggggagagattaggtggttactgaattgaggtgtgggcctcccctgaccatgtcagtgatccacaacccacctcacttcttggggcttaagctaaaagcagcttctgaagagatgttaatgtcctgtaatcactagaggagaaaattcattctccttccataacattacttagtaaaggaaaagcggtggtgcaatcaaattcacaaataccaatggggtctctaaaatgtagaatgcagcttgctgggtgctggtcagttttctaaatgggaccagaaatggctttcctaagaccataaatgaactctccagccacacatacattcaaatgcattccattagacattgagctcctcaagagcaggaactgctttatctccacagtccagctcagggttggctcaagtctgaagctcagtaaatgtctgtcaaatagaaaagaaaggatgagccttcggtcatcagctacatgagtcaggcacggtggcagcttcccattttagtcagtttgccagtttgtaaccagacagtaatcaattaagagctttaatctcttaaggacatttttcctttagggaaaatgaacaaaaaataaaacatttattaccagtgcttcttccaagcaaaaatttaaaaattaaattaaaatttaaaaaataagtgaagccacttaggagtttccccggcaagcctcacccaagaagacttaaccttttttaaaaagaggcaaatagattaaaggggccaggggctggatgcataatccccctgatctgataccaacccaacaggcccagatgacttcttccagcagatacaatcaatgggtcaagaacattttctcaaagtttctttccctctctatggaaaagagctgacagcccccttctaagggcaccacatttcctggatttcccctcagactgaccttcaccctcccccctaacttcccctttaataataaaaaaacccagaatgcatatatacaaggaacagagtaagacatgggtaatttgtatggtgaactgggcttcaatgatttgtgaggaatttgttttgtgaaatcctgcacctcttattctagctcacaaacccttcccatcgttctgtttccttccttgtccttttctgttcccccaaataatacacatcaacatatcgacttttaaccaacttcagaatcatggaaggagagagggagatttttcagaaagaaaagcattcaggttttagttattaaggatgggaagcatcttaaaattcagataataccttagtggtttttccttcctccaaagccaacctgattaaagatcaaccctcctccctccttaacctagaccactctacctatatttgaaggactgttgctcagcaggaagtttagaaaacaactgtcaataccatcctaggcatcactgtaggtacaaggggggaaggcagtaagctggacctagagtttggactatttgcttaacaagaatttgttcttcattctgcacttgttacaactgctatgcaattcttaaaatgaaagtattaatttggggaaatatttaaaatatatatcttttatctattaaaaatatttctttttaccaaagac

SEQ ID NO: 427748 - DNA, 6619 bp, Homo sapiens
agcggagtcgtcccggccgtcggttgccgcctacactgtctgccgtcgcgtcgcagttactaaggcgtggggaagatagcggcaggcaccgcagtggagcggctccgagatccccggggggctcgcaggcgcgcatccctcctgactgggacgtcgcctccgcagacccctcggaggctgaagcgacgccggaggcaggcaaagaaacaagtgaagaaacaaaaaaaaaaggaagttaaggggccattcccaaagtcaaagatcaagccaaggacactggttagtggttcagaaaggtaacctcaagaagaagcccaagggtttggttggagcacaagctgaacgtcgggaaagcctgaaggcgacttcttttgagttcaaggggaagaaagagtctcggcgggaaaatcaggtggaccttcctggacatatcctggaccaggcttttctgctgaagcaccactgtgtgaggaagccatcagatctgtgcaccattaatgtgagtggcctgaagttctccaaggccaaggaaaatgacttcaagcattttcattctgtgatttatatcaatgcctcagaaaacctgctgcctctagaggcatttcacacgtttccagccctaaaggaactggatctcgcatttaatggcatcaaaactatctacgtgaaatatggagactttaagttattagaattcttggacctttccttcaacagcctgactgtggaggccatctgtgatttggggattctgccacacctccgtgtcctgctcctcacaggcaatggccttacctccctgccgcccaatttggccgtcgcagaacaggaggcatctgtaacatcgctgacaagcaagaggtacatcctgaggttcccagcgctggagacactgatgctggatgacaacagactctccaaccccagttgctttgccagcctggctgggctcaggagactgaagaagttaagcttggatgaaaacaggattatcaggatcccatacctacagcaagttcagctctatgacgagtcagtagactggaatggaggcaggggaagtccccataaagagccccaattcatgctgcagtccaagccaaggatgcttgaggactcagatgagcaactggattatactgtactgcccatgaaaaaggatgttgaccggacagatcgcaaaagaggatgctgtcctaccagtagctctcttcccatctctctgtgagttcgtctttcataacaaccctctggtggcccatacacgaggggtccctccactgctgaagagcttcctccaggagcgactgggaatccacttaattcgaaggaagatagtaaagcctaagcatcatgttttgatgtctcggaaggaatcatggaaggtgaaaagcgaaatcccaaaggtgccgaagcagcctctggtgctccatcacccgcgcatgacgacaaccaagtctccctcaaaggatatgctagagccagaggcagagctggctgaagatctgcccactaccaaaagcacttctgtggagtcagagatgcccactgagaacctggaaggccattccccgtcttgccggaccttcgtgccactgcctcccatctgctccaactccactgtgcatagtgaagagaccctgtcccacctgagtgacacaactgtccgcctcagcccagagcgcccatcagatgaggactccaagagcacagagtccatcttcctgacccaggtgagtgaactgccttcctccgtcatccataaggatgatttagagttaaaggagaaagaccaaaagaaaccaccaacggcacccagagaggtgaaagggactcggaggaaactcccaactgccttccttcccagcaagtaccacggctatgaagaactgctgacagccaagcctgatccagccttcattgagccaaagggaatccagaagaatgcacaagccctgcaacaaatgctgaagcacccactcctgtgccactcctccaagcccaagctggacactcttcagaaaccctatgttcacaaagagaaacgggcccagagaatcccgattccacccccaaagaagactagagcccaacttctggatgacatcttcattcgcttgcgggatccccggaacattacagaggctccactaggtgctgtcctgcaccagtggacagaacggcggctggtgaaccacaagcagtacctggaggccaagaggctgttgaaggagttccaggcacgttaccggcagctggtgagtggctctctgcgcacagtgttcgggactaccccgctccccatggcctgcccagcgctgagtgagagccagcccaagttcggccacttcctcgagttcatggatgagttctgccaggagcccacagccagtgactcacaaggctagagctgtgcatgggggctgtgtgcaccacccggcctgtgccccagctctccccgagggctctgtgccctggaccgcacctcaaggttgaccagccggccacaggcctcagagctcagctgggccccacttgctggccacaaggtggcatccccttgtcaggatctcccctccttggcccaggcatgacctggtgcctggcccagcggcaataaagagtgggtgcacagggcaatagactgggtgccacatgcattctttcttggaacccaggccacagcagcattgtcacacttccctctaaaaatggttttccagttcagatgcaacagggatacatttgttctctgttgtatgagaaactgacaccaaggggatcttaacaaattcctgaacaatggctccaaaaaaggatatttttaaaaaccagatcttgtgagtacagccctaatgtgcagggacagtgtcatcctgtatattcgttctttactcagactctttcttggttccttcattaggagcatgaatggttgaatgtgaacatgacagtaaattggagcaaactgtaaactggacataacttatgccaaaagacgtagttgtacaccatggaaaccccatccctgctcctaatctctactgccattctgaatgccaaagcaagacatccaacatggggcatctcccagagcacatacagcaccaaaaatccacacacagcctaagcttaacccatgtttttgtctgagattgttcaccagagacaagactctgactataaacagaacatccactttcatgagtttcctttactgtattctcaacttgggccttgcttcaagcaggcaaacatacattgaagaatgcactttggtactgtttaaataacaacacatcagcccacttgattccatgccatgtccttgctgacagaaacatccccaacagggcatgccctggtccaagtcctctgtctttgtcaaaatgctcttctgatgagttggagaggaggcagccagcagtggcagtccacaaggatccaggtaccttctccaatcctaaagcagacagcaggttgaataaaaccaatacacaacctattttctaggcaggaggggaaaaggcccttaggacaataatatttgtacaaagagttgagagtaaacaaacagtatatcaggttcaaaaaaaaaaaaactattcgttggcatttaaatttttttcccttgcatagtatctattctctcactaggacttttaagtgctctgctggaggctcagcgttggtaataccatgtttgatgcaaacttgaacccaatgctctcattggtggcacagctttggagggtggtggccccaagaaggggcaatctgcctgctgctatattaatctggaaccagggccaacagctactcttgaactatggtatttgaagagcgagttcattgcctgttttaccttaaatgacaggaaaggaagatgaacaaaccttgctttgccttggcttcaaactagttcttgatttaagacaccagaaagggagagagggagtctgcttagagtttgaggttgcctctcacaagatgacagttaaaagttgccaccttacttaaaaggcattaaggaggcatttactcacaaaggagagagagtaaatttttttcttaagagggaaaaaaatactgataatacatagaacaatctgcacatccagtcttggcactttttccaatttgactgatctctaaactggtgacccttgcatatatcttagtctcttttctacaatcttcttcagaaagctacagcagctaacaatcatgtataaagatgcatttcctagatcatcttcagaagaaaatctcttcagcactttccctagaatctgtctcctgaccaccccgccccagacctgctttctcttttgagaattcataaccaggtatgtttagataccagttcaaaagaccactctatgggttgatgaggaaaaggctgcctgaggacaatttaagaccataatgagtttccaatttttaaagaaaatttggctagctggcttttaattcttaattaaaatcattaaatttaattaaaattattccaatcaaaatatatcactttccaagattccacattcatattacttacttatactatggagactttctctacctgagcatgtattcaggggctataggtacatttaactctaactaactgaaaaaaatcaggaagaaaaaactattaaaataaaataacctcctaaatcatttgggggtatccccatcattggtgcgtgtgtctgcgtgtgtcaaactttaatgattatttattcagaccctggaaaaccacactataaaatagggcactggatcacaagttcgtttggttaaaaaaaaaaaaaaaaaaagtgggggcggggggcagagaagaagtttaacttggatgatttccatgcccattccagctgtaacattctatgactgtgacccagcctttgttctcttttctcactctcctactagacatttcaatgaaaagttaggcaggaaaaaggaaaggaatcccaagttgctgccagctctgatgagagatcaggttgggggagagattaggtggttactgaattgaggtgtgggcctcccctgaccatgtcagtgatccacaacccacctcacttcttggggcttaagctaaaagcagcttctgaagagatgttaatgtcctgtaatcactagaggagaaaattcattctccttccataacattacttagtaaaggaaaagcggtggtgcaatcaaattcacaaataccaatggggtctctaaaatgtagaatgcagcttgctgggtgctggtcagttttctaaatgggaccagaaatggctttcctaagaccataaatgaactctccagccacacatacattcaaatgcattccattagacattgagctcctcaagagcaggaactgctttatctccacagtccagctcagggttggctcaagtctgaagctcagtaaatgtctgtcaaatagaaaagaaaggatgagccttcggtcatcagctacatgagtcaggcacggtggcagcttcccattttagtcagtttgccagtttgtaaccagacagtaatcaattaagagctttaatctcttaaggacatttttcctttagggaaaatgaacaaaaaataaaacatttattaccagtgcttcttccaagcaaaaatttaaaaattaaattaaaatttaaaaaataagtgaagccacttaggagtttccccggcaagcctcacccaagaagacttaaccttttttaaaaagaggcaaatagattaaaggggccaggggctggatgcataatccccctgatctgataccaacccaacaggcccagatgacttcttccagcagatacaatcaatgggtcaagaacattttctcaaagtttctttccctctctatggaaaagagctgacagcccccttctaagggcaccacatttcctggatttcccctcagactgaccttcaccctcccccctaacttcccctttaataataaaaaaacccagaatgcatatatacaaggaacagagtaagacatgggtaatttgtatggtgaactgggcttcaatgatttgtgaggaatttgttttgtgaaatcctgcacctcttattctagctcacaaacccttcccatcgttctgtttccttccttgtccttttctgttcccccaaataatacacatcaacatatcgacttttaaccaacttcagaatcatggaaggagagagggagatttttcagaaagaaaagcattcaggttttagttattaaggatgggaagcatcttaaaattcagataataccttagtggtttttccttcctccaaagccaacctgattaaagatcaaccctcctccctccttaacctagaccactctacctatatttgaaggactgttgctcagcaggaagtttagaaaacaactgtcaataccatcctaggcatcactgtaggtacaaggggggaaggcagtaagctggacctagagtttggactatttgcttaacaagaatttgttcttcattctgcacttgttacaactgctatgcaattcttaaaatgaaagtattaatttggggaaatatttaaaatatatatcttttatctattaaaaatatttctttttaccaaagac

SEQ ID NO: 427749 - DNA, 5747 bp, Homo sapiens
ccctagtatttgatgtaggctacatatccagcatggaaaaaagaggaaaaactcttagctcttaaacacgcaacagtgatggtggaatttcagacaggaggggcaaggtactctgtgcatgagtaggtattattacagggtcaaggcatcacccagcagtgagtcccatccacagcagcatgtcttacccaataccacccccaatcctagcaagcatgtagccctgcagtgaggggcctagacatacctgggtagaggtgaggggtggtgtcaacctgagagtctctcctgcattcattacagatcgcaaaagaggatgctgtcctaccagtagctctcttcccatctctctgtgagttcgtctttcataacaaccctctggtggcccatacacgaggggtccctccactgctgaagagcttcctccaggagcgactgggaatccacttaattcgaaggaagatagtaaagcctaagcatcatgttttgatgtctcggaaggaatcatggaaggtgaaaagcgaaatcccaaaggtgccgaagcagcctctggtgctccatcacccgcgcatgacgacaaccaagtctccctcaaaggatatgctagagccagaggcagagctggctgaagatctgcccactaccaaaagcacttctgtggagtcagagatgcccactgagaacctggaaggccattccccgtcttgccggaccttcgtgccactgcctcccatctgctccaactccactgtgcatagtgaagagaccctgtcccacctgagtgacacaactgtccgcctcagcccagagcgcccatcagatgaggactccaagagcacagagtccatcttcctgacccaggtgagtgaactgccttcctccgtcatccataaggatgatttagagttaaaggagaaagaccaaaagaaaccaccaacggcacccagagaggtgaaagggactcggaggaaactcccaactgccttccttcccagcaagtaccacggctatgaagaactgctgacagccaagcctgatccagccttcattgagccaaagggaatccagaagaatgcacaagccctgcaacaaatgctgaagcacccactcctgtgccactcctccaagcccaagctggacactcttcagaaaccctatgttcacaaagagaaacgggcccagagaatcccgattccacccccaaagaagactagagcccaacttctggatgacatcttcattcgcttgcgggatccccggaacattacagaggctccactaggtgctgtcctgcaccagtggacagaacggcggctggtgaaccacaagcagtacctggaggccaagaggctgttgaaggagttccaggcacgttaccggcagctggtgagtggctctctgcgcacagtgttcgggactaccccgctccccatggcctgcccagcgctgagtgagagccagcccaagttcggccacttcctcgagttcatggatgagttctgccaggagcccacagccagtgactcacaaggctagagctgtgcatgggggctgtgtgcaccacccggcctgtgccccagctctccccgagggctctgtgccctggaccgcacctcaaggttgaccagccggccacaggcctcagagctcagctgggccccacttgctggccacaaggtggcatccccttgtcaggatctcccctccttggcccaggcatgacctggtgcctggcccagcggcaataaagagtgggtgcacagggcaatagactgggtgccacatgcattctttcttggaacccaggccacagcagcattgtcacacttccctctaaaaatggttttccagttcagatgcaacagggatacatttgttctctgttgtatgagaaactgacaccaaggggatcttaacaaattcctgaacaatggctccaaaaaaggatatttttaaaaaccagatcttgtgagtacagccctaatgtgcagggacagtgtcatcctgtatattcgttctttactcagactctttcttggttccttcattaggagcatgaatggttgaatgtgaacatgacagtaaattggagcaaactgtaaactggacataacttatgccaaaagacgtagttgtacaccatggaaaccccatccctgctcctaatctctactgccattctgaatgccaaagcaagacatccaacatggggcatctcccagagcacatacagcaccaaaaatccacacacagcctaagcttaacccatgtttttgtctgagattgttcaccagagacaagactctgactataaacagaacatccactttcatgagtttcctttactgtattctcaacttgggccttgcttcaagcaggcaaacatacattgaagaatgcactttggtactgtttaaataacaacacatcagcccacttgattccatgccatgtccttgctgacagaaacatccccaacagggcatgccctggtccaagtcctctgtctttgtcaaaatgctcttctgatgagttggagaggaggcagccagcagtggcagtccacaaggatccaggtaccttctccaatcctaaagcagacagcaggttgaataaaaccaatacacaacctattttctaggcaggaggggaaaaggcccttaggacaataatatttgtacaaagagttgagagtaaacaaacagtatatcaggttcaaaaaaaaaaaaactattcgttggcatttaaatttttttcccttgcatagtatctattctctcactaggacttttaagtgctctgctggaggctcagcgttggtaataccatgtttgatgcaaacttgaacccaatgctctcattggtggcacagctttggagggtggtggccccaagaaggggcaatctgcctgctgctatattaatctggaaccagggccaacagctactcttgaactatggtatttgaagagcgagttcattgcctgttttaccttaaatgacaggaaaggaagatgaacaaaccttgctttgccttggcttcaaactagttcttgatttaagacaccagaaagggagagagggagtctgcttagagtttgaggttgcctctcacaagatgacagttaaaagttgccaccttacttaaaaggcattaaggaggcatttactcacaaaggagagagagtaaatttttttcttaagagggaaaaaaatactgataatacatagaacaatctgcacatccagtcttggcactttttccaatttgactgatctctaaactggtgacccttgcatatatcttagtctcttttctacaatcttcttcagaaagctacagcagctaacaatcatgtataaagatgcatttcctagatcatcttcagaagaaaatctcttcagcactttccctagaatctgtctcctgaccaccccgccccagacctgctttctcttttgagaattcataaccaggtatgtttagataccagttcaaaagaccactctatgggttgatgaggaaaaggctgcctgaggacaatttaagaccataatgagtttccaatttttaaagaaaatttggctagctggcttttaattcttaattaaaatcattaaatttaattaaaattattccaatcaaaatatatcactttccaagattccacattcatattacttacttatactatggagactttctctacctgagcatgtattcaggggctataggtacatttaactctaactaactgaaaaaaatcaggaagaaaaaactattaaaataaaataacctcctaaatcatttgggggtatccccatcattggtgcgtgtgtctgcgtgtgtcaaactttaatgattatttattcagaccctggaaaaccacactataaaatagggcactggatcacaagttcgtttggttaaaaaaaaaaaaaaaaaaagtgggggcggggggcagagaagaagtttaacttggatgatttccatgcccattccagctgtaacattctatgactgtgacccagcctttgttctcttttctcactctcctactagacatttcaatgaaaagttaggcaggaaaaaggaaaggaatcccaagttgctgccagctctgatgagagatcaggttgggggagagattaggtggttactgaattgaggtgtgggcctcccctgaccatgtcagtgatccacaacccacctcacttcttggggcttaagctaaaagcagcttctgaagagatgttaatgtcctgtaatcactagaggagaaaattcattctccttccataacattacttagtaaaggaaaagcggtggtgcaatcaaattcacaaataccaatggggtctctaaaatgtagaatgcagcttgctgggtgctggtcagttttctaaatgggaccagaaatggctttcctaagaccataaatgaactctccagccacacatacattcaaatgcattccattagacattgagctcctcaagagcaggaactgctttatctccacagtccagctcagggttggctcaagtctgaagctcagtaaatgtctgtcaaatagaaaagaaaggatgagccttcggtcatcagctacatgagtcaggcacggtggcagcttcccattttagtcagtttgccagtttgtaaccagacagtaatcaattaagagctttaatctcttaaggacatttttcctttagggaaaatgaacaaaaaataaaacatttattaccagtgcttcttccaagcaaaaatttaaaaattaaattaaaatttaaaaaataagtgaagccacttaggagtttccccggcaagcctcacccaagaagacttaaccttttttaaaaagaggcaaatagattaaaggggccaggggctggatgcataatccccctgatctgataccaacccaacaggcccagatgacttcttccagcagatacaatcaatgggtcaagaacattttctcaaagtttctttccctctctatggaaaagagctgacagcccccttctaagggcaccacatttcctggatttcccctcagactgaccttcaccctcccccctaacttcccctttaataataaaaaaacccagaatgcatatatacaaggaacagagtaagacatgggtaatttgtatggtgaactgggcttcaatgatttgtgaggaatttgttttgtgaaatcctgcacctcttattctagctcacaaacccttcccatcgttctgtttccttccttgtccttttctgttcccccaaataatacacatcaacatatcgacttttaaccaacttcagaatcatggaaggagagagggagatttttcagaaagaaaagcattcaggttttagttattaaggatgggaagcatcttaaaattcagataataccttagtggtttttccttcctccaaagccaacctgattaaagatcaaccctcctccctccttaacctagaccactctacctatatttgaaggactgttgctcagcaggaagtttagaaaacaactgtcaataccatcctaggcatcactgtaggtacaaggggggaaggcagtaagctggacctagagtttggactatttgcttaacaagaatttgttcttcattctgcacttgttacaactgctatgcaattcttaaaatgaaagtattaatttggggaaatatttaaaatatatatcttttatctattaaaaatatttctttttaccaaagac

SEQ ID NO: 427750 - DNA, 5589 bp, Homo sapiens
ctttattatcttggacaaattccttagcctctctgtgcctcagtttccttgcctattgaatgggaataatggtaggaggtaggaattctcctaggaggtaggaattctcgacctacctcctagggttgagaataagtttcagtaatacatgtaaagcaatttgaatagtgcctggcacatagtaagccccagtataaattttagctaatagtaatcttattttcccatcatggcaccaggggtccctccactgctgaagagcttcctccaggagcgactgggaatccacttaattcgaaggaagatagtaaagcctaagcatcatgttttgatgtctcggaaggaatcatggaaggtgaaaagcgaaatcccaaaggtgccgaagcagcctctggtgctccatcacccgcgcatgacgacaaccaagtctccctcaaaggatatgctagagccagaggcagagctggctgaagatctgcccactaccaaaagcacttctgtggagtcagagatgcccactgagaacctggaaggccattccccgtcttgccggaccttcgtgccactgcctcccatctgctccaactccactgtgcatagtgaagagaccctgtcccacctgagtgacacaactgtccgcctcagcccagagcgcccatcagatgaggactccaagagcacagagtccatcttcctgacccaggtgagtgaactgccttcctccgtcatccataaggatgatttagagttaaaggagaaagaccaaaagaaaccaccaacggcacccagagaggtgaaagggactcggaggaaactcccaactgccttccttcccagcaagtaccacggctatgaagaactgctgacagccaagcctgatccagccttcattgagccaaagggaatccagaagaatgcacaagccctgcaacaaatgctgaagcacccactcctgtgccactcctccaagcccaagctggacactcttcagaaaccctatgttcacaaagagaaacgggcccagagaatcccgattccacccccaaagaagactagagcccaacttctggatgacatcttcattcgcttgcgggatccccggaacattacagaggctccactaggtgctgtcctgcaccagtggacagaacggcggctggtgaaccacaagcagtacctggaggccaagaggctgttgaaggagttccaggcacgttaccggcagctggtgagtggctctctgcgcacagtgttcgggactaccccgctccccatggcctgcccagcgctgagtgagagccagcccaagttcggccacttcctcgagttcatggatgagttctgccaggagcccacagccagtgactcacaaggctagagctgtgcatgggggctgtgtgcaccacccggcctgtgccccagctctccccgagggctctgtgccctggaccgcacctcaaggttgaccagccggccacaggcctcagagctcagctgggccccacttgctggccacaaggtggcatccccttgtcaggatctcccctccttggcccaggcatgacctggtgcctggcccagcggcaataaagagtgggtgcacagggcaatagactgggtgccacatgcattctttcttggaacccaggccacagcagcattgtcacacttccctctaaaaatggttttccagttcagatgcaacagggatacatttgttctctgttgtatgagaaactgacaccaaggggatcttaacaaattcctgaacaatggctccaaaaaaggatatttttaaaaaccagatcttgtgagtacagccctaatgtgcagggacagtgtcatcctgtatattcgttctttactcagactctttcttggttccttcattaggagcatgaatggttgaatgtgaacatgacagtaaattggagcaaactgtaaactggacataacttatgccaaaagacgtagttgtacaccatggaaaccccatccctgctcctaatctctactgccattctgaatgccaaagcaagacatccaacatggggcatctcccagagcacatacagcaccaaaaatccacacacagcctaagcttaacccatgtttttgtctgagattgttcaccagagacaagactctgactataaacagaacatccactttcatgagtttcctttactgtattctcaacttgggccttgcttcaagcaggcaaacatacattgaagaatgcactttggtactgtttaaataacaacacatcagcccacttgattccatgccatgtccttgctgacagaaacatccccaacagggcatgccctggtccaagtcctctgtctttgtcaaaatgctcttctgatgagttggagaggaggcagccagcagtggcagtccacaaggatccaggtaccttctccaatcctaaagcagacagcaggttgaataaaaccaatacacaacctattttctaggcaggaggggaaaaggcccttaggacaataatatttgtacaaagagttgagagtaaacaaacagtatatcaggttcaaaaaaaaaaaaactattcgttggcatttaaatttttttcccttgcatagtatctattctctcactaggacttttaagtgctctgctggaggctcagcgttggtaataccatgtttgatgcaaacttgaacccaatgctctcattggtggcacagctttggagggtggtggccccaagaaggggcaatctgcctgctgctatattaatctggaaccagggccaacagctactcttgaactatggtatttgaagagcgagttcattgcctgttttaccttaaatgacaggaaaggaagatgaacaaaccttgctttgccttggcttcaaactagttcttgatttaagacaccagaaagggagagagggagtctgcttagagtttgaggttgcctctcacaagatgacagttaaaagttgccaccttacttaaaaggcattaaggaggcatttactcacaaaggagagagagtaaatttttttcttaagagggaaaaaaatactgataatacatagaacaatctgcacatccagtcttggcactttttccaatttgactgatctctaaactggtgacccttgcatatatcttagtctcttttctacaatcttcttcagaaagctacagcagctaacaatcatgtataaagatgcatttcctagatcatcttcagaagaaaatctcttcagcactttccctagaatctgtctcctgaccaccccgccccagacctgctttctcttttgagaattcataaccaggtatgtttagataccagttcaaaagaccactctatgggttgatgaggaaaaggctgcctgaggacaatttaagaccataatgagtttccaatttttaaagaaaatttggctagctggcttttaattcttaattaaaatcattaaatttaattaaaattattccaatcaaaatatatcactttccaagattccacattcatattacttacttatactatggagactttctctacctgagcatgtattcaggggctataggtacatttaactctaactaactgaaaaaaatcaggaagaaaaaactattaaaataaaataacctcctaaatcatttgggggtatccccatcattggtgcgtgtgtctgcgtgtgtcaaactttaatgattatttattcagaccctggaaaaccacactataaaatagggcactggatcacaagttcgtttggttaaaaaaaaaaaaaaaaaaagtgggggcggggggcagagaagaagtttaacttggatgatttccatgcccattccagctgtaacattctatgactgtgacccagcctttgttctcttttctcactctcctactagacatttcaatgaaaagttaggcaggaaaaaggaaaggaatcccaagttgctgccagctctgatgagagatcaggttgggggagagattaggtggttactgaattgaggtgtgggcctcccctgaccatgtcagtgatccacaacccacctcacttcttggggcttaagctaaaagcagcttctgaagagatgttaatgtcctgtaatcactagaggagaaaattcattctccttccataacattacttagtaaaggaaaagcggtggtgcaatcaaattcacaaataccaatggggtctctaaaatgtagaatgcagcttgctgggtgctggtcagttttctaaatgggaccagaaatggctttcctaagaccataaatgaactctccagccacacatacattcaaatgcattccattagacattgagctcctcaagagcaggaactgctttatctccacagtccagctcagggttggctcaagtctgaagctcagtaaatgtctgtcaaatagaaaagaaaggatgagccttcggtcatcagctacatgagtcaggcacggtggcagcttcccattttagtcagtttgccagtttgtaaccagacagtaatcaattaagagctttaatctcttaaggacatttttcctttagggaaaatgaacaaaaaataaaacatttattaccagtgcttcttccaagcaaaaatttaaaaattaaattaaaatttaaaaaataagtgaagccacttaggagtttccccggcaagcctcacccaagaagacttaaccttttttaaaaagaggcaaatagattaaaggggccaggggctggatgcataatccccctgatctgataccaacccaacaggcccagatgacttcttccagcagatacaatcaatgggtcaagaacattttctcaaagtttctttccctctctatggaaaagagctgacagcccccttctaagggcaccacatttcctggatttcccctcagactgaccttcaccctcccccctaacttcccctttaataataaaaaaacccagaatgcatatatacaaggaacagagtaagacatgggtaatttgtatggtgaactgggcttcaatgatttgtgaggaatttgttttgtgaaatcctgcacctcttattctagctcacaaacccttcccatcgttctgtttccttccttgtccttttctgttcccccaaataatacacatcaacatatcgacttttaaccaacttcagaatcatggaaggagagagggagatttttcagaaagaaaagcattcaggttttagttattaaggatgggaagcatcttaaaattcagataataccttagtggtttttccttcctccaaagccaacctgattaaagatcaaccctcctccctccttaacctagaccactctacctatatttgaaggactgttgctcagcaggaagtttagaaaacaactgtcaataccatcctaggcatcactgtaggtacaaggggggaaggcagtaagctggacctagagtttggactatttgcttaacaagaatttgttcttcattctgcacttgttacaactgctatgcaattcttaaaatgaaagtattaatttggggaaatatttaaaatatatatcttttatctattaaaaatatttctttttaccaaagac

SEQ ID NO: 427751 - DNA, 6506 bp, Homo sapiens
agcggagtcgtcccggccgtcggttgccgcctacactgtctgccgtcgcgtcgcagttactaaggcgtggggaagatagcggcaggcaccgcagtggagcggctccgagatccccggggggctcgcaggcgcgcatccctcctgactgggacgtcgcctccgcagacccctcggaggctgaagcgacgccggaggcaggccaaggacactggttagtggttcagaaaggtaacctcaagaagaagcccaagggtttggttggagcacaagctgaacgtcgggaaagcctgaaggcgacttcttttgagttcaaggggaagaaagagtctcggcgggaaaatcaggtggaccttcctggacatatcctggaccaggcttttctgctgaagcaccactgtgtgaggaagccatcagatctgtgcaccattaatgtgagtggcctgaagttctccaaggccaaggaaaatgacttcaagcattttcattctgtgatttatatcaatgcctcagaaaacctgctgcctctagaggcatttcacacgtttccagccctaaaggaactggatctcgcatttaatggcatcaaaactatctacgtgaaatatggagactttaagttattagaattcttggacctttccttcaacagcctgactgtggaggccatctgtgatttggggattctgccacacctccgtgtcctgctcctcacaggcaatggccttacctccctgccgcccaatttggccgtcgcagaacaggaggcatctgtaacatcgctgacaagcaagaggtacatcctgaggttcccagcgctggagacactgatgctggatgacaacagactctccaaccccagttgctttgccagcctggctgggctcaggagactgaagaagttaagcttggatgaaaacaggattatcaggatcccatacctacagcaagttcagctctatgacgagtcagtagactggaatggaggcaggggaagtccccataaagagccccaattcatgctgcagtccaagccaaggatgcttgaggactcagatgagcaactggattatactgtactgcccatgaaaaaggatgttgaccggacagatcgcaaaagaggatgctgtcctaccagtagctctcttcccatctctctgtgagttcgtctttcataacaaccctctggtggcccatacacgaggggtccctccactgctgaagagcttcctccaggagcgactgggaatccacttaattcgaaggaagatagtaaagcctaagcatcatgttttgatgtctcggaaggaatcatggaaggtgaaaagcgaaatcccaaaggtgccgaagcagcctctggtgctccatcacccgcgcatgacgacaaccaagtctccctcaaaggatatgctagagccagaggcagagctggctgaagatctgcccactaccaaaagcacttctgtggagtcagagatgcccactgagaacctggaaggccattccccgtcttgccggaccttcgtgccactgcctcccatctgctccaactccactgtgcatagtgaagagaccctgtcccacctgagtgacacaactgtccgcctcagcccagagcgcccatcagatgaggactccaagagcacagagtccatcttcctgacccaggtgagtgaactgccttcctccgtcatccataaggatgatttagagttaaaggagaaagaccaaaagaaaccaccaacggcacccagagaggtgaaagggactcggaggaaactcccaactgccttccttcccagcaagtaccacggctatgaagaactgctgacagccaagcctgatccagccttcattgagccaaagggaatccagaagaatgcacaagccctgcaacaaatgctgaagcacccactcctgtgccactcctccaagcccaagctggacactcttcagaaaccctatgttcacaaagagaaacgggcccagagaatcccgattccacccccaaagaagactagagcccaacttctggatgacatcttcattcgcttgcgggatccccggaacattacagaggctccactaggtgctgtcctgcaccagtggacagaacggcggctggtgaaccacaagcagtacctggaggccaagaggctgttgaaggagttccaggcacgttaccggcagctggtgagtggctctctgcgcacagtgttcgggactaccccgctccccatggcctgcccagcgctgagtgagagccagcccaagttcggccacttcctcgagttcatggatgagttctgccaggagcccacagccagtgactcacaaggctagagctgtgcatgggggctgtgtgcaccacccggcctgtgccccagctctccccgagggctctgtgccctggaccgcacctcaaggttgaccagccggccacaggcctcagagctcagctgggccccacttgctggccacaaggtggcatccccttgtcaggatctcccctccttggcccaggcatgacctggtgcctggcccagcggcaataaagagtgggtgcacagggcaatagactgggtgccacatgcattctttcttggaacccaggccacagcagcattgtcacacttccctctaaaaatggttttccagttcagatgcaacagggatacatttgttctctgttgtatgagaaactgacaccaaggggatcttaacaaattcctgaacaatggctccaaaaaaggatatttttaaaaaccagatcttgtgagtacagccctaatgtgcagggacagtgtcatcctgtatattcgttctttactcagactctttcttggttccttcattaggagcatgaatggttgaatgtgaacatgacagtaaattggagcaaactgtaaactggacataacttatgccaaaagacgtagttgtacaccatggaaaccccatccctgctcctaatctctactgccattctgaatgccaaagcaagacatccaacatggggcatctcccagagcacatacagcaccaaaaatccacacacagcctaagcttaacccatgtttttgtctgagattgttcaccagagacaagactctgactataaacagaacatccactttcatgagtttcctttactgtattctcaacttgggccttgcttcaagcaggcaaacatacattgaagaatgcactttggtactgtttaaataacaacacatcagcccacttgattccatgccatgtccttgctgacagaaacatccccaacagggcatgccctggtccaagtcctctgtctttgtcaaaatgctcttctgatgagttggagaggaggcagccagcagacagcaggttgaataaaaccaatacacaacctattttctaggcaggaggggaaaaggcccttaggacaataatatttgtacaaagagttgagagtaaacaaacagtatatcaggttcaaaaaaaaaaaaactattcgttggcatttaaatttttttcccttgcatagtatctattctctcactaggacttttaagtgctctgctggaggctcagcgttggtaataccatgtttgatgcaaacttgaacccaatgctctcattggtggcacagctttggagggtggtggccccaagaaggggcaatctgcctgctgctatattaatctggaaccagggccaacagctactcttgaactatggtatttgaagagcgagttcattgcctgttttaccttaaatgacaggaaaggaagatgaacaaaccttgctttgccttggcttcaaactagttcttgatttaagacaccagaaagggagagagggagtctgcttagagtttgaggttgcctctcacaagatgacagttaaaagttgccaccttacttaaaaggcattaaggaggcatttactcacaaaggagagagagtaaatttttttcttaagagggaaaaaaatactgataatacatagaacaatctgcacatccagtcttggcactttttccaatttgactgatctctaaactggtgacccttgcatatatcttagtctcttttctacaatcttcttcagaaagctacagcagctaacaatcatgtataaagatgcatttcctagatcatcttcagaagaaaatctcttcagcactttccctagaatctgtctcctgaccaccccgccccagacctgctttctcttttgagaattcataaccaggtatgtttagataccagttcaaaagaccactctatgggttgatgaggaaaaggctgcctgaggacaatttaagaccataatgagtttccaatttttaaagaaaatttggctagctggcttttaattcttaattaaaatcattaaatttaattaaaattattccaatcaaaatatatcactttccaagattccacattcatattacttacttatactatggagactttctctacctgagcatgtattcaggggctataggtacatttaactctaactaactgaaaaaaatcaggaagaaaaaactattaaaataaaataacctcctaaatcatttgggggtatccccatcattggtgcgtgtgtctgcgtgtgtcaaactttaatgattatttattcagaccctggaaaaccacactataaaatagggcactggatcacaagttcgtttggttaaaaaaaaaaaaaaaaaaagtgggggcggggggcagagaagaagtttaacttggatgatttccatgcccattccagctgtaacattctatgactgtgacccagcctttgttctcttttctcactctcctactagacatttcaatgaaaagttaggcaggaaaaaggaaaggaatcccaagttgctgccagctctgatgagagatcaggttgggggagagattaggtggttactgaattgaggtgtgggcctcccctgaccatgtcagtgatccacaacccacctcacttcttggggcttaagctaaaagcagcttctgaagagatgttaatgtcctgtaatcactagaggagaaaattcattctccttccataacattacttagtaaaggaaaagcggtggtgcaatcaaattcacaaataccaatggggtctctaaaatgtagaatgcagcttgctgggtgctggtcagttttctaaatgggaccagaaatggctttcctaagaccataaatgaactctccagccacacatacattcaaatgcattccattagacattgagctcctcaagagcaggaactgctttatctccacagtccagctcagggttggctcaagtctgaagctcagtaaatgtctgtcaaatagaaaagaaaggatgagccttcggtcatcagctacatgagtcaggcacggtggcagcttcccattttagtcagtttgccagtttgtaaccagacagtaatcaattaagagctttaatctcttaaggacatttttcctttagggaaaatgaacaaaaaataaaacatttattaccagtgcttcttccaagcaaaaatttaaaaattaaattaaaatttaaaaaataagtgaagccacttaggagtttccccggcaagcctcacccaagaagacttaaccttttttaaaaagaggcaaatagattaaaggggccaggggctggatgcataatccccctgatctgataccaacccaacaggcccagatgacttcttccagcagatacaatcaatgggtcaagaacattttctcaaagtttctttccctctctatggaaaagagctgacagcccccttctaagggcaccacatttcctggatttcccctcagactgaccttcaccctcccccctaacttcccctttaataataaaaaaacccagaatgcatatatacaaggaacagagtaagacatgggtaatttgtatggtgaactgggcttcaatgatttgtgaggaatttgttttgtgaaatcctgcacctcttattctagctcacaaacccttcccatcgttctgtttccttccttgtccttttctgttcccccaaataatacacatcaacatatcgacttttaaccaacttcagaatcatggaaggagagagggagatttttcagaaagaaaagcattcaggttttagttattaaggatgggaagcatcttaaaattcagataataccttagtggtttttccttcctccaaagccaacctgattaaagatcaaccctcctccctccttaacctagaccactctacctatatttgaaggactgttgctcagcaggaagtttagaaaacaactgtcaataccatcctaggcatcactgtaggtacaaggggggaaggcagtaagctggacctagagtttggactatttgcttaacaagaatttgttcttcattctgcacttgttacaactgctatgcaattcttaaaatgaaagtattaatttggggaaatatttaaaatatatatcttttatctattaaaaatatttctttttaccaaagac

SEQ ID NO: 427752 - DNA, 3522 bp, Homo sapiens
agcggagtcgtcccggccgtcggttgccgcctacactgtctgccgtcgcgtcgcagttactaaggcgtggggaagatagcggcaggcaccgcagtggagcggctccgagatccccggggggctcgcaggcgcgcatccctcctgactgggacgtcgcctccgcagacccctcggaggctgaagcgacgccggaggcaggccaaggacactggttagtggttcagaaaggtaacctcaagaagaagcccaagggtttggttggagcacaagctgaacgtcgggaaagcctgaaggcgacttcttttgagttcaaggggaagaaagagtctcggcgggaaaatcaggtggaccttcctggacatatcctggaccaggcttttctgctgaagcaccactgtgtgaggaagccatcagatctgtgcaccattaatgtgagtggcctgaagttctccaaggccaaggaaaatgacttcaagcattttcattctgtgatttatatcaatgcctcagaaaacctgctgcctctagaggcatttcacacgtttccagccctaaaggaactggatctcgcatttaatggcatcaaaactatctacgtgaaatatggagactttaagttattagaattcttggacctttccttcaacagcctgactgtggaggccatctgtgatttggggattctgccacacctccgtgtcctgctcctcacaggcaatggccttacctccctgccgcccaatttggccgtcgcagaacaggaggcatctgtaacatcgctgacaagcaagaggtacatcctgaggttcccagcgctggagacactgatgctggatgacaacagactctccaaccccagttgctttgccagcctggctgggctcaggagactgaagaagttaagcttggatgaaaacaggattatcaggatcccatacctacagcaagttcagctctatgacgagtcagtagactggaatggaggcaggggaagtccccataaagagccccaattcatgctgcagtccaagccaaggatgcttgaggactcagatgagcaactggattatactgtactgcccatgaaaaaggatgttgaccggacagatcgcaaaagaggatgctgtcctaccagtagctctcttcccatctctctgtgagttcgtctttcataacaaccctctggtggcccatacacgaggggtccctccactgctgaagagcttcctccaggagcgactgggaatccacttaattcgaaggaagatagtaaagcctaagcatcatgttttgatgtctcggaaggaatcatggaaggtgaaaagcgaaatcccaaaggtgccgaagcagcctctggtgctccatcacccgcgcatgacgacaaccaagtctccctcaaaggatatgctagagccagaggcagagctggctgaagatctgcccactaccaaaagcacttctgtggagtcagagatgcccactgagaacctggaaggccattccccgtcttgccggaccttcgtgccactgcctcccatctgctccaactccactgtgcatagtgaagagaccctgtcccacctgagtgacacaactgtccgcctcagcccagagcgcccatcagatgaggactccaagagcacagagtccatcttcctgacccaggtgagtgaactgccttcctccgtcatccataaggatgatttagagttaaaggagaaagaccaaaagaaaccaccaacggcacccagagaggtgaaagggactcggaggaaactcccaactgccttccttcccagcaagtaccacggctatgaagaactgctgacagccaagcctgatccagccttcattgagccaaagggaatccagaagaatgcacaagccctgcaacaaatgctgaagcacccactcctgtgccactcctccaagcccaagctggacactcttcagaaaccctatgttcacaaagagaaacgggcccagagaatcccgattccacccccaaagaagactagagcccaacttctggatgacatcttcattcgcttgcgggatccccggaacattacagaggctccactaggtgctgtcctgcaccagtggacagaacggcggctggtgaaccacaagcagtacctggaggccaagaggctgttgaaggagttccaggcacgttaccggcagctggtgagtggctctctgcgcacagtgttcgggactaccccgctccccatggcctgcccagcgctgagtgagagccagcccaagttcggccacttcctcgagttcatggatgagttctgccaggagcccacagccagtgactcacaaggctagagctgtgcatgggggctgtgtgcaccacccggcctgtgccccagctctccccgagggctctgtgccctggaccgcacctcaaggttgaccagccggccacaggcctcagagctcagctgggccccacttgctggccacaaggtggcatccccttgtcaggatctcccctccttggcccaggcatgacctggtgcctggcccagcggcaataaagagtgggtgcacagggcaatagactgggtgccacatgcattctttcttggaacccaggccacagcagcattgtcacacttccctctaaaaatggttttccagttcagatgcaacagggatacatttgttctctgttgtatgagaaactgacaccaaggggatcttaacaaattcctgaacaatggctccaaaaaaggatatttttaaaaaccagatcttgtgagtacagccctaatgtgcagggacagtgtcatcctgtatattcgttctttactcagactctttcttggttccttcattaggagcatgaatggttgaatgtgaacatgacagtaaattggagcaaactgtaaactggacataacttatgccaaaagacgtagttgtacaccatggaaaccccatccctgctcctaatctctactgccattctgaatgccaaagcaagacatccaacatggggcatctcccagagcacatacagcaccaaaaatccacacacagcctaagcttaacccatgtttttgtctgagattgttcaccagagacaagactctgactataaacagaacatccactttcatgagtttcctttactgtattctcaacttgggccttgcttcaagcaggcaaacatacattgaagaatgcactttggtactgtttaaataacaacacatcagcccacttgattccatgccatgtccttgctgacagaaacatccccaacagggcatgccctggtccaagtcctctgtctttgtcaaaatgctcttctgatgagttggagaggaggcagccagcagtggcagtccacaaggatccaggtaccttctccaatcctaaagcagacagcaggttgaataaaaccaatacacaacctattttctaggcaggaggggaaaaggcccttaggacaataatatttgtacaaagagttgagagtaaacaaacagtatatcaggttca

SEQ ID NO: 427753 - DNA, 3865 bp, Homo sapiens
agcggagtcgtcccggccgtcggttgccgcctacactgtctgccgtcgcgtcgcagttactaaggcgtggggaagatagcggcaggcaccgcagtggagcggctccgagatccccggggggctcgcaggcgcgcatccctcctgactgggacgtcgcctccgcagacccctcggaggctgaagcgacgccggaggcaggccaaggacactggttagtggttcagaaaggtaacctcaagaagaagcccaagggtttggttggagcacaagctgaacgtcgggaaagcctgaaggcgacttcttttgagttcaaggggaagaaagagtctcggcgggaaaatcaggtggaccttcctggacatatcctggaccaggcttttctgctgaagcaccactgtgtgaggaagccatcagatctgtgcaccattaatgtgagtggcctgaagttctccaaggccaaggaaaatgacttcaagcattttcattctgtgatttatatcaatgcctcagaaaacctgctgcctctagaggcatttcacacgtttccagccctaaaggaactggatctcgcatttaatggcatcaaaactatctacgtgaaatatggagactttaagttattagaattcttggacctttccttcaacagcctgactgtggaggccatctgtgatttggggattctgccacacctccgtgtcctgctcctcacaggcaatggccttacctccctgccgcccaatttggccgtcgcagaacaggaggcatctgtaacatcgctgacaagcaagaggtacatcctgaggttcccagcgctggagacactgatgctggatgacaacagactctccaaccccagttgctttgccagcctggctgggctcaggagactgaagaagttaagcttggatgaaaacaggattatcaggatcccatacctacagcaagttcagctctatgacgagtcagtagactggaatggaggcaggggaagtccccataaagagccccaattcatgctgcagtccaagccaaggatgcttgaggactcagatgagcaactggattatactgtactgcccatgaaaaaggatgttgaccggacagatcgcaaaagaggatgctgtcctaccagtagctctcttcccatctctctgtgagttcgtctttcataacaaccctctggtggcccatacacgaggggtccctccactgctgaagagcttcctccaggagcgactgggaatccacttaattcgaaggaagatagtaaagcctaagcatcatgttttgatgtctcggaaggaatcatggaaggtgaaaagcgaaatcccaaaggtgccgaagcagcctctggtgctccatcacccgcgcatgacgacaaccaagtctccctcaaaggatatgctagagccagaggcagagctggctgaagatctgcccactaccaaaagcacttctgtggagtcagagatgcccactgagaacctggaaggccattccccgtcttgccggaccttcgtgccactgcctcccatctgctccaactccactgtgcatagtgaagagaccctgtcccacctgagtgacacaactgtccgcctcagcccagagcgcccatcagatgaggactccaagagcacagagtccatcttcctgacccaggtgagtgaactgccttcctccgtcatccataaggatgatttagagttaaaggagaaagaccaaaagaaaccaccaacggcacccagagaggtgaaagggactcggaggaaactcccaactgccttccttcccagcaagtaccacggctatgaagaactgctgacagccaagcctgatccagccttcattgagccaaagggaatccagaagaatgcacaagccctgcaacaaatgctgaagcacccactcctgtgccactcctccaagcccaagctggacactcttcagaaaccctatgttcacaaagagaaacgggcccagagaatcccgattccacccccaaagaagactagagcccaacttctggatgacatcttcattcgcttgcgggatccccggaacattacagaggctccactaggtgctgtcctgcaccagtggacagaacggcggctggtgaaccacaagcagtacctggaggccaagaggctgttgaaggagttccaggcacgttaccggcagctggtgagtggctctctgcgcacagtgttcgggactaccccgctccccatggcctgcccagcgctgagtgagagccagcccaagttcggccacttcctcgagttcatggatgagttctgccaggagcccacagccagtgactcacaaggctagagctgtgcatgggggctgtgtgcaccacccggcctgtgccccagctctccccgagggctctgtgccctggaccgcacctcaaggttgaccagccggccacaggcctcagagctcagctgggccccacttgctggccacaaggtggcatccccttgtcaggatctcccctccttggcccaggcatgacctggtgcctggcccagcggcaataaagagtgggtgcacagggcaatagactgggtgccacatgcattctttcttggaacccaggccacagcagcattgtcacacttccctctaaaaatggttttccagttcagatgcaacagggatacatttgttctctgttgtatgagaaactgacaccaaggggatcttaacaaattcctgaacaatggctccaaaaaaggatatttttaaaaaccagatcttgtgagtacagccctaatgtgcagggacagtgtcatcctgtatattcgttctttactcagactctttcttggttccttcattaggagcatgaatggttgaatgtgaacatgacagtaaattggagcaaactgtaaactggacataacttatgccaaaagacgtagttgtacaccatggaaaccccatccctgctcctaatctctactgccattctgaatgccaaagcaagacatccaacatggggcatctcccagagcacatacagcaccaaaaatccacacacagcctaagcttaacccatgtttttgtctgagattgttcaccagagacaagactctgactataaacagaacatccactttcatgagtttcctttactgtattctcaacttgggccttgcttcaagcaggcaaacatacattgaagaatgcactttggtactgtttaaataacaacacatcagcccacttgattccatgccatgtccttgctgacagaaacatccccaacagggcatgccctggtccaagtcctctgtctttgtcaaaatgctcttctgatgagttggagaggaggcagccagcagtggcagtccacaaggatccaggtaccttctccaatcctaaagcacttttaaaaataggtaacacttcattaggtgctacttggccccggccatgttgctggaccgtaggagatactgatccacacttccttttcgccggctcacagtccgcctctcattgtcgaacatgcgctgcaactgcagagccaactgtcggtcttcttcctcttgctgaagcttctgctccatctctcgcaggactgggtctgttggggccagacccacctccccactggtttgtcgcagttttttaagggagccattttgttctaagtgcttggtcttgcagtgtcttttccggcctcgacgcaaagaaggaagtggctcttcacttaggctctcaactagaacaccattagtcagatcaaaatgatttaatgtcttcaattgttgctttgttttgaggactccacccaaaacactgttttggggtagcactgaattaactgtggtgattttcatggctc

SEQ ID NO: 427754 - DNA, 1533 bp, Homo sapiens
agcggagtcgtcccggccgtcggttgccgcctacactgtctgccgtcgcgtcgcagttactaaggcgtggggaagatagcggcaggcaccgcagtggagcggctccgagatccccggggggctcgcaggcgcgcatccctcctgactgggacgtcgcctccgcagacccctcggaggctgaagcgacgccggaggcaggccaaggacactggttagtggttcagaaaggtaacctcaagaagaagcccaagggtttggttggagcacaagctgaacgtcgggaaagcctgaaggcgacttcttttgagttcaaggggaagaaagagtctcggcgggaaaatcaggtggaccttcctggacatatcctggaccaggcttttctgctgaagcaccactgtgtgaggaagccatcagatctgtgcaccattaatgtgagtggcctgaagttctccaaggccaaggaaaatgacttcaagcattttcattctgtgatttatatcaatgcctcagaaaacctgctgcctctagaggcatttcacacgtttccagccctaaaggaactggatctcgcatttaatggcatcaaaactatctacgtgaaatatggagactttaagttattagaattcttggacctttccttcaacagcctgactgtggaggccatctgtgatttggggattctgccacacctccgtgtcctgctcctcacaggcaatggccttacctccctgccgcccaatttggccgtcgcagaacaggaggcatctgtaacatcgctgacaagcaagaggtacatcctgaggttcccagcgctggagacactgatgctggatgacaacagactctccaaccccagttgctttgccagcctggctgggctcaggagactgaagaagttaagcttggatgaaaacaggattatcaggatcccatacctacagcaagttcagctctatgacgagtcagtagactggaatggaggcaggggaagtccccataaagagccccaattcatgctgcagtccaagccaaggatgcttgaggactcagatgagcaactggattatactgtactgcccatgaaaaaggatgttgaccggacagatcgcaaaagaggatgctgtcctaccagtagctctcttcccatctctctgtgagttcgtctttcataacaaccctctggtggcccatacacgaggggtccctccactgctgaagagcttcctccaggagcgactgggaatccacttaattcgaaggaagatagtaaagcctaagcatcatgttttgatgtctcggaaggaatcatggaaggtagggcttccaaggcaggactcccacccccaggaagagtgcagcctattataatgtatgcaaaccaacctggctgtagagctgctcactccacagtgcctggaatctctccattaggttcagcattgccttctcctttccttgctttgggaagagcactggatgaaacaacagatatgaaaatatattttaaactcctaaaactcttaccattga

SEQ ID NO: 427755 - DNA, 433 bp, Homo sapiens
aaactcttagctcttaaacacgcaacagtgatggtggaatttcagacaggaggggcaaggtactctgtgcatgagtaggtattattacagggtcaaggcatcacccagcagtgagtcccatccacagcagcatgtcttacccaataccacccccaatcctagcaagcatgtagccctgcagtgaggggcctagacatacctgggtagaggtgaggggtggtgtcaacctgagagtctctcctgcattcattacagatcgcaaaagaggatgctgtcctaccagtagctctcttcccatctctctgtgagttcgtctttcataacaaccctctggtggcccatacacgaggtatagtgcccgcaaacctgccccctctcaacccagtgcccaaggagcagtgtggcaccctcatccccacctcatcaatgccaa

SEQ ID NO: 427756 - DNA, 572 bp, Homo sapiens
ggcactgtgacctttgaagatgtggctgtgaacttttcccaggaggaatggagtctccttagtgaggctcagagatgcctttatcatgacgtgatgctggagaacctgacacttatatcttctctaggttgttggtatggagcaaaagacgagacaccttctaagcagaccctttctatacaacaggagtccccactcaggacacattggacaggtgtatgtaccaagaaggtccacctctggggaatgtgtggccctctcctgggagatatcttacaccagggaacacaacacaatcagaaattgaatgggtttggggcatatgaaaaaaaattggatgacgatgcaaaccatcatcaagaccagaagcagcacattggagagaaatcgtacagaagcaatgccaagggaacatcttttgtaaagaactgtaaattccatatgtcacatgagccatttatctttcatgaggttgggaaagactttttgtccagcttgagattactccaacaagaggacattcacacttcagggaagtcaaaactttgaaactaagcatgggataccccttc

SEQ ID NO: 427757 - DNA, 351 bp, Homo sapiens
ggggccttaacccttcaatttcggaatgtgtggccctctcctgggagatatcttacaccagggaacacaacacaatcagaaattgaatgggtttggggcatatgaaaaaaaattggatgacgatgcaaaccatcatcaagaccagaagcagcacattggagagaaatcgtacagaagcaatgccaagggaacatcttttgtaaagaactgtaaattccatatgtcacatgagccatttatctttcatgaggttgggaaagactttttgtccagcttgagattactccaacaagaggacattcacacttcagggaagtcaaaactttgaaactaagcatgggataccccttc

SEQ ID NO: 427758 - DNA, 1491 bp, Homo sapiens
ttttagtgacacactttggtgcttctgagaacagcacaaaattattctcttgtttataatggatattgcattctgctcagtactggtgagggaaatctgttctcaagtcctacagtgcattcatgtgtcctgaagtccagaattctgtaggatagtgtcctacgttataagcctggagaaagaaatcataattctttaatttttatttttttagggaaatgatgtcactctgaaactcaggctggaatacactggcatggtcatacctcactgcggcctcaaactcctgggctcaagtgatcctcctgcctcagcctcccgagtacctgagattagcccaggtaatttaagaattttttatagagatagggttttgctattttaccctgactgatgttcaactcctggcctcaagtaatcctctagcatacgcccttgaaagcactaggattacaggtgtgagccaccatgcccagcccaaaaataatttttgtagaattagcatttctaggtagtgaagcagactgcaacagaatagttgggatatactttttttaaaaaggcatccacaatgattcagtcactatgtctgtgatggacaagcaggtacagaaattttcaggacctccataattatgaatctagtgtagcttaggtcattgtcagactaaatctaaaggttttgtggatttctgtagcctatctgggctgcataccaaaaagccatccctgaattagtaggaggaagaggatagggagaaaggaaatctcttagtccagtgatgtggcctttgcaaccagccagcattccaatttaatcaggtggaaatgatcttcctggctcataagtatttggtatcacacaggctaattgccccccttagggcgtgatgagagttaggagagtcaatgtaaaatcacataacctatttgtcaaaaataatgttaaatccagatagttctttcaaattaaatttttaaagctgtaataagactgggcatggtgactcatgcctgttatcccaacactttgggagtccagggtgggagtattgcttgaggtaagaagtttgagactagcctgggtcccatagtaagaccctgtctcttaaaaaataaatactatctttctctctggcctctccatcctccagacaatcactgaattacaatatttgcttaacagtagattaatgtcaattttctggaattttatatgactgatataacatgtttcctcttttcatacctgagtactctcctgagccctatttatttagatgttcttcttttttctttattattatttttatttcacatagcagggatgcatattttgacattcatcaatcatgatatatgagtagttcattctttttatcttagaatatgacatgctatggaaatcactgtatacgaattcatctgcttatggatatgttattgcttcttatttttgtctgttaggaataaaactgcttgttaagcaca

SEQ ID NO: 427759 - DNA, 1404 bp, Homo sapiens
ggcactgtgacctttgaagatgtggctgtgaacttttcccaggaggaatggagtctccttagtgaggctcagagatgcctttatcatgacgtgatgctggagaacctgacacttatatcttctctagggaaatgatgtcactctgaaactcaggctggaatacactggcatggtcatacctcactgcggcctcaaactcctgggctcaagtgatcctcctgcctcagcctcccgagtacctgagattagcccaggtaatttaagaattttttatagagatagggttttgctattttaccctgactgatgttcaactcctggcctcaagtaatcctctagcatacgcccttgaaagcactaggattacaggtgtgagccaccatgcccagcccaaaaataatttttgtagaattagcatttctaggtagtgaagcagactgcaacagaatagttgggatatactttttttaaaaaggcatccacaatgattcagtcactatgtctgtgatggacaagcaggtacagaaattttcaggacctccataattatgaatctagtgtagcttaggtcattgtcagactaaatctaaaggttttgtggatttctgtagcctatctgggctgcataccaaaaagccatccctgaattagtaggaggaagaggatagggagaaaggaaatctcttagtccagtgatgtggcctttgcaaccagccagcattccaatttaatcaggtggaaatgatcttcctggctcataagtatttggtatcacacaggctaattgccccccttagggcgtgatgagagttaggagagtcaatgtaaaatcacataacctatttgtcaaaaataatgttaaatccagatagttctttcaaattaaatttttaaagctgtaataagactgggcatggtgactcatgcctgttatcccaacactttgggagtccagggtgggagtattgcttgaggtaagaagtttgagactagcctgggtcccatagtaagaccctgtctcttaaaaaataaatactatctttctctctggcctctccatcctccagacaatcactgaattacaatatttgcttaacagtagattaatgtcaattttctggaattttatatgactgatataacatgtttcctcttttcatacctgagtactctcctgagccctatttatttagatgttcttcttttttctttattattatttttatttcacatagcagggatgcatattttgacattcatcaatcatgatatatgagtagttcattctttttatcttagaatatgacatgctatggaaatcactgtatacgaattcatctgcttatggatatgttattgcttcttatttttgtctgttaggaataaaactgcttgttaagcaca

SEQ ID NO: 427760 - DNA, 1728 bp, Homo sapiens
ttttagtgacacactttggtgcttctgagaacagcacaaaattattctcttgtttataatggatattgcattctgctcagtactggtgagggaaatctgttctcaagtcctacagtgcattcatgtgtcctgaagtccagaattctgtaggatagtgtcctacgttataagcctggagaaagaaatcataattctttaatttttatttttttagggaaatgatgtcactctgaaactcaggctggaatacactggcatggtcatacctcactgcggcctcaaactcctgggctcaagtgatcctcctgcctcagcctcccgagtacctgagattagcccaggtaatttaagaattttttatagagatagggttttgctattttaccctgactgatgttcaactcctggcctcaagtaatcctctagcatacgcccttgaaagcactaggattacaggtgtgagccaccatgcccagcccaaaaataatttttgtagaattagcatttctaggtagtgaagcagactgcaacagaatagttgggatatactttttttaaaaaggcatccacaatgattcagtcactatgtctgtgatggacaagcaggtacagaaattttcaggacctccataattatgaatctagtgtagcttaggtcattgtcagactaaatctaaaggttttgtggatttctgtagcctatctgggctgcataccaaaaagccatccctgaattagtaggaggaagaggatagggagaaaggaaatctcttagtccagtgatgtggcctttgcaaccagccagcattccaatttaatcaggtggaaatgatcttcctggctcataagtatttggtatcacacaggctaattgccccccttagggcgtgatgagagttaggagagtcaatgtaaaatcacataacctatttgtcaaaaataatgttaaatccagatagttctttcaaattaaatttttaaagctgtaataagactgggcatggtgactcatgcctgttatcccaacactttgggagtccagggtgggagtattgcttgaggtaagaagtttgagactagcctgggtcccatagtaagaccctgtctcttaaaaaataaatactatctttctctctggcctctccatcctccagacaatcactgaattacaatatttgcttaacagtagattaatgtcaattttctggaattttatatgactgatataacatgtttcctcttttcatacctgagtactctcctgagccctatttatttagatgttcttcttttttctttattattatttttatttcacatagcagggatgcatattttgacattcatcaatcatgatatatgagtagttcattctttttatcttagaatatgacatgctatggaaatcactgtatacgaattcatctgcttatggatatgttattgcttcttatttttgtctgttaggaataaaactgcttgttaagcacatttgaatgcaattcttcatatagataaggtttcatttctcttgtttgaatgccttggtgtgcagtgcccaactcacatggtagatgaatgtatacccctctcccaactccaggccgcacagcttacagctccaagagagactccttccctccacttgaggagaggagagggaagaataaagaaaactttgtcttggaacttgttccagctcagctacagtaggatagggcaccaggc

SEQ ID NO: 427761 - DNA, 286 bp, Homo sapiens
cccaggaggaatggagtctccttagtgaggctcagagatgcctttatcatgacgtgatgctggagaacctgacacttatatcttctctaggtaaggcactcacactcttctctatgacctcagctattgtctgtctgtccccatcttttttccccatggcaagactgttttcctcacttcaggagcctgggcacaggttcctctgttagttccctgggtaggttctatgtggtatgtaggactgaggtgtgtgcactgccctctctctccttgagcagccccaaca

SEQ ID NO: 427762 - DNA, 1493 bp, Homo sapiens
ggcactgtgacctttgaagatgtggctgtgaacttttcccaggaggaatggagtctccttagtgaggctcagagatgcctttatcatgacgtgatgctggagaacctgacacttatatcttctctaggttgttggtatggagcaaaagacgagacaccttctaagcagaccctttctatacaacaggagtccccactcaggacacattggacaggtggaaatgatgtcactctgaaactcaggctggaatacactggcatggtcatacctcactgcggcctcaaactcctgggctcaagtgatcctcctgcctcagcctcccgagtacctgagattagcccaggtaatttaagaattttttatagagatagggttttgctattttaccctgactgatgttcaactcctggcctcaagtaatcctctagcatacgcccttgaaagcactaggattacaggtgtgagccaccatgcccagcccaaaaataatttttgtagaattagcatttctaggtagtgaagcagactgcaacagaatagttgggatatactttttttaaaaaggcatccacaatgattcagtcactatgtctgtgatggacaagcaggtacagaaattttcaggacctccataattatgaatctagtgtagcttaggtcattgtcagactaaatctaaaggttttgtggatttctgtagcctatctgggctgcataccaaaaagccatccctgaattagtaggaggaagaggatagggagaaaggaaatctcttagtccagtgatgtggcctttgcaaccagccagcattccaatttaatcaggtggaaatgatcttcctggctcataagtatttggtatcacacaggctaattgccccccttagggcgtgatgagagttaggagagtcaatgtaaaatcacataacctatttgtcaaaaataatgttaaatccagatagttctttcaaattaaatttttaaagctgtaataagactgggcatggtgactcatgcctgttatcccaacactttgggagtccagggtgggagtattgcttgaggtaagaagtttgagactagcctgggtcccatagtaagaccctgtctcttaaaaaataaatactatctttctctctggcctctccatcctccagacaatcactgaattacaatatttgcttaacagtagattaatgtcaattttctggaattttatatgactgatataacatgtttcctcttttcatacctgagtactctcctgagccctatttatttagatgttcttcttttttctttattattatttttatttcacatagcagggatgcatattttgacattcatcaatcatgatatatgagtagttcattctttttatcttagaatatgacatgctatggaaatcactgtatacgaattcatctgcttatggatatgttattgcttcttatttttgtctgttaggaataaaactgcttgttaagcaca

SEQ ID NO: 427763 - DNA, 2337 bp, Homo sapiens
tagattaggacccgcgggaaggttgtttaccgtaactaggggtaaggaggtacaaagaacaaggaagttaggctttgaaaatagagaacaaagaacaagtaagctgaacaagtaagttcctctttggagaggcaagagggcaaagaagctgaggacccagaagacaggattgtgcctaagaaagtggccttggagcagaggcccaaagaaagcggggagagcgccttgcccatcggtaagggaaaggtgctccaggcacagaagcagctaatgcaacggccctgaggcaaatgcaagataactggcaagttccaggaacagcaaggagggcaaggcgcctggagcagaggaagctagcggatcccttgatgagagggaggaactggcccatctctcatgggtcctgcaggcaggccatgagactgtcttttatgcggggcgagataacgaggcatggacgtgttgtgagcggaggcctagcctgttcaaggtctgaatttttacccctagaatgtaagaagcatgggagcagggactttgttttgctccctgccatatccacagccctagaaaaacgtcgggccattgatagctctcagtaaatgcttgacaagtaagtgaatgaacgaatgcacaattaatgaaatgagggctgcgtcaatgaataactgggaatctgactcctgcagggagccttcagcccacaggtgtatgtaagacccgccccgcctctcatccttcgggctcccacccccgccgttaggctgcggttcgcgccgcggtcgccagagggcgcggagcggcggggcttcccgcacggagggctttgcgtgaggcaccgcgtggggcggggctgcgggcgggctcccagctgctgggccctcatcggctgggcctcgtcgaccggcaagcggaacgcggcagcggggctgggcctgtgcggcggccgccggagcgctttggaaggcgcacggggcgaagatggcggcggagcgacaggaggcgctgagggagttcgtggcggtgacgggcgccgaggaggaccgggcccgcttctttctcgagtcggccggctgggacttgcagatcgcgctagcgagcttttatgaggacggaggggatgaagacattgtgaccatttcgcaggcaacccccagttcagtgtccagaggcacagcccccagtgataatagagtgacatccttcagagacctcattcatgaccaagatgaagatgaggaggaagaggaaggccagaggttttatgctgggggctcagagagaagtggacagcagattgttggccctcccaggaagaaaagtcccaacgagctggtggatgatctctttaaaggtgccaaagagcatggagctgtagctgtggagcgagtgaccaagagccctggagagaccagtaaaccgagaccatttgcaggaggtggctaccgccttggggcagcaccagaggaagagtctgcctatgtggcaggagaaaagaggcagcattccagccaagatgttcatgtagtattgaaactctggaagagtggattcagcctggataatggagaactcagaagctaccaagacccatccaatgcccagtttctggagtctatccgcagaggggaggtgccagcagagcttcggaggctagctcacggtggacaggtgaacttggatatggaggaccatcgggacgaggactttgtgaagcccaaaggagccttcaaagccttcactggcgagggtcagaaactgggcagcactgccccccaggtgttgagtaccagctctccagcccaacaggcagaaaatgaagccaaagccagctcttccatcttaatcgacgaatcagagcctaccacaaacatccaaattcggcttgcagacggcgggaggctggtgcagaaatttaaccacagccacaggatcagcgacatccgactcttcatcgtggatgcccggccagccatggctgccaccagctttatcctcatgactactttcccgaacaaagagctggctgatgagagccagaccctgaaggaagccaacctgctcaatgctgtcatcgtgcagcggttaacataaccgcccagccagctgcctggcctccctcctgtgtttcccatggccagtggccatgccccatggggatcgcccctcctgcccccttgtgcacacccagcagtccagtgcaacgtctcctccatagctctgggttcttagatcttggttggacgtttgttttctccttagttgcatttcctgggtttttgtgatgatcaatggactttaatgaaaaaaaaaataaaaacaaccaaaaaaattgaa

SEQ ID NO: 427764 - DNA, 1318 bp, Homo sapiens
  misc_feature (535)..(535): n is a, c, g, or t
taagcgagtgacccatcccagtgatgtgagttatttgtctcagtttcatttcactcattaagctcagcacactgctgcccattcccagggtggacagcccatgcagaggctttgctaggtgaaaaagcttggtttgctaaaagtcacaggcagaatcctgcaggtccatgcccttagatgtgccaaattgtaagttgcatagattttaggggtttggggcaaaaaggaaacttatgtttaagtgctctagggaaggaggcattgtttccaggtggtttcattgtcatatgatctccaggttcagaaggcaggtagtgtctggagaaacgattcctggccctgagaagttgaccattaatttctgacagatagtttaagtgcctcctgtgacatacaaaagagacacacactgtccttgtgaaattcatgagctgcaggaggagacactaatcagatcatcccagaaacgtggaaggagggccagggatggagccaaggagctaaggagggctttcctgaggaggtggcattgganccgaggcctgagttgtgattaggattacagaaaggggatcaggcaggggagcctctggaaagaaggacccaaatgtgggaagagagtatggcctgatgaactagaagcgggcagaagagaacgaggggaaagagggtggtataaaattaggtccttgggaacacagtagggttgttggtgtttatctcaaggaaaatggaaacaacagtgaaggactcttggcaaggaagggacttggtcccacatgcctgagcgtagctttcgctgttctgtggagaaagtcaggaaaggggatttgcgaggtgtttagctttccacagggcaggggtatggacagcagaggatggcactgctcaccgcttccccaactcctgcaggatcagcgacatccgactcttcatcgtggatgcccggccagccatggctgccaccagctttatcctcatgactactttcccgaacaaagagctggctgatgagagccagaccctgaaggaagccaacctgctcaatgctgtcatcgtgcagcggttaacataaccgcccagccagctgcctggcctccctcctgtgtttcccatggccagtggccatgccccatggggatcgcccctcctgcccccttgtgcacacccagcagtccagtgcaacgtctcctccatagctctgggttcttagatcttggttggacgtttgttttctccttagttgcatttcctgggtttttgtgatgatcaatggactttaatgaaaaaaaaaataaaaacaaccaaaaaaattgaa

SEQ ID NO: 427765 - DNA, 518 bp, Homo sapiens
ggaatcgagctcggtacctgacagtaaaatgaaccatttgcaggaggtggctaccgccttggggcagcaccagaggaagagtctgcctatgtggcaggagaaaagaggcagcattccagccaagatgttcatgtagtattgaaactctggaagagtggattcagcctggataatggagaactcagaagctaccaagacccatccaatgcccagtttctggagtctatccgcagaggggaggtgccagcagagcttcggaggctagctcacggtggacaggtgaacttggatatggaggaccatcgggacgaggactttgtgaagcccaaaggagccttcaaagccttcactggcgagggtcagaaactgggcagcactgccccccaggtgttgagtaccagctctccagcccaacaggcagaaaatgaagccaaagccagctcttccatcttaatcgacgaatcagagcctaccacagagcaatgtgttcatttactgtcaggtaccgagctgatctc

SEQ ID NO: 427766 - DNA, 1488 bp, Homo sapiens
tagattaggacccgcgggaaggttgtttaccgtaactaggggtaaggaggtacaaagaacaaggaagttaggctttgaaaatagagaacaaagaacaagtaagctgaacaagtaagttcctctttggagaggcaagagggcaaagaagctgaggacccagaagacaggattgtgcctaagaaagtggccttggagcagaggcccaaagaaagcggggagagcgccttgcccatcggtaagggaaaggtgctccaggcacagaagcagctaatgcaacggccctgaggcaaatgcaagataactggcaagttccaggaacagcaaggagggcaaggcgcctggagcagaggaagctagcggatcccttgatgagagggaggaactggcccatctctcatgggtcctgcaggcaggccatgagactgtcttttatgcggggcgagataacgaggcatggacgtgttgtgagcggaggcctagcctgttcaaggtctgaatttttacccctagaatgtaagaagcatgggagcagggactttgttttgctccctgccatatccacagccctagaaaaacgtcgggccattgatagctctcagtaaatgcttgacaagtaagtgaatgaacgaatgcacaattaatgaaatgagggctgcgtcaatgaataactgggaatctgactcctgcagggagccttcagcccacaggtgtatgtaagacccgccccgcctctcatccttcgggctcccacccccgccgttaggctgcggttcgcgccgcggtcgccagagggcgcggagcggcggggcttcccgcacggagggctttgcgtgaggcaccgcgtggggcggggctgcgggcgggctcccagctgctgggccctcatcggctgggcctcgtcgaccggcaagcggaacgcggcagcggggctgggcctgtgcggcggccgccggagcgctttggaaggcgcacggggcgaagatggcggcggagcgacaggaggcgctgagggagttcgtggcggtgacgggcgccgaggaggaccgggcccgcttctttctcgagtcggccggctgggacttgcagatcgcgctagcgagcttttatgaggacggaggggatgaagacattgtgaccatttcgcaggcaacccccagttcagtgtccagaggcacagcccccagtgataatagagtgacatccttcagagacctcattcatgaccaagatgaagatgaggaggaagaggaaggccagaggtgagtcttctagagggggtcagggggacagttcacagggaagtccagggtaatgtgtaaatcacctagaacaggacctggtaaacatgtttggttattgttagccattactactgtgggctggtctgtgtgggttatatcttaggaagtctcttctactccttgtagcttagaagtgacccctgttccgttacttaatgtatttattgaggaatattaggggagggaa

SEQ ID NO: 427767 - DNA, 3677 bp, Homo sapiens
tagattaggacccgcgggaaggttgtttaccgtaactaggggtaaggaggtacaaagaacaaggaagttaggctttgaaaatagagaacaaagaacaagtaagctgaacaagtaagttcctctttggagaggcaagagggcaaagaagctgaggacccagaagacaggattgtgcctaagaaagtggccttggagcagaggcccaaagaaagcggggagagcgccttgcccatcggtaagggaaaggtgctccaggcacagaagcagctaatgcaacggccctgaggcaaatgcaagataactggcaagttccaggaacagcaaggagggcaaggcgcctggagcagaggaagctagcggatcccttgatgagagggaggaactggcccatctctcatgggtcctgcaggcaggccatgagactgtcttttatgcggggcgagataacgaggcatggacgtgttgtgagcggaggcctagcctgttcaaggtctgaatttttacccctagaatgtaagaagcatgggagcagggactttgttttgctccctgccatatccacagccctagaaaaacgtcgggccattgatagctctcagtaaatgcttgacaagtaagtgaatgaacgaatgcacaattaatgaaatgagggctgcgtcaatgaataactgggaatctgactcctgcagggagccttcagcccacaggtgtatgtaagacccgccccgcctctcatccttcgggctcccacccccgccgttaggctgcggttcgcgccgcggtcgccagagggcgcggagcggcggggcttcccgcacggagggctttgcgtgaggcaccgcgtggggcggggctgcgggcgggctcccagctgctgggccctcatcggctgggcctcgtcgaccggcaagcggaacgcggcagcggggctgggcctgtgcggcggccgccggagcgctttggaaggcgcacggggcgaagatggcggcggagcgacaggaggcgctgagggagttcgtggcggtgacgggcgccgaggaggaccgggcccgcttctttctcgagtcggccggctgggacttgcagatcgcgctagcgagcttttatgaggacggaggggatgaagacattgtgaccatttcgcaggcaacccccagttcagtgtccagaggcacagcccccagtgataatagagtgacatccttcagagacctcattcatgaccaagatgaagatgaggaggaagaggaaggccagaggttttatgctgggggctcagagagaagtggacagcagattgttggccctcccaggaagaaaagtcccaacgagctggtggatgatctctttaaaggtgccaaagagcatggagctgtagctgtggagcgagtgaccaagagccctggagagaccagtaaaccgagaccatttgcaggaggtggctaccgccttggggcagcaccagaggaagagtctgcctatgtggcaggagaaaagaggcagcattccagccaagatgttcatgtagtattgaaactctggaagagtggattcagcctggataatggagaactcagaagctaccaagacccatccaatgcccagtttctggagtctatccgcagaggggaggtgccagcagagcttcggaggctagctcacggtggacaggtgaacttggatatggaggaccatcgggacgaggactttgtgaagcccaaaggagccttcaaagccttcactggcgagggtcagaaactgggcagcactgccccccaggtgttgagtaccagctctccagcccaacaggcagaaaatgaagccaaagccagctcttccatcttaatcgacgaatcagagcctaccacaaacatccaaattcggcttgcagacggcgggaggctggtgcagaaatttaaccacagccacaggatcagcgacatccgactcttcatcgtggatgcccggccagccatggctgccaccagctttatcctcatgactactttcccgaacaaagagctggctgatgagagccagaccctgaaggaagccaacctgctcaatgctgtcatcgtgcagcggttaacataaccgcccagccagctgcctggcctccctcctgtgtttcccatggccagtggccatgccccatggggatcgcccctcctgcccccttgtgcacacccagcagtccagtgcaacgtctcctccatagctctgggttcttagatcttggttggacgtttgttttctccttagttgcatttcctgggtttttgtgatgatcaatggactttaatgaaaaaaaaaataaaaacaaccaaaaaaattgaaggaatatcaccagcatgttgtacggaaactctcccactgaagcaggctttaattgctttaaaattatatttatcttggggcctgtgggaggaaacttccttccatcttctctgcataaaaacttgtggcacacaatgcttattcactagtgtgtcccacccgccagccccacagatgactggaggaaggaggggaaatgtgtagaaagaggcttcgccaccacttgttcccacgagaatatatcacttgcccagataaaactgggcggcagccagagttccctgaagtgggaagtcagagctacatgcacacagtgtcttcagaaggtgaaaataaatatttccctgtgctccttttactcaacccctggggtatctaatcttgccaggtcttggccagttgagattctgttccacctgcctgcctggccctttcctccattaccatccagactgctcgcctcctggggattctcaggggctccattatggcttgatttactccacgtgcagaagtcttgagtggacctaggaggtaggtgggatattttttttcactaggatacagctcatgccaacccatcctaagtgagttcagaatcagggtatcttgccctataagataaacagtcaaaatgccaccgagctgttcactagtgatgtgtggcaaatcaaatcaactgttgaagaaggggtgagttttctgtgctacaagcacctgtcactgttggtacttgcaggaggcttctgctgggtatgttttggaagtgagtgtcactacttggctttgcttagcaggttctgcttcacacttgttctttgacctgctgacttgtgacttgcagaaacataggcagtagtcctagcctggtaaagaccctccaccacccctataagtttgattgctatgcaggtttgggagaggaggcctattgggctcttggatggaaccctttcccgtattaaacaaaccagagacagaatcagtgctgactcaggatctcctggtttggaatcgtaatgtgcctcaatcctctttccaagcaggcctcaccagtctctttctctttcctgcttcacccctgcaatgagccaagaaccaacactacatccacctagaactgcagaagggcttgtggtttcaaccaagacccatcctgagcaagggacttggcttggtgcttttgatcccaaagttcccacaccggcagtggcctgctggggcaatggcatctgtcacggtgttttctccagcaggtggagattatggaacctacatatgggtctggaaaaactgtacactgttgtcaccttgaccattaaaaaccagaatgaggacaa

SEQ ID NO: 427768 - DNA, 3556 bp, Homo sapiens
  misc_feature (3165)..(3166): n is a, c, g, or t
  misc_feature (3169)..(3169): n is a, c, g, or t
  misc_feature (3171)..(3172): n is a, c, g, or t
  misc_feature (3174)..(3175): n is a, c, g, or t
tagattaggacccgcgggaaggttgtttaccgtaactaggggtaaggaggtacaaagaacaaggaagttaggctttgaaaatagagaacaaagaacaagtaagctgaacaagtaagttcctctttggagaggcaagagggcaaagaagctgaggacccagaagacaggattgtgcctaagaaagtggccttggagcagaggcccaaagaaagcggggagagcgccttgcccatcggtaagggaaaggtgctccaggcacagaagcagctaatgcaacggccctgaggcaaatgcaagataactggcaagttccaggaacagcaaggagggcaaggcgcctggagcagaggaagctagcggatcccttgatgagagggaggaactggcccatctctcatgggtcctgcaggcaggccatgagactgtcttttatgcggggcgagataacgaggcatggacgtgttgtgagcggaggcctagcctgttcaaggtctgaatttttacccctagaatgtaagaagcatgggagcagggactttgttttgctccctgccatatccacagccctagaaaaacgtcgggccattgatagctctcagtaaatgcttgacaagtaagtgaatgaacgaatgcacaattaatgaaatgagggctgcgtcaatgaataactgggaatctgactcctgcagggagccttcagcccacaggtgtatgtaagacccgccccgcctctcatccttcgggctcccacccccgccgttaggctgcggttcgcgccgcggtcgccagagggcgcggagcggcggggcttcccgcacggagggctttgcgtgaggcaccgcgtggggcggggctgcgggcgggctcccagctgctgggccctcatcggctgggcctcgtcgaccggcaagcggaacgcggcagcggggctgggcctgtgcggcggccgccggagcgctttggaaggcgcacggggcgaagatggcggcggagcgacaggaggcgctgagggagttcgtggcggtgacgggcgccgaggaggaccgggcccgcttctttctcgagtcggccggctgggacttgcagatcgcgctagcgagcttttatgaggacggaggggatgaagacattgtgaccatttcgcaggcaacccccagttcagtgtccagaggcacagcccccagtgataatagagtgacatccttcagagacctcattcatgaccaagatgaagatgaggaggaagaggaaggccagaggttttatgctgggggctcagagagaagtggacagcagattgttggccctcccaggaagaaaagtcccaacgagctggtggatgatctctttaaaggtgccaaagagcatggagctgtagctgtggagcgagtgaccaagagccctggagagaccagtaaaccgagaccatttgcaggaggtggctaccgccttggggcagcaccagaggaagagtctgcctatgtggcaggagaaaagaggcagcattccagccaagatgttcatgtagtattgaaactctggaagagtggattcagcctggataatggagaactcagaagctaccaagacccatccaatgcccagtttctggagtctatccgcagaggggaggtgccagcagagcttcggaggctagctcacggtggacaggtgaacttggatatggaggaccatcgggacgaggactttgtgaagcccaaaggagccttcaaagccttcactggcgagggtcagaaactgggcagcactgccccccaggtgttgagtaccagctctccagcccaacaggcagaaaatgaagccaaagccagctcttccatcttaatcgacgaatcagagcctaccacaaacatccaaattcggcttgcagacggcgggaggctggtgcagaaatttaaccacagccacaggatcagcgacatccgactcttcatcgtggatgcccggccagccatggctgccaccagctttatcctcatgactactttcccgaacaaagagctggctgatgagagccagaccctgaaggaagccaacctgctcaatgctgtcatcgtgcagcggttaacataaccgcccagccagctgcctggcctccctcctgtgtttcccatggccagtggccatgccccatggggatcgcccctcctgcccccttgtgcacacccagcagtccagtgcaacgtctcctccatagctctgggttcttagatcttggttggacgtttgttttctccttagttgcatttcctgggtttttgtgatgatcaatggactttaatgaaaaaaaaaataaaaacaaccaaaaaaattgaaggaatatcaccagcatgttgtacggaaactctcccactgaagcaggctttaattgctttaaaattatatttatcttggggcctgtgggaggaaacttccttccatcttctctgcataaaaacttgtggcacacaatgcttattcactagtgtgtcccacccgccagccccacagatgactggaggaaggaggggaaatgtgtagaaagaggcttcgccaccacttgttcccacgagaatatatcacttgcccagataaaactgggcggcagccagagttccctgaagtgggaagtcagagctacatgcacacagtgtcttcagaaggtgaaaataaatatttccctgtgctccttttactcaacccctggggtatctaatcttgccaggtcttggccagttgagattctgttccacctgcctgcctggccctttcctccattaccatccagactgctcgcctcctggggattctcaggggctccattatggcttgacactaggatacagctcatgccaacccatcctaagtgagttcagaatcagggtatcttgccctataagataaacagtcaaaatgccaccgagctgttcactagtgatgtgtggcaaatcaaatcaactgttgaagaaggggtgagttttctgtgctacaagcacctgtcactgttggtacttgcagcagtccagtgcaacgtctcctccatagctctgggttcttagatcttggttggacgtttgttttctccttagttgcatttcctgggtttttgtgatgatcaatggactttaatgaaaaaaaaaataaaaacaaccaaaaaaattgaannaanannannaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaccggcaaaatttttgccaaaatttgcaaaagaaaaatttttttaaaaaaaaaaaaaaaaaaaaaaaaaaaaaaaaaaaaaaaaaaaaaaaaacttgggttttaaaacaaaaacccctttaaaggaatttggttcaaaagggatttgggtattaaaaaaaaatttttttttgaaaaaacatagggggaatttttaaaaactttaaaaaaaaatttgtaggggggcttttccatttaaaagaaatgggaaaacccaaggttttaaaaaagaaaagggggccccct

SEQ ID NO: 427769 - DNA, 3834 bp, Homo sapiens
tagattaggacccgcgggaaggttgtttaccgtaactaggggtaaggaggtacaaagaacaaggaagttaggctttgaaaatagagaacaaagaacaagtaagctgaacaagtaagttcctctttggagaggcaagagggcaaagaagctgaggacccagaagacaggattgtgcctaagaaagtggccttggagcagaggcccaaagaaagcggggagagcgccttgcccatcggtaagggaaaggtgctccaggcacagaagcagctaatgcaacggccctgaggcaaatgcaagataactggcaagttccaggaacagcaaggagggcaaggcgcctggagcagaggaagctagcggatcccttgatgagagggaggaactggcccatctctcatgggtcctgcaggcaggccatgagactgtcttttatgcggggcgagataacgaggcatggacgtgttgtgagcggaggcctagcctgttcaaggtctgaatttttacccctagaatgtaagaagcatgggagcagggactttgttttgctccctgccatatccacagccctagaaaaacgtcgggccattgatagctctcagtaaatgcttgacaagtaagtgaatgaacgaatgcacaattaatgaaatgagggctgcgtcaatgaataactgggaatctgactcctgcagggagccttcagcccacaggtgtatgtaagacccgccccgcctctcatccttcgggctcccacccccgccgttaggctgcggttcgcgccgcggtcgccagagggcgcggagcggcggggcttcccgcacggagggctttgcgtgaggcaccgcgtggggcggggctgcgggcgggctcccagctgctgggccctcatcggctgggcctcgtcgaccggcaagcggaacgcggcagcggggctgggcctgtgcggcggccgccggagcgctttggaaggcgcacggggcgaagatggcggcggagcgacaggaggcgctgagggagttcgtggcggtgacgggcgccgaggaggaccgggcccgcttctttctcgagtcggccggctgggacttgcagatcgcgctagcgagcttttatgaggacggaggggatgaagacattgtgaccatttcgcaggcaacccccagttcagtgtccagaggcacagcccccagtgataatagagtgacatccttcagagacctcattcatgaccaagatgaagatgaggaggaagaggaaggccagaggggccacagtgtgtgtcacatgaatggcaaggtgaggtgaggcttgggggagctcctggtgctgtgtcacaccaccttacctgtgtgcattactctgtgcttgttcttttgcatacatctgctgatttgaacctcacggctctgacttaaggagcaggttttatgctgggggctcagagagaagtggacagcagattgttggccctcccaggaagaaaagtcccaacgagctggtggatgatctctttaaaggtgccaaagagcatggagctgtagctgtggagcgagtgaccaagagccctggagagaccagtaaaccgagaccatttgcaggaggtggctaccgccttggggcagcaccagaggaagagtctgcctatgtggcaggagaaaagaggcagcattccagccaagatgttcatgtagtattgaaactctggaagagtggattcagcctggataatggagaactcagaagctaccaagacccatccaatgcccagtttctggagtctatccgcagaggggaggtgccagcagagcttcggaggctagctcacggtggacaggtgaacttggatatggaggaccatcgggacgaggactttgtgaagcccaaaggagccttcaaagccttcactggcgagggtcagaaactgggcagcactgccccccaggtgttgagtaccagctctccagcccaacaggcagaaaatgaagccaaagccagctcttccatcttaatcgacgaatcagagcctaccacaaacatccaaattcggcttgcagacggcgggaggctggtgcagaaatttaaccacagccacaggatcagcgacatccgactcttcatcgtggatgcccggccagccatggctgccaccagctttatcctcatgactactttcccgaacaaagagctggctgatgagagccagaccctgaaggaagccaacctgctcaatgctgtcatcgtgcagcggttaacataaccgcccagccagctgcctggcctccctcctgtgtttcccatggccagtggccatgccccatggggatcgcccctcctgcccccttgtgcacacccagcagtccagtgcaacgtctcctccatagctctgggttcttagatcttggttggacgtttgttttctccttagttgcatttcctgggtttttgtgatgatcaatggactttaatgaaaaaaaaaataaaaacaaccaaaaaaattgaaggaatatcaccagcatgttgtacggaaactctcccactgaagcaggctttaattgctttaaaattatatttatcttggggcctgtgggaggaaacttccttccatcttctctgcataaaaacttgtggcacacaatgcttattcactagtgtgtcccacccgccagccccacagatgactggaggaaggaggggaaatgtgtagaaagaggcttcgccaccacttgttcccacgagaatatatcacttgcccagataaaactgggcggcagccagagttccctgaagtgggaagtcagagctacatgcacacagtgtcttcagaaggtgaaaataaatatttccctgtgctccttttactcaacccctggggtatctaatcttgccaggtcttggccagttgagattctgttccacctgcctgcctggccctttcctccattaccatccagactgctcgcctcctggggattctcaggggctccattatggcttgatttactccacgtgcagaagtcttgagtggacctaggaggtaggtgggatattttttttcactaggatacagctcatgccaacccatcctaagtgagttcagaatcagggtatcttgccctataagataaacagtcaaaatgccaccgagctgttcactagtgatgtgtggcaaatcaaatcaactgttgaagaaggggtgagttttctgtgctacaagcacctgtcactgttggtacttgcaggaggcttctgctgggtatgttttggaagtgagtgtcactacttggctttgcttagcaggttctgcttcacacttgttctttgacctgctgacttgtgacttgcagaaacataggcagtagtcctagcctggtaaagaccctccaccacccctataagtttgattgctatgcaggtttgggagaggaggcctattgggctcttggatggaaccctttcccgtattaaacaaaccagagacagaatcagtgctgactcaggatctcctggtttggaatcgtaatgtgcctcaatcctctttccaagcaggcctcaccagtctctttctctttcctgcttcacccctgcaatgagccaagaaccaacactacatccacctagaactgcagaagggcttgtggtttcaaccaagacccatcctgagcaagggacttggcttggtgcttttgatcccaaagttcccacaccggcagtggcctgctggggcaatggcatctgtcacggtgttttctccagcaggtggagattatggaacctacatatgggtctggaaaaactgtacactgttgtcaccttgaccattaaaaaccagaatgaggacaa

SEQ ID NO: 427770 - DNA, 3582 bp, Homo sapiens
tagattaggacccgcgggaaggttgtttaccgtaactaggggtaaggaggtacaaagaacaaggaagttaggctttgaaaatagagaacaaagaacaagtaagctgaacaagtaagttcctctttggagaggcaagagggcaaagaagctgaggacccagaagacaggattgtgcctaagaaagtggccttggagcagaggcccaaagaaagcggggagagcgccttgcccatcggtaagggaaaggtgctccaggcacagaagcagctaatgcaacggccctgaggcaaatgcaagataactggcaagttccaggaacagcaaggagggcaaggcgcctggagcagaggaagctagcggatcccttgatgagagggaggaactggcccatctctcatgggtcctgcaggcaggccatgagactgtcttttatgcggggcgagataacgaggcatggacgtgttgtgagcggaggcctagcctgttcaaggtctgaatttttacccctagaatgtaagaagcatgggagcagggactttgttttgctccctgccatatccacagccctagaaaaacgtcgggccattgatagctctcagtaaatgcttgacaagtaagtgaatgaacgaatgcacaattaatgaaatgagggctgcgtcaatgaataactgggaatctgactcctgcagggagccttcagcccacaggtgtatgtaagacccgccccgcctctcatccttcgggctcccacccccgccgttaggctgcggttcgcgccgcggtcgccagagggcgcggagcggcggggcttcccgcacggagggctttgcgtgaggcaccgcgtggggcggggctgcgggcgggctcccagctgctgggccctcatcggctgggcctcgtcgaccggcaagcggaacgcggcagcggggctgggcctgtgcggcggccgccggagcgctttggaaggcgcacggggcgaagatggcggcggagcgacaggaggcgctgagggagttcgtggcggtgacgggcgccgaggaggaccgggcccgcttctttctcgagtcggccggctgggacttgcagatcgcgctagcgagcttttatgaggacggaggggatgaagacattgtgaccatttcgcaggcaacccccagttcagtgtccagaggcacagcccccagtgataatagagtgacatccttcagagacctcattcatgaccaagatgaagatgaggaggaagaggaaggccagaggtgccaaagagcatggagctgtagctgtggagcgagtgaccaagagccctggagagaccagtaaaccgagaccatttgcaggaggtggctaccgccttggggcagcaccagaggaagagtctgcctatgtggcaggagaaaagaggcagcattccagccaagatgttcatgtagtattgaaactctggaagagtggattcagcctggataatggagaactcagaagctaccaagacccatccaatgcccagtttctggagtctatccgcagaggggaggtgccagcagagcttcggaggctagctcacggtggacaggtgaacttggatatggaggaccatcgggacgaggactttgtgaagcccaaaggagccttcaaagccttcactggcgagggtcagaaactgggcagcactgccccccaggtgttgagtaccagctctccagcccaacaggcagaaaatgaagccaaagccagctcttccatcttaatcgacgaatcagagcctaccacaaacatccaaattcggcttgcagacggcgggaggctggtgcagaaatttaaccacagccacaggatcagcgacatccgactcttcatcgtggatgcccggccagccatggctgccaccagctttatcctcatgactactttcccgaacaaagagctggctgatgagagccagaccctgaaggaagccaacctgctcaatgctgtcatcgtgcagcggttaacataaccgcccagccagctgcctggcctccctcctgtgtttcccatggccagtggccatgccccatggggatcgcccctcctgcccccttgtgcacacccagcagtccagtgcaacgtctcctccatagctctgggttcttagatcttggttggacgtttgttttctccttagttgcatttcctgggtttttgtgatgatcaatggactttaatgaaaaaaaaaataaaaacaaccaaaaaaattgaaggaatatcaccagcatgttgtacggaaactctcccactgaagcaggctttaattgctttaaaattatatttatcttggggcctgtgggaggaaacttccttccatcttctctgcataaaaacttgtggcacacaatgcttattcactagtgtgtcccacccgccagccccacagatgactggaggaaggaggggaaatgtgtagaaagaggcttcgccaccacttgttcccacgagaatatatcacttgcccagataaaactgggcggcagccagagttccctgaagtgggaagtcagagctacatgcacacagtgtcttcagaaggtgaaaataaatatttccctgtgctccttttactcaacccctggggtatctaatcttgccaggtcttggccagttgagattctgttccacctgcctgcctggccctttcctccattaccatccagactgctcgcctcctggggattctcaggggctccattatggcttgatttactccacgtgcagaagtcttgagtggacctaggaggtaggtgggatattttttttcactaggatacagctcatgccaacccatcctaagtgagttcagaatcagggtatcttgccctataagataaacagtcaaaatgccaccgagctgttcactagtgatgtgtggcaaatcaaatcaactgttgaagaaggggtgagttttctgtgctacaagcacctgtcactgttggtacttgcaggaggcttctgctgggtatgttttggaagtgagtgtcactacttggctttgcttagcaggttctgcttcacacttgttctttgacctgctgacttgtgacttgcagaaacataggcagtagtcctagcctggtaaagaccctccaccacccctataagtttgattgctatgcaggtttgggagaggaggcctattgggctcttggatggaaccctttcccgtattaaacaaaccagagacagaatcagtgctgactcaggatctcctggtttggaatcgtaatgtgcctcaatcctctttccaagcaggcctcaccagtctctttctctttcctgcttcacccctgcaatgagccaagaaccaacactacatccacctagaactgcagaagggcttgtggtttcaaccaagacccatcctgagcaagggacttggcttggtgcttttgatcccaaagttcccacaccggcagtggcctgctggggcaatggcatctgtcacggtgttttctccagcaggtggagattatggaacctacatatgggtctggaaaaactgtacactgttgtcaccttgaccattaaaaaccagaatgaggacaa

SEQ ID NO: 427771 - DNA, 3609 bp, Homo sapiens
tagattaggacccgcgggaaggttgtttaccgtaactaggggtaaggaggtacaaagaacaaggaagttaggctttgaaaatagagaacaaagaacaagtaagctgaacaagtaagttcctctttggagaggcaagagggcaaagaagctgaggacccagaagacaggattgtgcctaagaaagtggccttggagcagaggcccaaagaaagcggggagagcgccttgcccatcggtaagggaaaggtgctccaggcacagaagcagctaatgcaacggccctgaggcaaatgcaagataactggcaagttccaggaacagcaaggagggcaaggcgcctggagcagaggaagctagcggatcccttgatgagagggaggaactggcccatctctcatgggtcctgcaggcaggccatgagactgtcttttatgcggggcgagataacgaggcatggacgtgttgtgagcggaggcctagcctgttcaaggtctgaatttttacccctagaatgtaagaagcatgggagcagggactttgttttgctccctgccatatccacagccctagaaaaacgtcgggccattgatagctctcagtaaatgcttgacaagtaagtgaatgaacgaatgcacaattaatgaaatgagggctgcgtcaatgaataactgggaatctgactcctgcagggagccttcagcccacaggtgtatgtaagacccgccccgcctctcatccttcgggctcccacccccgccgttaggctgcggttcgcgccgcggtcgccagagggcgcggagcggcggggcttcccgcacggagggctttgcgtgaggcaccgcgtggggcggggctgcgggcgggctcccagctgctgggccctcatcggctgggcctcgtcgaccggcaagcggaacgcggcagcggggctgggcctgtgcggcggccgccggagcgctttggaaggcgcacggggcgaagatggcggcggagcgacaggaggcgctgagggagttcgtggcggtgacgggcgccgaggaggaccgggcccgcttctttctcgagtcggccggctgggacttgcagatcgcgctagcgagcttttatgaggacggaggggatgaagacattgtgaccatttcgcaggcaacccccagttcagtgtccagaggcacagcccccagtgataatagagtgacatccttcagagacctcattcatgaccaagatgaagatgaggaggaagaggaaggccagaggttttatgctgggggctcagagagaagtggacagcagattgttggccctcccaggaagaaaagtcccaacgagctggtggatgatctctttaaaggtgccaaagagcatggagctgtagctgtggagcgagtgaccaagagccctggagagaccagtaaaccgagaccatttgcaggaggtggctaccgccttggggcagcaccagaggaagagtctgcctatgtggcaggagaaaagaggcagcattccagccaagatgttcatgtagtattgaaactctggaagagtggattcagcctggataatggagaactcagaagctaccaagacccatccaatgcccagtttctggagtctatccgcagaggggaggtgccagcagagcttcggaggctagctcacggtggacaggtgaacttggatatggaggaccatcgggacgaggactttgtgaagcccaaaggagccttcaaagccttcactggcgagggtcagaaactgggcagcactgccccccaggtgttgagtaccagctctccagcccaacaggcagaaaatgaagccaaagccagctcttccatcttaatcgacgaatcagagcctaccacaaacatccaaattcggcttgcagacggcgggaggctggtggatgatctctttaaaggtgccaaagagcatggagctgtagctgtggagcgagtgaccaagagccctggagagaccagtaaacctgctcaatgctgtcatcgtgcagcggttaacataaccgcccagccagctgcctggcctccctcctgtgtttcccatggccagtggccatgccccatggggatcgcccctcctgcccccttgtgcacacccagcagtccagtgcaacgtctcctccatagctctgggttcttagatcttggttggacgtttgttttctccttagttgcatttcctgggtttttgtgatgatcaatggactttaatgaaaaaaaaaataaaaacaaccaaaaaaattgaaggaatatcaccagcatgttgtacggaaactctcccactgaagcaggctttaattgctttaaaattatatttatcttggggcctgtgggaggaaacttccttccatcttctctgcataaaaacttgtggcacacaatgcttattcactagtgtgtcccacccgccagccccacagatgactggaggaaggaggggaaatgtgtagaaagaggcttcgccaccacttgttcccacgagaatatatcacttgcccagataaaactgggcggcagccagagttccctgaagtgggaagtcagagctacatgcacacagtgtcttcagaaggtgaaaataaatatttccctgtgctccttttactcaacccctggggtatctaatcttgccaggtcttggccagttgagattctgttccacctgcctgcctggccctttcctccattaccatccagactgctcgcctcctggggattctcaggggctccattatggcttgatttactccacgtgcagaagtcttgagtggacctaggaggtaggtgggatattttttttcactaggatacagctcatgccaacccatcctaagtgagttcagaatcagggtatcttgccctataagataaacagtcaaaatgccaccgagctgttcactagtgatgtgtggcaaatcaaatcaactgttgaagaaggggtgagttttctgtgctacaagcacctgtcactgttggtacttgcaggaggcttctgctgggtatgttttggaagtgagtgtcactacttggctttgcttagcaggttctgcttcacacttgttctttgacctgctgacttgtgacttgcagaaacataggcagtagtcctagcctggtaaagaccctccaccacccctataagtttgattgctatgcaggtttgggagaggaggcctattgggctcttggatggaaccctttcccgtattaaacaaaccagagacagaatcagtgctgactcaggatctcctggtttggaatcgtaatgtgcctcaatcctctttccaagcaggcctcaccagtctctttctctttcctgcttcacccctgcaatgagccaagaaccaacactacatccacctagaactgcagaagggcttgtggtttcaaccaagacccatcctgagcaagggacttggcttggtgcttttgatcccaaagttcccacaccggcagtggcctgctggggcaatggcatctgtcacggtgttttctccagcaggtggagattatggaacctacatatgggtctggaaaaactgtacactgttgtcaccttgaccattaaaaaccagaatgaggacaa

SEQ ID NO: 427772 - DNA, 3324 bp, Homo sapiens
gaacaagaatgaacgccagcctcatttcatgggttttggttctccacaggatctgcctcggtctgtcagacattcctaaggaaaattgtataataactatttcgggaatgcagttatctcatcatggtcagtctttggggaagtgggctgagaaattacatgtgttctattctctattttcattcctattgtgaccttcacaccgactcaaaaccttccttttagatacttctggatataaaaatatatgttaattttggggtttcacactcctgagtgaaaggcagtgtcatcaagtacgtgaatgcccagctcctaaatgtctttctcgttctcctcccacccagtcacgtcctccaggcagtgaccttcctttatttcacattccgcttacttccttgacccctcagcatttcagacctgaaaggacactggtactgttgtccttgtcggggcctgtggctttgcctctcattccctggtgaatgtcaggaaatagagggctgagactaatttttataggttctcaatttttcttgcttggggacaagctgttgacttagctctgaataggagtaataaggaggcagtgggccaggctgcatgacaactggttttcaggcccatataaaaaagtactaactttattatctcaagccatgcctggcctattgcaaagcccagtgtgggtgtcttggggcttgtatttgagattggagcttctctgacctccagtaccctttcctcaggggccacagtgtgtgtcacatgaatggcaaggtgaggtgaggcttgggggagctcctggtgctgtgtcacaccaccttacctgtgtgcattactctgtgcttgttcttttgcatacatctgctgatttgaacctcacggctctgacttaaggagcaggttttatgctgggggctcagagagaagtggacagcagattgttggccctcccaggaagaaaagtcccaacgagctggtggatgatctctttaaaggtgccaaagagcatggagctgtagctgtggagcgagtgaccaagagccctggagagaccagtaaaccgagaccatttgcaggaggtggctaccgccttggggcagcaccagaggaagagtctgcctatgtggcaggagaaaagaggcagcattccagccaagatgttcatgtagtattgaaactctggaagagtggattcagcctggataatggagaactcagaagctaccaagacccatccaatgcccagtttctggagtctatccgcagaggggaggtgccagcagagcttcggaggctagctcacggtggacaggtgaacttggatatggaggaccatcgggacgaggactttgtgaagcccaaaggagccttcaaagccttcactggcgagggtcagaaactgggcagcactgccccccaggtgttgagtaccagctctccagcccaacaggcagaaaatgaagccaaagccagctcttccatcttaatcgacgaatcagagcctaccacaaacatccaaattcggcttgcagacggcgggaggctggtgcagaaatttaaccacagccacaggatcagcgacatccgactcttcatcgtggatgcccggccagccatggctgccaccagctttatcctcatgactactttcccgaacaaagagctggctgatgagagccagaccctgaaggaagccaacctgctcaatgctgtcatcgtgcagcggttaacataaccgcccagccagctgcctggcctccctcctgtgtttcccatggccagtggccatgccccatggggatcgcccctcctgcccccttgtgcacacccagcagtccagtgcaacgtctcctccatagctctgggttcttagatcttggttggacgtttgttttctccttagttgcatttcctgggtttttgtgatgatcaatggactttaatgaaaaaaaaaataaaaacaaccaaaaaaattgaaggaatatcaccagcatgttgtacggaaactctcccactgaagcaggctttaattgctttaaaattatatttatcttggggcctgtgggaggaaacttccttccatcttctctgcataaaaacttgtggcacacaatgcttattcactagtgtgtcccacccgccagccccacagatgactggaggaaggaggggaaatgtgtagaaagaggcttcgccaccacttgttcccacgagaatatatcacttgcccagataaaactgggcggcagccagagttccctgaagtgggaagtcagagctacatgcacacagtgtcttcagaaggtgaaaataaatatttccctgtgctccttttactcaacccctggggtatctaatcttgccaggtcttggccagttgagattctgttccacctgcctgcctggccctttcctccattaccatccagactgctcgcctcctggggattctcaggggctccattatggcttgatttactccacgtgcagaagtcttgagtggacctaggaggtaggtgggatattttttttcactaggatacagctcatgccaacccatcctaagtgagttcagaatcagggtatcttgccctataagataaacagtcaaaatgccaccgagctgttcactagtgatgtgtggcaaatcaaatcaactgttgaagaaggggtgagttttctgtgctacaagcacctgtcactgttggtacttgcaggaggcttctgctgggtatgttttggaagtgagtgtcactacttggctttgcttagcaggttctgcttcacacttgttctttgacctgctgacttgtgacttgcagaaacataggcagtagtcctagcctggtaaagaccctccaccacccctataagtttgattgctatgcaggtttgggagaggaggcctattgggctcttggatggaaccctttcccgtattaaacaaaccagagacagaatcagtgctgactcaggatctcctggtttggaatcgtaatgtgcctcaatcctctttccaagcaggcctcaccagtctctttctctttcctgcttcacccctgcaatgagccaagaaccaacactacatccacctagaactgcagaagggcttgtggtttcaaccaagacccatcctgagcaagggacttggcttggtgcttttgatcccaaagttcccacaccggcagtggcctgctggggcaatggcatctgtcacggtgttttctccagcaggtggagattatggaacctacatatgggtctggaaaaactgtacactgttgtcaccttgaccattaaaaaccagaatgaggacaa

SEQ ID NO: 427773 - DNA, 3465 bp, Homo sapiens
tagattaggacccgcgggaaggttgtttaccgtaactaggggtaaggaggtacaaagaacaaggaagttaggctttgaaaatagagaacaaagaacaagtaagctgaacaagtaagttcctctttggagaggcaagagggcaaagaagctgaggacccagaagacaggattgtgcctaagaaagtggccttggagcagaggcccaaagaaagcggggagagcgccttgcccatcggtaagggaaaggtgctccaggcacagaagcagctaatgcaacggccctgaggcaaatgcaagataactggcaagttccaggaacagcaaggagggcaaggcgcctggagcagaggaagctagcggatcccttgatgagagggaggaactggcccatctctcatgggtcctgcaggcaggccatgagactgtcttttatgcggggcgagataacgaggcatggacgtgttgtgagcggaggcctagcctgttcaaggtctgaatttttacccctagaatgtaagaagcatgggagcagggactttgttttgctccctgccatatccacagccctagaaaaacgtcgggccattgatagctctcagtaaatgcttgacaagtaagtgaatgaacgaatgcacaattaatgaaatgagggctgcgtcaatgaataactgggaatctgactcctgcagggagccttcagcccacaggtgtatgtaagacccgccccgcctctcatccttcgggctcccacccccgccgttaggctgcggttcgcgccgcggtcgccagagggcgcggagcggcggggcttcccgcacggagggctttgcgtgaggcaccgcgtggggcggggctgcgggcgggctcccagctgctgggccctcatcggctgggcctcgtcgaccggcaagcggaacgcggcagcggggctgggcctgtgcggcggccgccggagcgctttggaaggcgcacggggcgaagatggcggcggagcgacaggaggcgctgagggagttcgtggcggtgacgggcgccgaggaggaccgggcccgcttctttctcgagtcggccggctgggacttgcagatcgcgctagcgagcttttatgaggacggaggggatgaagacattgtgaccatttcgcaggcaacccccagttcagtgtccagaggcacagcccccagtgataatagagtgacatccttcagagacctcattcatgaccaagatgaagatgaggaggaagaggaaggccagaggttttatgctgggggctcagagagaagtggacagcagattgttggccctcccaggaagaaaagtcccaacgagctggtggatgatctctttaaaggtgccaaagagcatggagctgtagctgtggagcgagtgaccaagagccctggagagaccagtaaaccgagaccatttgcaggaggtggctaccgccttggggcagcaccagaggaagagtctgcctatgtggcaggagaaaagaggcagcattccagccaagatgttcatgtagtattgaaactctggaagagtggattcagcctggataatggagaactcagaagctaccaagacccatccaatgcccagtttctggagtctatccgcagaggggaggtgccagcagagcttcggaggctagctcacggtggacaggtgaacttggatatggaggaccatcgggacgaggactttgtgaagcccaaaggagccttcaaagccttcactggcgagggtcagaaactgggcagcactgccccccaggtgttgagtaccagctctccagcccaacaggcagaatgatgagagccagaccctgaaggaagccaacctgctcaatgctgtcatcgtgcagcggttaacataaccgcccagccagctgcctggcctccctcctgtgtttcccatggccagtggccatgccccatggggatcgcccctcctgcccccttgtgcacacccagcagtccagtgcaacgtctcctccatagctctgggttcttagatcttggttggacgtttgttttctccttagttgcatttcctgggtttttgtgatgatcaatggactttaatgaaaaaaaaaataaaaacaaccaaaaaaattgaaggaatatcaccagcatgttgtacggaaactctcccactgaagcaggctttaattgctttaaaattatatttatcttggggcctgtgggaggaaacttccttccatcttctctgcataaaaacttgtggcacacaatgcttattcactagtgtgtcccacccgccagccccacagatgactggaggaaggaggggaaatgtgtagaaagaggcttcgccaccacttgttcccacgagaatatatcacttgcccagataaaactgggcggcagccagagttccctgaagtgggaagtcagagctacatgcacacagtgtcttcagaaggtgaaaataaatatttccctgtgctccttttactcaacccctggggtatctaatcttgccaggtcttggccagttgagattctgttccacctgcctgcctggccctttcctccattaccatccagactgctcgcctcctggggattctcaggggctccattatggcttgatttactccacgtgcagaagtcttgagtggacctaggaggtaggtgggatattttttttcactaggatacagctcatgccaacccatcctaagtgagttcagaatcagggtatcttgccctataagataaacagtcaaaatgccaccgagctgttcactagtgatgtgtggcaaatcaaatcaactgttgaagaaggggtgagttttctgtgctacaagcacctgtcactgttggtacttgcaggaggcttctgctgggtatgttttggaagtgagtgtcactacttggctttgcttagcaggttctgcttcacacttgttctttgacctgctgacttgtgacttgcagaaacataggcagtagtcctagcctggtaaagaccctccaccacccctataagtttgattgctatgcaggtttgggagaggaggcctattgggctcttggatggaaccctttcccgtattaaacaaaccagagacagaatcagtgctgactcaggatctcctggtttggaatcgtaatgtgcctcaatcctctttccaagcaggcctcaccagtctctttctctttcctgcttcacccctgcaatgagccaagaaccaacactacatccacctagaactgcagaagggcttgtggtttcaaccaagacccatcctgagcaagggacttggcttggtgcttttgatcccaaagttcccacaccggcagtggcctgctggggcaatggcatctgtcacggtgttttctccagcaggtggagattatggaacctacatatgggtctggaaaaactgtacactgttgtcaccttgaccattaaaaaccagaatgaggacaa

SEQ ID NO: 427774 - DNA, 3265 bp, Homo sapiens
tagattaggacccgcgggaaggttgtttaccgtaactaggggtaaggaggtacaaagaacaaggaagttaggctttgaaaatagagaacaaagaacaagtaagctgaacaagtaagttcctctttggagaggcaagagggcaaagaagctgaggacccagaagacaggattgtgcctaagaaagtggccttggagcagaggcccaaagaaagcggggagagcgccttgcccatcggtaagggaaaggtgctccaggcacagaagcagctaatgcaacggccctgaggcaaatgcaagataactggcaagttccaggaacagcaaggagggcaaggcgcctggagcagaggaagctagcggatcccttgatgagagggaggaactggcccatctctcatgggtcctgcaggcaggccatgagactgtcttttatgcggggcgagataacgaggcatggacgtgttgtgagcggaggcctagcctgttcaaggtctgaatttttacccctagaatgtaagaagcatgggagcagggactttgttttgctccctgccatatccacagccctagaaaaacgtcgggccattgatagctctcagtaaatgcttgacaagtaagtgaatgaacgaatgcacaattaatgaaatgagggctgcgtcaatgaataactgggaatctgactcctgcagggagccttcagcccacaggtgtatgtaagacccgccccgcctctcatccttcgggctcccacccccgccgttaggctgcggttcgcgccgcggtcgccagagggcgcggagcggcggggcttcccgcacggagggctttgcgtgaggcaccgcgtggggcggggctgcgggcgggctcccagctgctgggccctcatcggctgggcctcgtcgaccggcaagcggaacgcggcagcggggctgggcctgtgcggcggccgccggagcgctttggaaggcgcacggggcgaagatggcggcggagcgacaggaggcgctgagggagttcgtggcggtgacgggcgccgaggaggaccgggcccgcttctttctcgagtcggccggctgggacttgcagatcgcgctagcgagcttttatgaggacggaggggatgaagacattgtgaccatttcgcaggcaacccccagttcagtgtccagaggcacagcccccagtgataatagagtgacatccttcagagacctcattcatgaccaagatgaagatgaggaggaagaggaaggccagaggttttatgctgggggctcagagagaagtggacagcagattgttggccctcccaggaagaaaagtcccaacgagctggtggatgatctctttaaaggtgccaaagagcatggagctgtagctgtggagcgagtgaccaagagccctggagagaccagtaaaccgagaccatttgcaggaggtggctaccgccttggggcagcaccagaggaagagtctgcctatgtggcaggagaaaagaggcagcattccagccaagatgttcatgtagtattgaaactctggaagagtggattcagcctggataatggagaactcagaagctaccaagacccatccaatgcccagtttctggagtctatccgcagaggggaggtgccagcagagcttcggaggctagctcacggtggacaggtgaacttggatatggaggaccatcgggacgaggactttgtgaagcccaaaggagccttcaaagccttcactggcgagggtcagaaactgggcagtgtgcacacccagcagtccagtgcaacgtctcctccatagctctgggttcttagatcttggttggacgtttgttttctccttagttgcatttcctgggtttttgtgatgatcaatggactttaatgaaaaaaaaaataaaaacaaccaaaaaaattgaaggaatatcaccagcatgttgtacggaaactctcccactgaagcaggctttaattgctttaaaattatatttatcttggggcctgtgggaggaaacttccttccatcttctctgcataaaaacttgtggcacacaatgcttattcactagtgtgtcccacccgccagccccacagatgactggaggaaggaggggaaatgtgtagaaagaggcttcgccaccacttgttcccacgagaatatatcacttgcccagataaaactgggcggcagccagagttccctgaagtgggaagtcagagctacatgcacacagtgtcttcagaaggtgaaaataaatatttccctgtgctccttttactcaacccctggggtatctaatcttgccaggtcttggccagttgagattctgttccacctgcctgcctggccctttcctccattaccatccagactgctcgcctcctggggattctcaggggctccattatggcttgatttactccacgtgcagaagtcttgagtggacctaggaggtaggtgggatattttttttcactaggatacagctcatgccaacccatcctaagtgagttcagaatcagggtatcttgccctataagataaacagtcaaaatgccaccgagctgttcactagtgatgtgtggcaaatcaaatcaactgttgaagaaggggtgagttttctgtgctacaagcacctgtcactgttggtacttgcaggaggcttctgctgggtatgttttggaagtgagtgtcactacttggctttgcttagcaggttctgcttcacacttgttctttgacctgctgacttgtgacttgcagaaacataggcagtagtcctagcctggtaaagaccctccaccacccctataagtttgattgctatgcaggtttgggagaggaggcctattgggctcttggatggaaccctttcccgtattaaacaaaccagagacagaatcagtgctgactcaggatctcctggtttggaatcgtaatgtgcctcaatcctctttccaagcaggcctcaccagtctctttctctttcctgcttcacccctgcaatgagccaagaaccaacactacatccacctagaactgcagaagggcttgtggtttcaaccaagacccatcctgagcaagggacttggcttggtgcttttgatcccaaagttcccacaccggcagtggcctgctggggcaatggcatctgtcacggtgttttctccagcaggtggagattatggaacctacatatgggtctggaaaaactgtacactgttgtcaccttgaccattaaaaaccagaatgaggacaa

SEQ ID NO: 427775 - DNA, 2339 bp, Homo sapiens
  misc_feature (29)..(29): n is a, c, g, or t
  misc_feature (31)..(32): n is a, c, g, or t
ggtggtcgtctagaggatcccacatgatngnncaccgctccactgaggctaaaactgaccctgttctattatgtcttccagccttatgaccctgtctctcccaccctaggctgtcctgctttcctcccttcaagcccttgttcagttgaagacaccaaggaggaaaaaggccgagtaacttgcccacattactcaggagcggtggagctagcaataacgtatgaaatatatgactcagggtttgaagtgaattctgctggacctgtaagttccataagggcacgattttccctgtctgggtcaatagatcagcagcaccaaacaatgccaggcgcattgcaaatgctcagtaacagtccaagaagggattcccttcttgctaggggccttgtttctgcttgtgttctgatgccatcctctctcctcagcactgccccccaggtgttgagtaccagctctccagcccaacaggcagaaaatgaagccaaagccagctcttccatcttaatcgacgaatcagagcctaccacaaacatccaaattcggcttgcagacggcgggaggctggtgcagaaatttaaccacagccacaggatcagcgacatccgactcttcatcgtggatgcccggccagccatggctgccaccagctttatcctcatgactactttcccgaacaaagagctggctgatgagagccagaccctgaaggaagccaacctgctcaatgctgtcatcgtgcagcggttaacataaccgcccagccagctgcctggcctccctcctgtgtttcccatggccagtggccatgccccatggggatcgcccctcctgcccccttgtgcacacccagcagtccagtgcaacgtctcctccatagctctgggttcttagatcttggttggacgtttgttttctccttagttgcatttcctgggtttttgtgatgatcaatggactttaatgaaaaaaaaaataaaaacaaccaaaaaaattgaaggaatatcaccagcatgttgtacggaaactctcccactgaagcaggctttaattgctttaaaattatatttatcttggggcctgtgggaggaaacttccttccatcttctctgcataaaaacttgtggcacacaatgcttattcactagtgtgtcccacccgccagccccacagatgactggaggaaggaggggaaatgtgtagaaagaggcttcgccaccacttgttcccacgagaatatatcacttgcccagataaaactgggcggcagccagagttccctgaagtgggaagtcagagctacatgcacacagtgtcttcagaaggtgaaaataaatatttccctgtgctccttttactcaacccctggggtatctaatcttgccaggtcttggccagttgagattctgttccacctgcctgcctggccctttcctccattaccatccagactgctcgcctcctggggattctcaggggctccattatggcttgatttactccacgtgcagaagtcttgagtggacctaggaggtaggtgggatattttttttcactaggatacagctcatgccaacccatcctaagtgagttcagaatcagggtatcttgccctataagataaacagtcaaaatgccaccgagctgttcactagtgatgtgtggcaaatcaaatcaactgttgaagaaggggtgagttttctgtgctacaagcacctgtcactgttggtacttgcaggaggcttctgctgggtatgttttggaagtgagtgtcactacttggctttgcttagcaggttctgcttcacacttgttctttgacctgctgacttgtgacttgcagaaacataggcagtagtcctagcctggtaaagaccctccaccacccctataagtttgattgctatgcaggtttgggagaggaggcctattgggctcttggatggaaccctttcccgtattaaacaaaccagagacagaatcagtgctgactcaggatctcctggtttggaatcgtaatgtgcctcaatcctctttccaagcaggcctcaccagtctctttctctttcctgcttcacccctgcaatgagccaagaaccaacactacatccacctagaactgcagaagggcttgtggtttcaaccaagacccatcctgagcaagggacttggcttggtgcttttgatcccaaagttcccacaccggcagtggcctgctggggcaatggcatctgtcacggtgttttctccagcaggtggagattatggaacctacatatgggtctggaaaaactgtacactgttgtcaccttgaccattaaaaaccagaatgaggacaa

SEQ ID NO: 427776 - DNA, 3272 bp, Homo sapiens
tagattaggacccgcgggaaggttgtttaccgtaactaggggtaaggaggtacaaagaacaaggaagttaggctttgaaaatagagaacaaagaacaagtaagctgaacaagtaagttcctctttggagaggcaagagggcaaagaagctgaggacccagaagacaggattgtgcctaagaaagtggccttggagcagaggcccaaagaaagcggggagagcgccttgcccatcggtaagggaaaggtgctccaggcacagaagcagctaatgcaacggccctgaggcaaatgcaagataactggcaagttccaggaacagcaaggagggcaaggcgcctggagcagaggaagctagcggatcccttgatgagagggaggaactggcccatctctcatgggtcctgcaggcaggccatgagactgtcttttatgcggggcgagataacgaggcatggacgtgttgtgagcggaggcctagcctgttcaaggtctgaatttttacccctagaatgtaagaagcatgggagcagggactttgttttgctccctgccatatccacagccctagaaaaacgtcgggccattgatagctctcagtaaatgcttgacaagtaagtgaatgaacgaatgcacaattaatgaaatgagggctgcgtcaatgaataactgggaatctgactcctgcagggagccttcagcccacaggtgtatgtaagacccgccccgcctctcatccttcgggctcccacccccgccgttaggctgcggttcgcgccgcggtcgccagagggcgcggagcggcggggcttcccgcacggagggctttgcgtgaggcaccgcgtggggcggggctgcgggcgggctcccagctgctgggccctcatcggctgggcctcgtcgaccggcaagcggaacgcggcagcggggctgggcctgtgcggcggccgccggagcgctttggaaggcgcacggggcgaagatggcggcggagcgacaggaggcgctgagggagttcgtggcggtgacgggcgccgaggaggaccgggcccgcttctttctcgagtcggccggctgggacttgcagtgataatagagtgacatccttcagagacctcattcatgaccaagatgaagatgaggaggaagaggaaggccagaggtgccaaagagcatggagctgtagctgtggagcgagtgaccaagagccctggagagaccagtaaaccgagaccatttgcaggaggtggctaccgccttggggcagcaccagaggaagagtctgcctatgtggcaggagaaaagaggcagcattccagccaagatgttcatgtagtattgaaactctggaagagtggattcagcctggataatggagaactcagaagctaccaagacccatccaatgcccagtttctggagtctatccgcagaggggaggtgccagcagagcttcggaggctagctcacggtggacaggtgaacttggatatggaggaccatcgggacgaggactttgtgaagcccaaaggagccttcaaagccttcactggcgagggtcagaaactgggcagcactgccccccaggtgttgagtaccagctctccagcccaacaggcagaatgatgagagccagaccctgaaggaagccaacctgctcaatgctgtcatcgtgcagcggttaacataaccgcccagccagctgcctggcctccctcctgtgtttcccatggccagtggccatgccccatggggatcgcccctcctgcccccttgtgcacacccagcagtccagtgcaacgtctcctccatagctctgggttcttagatcttggttggacgtttgttttctccttagttgcatttcctgggtttttgtgatgatcaatggactttaatgaaaaaaaaaataaaaacaaccaaaaaaattgaaggaatatcaccagcatgttgtacggaaactctcccactgaagcaggctttaattgctttaaaattatatttatcttggggcctgtgggaggaaacttccttccatcttctctgcataaaaacttgtggcacacaatgcttattcactagtgtgtcccacccgccagccccacagatgactggaggaaggaggggaaatgtgtagaaagaggcttcgccaccacttgttcccacgagaatatatcacttgcccagataaaactgggcggcagccagagttccctgaagtgggaagtcagagctacatgcacacagtgtcttcagaaggtgaaaataaatatttccctgtgctccttttactcaacccctggggtatctaatcttgccaggtcttggccagttgagattctgttccacctgcctgcctggccctttcctccattaccatccagactgctcgcctcctggggattctcaggggctccattatggcttgatttactccacgtgcagaagtcttgagtggacctaggaggtaggtgggatattttttttcactaggatacagctcatgccaacccatcctaagtgagttcagaatcagggtatcttgccctataagataaacagtcaaaatgccaccgagctgttcactagtgatgtgtggcaaatcaaatcaactgttgaagaaggggtgagttttctgtgctacaagcacctgtcactgttggtacttgcaggaggcttctgctgggtatgttttggaagtgagtgtcactacttggctttgcttagcaggttctgcttcacacttgttctttgacctgctgacttgtgacttgcagaaacataggcagtagtcctagcctggtaaagaccctccaccacccctataagtttgattgctatgcaggtttgggagaggaggcctattgggctcttggatggaaccctttcccgtattaaacaaaccagagacagaatcagtgctgactcaggatctcctggtttggaatcgtaatgtgcctcaatcctctttccaagcaggcctcaccagtctctttctctttcctgcttcacccctgcaatgagccaagaaccaacactacatccacctagaactgcagaagggcttgtggtttcaaccaagacccatcctgagcaagggacttggcttggtgcttttgatcccaaagttcccacaccggcagtggcctgctggggcaatggcatctgtcacggtgttttctccagcaggtggagattatggaacctacatatgggtctggaaaaactgtacactgttgtcaccttgaccattaaaaaccagaatgaggacaa

SEQ ID NO: 427777 - DNA, 2658 bp, Homo sapiens
  misc_feature (535)..(535): n is a, c, g, or t
taagcgagtgacccatcccagtgatgtgagttatttgtctcagtttcatttcactcattaagctcagcacactgctgcccattcccagggtggacagcccatgcagaggctttgctaggtgaaaaagcttggtttgctaaaagtcacaggcagaatcctgcaggtccatgcccttagatgtgccaaattgtaagttgcatagattttaggggtttggggcaaaaaggaaacttatgtttaagtgctctagggaaggaggcattgtttccaggtggtttcattgtcatatgatctccaggttcagaaggcaggtagtgtctggagaaacgattcctggccctgagaagttgaccattaatttctgacagatagtttaagtgcctcctgtgacatacaaaagagacacacactgtccttgtgaaattcatgagctgcaggaggagacactaatcagatcatcccagaaacgtggaaggagggccagggatggagccaaggagctaaggagggctttcctgaggaggtggcattgganccgaggcctgagttgtgattaggattacagaaaggggatcaggcaggggagcctctggaaagaaggacccaaatgtgggaagagagtatggcctgatgaactagaagcgggcagaagagaacgaggggaaagagggtggtataaaattaggtccttgggaacacagtagggttgttggtgtttatctcaaggaaaatggaaacaacagtgaaggactcttggcaaggaagggacttggtcccacatgcctgagcgtagctttcgctgttctgtggagaaagtcaggaaaggggatttgcgaggtgtttagctttccacagggcaggggtatggacagcagaggatggcactgctcaccgcttccccaactcctgcaggatcagcgacatccgactcttcatcgtggatgcccggccagccatggctgccaccagctttatcctcatgactactttcccgaacaaagagctggctgatgagagccagaccctgaaggaagccaacctgctcaatgctgtcatcgtgcagcggttaacataaccgcccagccagctgcctggcctccctcctgtgtttcccatggccagtggccatgccccatggggatcgcccctcctgcccccttgtgcacacccagcagtccagtgcaacgtctcctccatagctctgggttcttagatcttggttggacgtttgttttctccttagttgcatttcctgggtttttgtgatgatcaatggactttaatgaaaaaaaaaataaaaacaaccaaaaaaattgaaggaatatcaccagcatgttgtacggaaactctcccactgaagcaggctttaattgctttaaaattatatttatcttggggcctgtgggaggaaacttccttccatcttctctgcataaaaacttgtggcacacaatgcttattcactagtgtgtcccacccgccagccccacagatgactggaggaaggaggggaaatgtgtagaaagaggcttcgccaccacttgttcccacgagaatatatcacttgcccagataaaactgggcggcagccagagttccctgaagtgggaagtcagagctacatgcacacagtgtcttcagaaggtgaaaataaatatttccctgtgctccttttactcaacccctggggtatctaatcttgccaggtcttggccagttgagattctgttccacctgcctgcctggccctttcctccattaccatccagactgctcgcctcctggggattctcaggggctccattatggcttgatttactccacgtgcagaagtcttgagtggacctaggaggtaggtgggatattttttttcactaggatacagctcatgccaacccatcctaagtgagttcagaatcagggtatcttgccctataagataaacagtcaaaatgccaccgagctgttcactagtgatgtgtggcaaatcaaatcaactgttgaagaaggggtgagttttctgtgctacaagcacctgtcactgttggtacttgcaggaggcttctgctgggtatgttttggaagtgagtgtcactacttggctttgcttagcaggttctgcttcacacttgttctttgacctgctgacttgtgacttgcagaaacataggcagtagtcctagcctggtaaagaccctccaccacccctataagtttgattgctatgcaggtttgggagaggaggcctattgggctcttggatggaaccctttcccgtattaaacaaaccagagacagaatcagtgctgactcaggatctcctggtttggaatcgtaatgtgcctcaatcctctttccaagcaggcctcaccagtctctttctctttcctgcttcacccctgcaatgagccaagaaccaacactacatccacctagaactgcagaagggcttgtggtttcaaccaagacccatcctgagcaagggacttggcttggtgcttttgatcccaaagttcccacaccggcagtggcctgctggggcaatggcatctgtcacggtgttttctccagcaggtggagattatggaacctacatatgggtctggaaaaactgtacactgttgtcaccttgaccattaaaaaccagaatgaggacaa

SEQ ID NO: 427778 - DNA, 1561 bp, Homo sapiens
tagattaggacccgcgggaaggttgtttaccgtaactaggggtaaggaggtacaaagaacaaggaagttaggctttgaaaatagagaacaaagaacaagtaagctgaacaagtaagttcctctttggagaggcaagagggcaaagaagctgaggacccagaagacaggattgtgcctaagaaagtggccttggagcagaggcccaaagaaagcggggagagcgccttgcccatcggtaagggaaaggtgctccaggcacagaagcagctaatgcaacggccctgaggcaaatgcaagataactggcaagttccaggaacagcaaggagggcaaggcgcctggagcagaggaagctagcggatcccttgatgagagggaggaactggcccatctctcatgggtcctgcaggcaggccatgagactgtcttttatgcggggcgagataacgaggcatggacgtgttgtgagcggaggcctagcctgttcaaggtctgaatttttacccctagaatgtaagaagcatgggagcagggactttgttttgctccctgccatatccacagccctagaaaaacgtcgggccattgatagctctcagtaaatgcttgacaagtaagtgaatgaacgaatgcacaattaatgaaatgagggctgcgtcaatgaataactgggaatctgactcctgcagggagccttcagcccacaggtgtatgtaagacccgccccgcctctcatccttcgggctcccacccccgccgttaggctgcggttcgcgccgcggtcgccagagggcgcggagcggcggggcttcccgcacggagggctttgcgtgaggcaccgcgtggggcggggctgcgggcgggctcccagctgctgggccctcatcggctgggcctcgtcgaccggcaagcggaacgcggcagcggggctgggcctgtgcggcggccgccggagcgctttggaaggcgcacggggcgaagatggcggcggagcgacaggaggcgctgagggagttcgtggcggtgacgggcgccgaggaggaccgggcccgcttctttctcgagtcggccggctgggacttgcagatcgcgctagcgagcttttatgaggacggaggggatgaagacattgtgaccatttcgcaggcaacccccagttcagtgtccagaggcacagcccccagtgataatagagtgacatccttcagagacctcattcatgaccaagatgaagatgaggaggaagaggaaggccagaggttttatgctgggggctcagagagaagtggacagcagattgttggccctcccaggaagaaaagtcccaacgagctggtggatgatctctttaaaggtgccaaagagcatggagctgtagctgtggagcgagtgaccaagagcctgtgcacacccagcagtccagtgcaacgtctcctccatagctctgggttcttagatcttggttggacgtttgttttctccttagttgcatttcctgggtttttgtgatgatcaatggactttaatgaaaaaaaaaataaaaacaaccaaaaaaattgaa

SEQ ID NO: 427779 - DNA, 3584 bp, Homo sapiens
tagattaggacccgcgggaaggttgtttaccgtaactaggggtaaggaggtacaaagaacaaggaagttaggctttgaaaatagagaacaaagaacaagtaagctgaacaagtaagttcctctttggagaggcaagagggcaaagaagctgaggacccagaagacaggattgtgcctaagaaagtggccttggagcagaggcccaaagaaagcggggagagcgccttgcccatcggtaagggaaaggtgctccaggcacagaagcagctaatgcaacggccctgaggcaaatgcaagataactggcaagttccaggaacagcaaggagggcaaggcgcctggagcagaggaagctagcggatcccttgatgagagggaggaactggcccatctctcatgggtcctgcaggcaggccatgagactgtcttttatgcggggcgagataacgaggcatggacgtgttgtgagcggaggcctagcctgttcaaggtctgaatttttacccctagaatgtaagaagcatgggagcagggactttgttttgctccctgccatatccacagccctagaaaaacgtcgggccattgatagctctcagtaaatgcttgacaagtaagtgaatgaacgaatgcacaattaatgaaatgagggctgcgtcaatgaataactgggaatctgactcctgcagggagccttcagcccacaggtgtatgtaagacccgccccgcctctcatccttcgggctcccacccccgccgttaggctgcggttcgcgccgcggtcgccagagggcgcggagcggcggggcttcccgcacggagggctttgcgtgaggcaccgcgtggggcggggctgcgggcgggctcccagctgctgggccctcatcggctgggcctcgtcgaccggcaagcggaacgcggcagcggggctgggcctgtgcggcggccgccggagcgctttggaaggcgcacggggcgaagatggcggcggagcgacaggaggcgctgagggagttcgtggcggtgacgggcgccgaggaggaccgggcccgcttctttctcgagtcggccggctgggacttgcagatcgcgctagcgagcttttatgaggacggaggggatgaagacattgtgaccatttcgcaggcaacccccagttcagtgtccagaggcacagcccccagtgataatagagtgacatccttcagagacctcattcatgaccaagatgaagatgaggaggaagaggaaggccagaggttttatgctgggggctcagagagaagtggacagcagattgttggccctcccaggaagaaaagtcccaacgagctggtggatgatctctttaaaggtgccaaagagcatggagctgtagctgtggagcgagtgaccaagagccctggagagaccagtaaaccgagagttcatgtagtattgaaactctggaagagtggattcagcctggataatggagaactcagaagctaccaagacccatccaatgcccagtttctggagtctatccgcagaggggaggtgccagcagagcttcggaggctagctcacggtggacaggtgaacttggatatggaggaccatcgggacgaggactttgtgaagcccaaaggagccttcaaagccttcactggcgagggtcagaaactgggcagcactgccccccaggtgttgagtaccagctctccagcccaacaggcagaaaatgaagccaaagccagctcttccatcttaatcgacgaatcagagcctaccacaaacatccaaattcggcttgcagacggcgggaggctggtgcagaaatttaaccacagccacaggatcagcgacatccgactcttcatcgtggatgcccggccagccatggctgccaccagctttatcctcatgactactttcccgaacaaagagctggctgatgagagccagaccctgaaggaagccaacctgctcaatgctgtcatcgtgcagcggttaacataaccgcccagccagctgcctggcctccctcctgtgtttcccatggccagtggccatgccccatggggatcgcccctcctgcccccttgtgcacacccagcagtccagtgcaacgtctcctccatagctctgggttcttagatcttggttggacgtttgttttctccttagttgcatttcctgggtttttgtgatgatcaatggactttaatgaaaaaaaaaataaaaacaaccaaaaaaattgaaggaatatcaccagcatgttgtacggaaactctcccactgaagcaggctttaattgctttaaaattatatttatcttggggcctgtgggaggaaacttccttccatcttctctgcataaaaacttgtggcacacaatgcttattcactagtgtgtcccacccgccagccccacagatgactggaggaaggaggggaaatgtgtagaaagaggcttcgccaccacttgttcccacgagaatatatcacttgcccagataaaactgggcggcagccagagttccctgaagtgggaagtcagagctacatgcacacagtgtcttcagaaggtgaaaataaatatttccctgtgctccttttactcaacccctggggtatctaatcttgccaggtcttggccagttgagattctgttccacctgcctgcctggccctttcctccattaccatccagactgctcgcctcctggggattctcaggggctccattatggcttgatttactccacgtgcagaagtcttgagtggacctaggaggtaggtgggatattttttttcactaggatacagctcatgccaacccatcctaagtgagttcagaatcagggtatcttgccctataagataaacagtcaaaatgccaccgagctgttcactagtgatgtgtggcaaatcaaatcaactgttgaagaaggggtgagttttctgtgctacaagcacctgtcactgttggtacttgcaggaggcttctgctgggtatgttttggaagtgagtgtcactacttggctttgcttagcaggttctgcttcacacttgttctttgacctgctgacttgtgacttgcagaaacataggcagtagtcctagcctggtaaagaccctccaccacccctataagtttgattgctatgcaggtttgggagaggaggcctattgggctcttggatggaaccctttcccgtattaaacaaaccagagacagaatcagtgctgactcaggatctcctggtttggaatcgtaatgtgcctcaatcctctttccaagcaggcctcaccagtctctttctctttcctgcttcacccctgcaatgagccaagaaccaacactacatccacctagaactgcagaagggcttgtggtttcaaccaagacccatcctgagcaagggacttggcttggtgcttttgatcccaaagttcccacaccggcagtggcctgctggggcaatggcatctgtcacggtgttttctccagcaggtggagattatggaacctacatatgggtctggaaaaactgtacactgttgtcaccttgaccattaaaaaccagaatgaggacaa

SEQ ID NO: 427780 - DNA, 1483 bp, Homo sapiens
tagattaggacccgcgggaaggttgtttaccgtaactaggggtaaggaggtacaaagaacaaggaagttaggctttgaaaatagagaacaaagaacaagtaagctgaacaagtaagttcctctttggagaggcaagagggcaaagaagctgaggacccagaagacaggattgtgcctaagaaagtggccttggagcagaggcccaaagaaagcggggagagcgccttgcccatcggtaagggaaaggtgctccaggcacagaagcagctaatgcaacggccctgaggcaaatgcaagataactggcaagttccaggaacagcaaggagggcaaggcgcctggagcagaggaagctagcggatcccttgatgagagggaggaactggcccatctctcatgggtcctgcaggcaggccatgagactgtcttttatgcggggcgagataacgaggcatggacgtgttgtgagcggaggcctagcctgttcaaggtctgaatttttacccctagaatgtaagaagcatgggagcagggactttgttttgctccctgccatatccacagccctagaaaaacgtcgggccattgatagctctcagtaaatgcttgacaagtaagtgaatgaacgaatgcacaattaatgaaatgagggctgcgtcaatgaataactgggaatctgactcctgcagggagccttcagcccacaggtgtatgtaagacccgccccgcctctcatccttcgggctcccacccccgccgttaggctgcggttcgcgccgcggtcgccagagggcgcggagcggcggggcttcccgcacggagggctttgcgtgaggcaccgcgtggggcggggctgcgggcgggctcccagctgctgggccctcatcggctgggcctcgtcgaccggcaagcggaacgcggcagcggggctgggcctgtgcggcggccgccggagcgctttggaaggcgcacggggcgaagatggcggcggagcgacaggaggcgctgagggagttcgtggcggtgacgggcgccgaggaggaccgggcccgcttctttctcgagtcggccggctgggacttgcagatcgcgctagcgagcttttatgaggacggaggggatgaagacattgtgaccatttcgcagcaggagaatggcgtgaacccggggggcggagcttgcagtgagtcgagattgcgccactgcactccagcctgggcgacagagcaagactctgtctcaaaaaaaaaaaaaaaaaaatggaaggtaggtaaacttttctaatttgggcacaggggggtaaattgggggggatttaaggggacatttttccagggggcctagggctaaaattaggtcatgggggtgtgcttaaatattatattaattactattaaagattaccaggagcaaggacggtaagggtgcaaatttctataaaatttccaaattaaagggtgtttaccagtggtttcaagggggg

SEQ ID NO: 427781 - DNA, 3614 bp, Homo sapiens
  misc_feature (3223)..(3224): n is a, c, g, or t
  misc_feature (3227)..(3227): n is a, c, g, or t
  misc_feature (3229)..(3230): n is a, c, g, or t
  misc_feature (3232)..(3233): n is a, c, g, or t
tagattaggacccgcgggaaggttgtttaccgtaactaggggtaaggaggtacaaagaacaaggaagttaggctttgaaaatagagaacaaagaacaagtaagctgaacaagtaagttcctctttggagaggcaagagggcaaagaagctgaggacccagaagacaggattgtgcctaagaaagtggccttggagcagaggcccaaagaaagcggggagagcgccttgcccatcggtaagggaaaggtgctccaggcacagaagcagctaatgcaacggccctgaggcaaatgcaagataactggcaagttccaggaacagcaaggagggcaaggcgcctggagcagaggaagctagcggatcccttgatgagagggaggaactggcccatctctcatgggtcctgcaggcaggccatgagactgtcttttatgcggggcgagataacgaggcatggacgtgttgtgagcggaggcctagcctgttcaaggtctgaatttttacccctagaatgtaagaagcatgggagcagggactttgttttgctccctgccatatccacagccctagaaaaacgtcgggccattgatagctctcagtaaatgcttgacaagtaagtgaatgaacgaatgcacaattaatgaaatgagggctgcgtcaatgaataactgggaatctgactcctgcagggagccttcagcccacaggtgtatgtaagacccgccccgcctctcatccttcgggctcccacccccgccgttaggctgcggttcgcgccgcggtcgccagagggcgcggagcggcggggcttcccgcacggagggctttgcgtgaggcaccgcgtggggcggggctgcgggcgggctcccagctgctgggccctcatcggctgggcctcgtcgaccggcaagcggaacgcggcagcggggctgggcctgtgcggcggccgccggagcgctttggaaggcgcacggggcgaagatggcggcggagcgacaggaggcgctgagggagttcgtggcggtgacgggcgccgaggaggaccgggcccgcttctttctcgagtcggccggctgggacttgcagatcgcgctagcgagcttttatgaggacggaggggatgaagacattgtgaccatttcgcaggcaacccccagttcagtgtccagaggcacagcccccagtgataatagagtgacatccttcagagacctcattcatgaccaagatgaagatgaggaggaagaggaaggccagaggttttatgctgggggctcagagagaagtggacagcagattgttggccctcccaggaagaaaagtcccaacgagctggtggatgatctctttaaaggtgccaaagagcatggagctgtagctgtggagcgagtgaccaagagccctggagagaccagtaaaccgagaccatttgcaggaggtggctaccgccttggggcagcaccagaggaagagtctgcctatgtggcaggagaaaagaggcagcattccagccaagatgttcatgtagtattgaaactctggaagagtggattcagcctggataatggagaactcagaagctaccaagacccatccaatgcccagtttctggagtctatccgcagaggggaggtgccagcagagcttcggaggctagctcacggtggacaggtgaacttggatatggaggaccatcgggacgaggactttgtgaagcccaaaggagccttcaaagccttcactggcgagggtcagaaactgggcagcactgccccccaggtgttgagtaccagctctccagcccaacaggcagaaaatgaagccaaagccagctcttccatcttaatcgacgaatcagagcctaccacaaacatccaaattcggcttgcagacggcgggaggctggtgcagaaatttaaccacagccacaggatcagcgacatccgactcttcatcgtggatgcccggccagccatggctgccaccagctttatcctcatgactactttcccgaacaaagagctggctgatgagagccagaccctgaaggaagccaacctgctcaatgctgtcatcgtgcagcggttaacataaccgcccagccagctgcctggcctccctcctgtgtttcccatggccagtggccatgccccatggggatcgcccctcctgcccccttgtgcacacccagcagtccagtgcaacgtctcctccatagctctgggttcttagatcttggttggacgtttgttttctccttagttgcatttcctgggtttttgtgatgatcaatggactttaatgaaaaaaaaaataaaaacaaccaaaaaaattgaaggaatatcaccagcatgttgtacggaaactctcccactgaagcaggctttaattgctttaaaattatatttatcttggggcctgtgggaggaaacttccttccatcttctctgcataaaaacttgtggcacacaatgcttattcactagtgtgtcccacccgccagccccacagatgactggaggaaggaggggaaatgtgtagaaagaggcttcgccaccacttgttcccacgagaatatatcacttgcccagataaaactgggcggcagccagagttccctgaagtgggaagtcagagctacatgcacacagtgtcttcagaaggtgaaaataaatatttccctgtgctccttttactcaacccctggggtatctaatcttgccaggtcttggccagttgagattctgttccacctgcctgcctggccctttcctccattaccatccagactgctcgcctcctggggattctcaggggctccattatggcttgatttactccacgtgcagaagtcttgagtggacctaggaggtaggtgggatattttttttcactaggatacagctcatgccaacccatcctaagtgagttcagaatcagggtatcttgccctataagataaacagtcaaaatgccaccgagctgttcactagtgatgtgtggcaaatcaaatcaactgttgaagaaggggtgagttttctgtgctacaagcacctgtcactgttggtacttgcagcagtccagtgcaacgtctcctccatagctctgggttcttagatcttggttggacgtttgttttctccttagttgcatttcctgggtttttgtgatgatcaatggactttaatgaaaaaaaaaataaaaacaaccaaaaaaattgaannaanannannaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaccggcaaaatttttgccaaaatttgcaaaagaaaaatttttttaaaaaaaaaaaaaaaaaaaaaaaaaaaaaaaaaaaaaaaaaaaaaaaaacttgggttttaaaacaaaaacccctttaaaggaatttggttcaaaagggatttgggtattaaaaaaaaatttttttttgaaaaaacatagggggaatttttaaaaactttaaaaaaaaatttgtaggggggcttttccatttaaaagaaatgggaaaacccaaggttttaaaaaagaaaagggggccccct

SEQ ID NO: 427782 - DNA, 3484 bp, Homo sapiens
tagattaggacccgcgggaaggttgtttaccgtaactaggggtaaggaggtacaaagaacaaggaagttaggctttgaaaatagagaacaaagaacaagtaagctgaacaagtaagttcctctttggagaggcaagagggcaaagaagctgaggacccagaagacaggattgtgcctaagaaagtggccttggagcagaggcccaaagaaagcggggagagcgccttgcccatcggtaagggaaaggtgctccaggcacagaagcagctaatgcaacggccctgaggcaaatgcaagataactggcaagttccaggaacagcaaggagggcaaggcgcctggagcagaggaagctagcggatcccttgatgagagggaggaactggcccatctctcatgggtcctgcaggcaggccatgagactgtcttttatgcggggcgagataacgaggcatggacgtgttgtgagcggaggcctagcctgttcaaggtctgaatttttacccctagaatgtaagaagcatgggagcagggactttgttttgctccctgccatatccacagccctagaaaaacgtcgggccattgatagctctcagtaaatgcttgacaagtaagtgaatgaacgaatgcacaattaatgaaatgagggctgcgtcaatgaataactgggaatctgactcctgcagggagccttcagcccacaggtgtatgtaagacccgccccgcctctcatccttcgggctcccacccccgccgttaggctgcggttcgcgccgcggtcgccagagggcgcggagcggcggggcttcccgcacggagggctttgcgtgaggcaccgcgtggggcggggctgcgggcgggctcccagctgctgggccctcatcggctgggcctcgtcgaccggcaagcggaacgcggcagcggggctgggcctgtgcggcggccgccggagcgctttggaaggcgcacggggcgaagatggcggcggagcgacaggaggcgctgagggagttcgtggcggtgacgggcgccgaggaggaccgggcccgcttctttctcgagtcggccggctgggacttgcagtgataatagagtgacatccttcagagacctcattcatgaccaagatgaagatgaggaggaagaggaaggccagaggtgccaaagagcatggagctgtagctgtggagcgagtgaccaagagccctggagagaccagtaaaccgagaccatttgcaggaggtggctaccgccttggggcagcaccagaggaagagtctgcctatgtggcaggagaaaagaggcagcattccagccaagatgttcatgtagtattgaaactctggaagagtggattcagcctggataatggagaactcagaagctaccaagacccatccaatgcccagtttctggagtctatccgcagaggggaggtgccagcagagcttcggaggctagctcacggtggacaggtgaacttggatatggaggaccatcgggacgaggactttgtgaagcccaaaggagccttcaaagccttcactggcgagggtcagaaactgggcagcactgccccccaggtgttgagtaccagctctccagcccaacaggcagaaaatgaagccaaagccagctcttccatcttaatcgacgaatcagagcctaccacaaacatccaaattcggcttgcagacggcgggaggctggtgcagaaatttaaccacagccacaggatcagcgacatccgactcttcatcgtggatgcccggccagccatggctgccaccagctttatcctcatgactactttcccgaacaaagagctggctgatgagagccagaccctgaaggaagccaacctgctcaatgctgtcatcgtgcagcggttaacataaccgcccagccagctgcctggcctccctcctgtgtttcccatggccagtggccatgccccatggggatcgcccctcctgcccccttgtgcacacccagcagtccagtgcaacgtctcctccatagctctgggttcttagatcttggttggacgtttgttttctccttagttgcatttcctgggtttttgtgatgatcaatggactttaatgaaaaaaaaaataaaaacaaccaaaaaaattgaaggaatatcaccagcatgttgtacggaaactctcccactgaagcaggctttaattgctttaaaattatatttatcttggggcctgtgggaggaaacttccttccatcttctctgcataaaaacttgtggcacacaatgcttattcactagtgtgtcccacccgccagccccacagatgactggaggaaggaggggaaatgtgtagaaagaggcttcgccaccacttgttcccacgagaatatatcacttgcccagataaaactgggcggcagccagagttccctgaagtgggaagtcagagctacatgcacacagtgtcttcagaaggtgaaaataaatatttccctgtgctccttttactcaacccctggggtatctaatcttgccaggtcttggccagttgagattctgttccacctgcctgcctggccctttcctccattaccatccagactgctcgcctcctggggattctcaggggctccattatggcttgatttactccacgtgcagaagtcttgagtggacctaggaggtaggtgggatattttttttcactaggatacagctcatgccaacccatcctaagtgagttcagaatcagggtatcttgccctataagataaacagtcaaaatgccaccgagctgttcactagtgatgtgtggcaaatcaaatcaactgttgaagaaggggtgagttttctgtgctacaagcacctgtcactgttggtacttgcaggaggcttctgctgggtatgttttggaagtgagtgtcactacttggctttgcttagcaggttctgcttcacacttgttctttgacctgctgacttgtgacttgcagaaacataggcagtagtcctagcctggtaaagaccctccaccacccctataagtttgattgctatgcaggtttgggagaggaggcctattgggctcttggatggaaccctttcccgtattaaacaaaccagagacagaatcagtgctgactcaggatctcctggtttggaatcgtaatgtgcctcaatcctctttccaagcaggcctcaccagtctctttctctttcctgcttcacccctgcaatgagccaagaaccaacactacatccacctagaactgcagaagggcttgtggtttcaaccaagacccatcctgagcaagggacttggcttggtgcttttgatcccaaagttcccacaccggcagtggcctgctggggcaatggcatctgtcacggtgttttctccagcaggtggagattatggaacctacatatgggtctggaaaaactgtacactgttgtcaccttgaccattaaaaaccagaatgaggacaa

SEQ ID NO: 427783 - DNA, 3623 bp, Homo sapiens
tagattaggacccgcgggaaggttgtttaccgtaactaggggtaaggaggtacaaagaacaaggaagttaggctttgaaaatagagaacaaagaacaagtaagctgaacaagtaagttcctctttggagaggcaagagggcaaagaagctgaggacccagaagacaggattgtgcctaagaaagtggccttggagcagaggcccaaagaaagcggggagagcgccttgcccatcggtaagggaaaggtgctccaggcacagaagcagctaatgcaacggccctgaggcaaatgcaagataactggcaagttccaggaacagcaaggagggcaaggcgcctggagcagaggaagctagcggatcccttgatgagagggaggaactggcccatctctcatgggtcctgcaggcaggccatgagactgtcttttatgcggggcgagataacgaggcatggacgtgttgtgagcggaggcctagcctgttcaaggtctgaatttttacccctagaatgtaagaagcatgggagcagggactttgttttgctccctgccatatccacagccctagaaaaacgtcgggccattgatagctctcagtaaatgcttgacaagtaagtgaatgaacgaatgcacaattaatgaaatgagggctgcgtcaatgaataactgggaatctgactcctgcagggagccttcagcccacaggtgtatgtaagacccgccccgcctctcatccttcgggctcccacccccgccgttaggctgcggttcgcgccgcggtcgccagagggcgcggagcggcggggcttcccgcacggagggctttgcgtgaggcaccgcgtggggcggggctgcgggcgggctcccagctgctgggccctcatcggctgggcctcgtcgaccggcaagcggaacgcggcagcggggctgggcctgtgcggcggccgccggagcgctttggaaggcgcacggggcgaagatggcggcggagcgacaggaggcgctgagggagttcgtggcggtgacgggcgccgaggaggaccgggcccgcttctttctcgagtcggccggctgggacttgcagatcgcgctagcgagcttttatgaggacggaggggatgaagacattgtgaccatttcgcaggcaacccccagttcagtgtccagaggcacagcccccagtgataatagagtgacatccttcagagacctcattcatgaccaagatgaagatgaggaggaagaggaaggccagaggttttatgctgggggctcagagagaagtggacagcagattgttggccctcccaggaagaaaagtcccaacgagctggtggatgatctctttaaaggtgccaaagagcatggagctgtagctgtggagcgagtgaccaagagccctggagagaccagtaaaccgagaccatttgcaggaggtggctaccgccttggggcagcaccagaggaagagtctgcctatgtggcaggagaaaagaggcagcattccagccaagatgttcatgtagtattgaaactctggaagagtggattcagcctggataatggagaactcagaagctaccaagacccatccaatgcccagtttctggagtctatccgcagaggggaggtgccagcagagcttcggaggctagctcacggtggacaggtgaacttggatatggaggaccatcgggacgaggactttgtgaagcccaaaggagccttcaaagccttcactggcgagggtcagaaactgggcagcactgccccccaggtgttgagtaccagctctccagcccaacaggcagaaaacatccaaattcggcttgcagacggcgggaggctggtgcagaaatttaaccacagccacaggatcagcgacatccgactcttcatcgtggatgcccggccagccatggctgccaccagctttatcctcatgactactttcccgaacaaagagctggctgatgagagccagaccctgaaggaagccaacctgctcaatgctgtcatcgtgcagcggttaacataaccgcccagccagctgcctggcctccctcctgtgtttcccatggccagtggccatgccccatggggatcgcccctcctgcccccttgtgcacacccagcagtccagtgcaacgtctcctccatagctctgggttcttagatcttggttggacgtttgttttctccttagttgcatttcctgggtttttgtgatgatcaatggactttaatgaaaaaaaaaataaaaacaaccaaaaaaattgaaggaatatcaccagcatgttgtacggaaactctcccactgaagcaggctttaattgctttaaaattatatttatcttggggcctgtgggaggaaacttccttccatcttctctgcataaaaacttgtggcacacaatgcttattcactagtgtgtcccacccgccagccccacagatgactggaggaaggaggggaaatgtgtagaaagaggcttcgccaccacttgttcccacgagaatatatcacttgcccagataaaactgggcggcagccagagttccctgaagtgggaagtcagagctacatgcacacagtgtcttcagaaggtgaaaataaatatttccctgtgctccttttactcaacccctggggtatctaatcttgccaggtcttggccagttgagattctgttccacctgcctgcctggccctttcctccattaccatccagactgctcgcctcctggggattctcaggggctccattatggcttgatttactccacgtgcagaagtcttgagtggacctaggaggtaggtgggatattttttttcactaggatacagctcatgccaacccatcctaagtgagttcagaatcagggtatcttgccctataagataaacagtcaaaatgccaccgagctgttcactagtgatgtgtggcaaatcaaatcaactgttgaagaaggggtgagttttctgtgctacaagcacctgtcactgttggtacttgcaggaggcttctgctgggtatgttttggaagtgagtgtcactacttggctttgcttagcaggttctgcttcacacttgttctttgacctgctgacttgtgacttgcagaaacataggcagtagtcctagcctggtaaagaccctccaccacccctataagtttgattgctatgcaggtttgggagaggaggcctattgggctcttggatggaaccctttcccgtattaaacaaaccagagacagaatcagtgctgactcaggatctcctggtttggaatcgtaatgtgcctcaatcctctttccaagcaggcctcaccagtctctttctctttcctgcttcacccctgcaatgagccaagaaccaacactacatccacctagaactgcagaagggcttgtggtttcaaccaagacccatcctgagcaagggacttggcttggtgcttttgatcccaaagttcccacaccggcagtggcctgctggggcaatggcatctgtcacggtgttttctccagcaggtggagattatggaacctacatatgggtctggaaaaactgtacactgttgtcaccttgaccattaaaaaccagaatgaggacaa

SEQ ID NO: 427784 - DNA, 3996 bp, Homo sapiens
tagattaggacccgcgggaaggttgtttaccgtaactaggggtaaggaggtacaaagaacaaggaagttaggctttgaaaatagagaacaaagaacaagtaagctgaacaagtaagttcctctttggagaggcaagagggcaaagaagctgaggacccagaagacaggattgtgcctaagaaagtggccttggagcagaggcccaaagaaagcggggagagcgccttgcccatcggtaagggaaaggtgctccaggcacagaagcagctaatgcaacggccctgaggcaaatgcaagataactggcaagttccaggaacagcaaggagggcaaggcgcctggagcagaggaagctagcggatcccttgatgagagggaggaactggcccatctctcatgggtcctgcaggcaggccatgagactgtcttttatgcggggcgagataacgaggcatggacgtgttgtgagcggaggcctagcctgttcaaggtctgaatttttacccctagaatgtaagaagcatgggagcagggactttgttttgctccctgccatatccacagccctagaaaaacgtcgggccattgatagctctcagtaaatgcttgacaagtaagtgaatgaacgaatgcacaattaatgaaatgagggctgcgtcaatgaataactgggaatctgactcctgcagggagccttcagcccacaggtgtatgtaagacccgccccgcctctcatccttcgggctcccacccccgccgttaggctgcggttcgcgccgcggtcgccagagggcgcggagcggcggggcttcccgcacggagggctttgcgtgaggcaccgcgtggggcggggctgcgggcgggctcccagctgctgggccctcatcggctgggcctcgtcgaccggcaagcggaacgcggcagcggggctgggcctgtgcggcggccgccggagcgctttggaaggcgcacggggcgaagatggcggcggagcgacaggaggcgctgagggagttcgtggcggtgacgggcgccgaggaggaccgggcccgcttctttctcgagtcggccggctgggacttgcagatcgcgctagcgagcttttatgaggacggaggggatgaagacattgtgaccatttcgcaggcaacccccagttcagtgtccagaggcacagcccccagtgataatagagtgacatccttcagagacctcattcatgaccaagatgaagatgaggaggaagaggaaggccagaggttttatgctgggggctcagagagaagtggacagcagattgttggccctcccaggaagaaaagtcccaacgagctggtggatgatctctttaaaggtgccaaagagcatggagctgtagctgtggagcgagtgaccaagagccctggagagaccagtaaaccgagaccatttgcaggaggtggctaccgccttggggcagcaccagaggaagagtctgcctatgtggcaggagaaaagaggcagcattccagccaagatgttcatgtagtattgaaactctggaagagtggattcagcctggataatggagaactcagaagctaccaagacccatccaatgcccagtttctggagtctatccgcagaggggaggtgccagcagagcttcggaggctagctcacggtggacaggtgaacttggatatggaggaccatcgggacgaggactttgtgaagcccaaaggagccttcaaagccttcactggcgagggtcagaaactgggcaggctgtcctgctttcctcccttcaagcccttgttcagttgaagacaccaaggaggaaaaaggccgagtaacttgcccacattactcaggagcggtggagctagcaataacgtatgaaatatatgactcagggtttgaagtgaattctgctggacctgtaagttccataagggcacgattttccctgtctgggtcaatagatcagcagcaccaaacaatgccaggcgcattgcaaatgctcagtaacagtccaagaagggattcccttcttgctaggggccttgtttctgcttgtgttctgatgccatcctctctcctcagcactgccccccaggtgttgagtaccagctctccagcccaacaggcagaaaatgaagccaaagccagctcttccatcttaatcgacgaatcagagcctaccacaaacatccaaattcggcttgcagacggcgggaggctggtgcagaaatttaaccacagccacaggatcagcgacatccgactcttcatcgtggatgcccggccagccatggctgccaccagctttatcctcatgactactttcccgaacaaagagctggctgatgagagccagaccctgaaggaagccaacctgctcaatgctgtcatcgtgcagcggttaacataaccgcccagccagctgcctggcctccctcctgtgtttcccatggccagtggccatgccccatggggatcgcccctcctgcccccttgtgcacacccagcagtccagtgcaacgtctcctccatagctctgggttcttagatcttggttggacgtttgttttctccttagttgcatttcctgggtttttgtgatgatcaatggactttaatgaaaaaaaaaataaaaacaaccaaaaaaattgaaggaatatcaccagcatgttgtacggaaactctcccactgaagcaggctttaattgctttaaaattatatttatcttggggcctgtgggaggaaacttccttccatcttctctgcataaaaacttgtggcacacaatgcttattcactagtgtgtcccacccgccagccccacagatgactggaggaaggaggggaaatgtgtagaaagaggcttcgccaccacttgttcccacgagaatatatcacttgcccagataaaactgggcggcagccagagttccctgaagtgggaagtcagagctacatgcacacagtgtcttcagaaggtgaaaataaatatttccctgtgctccttttactcaacccctggggtatctaatcttgccaggtcttggccagttgagattctgttccacctgcctgcctggccctttcctccattaccatccagactgctcgcctcctggggattctcaggggctccattatggcttgatttactccacgtgcagaagtcttgagtggacctaggaggtaggtgggatattttttttcactaggatacagctcatgccaacccatcctaagtgagttcagaatcagggtatcttgccctataagataaacagtcaaaatgccaccgagctgttcactagtgatgtgtggcaaatcaaatcaactgttgaagaaggggtgagttttctgtgctacaagcacctgtcactgttggtacttgcaggaggcttctgctgggtatgttttggaagtgagtgtcactacttggctttgcttagcaggttctgcttcacacttgttctttgacctgctgacttgtgacttgcagaaacataggcagtagtcctagcctggtaaagaccctccaccacccctataagtttgattgctatgcaggtttgggagaggaggcctattgggctcttggatggaaccctttcccgtattaaacaaaccagagacagaatcagtgctgactcaggatctcctggtttggaatcgtaatgtgcctcaatcctctttccaagcaggcctcaccagtctctttctctttcctgcttcacccctgcaatgagccaagaaccaacactacatccacctagaactgcagaagggcttgtggtttcaaccaagacccatcctgagcaagggacttggcttggtgcttttgatcccaaagttcccacaccggcagtggcctgctggggcaatggcatctgtcacggtgttttctccagcaggtggagattatggaacctacatatgggtctggaaaaactgtacactgttgtcaccttgaccattaaaaaccagaatgaggacaa

SEQ ID NO: 427785 - DNA, 3650 bp, Homo sapiens
tagattaggacccgcgggaaggttgtttaccgtaactaggggtaaggaggtacaaagaacaaggaagttaggctttgaaaatagagaacaaagaacaagtaagctgaacaagtaagttcctctttggagaggcaagagggcaaagaagctgaggacccagaagacaggattgtgcctaagaaagtggccttggagcagaggcccaaagaaagcggggagagcgccttgcccatcggtaagggaaaggtgctccaggcacagaagcagctaatgcaacggccctgaggcaaatgcaagataactggcaagttccaggaacagcaaggagggcaaggcgcctggagcagaggaagctagcggatcccttgatgagagggaggaactggcccatctctcatgggtcctgcaggcaggccatgagactgtcttttatgcggggcgagataacgaggcatggacgtgttgtgagcggaggcctagcctgttcaaggtctgaatttttacccctagaatgtaagaagcatgggagcagggactttgttttgctccctgccatatccacagccctagaaaaacgtcgggccattgatagctctcagtaaatgcttgacaagtaagtgaatgaacgaatgcacaattaatgaaatgagggctgcgtcaatgaataactgggaatctgactcctgcagggagccttcagcccacaggtgtatgtaagacccgccccgcctctcatccttcgggctcccacccccgccgttaggctgcggttcgcgccgcggtcgccagagggcgcggagcggcggggcttcccgcacggagggctttgcgtgaggcaccgcgtggggcggggctgcgggcgggctcccagctgctgggccctcatcggctgggcctcgtcgaccggcaagcggaacgcggcagcggggctgggcctgtgcggcggccgccggagcgctttggaaggcgcacggggcgaagatggcggcggagcgacaggaggcgctgagggagttcgtggcggtgacgggcgccgaggaggaccgggcccgcttctttctcgagtcggccggctgggacttgcagatcgcgctagcgagcttttatgaggacggaggggatgaagacattgtgaccatttcgcaggcaacccccagttcagtgtccagaggcacagcccccagtgataatagagtgacatccttcagagacctcattcatgaccaagatgaagatgaggaggaagaggaaggccagaggttttatgctgggggctcagagagaagtggacagcagattgttggccctcccaggaagaaaagtcccaacgagctggtggatgatctctttaaaggtgccaaagagcatggagctgtagctgtggagcgagtgaccaagagccctggagagaccagtaaaccgagaccatttgcaggaggtggctaccgccttggggcagcaccagaggaagagtctgcctatgtggcaggagaaaagaggcagcattccagccaagatagtggattcagcctggataatggagaactcagaagctaccaagacccatccaatgcccagtttctggagtctatccgcagaggggaggtgccagcagagcttcggaggctagctcacggtggacaggtgaacttggatatggaggaccatcgggacgaggactttgtgaagcccaaaggagccttcaaagccttcactggcgagggtcagaaactgggcagcactgccccccaggtgttgagtaccagctctccagcccaacaggcagaaaatgaagccaaagccagctcttccatcttaatcgacgaatcagagcctaccacaaacatccaaattcggcttgcagacggcgggaggctggtgcagaaatttaaccacagccacaggatcagcgacatccgactcttcatcgtggatgcccggccagccatggctgccaccagctttatcctcatgactactttcccgaacaaagagctggctgatgagagccagaccctgaaggaagccaacctgctcaatgctgtcatcgtgcagcggttaacataaccgcccagccagctgcctggcctccctcctgtgtttcccatggccagtggccatgccccatggggatcgcccctcctgcccccttgtgcacacccagcagtccagtgcaacgtctcctccatagctctgggttcttagatcttggttggacgtttgttttctccttagttgcatttcctgggtttttgtgatgatcaatggactttaatgaaaaaaaaaataaaaacaaccaaaaaaattgaaggaatatcaccagcatgttgtacggaaactctcccactgaagcaggctttaattgctttaaaattatatttatcttggggcctgtgggaggaaacttccttccatcttctctgcataaaaacttgtggcacacaatgcttattcactagtgtgtcccacccgccagccccacagatgactggaggaaggaggggaaatgtgtagaaagaggcttcgccaccacttgttcccacgagaatatatcacttgcccagataaaactgggcggcagccagagttccctgaagtgggaagtcagagctacatgcacacagtgtcttcagaaggtgaaaataaatatttccctgtgctccttttactcaacccctggggtatctaatcttgccaggtcttggccagttgagattctgttccacctgcctgcctggccctttcctccattaccatccagactgctcgcctcctggggattctcaggggctccattatggcttgatttactccacgtgcagaagtcttgagtggacctaggaggtaggtgggatattttttttcactaggatacagctcatgccaacccatcctaagtgagttcagaatcagggtatcttgccctataagataaacagtcaaaatgccaccgagctgttcactagtgatgtgtggcaaatcaaatcaactgttgaagaaggggtgagttttctgtgctacaagcacctgtcactgttggtacttgcaggaggcttctgctgggtatgttttggaagtgagtgtcactacttggctttgcttagcaggttctgcttcacacttgttctttgacctgctgacttgtgacttgcagaaacataggcagtagtcctagcctggtaaagaccctccaccacccctataagtttgattgctatgcaggtttgggagaggaggcctattgggctcttggatggaaccctttcccgtattaaacaaaccagagacagaatcagtgctgactcaggatctcctggtttggaatcgtaatgtgcctcaatcctctttccaagcaggcctcaccagtctctttctctttcctgcttcacccctgcaatgagccaagaaccaacactacatccacctagaactgcagaagggcttgtggtttcaaccaagacccatcctgagcaagggacttggcttggtgcttttgatcccaaagttcccacaccggcagtggcctgctggggcaatggcatctgtcacggtgttttctccagcaggtggagattatggaacctacatatgggtctggaaaaactgtacactgttgtcaccttgaccattaaaaaccagaatgaggacaa

SEQ ID NO: 427786 - DNA, 2904 bp, Homo sapiens
tagattaggacccgcgggaaggttgtttaccgtaactaggggtaaggaggtacaaagaacaaggaagttaggctttgaaaatagagaacaaagaacaagtaagctgaacaagtaagttcctctttggagaggcaagagggcaaagaagctgaggacccagaagacaggattgtgcctaagaaagtggccttggagcagaggcccaaagaaagcggggagagcgccttgcccatcggtaagggaaaggtgctccaggcacagaagcagctaatgcaacggccctgaggcaaatgcaagataactggcaagttccaggaacagcaaggagggcaaggcgcctggagcagaggaagctagcggatcccttgatgagagggaggaactggcccatctctcatgggtcctgcaggcaggccatgagactgtcttttatgcggggcgagataacgaggcatggacgtgttgtgagcggaggcctagcctgttcaaggtctgaatttttacccctagaatgtaagaagcatgggagcagggactttgttttgctccctgccatatccacagccctagaaaaacgtcgggccattgatagctctcagtaaatgcttgacaagtaagtgaatgaacgaatgcacaattaatgaaatgagggctgcgtcaatgaataactgggaatctgactcctgcagggagccttcagcccacaggtgtatgtaagacccgccccgcctctcatccttcgggctcccacccccgccgttaggctgcggttcgcgccgcggtcgccagagggcgcggagcggcggggcttcccgcacggagggctttgcgtgaggcaccgcgtggggcggggctgcgggcgggctcccagctgctgggccctcatcggctgggcctcgtcgaccggcaagcggaacgcggcagcggggctgggcctgtgcggcggccgccggagcgctttggaaggcgcacggggcgaagatggcggcggagcgacaggaggcgctgagggagttccagctctccagcccaacaggcagaaaatgaagccaaagccagctcttccatcttaatcgacgaatcagagcctaccacaaacatccaaattcggcttgcagacggcgggaggctggtgcagaaatttaaccacagccacaggatcagcgacatccgactcttcatcgtggatgcccggccagccatggctgccaccagctttatcctcatgactactttcccgaacaaagagctggctgatgagagccagaccctgaaggaagccaacctgctcaatgctgtcatcgtgcagcggttaacataaccgcccagccagctgcctggcctccctcctgtgtttcccatggccagtggccatgccccatggggatcgcccctcctgcccccttgtgcacacccagcagtccagtgcaacgtctcctccatagctctgggttcttagatcttggttggacgtttgttttctccttagttgcatttcctgggtttttgtgatgatcaatggactttaatgaaaaaaaaaataaaaacaaccaaaaaaattgaaggaatatcaccagcatgttgtacggaaactctcccactgaagcaggctttaattgctttaaaattatatttatcttggggcctgtgggaggaaacttccttccatcttctctgcataaaaacttgtggcacacaatgcttattcactagtgtgtcccacccgccagccccacagatgactggaggaaggaggggaaatgtgtagaaagaggcttcgccaccacttgttcccacgagaatatatcacttgcccagataaaactgggcggcagccagagttccctgaagtgggaagtcagagctacatgcacacagtgtcttcagaaggtgaaaataaatatttccctgtgctccttttactcaacccctggggtatctaatcttgccaggtcttggccagttgagattctgttccacctgcctgcctggccctttcctccattaccatccagactgctcgcctcctggggattctcaggggctccattatggcttgatttactccacgtgcagaagtcttgagtggacctaggaggtaggtgggatattttttttcactaggatacagctcatgccaacccatcctaagtgagttcagaatcagggtatcttgccctataagataaacagtcaaaatgccaccgagctgttcactagtgatgtgtggcaaatcaaatcaactgttgaagaaggggtgagttttctgtgctacaagcacctgtcactgttggtacttgcaggaggcttctgctgggtatgttttggaagtgagtgtcactacttggctttgcttagcaggttctgcttcacacttgttctttgacctgctgacttgtgacttgcagaaacataggcagtagtcctagcctggtaaagaccctccaccacccctataagtttgattgctatgcaggtttgggagaggaggcctattgggctcttggatggaaccctttcccgtattaaacaaaccagagacagaatcagtgctgactcaggatctcctggtttggaatcgtaatgtgcctcaatcctctttccaagcaggcctcaccagtctctttctctttcctgcttcacccctgcaatgagccaagaaccaacactacatccacctagaactgcagaagggcttgtggtttcaaccaagacccatcctgagcaagggacttggcttggtgcttttgatcccaaagttcccacaccggcagtggcctgctggggcaatggcatctgtcacggtgttttctccagcaggtggagattatggaacctacatatgggtctggaaaaactgtacactgttgtcaccttgaccattaaaaaccagaatgaggacaa

SEQ ID NO: 427787 - DNA, 2538 bp, Homo sapiens
gaacaagaatgaacgccagcctcatttcatgggttttggttctccacaggatctgcctcggtctgtcagacattcctaaggaaaattgtataataactatttcgggaatgcagttatctcatcatggtcagtctttggggaagtgggctgagaaattacatgtgttctattctctattttcattcctattgtgaccttcacaccgactcaaaaccttccttttagatacttctggatataaaaatatatgttaattttggggtttcacactcctgagtgaaaggcagtgtcatcaagtacgtgaatgcccagctcctaaatgtctttctcgttctcctcccacccagtcacgtcctccaggcagtgaccttcctttatttcacattccgcttacttccttgacccctcagcatttcagacctgaaaggacactggtactgttgtccttgtcggggcctgtggctttgcctctcattccctggtgaatgtcaggaaatagagggctgagactaatttttataggttctcaatttttcttgcttggggacaagctgttgacttagctctgaataggagtaataaggaggcagtgggccaggctgcatgacaactggttttcaggcccatataaaaaagtactaactttattatctcaagccatgcctggcctattgcaaagcccagtgtgggtgtcttggggcttgtatttgagattggagcttctctgacctccagtaccctttcctcaggggccacagtgtgtgtcacatgaatggcaaggttttatgctgggggctcagagagaagtggacagcagattgttggccctcccaggaagaaaagtcccaacgagctggtggatgatctctttaaaggtgccaaagagcatggagctgtagctgtggagcgagtgaccaagagccctggagagaccagtaaaccgagaccatttgcaggaggtggctaccgccttggggcagcaccagaggaagagtctgcctatgtggcaggagaaaagaggcagcattccagccaagattgtgcacacccagcagtccagtgcaacgtctcctccatagctctgggttcttagatcttggttggacgtttgttttctccttagttgcatttcctgggtttttgtgatgatcaatggactttaatgaaaaaaaaaataaaaacaaccaaaaaaattgaaggaatatcaccagcatgttgtacggaaactctcccactgaagcaggctttaattgctttaaaattatatttatcttggggcctgtgggaggaaacttccttccatcttctctgcataaaaacttgtggcacacaatgcttattcactagtgtgtcccacccgccagccccacagatgactggaggaaggaggggaaatgtgtagaaagaggcttcgccaccacttgttcccacgagaatatatcacttgcccagataaaactgggcggcagccagagttccctgaagtgggaagtcagagctacatgcacacagtgtcttcagaaggtgaaaataaatatttccctgtgctccttttactcaacccctggggtatctaatcttgccaggtcttggccagttgagattctgttccacctgcctgcctggccctttcctccattaccatccagactgctcgcctcctggggattctcaggggctccattatggcttgatttactccacgtgcagaagtcttgagtggacctaggaggtaggtgggatattttttttcactaggatacagctcatgccaacccatcctaagtgagttcagaatcagggtatcttgccctataagataaacagtcaaaatgccaccgagctgttcactagtgatgtgtggcaaatcaaatcaactgttgaagaaggggtgagttttctgtgctacaagcacctgtcactgttggtacttgcaggaggcttctgctgggtatgttttggaagtgagtgtcactacttggctttgcttagcaggttctgcttcacacttgttctttgacctgctgacttgtgacttgcagaaacataggcagtagtcctagcctggtaaagaccctccaccacccctataagtttgattgctatgcaggtttgggagaggaggcctattgggctcttggatggaaccctttcccgtattaaacaaaccagagacagaatcagtgctgactcaggatctcctggtttggaatcgtaatgtgcctcaatcctctttccaagcaggcctcaccagtctctttctctttcctgcttcacccctgcaatgagccaagaaccaacactacatccacctagaactgcagaagggcttgtggtttcaaccaagacccatcctgagcaagggacttggcttggtgcttttgatcccaaagttcccacaccggcagtggcctgctggggcaatggcatctgtcacggtgttttctccagcaggtggagattatggaacctacatatgggtctggaaaaactgtacactgttgtcaccttgaccattaaaaaccagaatgaggacaa

SEQ ID NO: 427788 - DNA, 2214 bp, Homo sapiens
tagattaggacccgcgggaaggttgtttaccgtaactaggggtaaggaggtacaaagaacaaggaagttaggctttgaaaatagagaacaaagaacaagtaagctgaacaagtaagttcctctttggagaggcaagagggcaaagaagctgaggacccagaagacaggattgtgcctaagaaagtggccttggagcagaggcccaaagaaagcggggagagcgccttgcccatcggtaagggaaaggtgctccaggcacagaagcagctaatgcaacggccctgaggcaaatgcaagataactggcaagttccaggaacagcaaggagggcaaggcgcctggagcagaggaagctagcggatcccttgatgagagggaggaactggcccatctctcatgggtcctgcaggcaggccatgagactgtcttttatgcggggcgagataacgaggcatggacgtgttgtgagcggaggcctagcctgttcaaggtctgaatttttacccctagaatgtaagaagcatgggagcagggactttgttttgctccctgccatatccacagccctagaaaaacgtcgggccattgatagctctcagtaaatgcttgacaagtaagtgaatgaacgaatgcacaattaatgaaatgagggctgcgtcaatgaataactgggaatctgactcctgcagggagccttcagcccacaggtgtatgtaagacccgccccgcctctcatccttcgggctcccacccccgccgttaggctgcggttcgcgccgcggtcgccagagggcgcggagcggcggggcttcccgcacggagggctttgcgtgaggcaccgcgtggggcggggctgcgggcgggctcccagctgctgggccctcatcggctgggcctcgtcgaccggcaagcggaacgcggcagcggggctgggcctgtgcggcggccgccggagcgctttggaaggcgcacggggcgaagatggcggcggagcgacaggaggcgctgagggagttcgtggcggtgacgggcgccgaggaggaccgggcccgcttctttctcgagtcggccggctgggacttgcagatcgcgctagcgagcttttatgaggacggaggggatgaagacattgtgaccatttcgcaccagagttccctgaagtgggaagtcagagctacatgcacacagtgtcttcagaaggtgaaaataaatatttccctgtgctccttttactcaacccctggggtatctaatcttgccaggtcttggccagttgagattctgttccacctgcctgcctggccctttcctccattaccatccagactgctcgcctcctggggattctcaggggctccattatggcttgatttactccacgtgcagaagtcttgagtggacctaggaggtaggtgggatattttttttcactaggatacagctcatgccaacccatcctaagtgagttcagaatcagggtatcttgccctataagataaacagtcaaaatgccaccgagctgttcactagtgatgtgtggcaaatcaaatcaactgttgaagaaggggtgagttttctgtgctacaagcacctgtcactgttggtacttgcaggaggcttctgctgggtatgttttggaagtgagtgtcactacttggctttgcttagcaggttctgcttcacacttgttctttgacctgctgacttgtgacttgcagaaacataggcagtagtcctagcctggtaaagaccctccaccacccctataagtttgattgctatgcaggtttgggagaggaggcctattgggctcttggatggaaccctttcccgtattaaacaaaccagagacagaatcagtgctgactcaggatctcctggtttggaatcgtaatgtgcctcaatcctctttccaagcaggcctcaccagtctctttctctttcctgcttcacccctgcaatgagccaagaaccaacactacatccacctagaactgcagaagggcttgtggtttcaaccaagacccatcctgagcaagggacttggcttggtgcttttgatcccaaagttcccacaccggcagtggcctgctggggcaatggcatctgtcacggtgttttctccagcaggtggagattatggaacctacatatgggtctggaaaaactgtacactgttgtcaccttgaccattaaaaaccagaatgaggacaa

SEQ ID NO: 427789 - DNA, 2043 bp, Homo sapiens
tgcactgtctggtcaagagcagtgtccatgtgcgtttctgtggcagcagtgcacgtggggtgggtggggggtgcgtacggtggggcttgtaggttaagatgtctctgcggtggtgttgtggggctggaggccgagccaggcacggcagctggccctctccaggcgcatggaggaattctccctttgccgttccaaggatgccgccgcctcctaccggggctcccgggggggtcagccaacactacaaagggcagcgagtcctcagggcgcccgggagccaccagtctgctctcgggctctactcagactagcgccaacagtctccgcggacagactcgcatcagccgccctggggctcggcctcctcccataggctcctcttcctctctttcattcaagtcttcaaactttgaaaaaaatatgagcttttgccaaataagacgggatagtttatggagttttctgaggcgcattgaactctggtcagcccctcgagcgtgggctcggccatcagcaggcccggtgggttggccgggctggccctcccaggctgcctttctctctggtcgcggcctggcccgccccggcctccaccgccgcaattcatgctggtgccgcgcccgcagccccactcctggtatgcctgagattctccaggggccaagccggtcctccttcccggcccactcttccagggccaggacgctcccgcggagccagcccatcgtggctgggggtcccaggggctggaggcctgcctggttagcctctgtttcccagacattgactcgaggcgcctccagtcctctcaaccccctgactttcaagtcctttcaagtccttgtgccctgaccaagttatgaggaaaagagggctgagggcctggaggtgggctcgcaccccctcgaacccacctagatgtctcctcctccccagcctatgagttcagacttggggggctccatctgtccctccctgaggtccctcatcttgtccctgctctgattctgtcagcagatcctgaacactccttggtggggacccatgcctccaaggctgcccccaatgccagctgtcctggggaaactccccagaactctcggggaaaggcccgagaaccttcggaggaagcctccgggactcctcgccacctgctctgtttctctcccggccccactgccttcaggtatcaggaagagggcaggcccctgtgccccctctccccttcccagggcggccaacaatactccaccatggggcgcttcctttcttctctggaaactaagacattggactgaaggaactggcctgaggggggctgaccgggggcccgtgctgctgggagctctacgcacaagaggccgccggggtcacggacaggaacctcagcccagggtgctggcctttctccttcgcaggagtcccccaaaatccacacagcgactcgagcagcccttcctgccgtttccaaggcctccggaagcaccaacccagttctcagttacctcctctggccggaaggcctcacgttgtcctccagagctgctctgggcccagggctggctccgtgaccacctgatggacgtgctgggcagcatgggctcccaaggcagcatccccagctgctctcccaccccaccccagctgcccggcggctgggcccacgagggctctggggacacttccataggaaaggggcctggcactttgtgattgccacgtgtttcctgttaagccgcctgcccccagtgcaaatctctgtgttttgctctctcctgaacaaaaatgtaaaccgacgccggaaagcaaatggtatcgaatacctttcttgcccataagggtttttacaaagaacgtgtctcactaggaactaggacactcatcggcccgagaccaactcctggataaaaggaataaggagaatcgtgtttgtaacgagttacaggattgtttctttcctggattttaaacttttgttaaattgtgaaattatggaggagttttatagaaaaaaaaagtgaaataaagtcagatgggaaagca

SEQ ID NO: 427790 - DNA, 2103 bp, Homo sapiens
tgcactgtctggtcaagagcagtgtccatgtgcgtttctgtggcagcagtgcacgtggggtgggtggggggtgcgtacggtggggcttgtaggttaagatgtctctgcggtggtgttgtggggctggaggccgagccaggcacggcagctggccctctccaggcgcatggaggaattctccctttgccgttccaaggatgccgccgcctcctaccggggctcccgggggggtcagccaacactacaaagggcagcgagtcctcagggcgcccgggagccaccagtctgctctcgggctctactcagactagcgccaacagtctccgcggacagactcgcatcagccgccctggggctcggcctcctcccataggctcctcttcctctctttcattcaagtcttcaaactttgaaaaaaatatgagcttttgccaaataagacgggatagtttatggagttttctgaggcgcattgaactctggtcagcccctcgagcgtgggctcggccatcagcaggcccggtgggttggccgggctggccctcccaggctgcctttctctctggtcgcggcctggcccgccccggcctccaccgccgcaattcatgctggtgccgcgcccgcagccccactcctggtatgcctgagattctccaggggccaagccggtcctccttcccggcccactcttccagggccaggacgctcccgcggagccagcccatcgtggctgggggtcccaggggctggaggcctgcctggttagcctctgtttcccagacattgactcgaggcgcctccagtcctctcaaccccctgactttcaagtcctttcaagtccttgtgccctgaccaagttatgaggaaaagagggctgagggcctggaggtgggctcgcaccccctcgaacccacctagatgtctcctcctccccagcctatgagttcagacttggggggctccatctgtccctccctgaggtccctcatcttgtccctgctctgattctgtcagcagatcctgaacactccttggtggggacccatgcctccaaggctgcccccaatgccagctgtcctggggaaactccccagaactctcggggaaaggcccgagaaccttcggaggaagcctccgggactcctcgccacctgctctgtttctctcccggccccactgccttcaggtatcaggaagagggcaggcccctgtgccccctctccccttcccagggcggccaacaatactccaccatggggcgcttcctttcttctctggaaactaagacattggactgaaggaactggcctgaggggggctgaccgggggcccgtgctgctgggagctctacgcacaagaggccgccggggtcacggacaggaacctcagcccagggtgctggcctttctccttcgcaggagtcccccaaaatccacacagcgactcgagcagccttccactcagccagaggagggtcgggctcccccgcctgctctcggtggtggcgtctggcccttcctgccgtttccaaggcctccggaagcaccaacccagttctcagttacctcctctggccggaaggcctcacgttgtcctccagagctgctctgggcccagggctggctccgtgaccacctgatggacgtgctgggcagcatgggctcccaaggcagcatccccagctgctctcccaccccaccccagctgcccggcggctgggcccacgagggctctggggacacttccataggaaaggggcctggcactttgtgattgccacgtgtttcctgttaagccgcctgcccccagtgcaaatctctgtgttttgctctctcctgaacaaaaatgtaaaccgacgccggaaagcaaatggtatcgaatacctttcttgcccataagggtttttacaaagaacgtgtctcactaggaactaggacactcatcggcccgagaccaactcctggataaaaggaataaggagaatcgtgtttgtaacgagttacaggattgtttctttcctggattttaaacttttgttaaattgtgaaattatggaggagttttatagaaaaaaaaagtgaaataaagtcagatgggaaagca

SEQ ID NO: 427791 - DNA, 2604 bp, Homo sapiens
  misc_feature (2430)..(2430): n is a, c, g, or t
tgcactgtctggtcaagagcagtgtccatgtgcgtttctgtggcagcagtgcacgtggggtgggtggggggtgcgtacggtggggcttgtaggttaagatgtctctgcggtggtgttgtggggctggaggccgagccaggcacggcagctggccctctccaggcgcatggaggaattctccctttgccgttccaaggatgccgccgcctcctaccggggctcccgggggggtcagccaacactacaaagggcagcgagtcctcagggcgcccgggagccaccagtctgctctcgggctctactcagactagcgccaacagtctccgcggacagactcgcatcagccgccctggggctcggcctcctcccataggctcctcttcctctctttcattcaagtcttcaaactttgaaaaaaatatgagcttttgccaaataagacgggatagtttatggagttttctgaggcgcattgaactctggtcagcccctcgagcgtgggctcggccatcagcaggcccggtgggttggccgggctggccctcccaggctgcctttctctctggtcgcggcctggcccgccccggcctccaccgccgcaattcatgctggtgccgcgcccgcagccccactcctggtatgcctgagattctccaggggccaagccggtcctccttcccggcccactcttccagggccaggacgctcccgcggagccagcccatcgtggctgggggtcccaggggctggaggcctgcctggttagcctctgtttcccagacattgactcgaggcgcctccagtcctctcaaccccctgactttcaagtcctttcaagtccttgtgccctgaccaagttatgaggaaaagagggctgagggcctggaggtgggctcgcaccccctcgaacccacctagatgtctcctcctccccagcctatgagttcagacttggggggctccatctgtccctccctgaggtccctcatcttgtccctgctctgattctgtcagcagatcctgaacactccttggtggggacccatgcctccaaggctgcccccaatgccagctgtcctggggaaactccccagaactctcggggaaaggcccgagaaccttcggaggaagcctccgggactcctcgccacctgctctgtttctctcccggccccactgccttcaggtatcaggaagagggcaggcccctgtgccccctctccccttcccagggcggccaacaatactccaccatggggcgcttcctttcttctctggaaactaagacattggactgaaggaactggcctgaggggggctgaccgggggcccgtgctgctgggagctctacgcacaagaggccgccggggtcacggacaggaacctcagcccagggtgctggcctttctccttcgcaggagtcccccaaaatccacacagcgactcgagcagccttccactcagccagaggagggtcgggctcccccgcctgctctcggtggtggcgtctggcccttcctgccgtttccaaggcctccggaagcaccaacccagttctcagttacctcctctggccggaaggcctcacgttgtcctccagagctgctctgggcccagggctggctccgtgaccacctgatggacgtgctgggcagcatgggctcccaaggcagcatccccagctgctctcccaccccaccccagctgcccggcggctgggcccacgagggctctggggacacttccataggaaaggggcctggcactttgtgattgccacgtgtttcctgttaagccgcctgcccccagtgcaaatctctgtgttttgctctctcctgaacaaaaatgtaaaccgacgccggaaagcaaatggtatcgaatacctttcttgcccataagggtttttacaaagaacgtgtctcactaggaactaggacactcatcggcccgagaccaactcctggataaaaggaataaggagaatcgtgtttgtaacgagttacaggattgtttctttcctggattttaaacttttgttaaattgtgaaattatggaggagttttatagaaaaaaaaagtgaaataaagtcagatgggaaagcaaaaaaaaaaaaaaaaaaaaaaaaaaaaaaaaaaaaaaaaaaaaaaaaaaaaaaaaaagcgggcggggcacgacaataaaaaatccccgcgggggcgccgccgaaatcaaccgacacgacgcctattgtgaacaacgagcaggggccccaacaagggggagcagctaaataaaaagcacagaacgagcacgaccccccccatcattatacacacaacgctagatagagatgggaaacaaaccgccgtcaagccagtgcaacatctttgggaggaagagcgaacaccccacacactggtgcgggtgggtgagcacccaattgaaggggngcaacacaccatccccacagaagagagagttaatcgacccccccggaagggagaagacacaacaacacacaccgcgtggtagataaagggtggatacacacacacagcagccaaaatgatccgagcatgaagaagaattgatgcgactaccactagcattatattgaacgacaa

SEQ ID NO: 427792 - DNA, 2297 bp, Homo sapiens
cgcgggatctcgagctgggatcgccctcctgggcttcggtgcgatcggcggcgggaggttccctgggaaccaggtggtcgaagggctgagctgtgtggccagacaagaggtccctgccctcccccagtgagccctgctgttcccgtgggagccatgaagctgaacgagaggagtgtagcccactatgcactcagcgactccccagcggaccacatgggcttcctgcgcacctgggggggcccagggaccccaccgacccccagtggcactggccgaagatgctggtttgtcctcaagggcaacctgctattctcctttgagagtcgcgagggccgggccccactgagcctggtggtgctggaaggctgcacagtggaactggccgaggctcccgtgcccgaggagtttgcctttgccatctgctttgatgcccctggagtgcgcccacacctgctggccgcagaagggccggcggcccaggaggcctgggtgaaggtgctgtcccgggcaagctttggctacatgcgcctggtggtacgcgagttggagagccagttgcaggacgcacgccagagcctggctttgcaacgccgctcatcctggaagtctgttgccagccgctgtaagccccaggctcctaaccaccgagctgcgggcctggagaatggccactgcctctccaaggacagcagccctgtgggcttggttgaagaagcgggcagcaggtctgcagggtgggggttggctgagtgggagctgcagggccctgccagcctcctcctaggcaaggggcagagccctgtgtcccctgagacctcctgcttctctaccctgcatgactggtatggccaggagatcgtggagctgcggcagtgttggcagaagagggcccaggggagccactcaaaatgtgaggaacaggataggccctaagtctgggccctttgagtcaggaaaccagggccagttctttttcaggagttaaatgtttacccatttccaaggttgcgttttgggaggggacatgggttctctccttcctgctatttaggcattctccaggttcgagatccacccgtgtgtctggaagggactgcgggaccattccttccatcctctttatttcctgaggtccagagaaggaaggagacttagcagccacagagcaagaccccaatctcctgactgcactggcctgactgccccctcccaggggatgttaatgaaatgaaggaagtggggaatgtcacccgagactgtcacaggcttgccatacctttggcctacacaccgggctctagagccataatttccaacctggggagtctcctgtgcacttaaatccgaggtaggctgcagtatcggcttgaagctctgacactgtcagagaaagtggatttattgtgtcataggagtttctgggacccagctcttcctgagaggggtgggaagattggggatgggatcctcactcagcagtctgggtagggccctttgaggcagagggtcttcggccagtgaagagagatttattctgctcagagtgctggggtcccatcctttctccctggctgccctgttaacagatggtgctggaccttgccccggaaggtcttgtagcttttttacgtcaacgaaatgccctcctgtactctgtcttcagcagccaactcctggagctgccaagtgaggggttaaagaagaggtggggaggcagtgtggctccctgggaaaagtctgttgctttggttctcagtcctgggtattctaggagcttggacacgggattgcgtttcctgtgctaaaattctctctcctggctgggctccggtaaactgaagctgctcgagaaatcacctgggaactctcatagccgtttgtcacccagggtgtacttgccaggacctctccttgctactcttcccaaagtcgggaggcaaagcggctgggtcaccagagcctgaccatactgacgctccagggggaagacgcagaggccgggaagagacaccccctcccaaacacataaaacttgccccttcctagcctcggctcccctcactggggccttgggcaggaccgacccgcatccaactaggcctaaggggtaggctctgagcctcttacccctaagaggcggagatgcgcccaaggcgggcgcccggcctgttccccagccctgcctggaagccccgcagccactgcattttgtttaaacacagatagcacgggcctttctcttattgctacagtgttttgtacacggttaaaacactagtaaagctttttcgttatta

SEQ ID NO: 427793 - DNA, 1219 bp, Homo sapiens
ttggattggattggattggattggattggattggtggattggattggattggattggattggattggattggtggattggattggattggattggattggattggattggtggattggattggattggattggattggattggattggtggattggattggattggattggattggattggattggtggattggattggattggattggattggattggattggtggattggattggattggattggattggattggattggtggattggattggattggattggattggattggattggtggattggattggattggattggattggattggattggtggattggattggattggattggattggattggattggtggattggattggattggattggattggattggattggtggattggattggattggattggattggattggattggtggattggattggattggattggattggattggattggtggattggattggattggattggattggattggattggtggattggattggattggattggattggattggattggtggattggattggattggattggattggattggattggtggattggattggattggattggattggattggattggtggattggattggattggattggattggattggattggtggattggattggattggattggatgggattgcgtttcctgtgctaaaattctctctcctggctgggctccggtaaactgaagctgctcgagaaatcacctgggaactctcatagccgtttgtcacccagggtgtacttgccaggacctctccttgctactcttcccaaagtcgggaggcaaagcggctgggtcaccagagcctgaccatactgacgctccagggggaagacgcagaggccgggaagagacaccccctcccaaacacataaaacttgccccttcctagcctcggctcccctcactggggccttgggcaggaccgacccgcatccaactaggcctaaggggtaggctctgagcctcttacccctaagaggcggagatgcgcccaaggcgggcgcccggcctgttccccagccctgcctggaagccccgcagccactgcattttgtttaaacacagatagcacgggcctttctcttattgctacagtgttttgtacacggttaaaacactagtaaagctttttcgttatta

SEQ ID NO: 427794 - DNA, 3909 bp, Homo sapiens
caggcatcggtgtcgcctcgcagggaacagttgggtggcttccagcttatgccaggagtctcctcctcacccgcacatcgcggggctaggatgggatgtcgtggctgccaaatcctccgaggcaactcctgcctgggacggcctaccacaggatgggcctgagaatccggagcgcaggctcgggccgctaggacaccttcccccgcccgcggacccagccttccagcatcaccggggttcgcggaggagaaagaggaaaggcgtttggcctgccaaggccgccgtagcgagggggcggggcccggaagagcaggatggcggcgcgggacagtgacagcgaagaagatctggtcagctatgggaccgggctggagcctctggaagaaggtgaaagaccaaagaaaccaatccctcttcaggatcagactgtcagagatgaaaaaggaaggtataaacgattccacggggcctttagtggaggtttctctgctggatacttcaatactgttggctcaaaagaaggatggacaccctctacctttgtgtcttcacgacagaacagagcagacaaatctgttcttggtcctgaagattttatggatgaagaggatcttagtgaatttgggatagcacctaaagcgattgtcaccacagacgattttgcctccaaaaccaaagacagaatacgagaaaaggctaggcagttggccgctgctactgcccctattcctggagccaccctccttgatgacctcataacgccagcaaaattatctgttggtttcgaattgctaagaaaaatgggttggaaagaaggacaaggagttggtcctcgagtaaagagacggccacgccgacagaaacctgatcctggagtcaaaatctatggctgtgcattaccccctggaagctcggaaggatctgagggtgaagatgatgactacttgcctgataatgtgacctttgcacccaaagatgtcacacctgtggatttcacacctaaagataatgtgcatggtctagcttacaagggcctggatccccaccaggcactgtttggaacttcgggagaacattttaatcttttcagtggtggttctgagagagctggcgatcttggagaaattggactgaataaaggaagaaaattgggaatttcaggccaggcttttggtgtaggtgccctggaagaggaagatgatgatatctatgccacagaaactctatccaagtatgacactgttctgaaggacgaggagcctggagacggactctatggctggacagcacccaggcagtataaaaaccagaaagaatcagagaaagaccttcggtacgttggcaaaattttggatggattttccttggcttctaaacctttatcttctaagaaaatctatccacctccagagctgccaagagactatcgaccagtgcattatttcagacccatggtggccgccacctccgagaactcacacttactgcaggtattatcagagtcagctggaaaggcaacgcctgacccagggacacacagtaagcaccaactgaatgcctccaaacgggctgagttgcttggagagacgcctattcaaggttcagctacttcagtgttagaatttctgtcccaaaaagacaaagagagaatcaaagaaatgaagcaggcaactgacctgaaagcagctcagctcaaggccaggagtctggcccagaacgctcagagcagcagagcccagctctcccctgcagcggctgctgggcactgctcttggaacatggcattaggtggtgggacggccaccttaaaagccagcaacttcaagcctttcgccaaagatccggaaaagcaaaagcgatacgacgagttcttagtacacatgaaacagggtcagaaagatgctctggaacgctgtctggaccccagcatgacagagtgggagcgaggccgtgagcgggatgagtttgcccgggcggccctgctgtacgcatcttcccattcgaccttgtcctccaggttcactcacgccaaggaggaggatgactcagatcaggttgaagtccctcgagaccaagagaatgatgtcggggataagcagtcggctgtgaagatgaagatgtttgggaagctcacccgagacacgtttgagtggcaccctgacaagcttctatgtaagagatttaatgtccctgacccttatccagattcaactttagttggcttaccaagagtgaagcgtgacaagtactcagtcttcaactttctgacgctcccagagacagcttccttgcccaccactcaagcatcaagtgaaaaagtatcacagcaccgaggtcccgacaaatcaagaaaaccatccagatgggatacctctaaacacgaaaagaaagaagattccattagtgaatttttaagtttggctagatcaaaagccgagccacctaaacaacagtccagccccttagtaaacaaagaggaagagcatgcaccagaattatccgcaaatcagaccgtcaacaaagatgtggacgcacaggctgaaggagaagggagccgcccatccatggacttattcagggccatctttgccagttcctcagatgaaaagtcctcatcctccgaggatgagcaaggtgacagtgaagatgatcaggcaggctctggggaggccaacttccaaagctcccaagacactgacttgggggaaacatcatctgtggctcacgctcttgtgccagcaccccaggagccgccaccttccttcccgatacaaaagatgcagatagatgaaagagaagagttcggcccgcggctgcctcccgtcttctgccccaatgctcgtcagacacttgaggttcctcaaaaagagaaacataaaaagaacaaagacaagcacaaggccaagaaagagcacaggcggaagaaagagaagaaaaagaaacacaggaagcacaaacacaaaggcaagcaaaagaataaaaaaccagagaaaagtagtagctccgagagttccgacagcagcgacagccagagtgacgaggaaaccgcagacgtgtcgccccaggagctgctgagacggctgaaaagtcttccactaagaaggcagtaattgaatgctgccctggctcgtcctagaatcatttctcctccatgatggaagcccagtgattgttcagttaacgcattgtacagagtgtatttatatgtaaattcctgctgtaaaataatttttaaaaccttgacatttcaaagactgccttgaaaggtcgcagaaattgatttctatttttaatttcagttagtatcgggggaaaaaaatccagactgaacagtttaattaaagtggaatttttctattttcttcttgatttttaaaaaaatttcctgggacgttaaaaaagaagttaaaagtgaaggcttctctctggttttgtgatgaagacagcctggactcactgaaggacaagcgtgtgagaaggggcggttgcggcccctcctgccgttttttgggagtgaagctcttccctctctgggtggctgggttactgttggtgcccaggaagccccatgggagggcagagccagggcctggcagggggcctcagcctctcagggtagatgtcactaaagtgtctgagacaggcagggaaaccaggcaggagaatgtgcacccacagcctgggttacacggctgcagctccctgctctgaggccacctcatgtgtaccaaggagacctttttgaaaaataaagtgcagaccaggtgtgatggctaatgcctgtaatcccagagctttgggaggccgaggcgggaggattgcttgagcccaggaattccagaccagcctgggccacatagagacccctgtctccacaaaaaataaagtattgagcatttgtattttaca

SEQ ID NO: 427795 - DNA, 3650 bp, Homo sapiens
caggcatcggtgtcgcctcgcagggaacagttgggtggcttccagcttatgccaggagtctcctcctcacccgcacatcgcggggctaggatgggatgtcgtggctgccaaatcctccgaggcaactcctgcctgggacggcctaccacaggatgggcctgagaatccggagcgcaggctcgggccgctaggacaccttcccccgcccgcggacccagccttccagcatcaccggggttcgcggaggagaaagaggaaaggcgtttggcctgccaaggccgccgtagcgagggggcggggcccggaagagcaggatggcggcgcgggacagtgacagcgaagaagatctggtcagctatgggaccgggctggagcctctggaagaaggtgaaagaccaaagaaaccaatccctcttcaggatcagactgtcagagatgaaaaaggaaggtataaacgattccacggggcctttagtggaggtttctctgctggatacttcaatactgttggctcaaaagaaggatggacaccctctacctttgtgtcttcacgacagaacagagcagacaaatctgttcttggtcctgaagattttatggatgaagagatcctggagtcaaaatctatggctgtgcattaccccctggaagctcggaaggatctgagggtgaagatgatgactacttgcctgataatgtgacctttgcacccaaagatgtcacacctgtggatttcacacctaaagataatgtgcatggtctagcttacaagggcctggatccccaccaggcactgtttggaacttcgggagaacattttaatcttttcagtggtggttctgagagagctggcgatcttggagaaattggactgaataaaggaagaaaattgggaatttcaggccaggcttttggtgtaggtgccctggaagaggaagatgatgatatctatgccacagaaactctatccaagtatgacactgttctgaaggacgaggagcctggagacggactctatggctggacagcacccaggcagtataaaaaccagaaagaatcagagaaagaccttcggtacgttggcaaaattttggatggattttccttggcttctaaacctttatcttctaagaaaatctatccacctccagagctgccaagagactatcgaccagtgcattatttcagacccatggtggccgccacctccgagaactcacacttactgcaggtattatcagagtcagctggaaaggcaacgcctgacccagggacacacagtaagcaccaactgaatgcctccaaacgggctgagttgcttggagagacgcctattcaaggttcagctacttcagtgttagaatttctgtcccaaaaagacaaagagagaatcaaagaaatgaagcaggcaactgacctgaaagcagctcagctcaaggccaggagtctggcccagaacgctcagagcagcagagcccagctctcccctgcagcggctgctgggcactgctcttggaacatggcattaggtggtgggacggccaccttaaaagccagcaacttcaagcctttcgccaaagatccggaaaagcaaaagcgatacgacgagttcttagtacacatgaaacagggtcagaaagatgctctggaacgctgtctggaccccagcatgacagagtgggagcgaggccgtgagcgggatgagtttgcccgggcggccctgctgtacgcatcttcccattcgaccttgtcctccaggttcactcacgccaaggaggaggatgactcagatcaggttgaagtccctcgagaccaagagaatgatgtcggggataagcagtcggctgtgaagatgaagatgtttgggaagctcacccgagacacgtttgagtggcaccctgacaagcttctatgtaagagatttaatgtccctgacccttatccagattcaactttagttggcttaccaagagtgaagcgtgacaagtactcagtcttcaactttctgacgctcccagagacagcttccttgcccaccactcaagcatcaagtgaaaaagtatcacagcaccgaggtcccgacaaatcaagaaaaccatccagatgggatacctctaaacacgaaaagaaagaagattccattagtgaatttttaagtttggctagatcaaaagccgagccacctaaacaacagtccagccccttagtaaacaaagaggaagagcatgcaccagaattatccgcaaatcagaccgtcaacaaagatgtggacgcacaggctgaaggagaagggagccgcccatccatggacttattcagggccatctttgccagttcctcagatgaaaagtcctcatcctccgaggatgagcaaggtgacagtgaagatgatcaggcaggctctggggaggccaacttccaaagctcccaagacactgacttgggggaaacatcatctgtggctcacgctcttgtgccagcaccccaggagccgccaccttccttcccgatacaaaagatgcagatagatgaaagagaagagttcggcccgcggctgcctcccgtcttctgccccaatgctcgtcagacacttgaggttcctcaaaaagagaaacataaaaagaacaaagacaagcacaaggccaagaaagagcacaggcggaagaaagagaagaaaaagaaacacaggaagcacaaacacaaaggcaagcaaaagaataaaaaaccagagaaaagtagtagctccgagagttccgacagcagcgacagccagagtgacgaggaaaccgcagacgtgtcgccccaggagctgctgagacggctgaaaagtcttccactaagaaggcagtaattgaatgctgccctggctcgtcctagaatcatttctcctccatgatggaagcccagtgattgttcagttaacgcattgtacagagtgtatttatatgtaaattcctgctgtaaaataatttttaaaaccttgacatttcaaagactgccttgaaaggtcgcagaaattgatttctatttttaatttcagttagtatcgggggaaaaaaatccagactgaacagtttaattaaagtggaatttttctattttcttcttgatttttaaaaaaatttcctgggacgttaaaaaagaagttaaaagtgaaggcttctctctggttttgtgatgaagacagcctggactcactgaaggacaagcgtgtgagaaggggcggttgcggcccctcctgccgttttttgggagtgaagctcttccctctctgggtggctgggttactgttggtgcccaggaagccccatgggagggcagagccagggcctggcagggggcctcagcctctcagggtagatgtcactaaagtgtctgagacaggcagggaaaccaggcaggagaatgtgcacccacagcctgggttacacggctgcagctccctgctctgaggccacctcatgtgtaccaaggagacctttttgaaaaataaagtgcagaccaggtgtgatggctaatgcctgtaatcccagagctttgggaggccgaggcgggaggattgcttgagcccaggaattccagaccagcctgggccacatagagacccctgtctccacaaaaaataaagtattgagcatttgtattttaca

SEQ ID NO: 427796 - DNA, 2272 bp, Homo sapiens
caggcatcggtgtcgcctcgcagggaacagttgggtggcttccagcttatgccaggagtctcctcctcacccgcacatcgcggggctaggatgggatgtcgtggctgccaaatcctccgaggcaactcctgcctgggacggcctaccacaggatgggcctgagaatccggagcgcaggctcgggccgctaggacaccttcccccgcccgcggacccagccttccagcatcaccggggttcgcggaggagaaagaggaaaggcgtttggcctgccaaggccgccgtagcgagggggcggggcccggaagagcaggatggcggcgcgggacagtgacagcgaagaagatctggtcagctatgggaccgggctggagcctctggaagaaggtgaaagaccaaagaaaccaatccctcttcaggatcagactgtcagagatgaaaaaggaaggtataaacgattccacggggcctttagtggaggtttctctgctggatacttcaatactgttggctcaaaagaaggatggacaccctctacctttgtgtcttcacgacagaacagagcagacaaatctgttcttggtcctgaagattttatggatgaagaggatcttagtgaatttgggatagcacctaaagcgattgtcaccacagacgattttgcctccaaaaccaaagacagaatacgagaaaaggctaggcagttggccgctgctactgcccctattcctggagccaccctccttgatgacctcataacgccagcaaaattatctgttggtttcgaattgctaagaaaaatgggttggaaagaaggacaaggagttggtcctcgagtaaagagacggccacgccgacagaaacctgatcctggagtcaaaatctatggctgtgcattaccccctggaagctcggaaggatctgagggtgaagatgatgactacttgcctgataatgtgacctttgcacccaaagatgtcacacctgtggatttcacacctaaagataatgtgcatggtctagcttacaagggcctggatccccaccaggcactgtttggaacttcgggagaacattttaatcttttcagtggtggttctgagagagctggcgatcttggagaaattggactgaataaaggaagaaaattgggaatttcaggccaggcttttggtgtaggtgccctggaagaggaagatgatgatatctatgccacagaaactctatccaagtatgacactgttctgaaggacgaggagcctggagacggactctatggctggacagcacccaggcagtataaaaaccagaaagaatcagagaaagaccttcggtacgttggcaaaattttggatggattttccttggcttctaaacctttatcttctaagaaaatctatccacctccagagctgccaagagactatcgaccagtgcattatttcagacccatggtggccgccacctccgagaactcacacttactgcaggtattatcagagtcagctggaaaggcaacgcctgacccagggacacacagtaagcaccaactgaatgcctccaaacgggctgagttgcttggagagacgcctattcaaggttcagctacttcagtgttagaatttctgtcccaaaaagacaaagagagaatcaaagaaatgaagcaggcaactgacctgaaagcagctcagctcaaggccaggagtctggcccagaacgctcagagcagcagagcccagctctcccctgcagcggctgctgggcactgctcttggaacatggcattaggtggtgggacggccaccttaaaagccagcaacttcaagcctttcgccaaagatccggaaaagcaaaagcgatacgacgagttcttagtacacatgaaacagggtcagaaagatgctctggaacgctgtctggaccccagcatgacagagtgggagcgaggccgtgagcgggatgagtttgcccgggcggccctgctgtacgcatcttcccattcgaccttgtcctccaggttcactcacgccaaggaggaggatgactcagatcaggttgaagtccctcgagaccaagagaatgatgtcggggataagcagtcggctgtgaagatgaagatgtttgggaagctcacccgagacacgtttgagtggcaccctgacaagcttctatgtaagagatttaatgtccctgacccttatccagagtaagttggataaacctttacatcagtacaaaatgtattcttgatattaaagctaattttcccctt

SEQ ID NO: 427797 - DNA, 194 bp, Homo sapiens
caccccaggagccgccaccttccttcccgatacaaaagatgcagatagatgaaagagaagagttcggcccgcggctgcctcccgtcttctgccccagtgagtgcagagccctttggttcgcccatttttatcagtgtgtgattgccctgagatggggacagtgtgacttagagccgaccaaacatacgtgcttg

SEQ ID NO: 427798 - DNA, 2136 bp, Homo sapiens
tgggaggctgatgcaggagaattgcttgaacctgggaggcggaggttgcagtgagccaagattgtgccattgcactctagcctgggtgacaaggcgagactcaatctcaagagaaaaaaaaacaaaacaaaaagatagcatatgtggtcaaaccagagactgtcagaaactttaggtatatttttatcagtggagcttttccttaatggaaatccattttgaaagttaaattcttgtccttatcataataaggaaaatctcatgggacctaaaatcagtcacccagattctcgaactgctttgagaagtgaaagcatcttaggagactttttagtcatgcagaagaggtggaaaacttgagatggaaagcttttcaggaggtggattttgtcctactggttgttactaaaatgattcttttttcaattcccagttcaactttagttggcttaccaagagtgaagcgtgacaagtactcagtcttcaactttctgacgctcccagagacagcttccttgcccaccactcaagcatcaagtgaaaaagtatcacagcaccgaggtcccgacaaatcaagaaaaccatccagatgggatacctctaaacacgaaaagaaagaagattccattagtgaatttttaagtttggctagatcaaaagccgagccacctaaacaacagtccagccccttagtaaacaaagaggaagagcatgcaccagaattatccgcaaatcagaccgtcaacaaagatgtggacgcacaggctgaaggagaagggagccgcccatccatggacttattcagggccatctttgccagttcctcagatgaaaagtcctcatcctccgaggatgagcaaggtgacagtgaagatgatcaggcaggctctggggaggccaacttccaaagctcccaagacactgacttgggggaaacatcatctgtggctcacgctcttgtgccagcaccccaggagccgccaccttccttcccgatacaaaagatgcagatagatgaaagagaagagttcggcccgcggctgcctcccgtcttctgccccaatgctcgtcagacacttgaggttcctcaaaaagagaaacataaaaagaacaaagacaagcacaaggccaagaaagagcacaggcggaagaaagagaagaaaaagaaacacaggaagcacaaacacaaaggcaagcaaaagaataaaaaaccagagaaaagtagtagctccgagagttccgacagcagcgacagccagagtgacgaggaaaccgcagacgtgtcgccccaggagctgctgagacggctgaaaagtcttccactaagaaggcagtaattgaatgctgccctggctcgtcctagaatcatttctcctccatgatggaagcccagtgattgttcagttaacgcattgtacagagtgtatttatatgtaaattcctgctgtaaaataatttttaaaaccttgacatttcaaagactgccttgaaaggtcgcagaaattgatttctatttttaatttcagttagtatcgggggaaaaaaatccagactgaacagtttaattaaagtggaatttttctattttcttcttgatttttaaaaaaatttcctgggacgttaaaaaagaagttaaaagtgaaggcttctctctggttttgtgatgaagacagcctggactcactgaaggacaagcgtgtgagaaggggcggttgcggcccctcctgccgttttttgggagtgaagctcttccctctctgggtggctgggttactgttggtgcccaggaagccccatgggagggcagagccagggcctggcagggggcctcagcctctcagggtagatgtcactaaagtgtctgagacaggcagggaaaccaggcaggagaatgtgcacccacagcctgggttacacggctgcagctccctgctctgaggccacctcatgtgtaccaaggagacctttttgaaaaataaagtgcagaccaggtgtgatggctaatgcctgtaatcccagagctttgggaggccgaggcgggaggattgcttgagcccaggaattccagaccagcctgggccacatagagacccctgtctccacaaaaaataaagtattgagcatttgtattttaca

SEQ ID NO: 427799 - DNA, 1179 bp, Homo sapiens
  misc_feature (17)..(17): n is a, c, g, or t
gggacttttattttctnttagaggggaaaaagtgtcccagttctctcctacagaaaaaatactttcagtatgttttgataaaactgttgctttgtcatgagttagtcaattgtatcaggttttccaagacctttaccagtaaattatgtttctgtatgtaaaataaccccttattagagagacagtgttatatgtatttacaaaattatataagttccattgggattgtattgattttgtattttcccaaaatagtactttgaattgatagtcctttatgcaatgtcttagcaatagtctctataatgcccatccaggagaagtgggtagtaattcttcatcatgaaaatgatatattacatatttagtatcttccctttgcagtattgcacttttgtttaactagaatacacctatgagatagccaaagtttcaaacacagttatcttagtttaccggtggagtatttcaacaccaaccacatttcccttcctccctctaattctacccacatgatctttattccttcctttcgccaattaaaaaaaaaaaaaaggaaaaaaaatctgtagatcttgtcactaaaatctaatttatatcaaatttatgagagaaagtattttcctaattatggtcaaataaatttggttaacatcctagtgattctctttctatataataaggcaattacagttttcaaagcattaagtctaacataactttaaacattctcttaggtttcaagacacttctatttaatattcattggggaaaagttgtccagctatcagctaagaaaacacatgcaaatatggttgtgtaaagttaagggttataaggaaaaaaaaatcagtagaattacataatactaaagttgcagttgaaagaatatccaagtatgtgttggtagttactaaaagaattatagctgttattgccttgtatttatagcccttgtttcaggttttatgattcaagtcttagtccaatctttcttttggacatttgcaatatttaccagttgtgttttgtgtagtctgaatttgctttctgtagttgagcaaacgtcttaaaaagtcatttgtaatttattaaattactttctatgatgttctatagagcaaatggaagtttaattattttttattaaacatattctttgactaccaaaaaaaaaag

SEQ ID NO: 427800 - DNA, 882 bp, Homo sapiens
ttttgttttctccttaacaccaacaccaaaaagtataaagtcacagaaactacttgagatgatattgcttcttaattttagagaaaacataatgctgcaggaaaactgactttacatttgatagaatatgtcttcagttttattatacttatttatgtaaatttattccatttcattccatagatacttatatgagcgaattgatggcagagtcagaggaaatcttcggcaagctgctatagatagatttagtaaacctgattcagatagatttgtttttctcctgtgtacccgagctggtgggttgggcatcaacttaactgcagctgatacatgtataatttttgattctgattggaatcctcagaatgatcttcaggtaaataatttccttggctaacaaaaaatgcattttttaaaaaagtaaaattgtgtaactttttggtaatccacatcttttatttttatctggacaaactaatgtatgtttctctatgaaatatctgtgccaaataaaataggtgaagttattttaattgttatgataaaaactataatgacaaaaatttttacttttttatatgtctcactaacttatatgtcttactagcttataaaaaattatacctaattgagtacagtactttttgtttgtttatttagatatgaggtctcactatgttgcccaggctggtcttgaaccccaggactcaagcattcctcccatcttggcctccaaaagtgctgggtttacaggcacgcatcatcacgcctggcctgatatttttatagtttaaagaatattatgtaaacttgagagagacctaagctttaagaataatttatttgtaataaaattaaaatttcagaattttaatcctt

SEQ ID NO: 427801 - DNA, 8796 bp, Homo sapiens
gatatatggaagatttaaacaccattcattctttgtttttccacaaaggaccgtcctccttctaatatttggaagaaaatagatcaatccagggactataaaaatggcaatcaactcagggaatatcaactggaagggctcaactggctcttgttcaattggtacaatagacgaaactgcatcttagcagatgaaatgggtcttggcaaaactattcaatcaattacattcctctatgaaatccttctgactggtataagaggacctttcctgattattgctccactttctactattgcaaactgggagagagaatttcgtacgtggactgatattaacgttgtggtttatcatgggagcctgattagcagacaaatgatacagcaatacgagatgtacttcagggattcacaggggcgtatcattcgaggagcttacagattccaagccatcatcaccacttttgaaatgattcttggaggctgtggagagcttaatgcaattgaatggcgatgtgtgattattgatgaagcacataggttaaaaaataaaaattgtaaactcttagagggcctgaaactcatgaatctggaacacaaggtgcttttgactggcacccctctccaaaatacagttgaagaactatttagtcttcttcactttcttgaacccttaaggtttccttctgaatcaacatttatgcaagaatttggggatctgaaaacagaggaacaggtacagaaacttcaggctatcctgaaaccaatgatgttgagacgattaaaagaagatgtggaaaagaagttggcacctaaagaagaaaccatcattgaagtagaacttactaatattcaaaagaaatactaccgggctatcttggaaaagaacttttcttttttatccaaaggagcaggacaaactaatgtacctaacttggtcaataccatgatggagctcaggaaatgttgtaatcatccatatcttataaaaggtgctgaggagaaaatacttggagaatttagagatacttacaatccagctgcttctgattttcatcttcaagcaatgatccagtctgctggtaaattggtccttattgataaattgcttcccaaaatgaaagccggaggtcataaagtgctcatcttctctcaaatggttcgttgccttgacattctggaggactatctcatacataaaagatacttatatgagcgaattgatggcagagtcagaggaaatcttcggcaagctgctatagatagatttagtaaacctgattcagatagatttgtttttctcctgtgtacccgagctggtgggttgggcatcaacttaactgcagctgatacatgtataatttttgattctgattggaatcctcagaatgatcttcaggcccaagctcgttgccacagaattggtcagaacaaagcagttaaagtctacagactggtaactcgtaactcatatgagagagagatgtttgaccgagccagtttgaaactgggcctagataaagctgtgttacagagcatgagtggaagagaaagtaatgttggtggtattcagcagctttccaaaaaggaaatagaagatctgcttcgaagaggtgcttatggtgctattatggaggaagaagatgaaggctctaaattctgcgaagaggatatcgatcagattttactacgtcgtacaaaaactattacaattgaatcagaaggacgtgggtcaacatttgccaaggcgagttttgtggcatctggaaaccggacagatatttctttagatgatcccaacttctggcaaaaatgggctaaaaaggcagaaatagatatagaggccatcagtggcagaaacagcttggttattgacactccaagaattaggaagcaaacaagaccttttagtgccacaaaagatgaattggctgaattatctgaagctgaaagtgaaggagatgaaaagcccaaactccggagaccctgtgaccgttccaatggctatggaagaactgaatgctttagagttgagaaaaacctgctagtttatgggtggggccgatggagagagattctatctcatggccgtttcaaaaggcagctaaatgaacacgatgtagagataatttgccgagctctcttagcatattgccttgttcactaccgaggagatgagaagattaaaggtttcatatgggatctcattactccaactgaagatggacagacacgagagctacagaatcatctaggcctatcagctcctgtacccaggggtcgaaaagggaagaaagtaaaaactcaaacaagctcatttgatatacaaaaagcagaatggcttcgaaaatataatcccgagcagctccttcaagatgaaggctacaaaaaacatataaaacaccactgtaataaggttttgcttcgtgtgagaatgctgtattatctaaagcaagaagttattggaaatgagtgtcagaaagtatttgatggagttgatgcaagtgacattgatgtttgggtaccagaaccagaccactcagaagttcctgctgagtggtgggattttgatgctgataagtcactccttattggagtttttaaacatggatatgaaaaatataacactattcgagcagacccagcattatgcttcttggaaagagtgggaaaacctgatgagaaagcagttgctgctgaacagagagcgaatgattatatggatggggatgtggaagatccagaatacaaacctgccccagccatctttaaagatgatatagaggatgatgtttcctcaccaggagatcttgttatagcagatggagatggtcaactgatggagggtgataaagtatattggcctactcaatcagctttaaccacacgtttgaggcgtctcatcactgcataccagcgtactaataaaaacagacaaattcagcagatacaaccgactttctcggtgcctaccagtgtaatgcagcctatttatgaggaagccactcttaatcctaaaatggcagccaagatagaaagacagcaaagatggacaagaagagaagaagctgacttttatagggttgtatctacatttggagtggtttttgaccctgacagaggccaatttgattggacaaaatttagagctatggctaggctacataagaaaactgatgatagtttggaaaaatatttgtacgcattcatgtccatgtgtcggagggtttgtcgtcttccttccaaagaagaattggtggatccaaatatttttatccagcccatcacagaagaacgtgcttctaggactttgtatcgcattgaacttctaaggaaagtacgggaacaggcccttcgacatccacagttgtttgaacgcttgaagctttgccatccaaatccagatttaccagtctggtgggaatgtggccctcatgatagggatttgcttattggtgctgccaaacacggggtgagccgaacagactatcacattcttcgtgatcctgaactctcatttatggcagctcagaggaactacagtcaaagtaagatggctcattcaaggacttctaccccacttctacagcaatatcaagtagcactttctgcttctcctcttacctctctacctaggctcctagatgctaaaggtattattctagaggagatgaaagttaaaagtgaaaaccttaaagaggagcctcagtcttctgaagaagaatctatgtcttctgtggaaaccaggacactaataaaatctgagcctgtaagtccaaagaatggtgttttaccacaggctactggagaccagaaatctggtggaaaatgtgaaacagacagacgcatggttgcagccagaacagaacccctaactccaaacccagcttctaagaaaccaagagtccacaaaaggggatcagaatctagttctgattctgactcagattctgagagatcatcttgttcttccagatcatcttcttcctcatcatcctcttcttgctcccactctcgatcaggctctagttcttcttcatcttcatcttgttcttcagcatcttcttcatcctcttcctccacctcttcctcctcctcctcctcttcatcttcatcagaagaaagtgacagtgatgaagaagaagcccaaaaacgagaaagtactactcacatgaaagcctatgatgaagaaagcgtcgcgtcactgagcactacccaggatgagactcaggatagttttcagatgaacaatgggacaccagagtctgcttatatcttacaaggtggatatatgctggcagcctcgtattggccaaaggatcgtgtgatgatcaataggttggacagtatttgtcaaacagttctgaaaggaaagtggccttcagctagaagaagttatgatgctaacacagtggcttctttctataccacaaaactgctggacagccctggagcagctacagaatacagcgagcccagtgtacccactcccccaggtgccggtgttaaagaagaacatgatcagtcaacacagatgtcaaaggaaggtggtttgaagttgacatttcagaagcaagggcttgctcagaaaagaccatttgatggtgaagacggtgctctggggcagcagcagtacctcactcggcttcgagagcttcaaagtgcatcagagaccagcctcgtcaatttcccaaaatccataccagtatcaggtacttccattcaaccaacccttggtgccaatggtgtgatattagacaaccagcctatagtcaaaaaaaggcgaggaaggaggaagaatgtagaaggtgttgacatcttcttttttaacagaaataaaccacctaatcatgtttctttaggcttaacctcctcacagatttccacagggataaatccagcactatcctatactcaacctcaaggaattcctgatacagaaagtccagttccagttattaatcttaaagatggaacgagacttgcaggagatgatgcaccaaagagaaaggatttggaaaaatggcttaaggagcacccgggttatgtggaagatttgggagcttttattcctagaatgcagcttcatgagggaagacccaaacaaaaaagacaccgttgcagaaaccccaataaactagatgtgaatagtctcactggagaagaacgtgttcaactgattaacagaagaaatgctagaaaggttggaggtgcatttgctccccctttgaaagatttatgtagattcctaaaagaaaattcagaatatggagtagctcctgaatggggagatgttgttaagcaatctggatttcttccagaaagcatgtatgaacgtattctcactggtcccgttgtgagagaggaagtaagcaggcgggggagacggcctaaaagtggaattgcaaaggccacagcagcagcagctgctgcatctgccaccagtgtttcaggcaatcctttgttagccaatggactacttccaggtgtggatctcacaactcttcaggccttacaacaaaacctacaaaacttgcagtcactgcaagtaactgctgggttgatgggaatgcctaccggccttccttctggaggagaagctaaaaacatggctgctatgttccccatgctgctgtcaggaatggctggattaccaaatctgttgggcatgggaggactcctgacaaagcctacggaatctgggacagaagacaaaaagggaagtgactctaaggagtcagaaggaaaaacagaaaggacagagagccaaagttcagagaatggtggagaaaactctgtgtcaagttctccttccacatcctctactgctgcattaaatacagctgcagctgccaacccattagctcttaacccactattactatctaatatactttatccagggatgcttctcactccaggccttaatcttcatattccaactttgtcccagtccaatacttttgatgtacaaaacaaaaacagtgacttaggctcgtctaagtctgtagaagtaaaagaagaagattccagaattaaagatcaggaagacaaaggaggaactgaaccaagtcctctcaatgaaaacagcacagatgagggttcagagaaagctgatgcttcatctggatctgatagtacatcgtcgtcatctgaggattcagattctagtaatgaagactgattcccagactctgcacttaaaatatgaactgattttggattttttctttaataattaattgtaaataccccagtgttgagtgcatcaataacttactgaccgaacatttcagttatttgtttagaagtgcaaactgctttcagagactttttgcatgtaatatttcttaagattcataagtttctgaactcgtatgtactatcaaatacataaaggtgtaaaattacaacaaaaggcattataattttgttgggggttaattttatgaaaattatgctcaataagagttgtatatttaatatatttgcagtgaacacagaatactttatgcatattactgatttaatttgaatatagttttacagcctccttgacacctataatttacagatcaaaactcagcaataatttgggcagctaatgaatgtcatgaaagctgtagaatctacatcaccatccattgctttaattacatgaaaatgctctagtgttgtgatgcactgctgatgtttccaattcaggtacaagtatgttttaaagaagaaataagtttcccaatcagccaatttaactggctacctgttacctcagctgagttagtttaggaagtttacattcgtttctaattctatacttgttttcaggggttttttaaacacatcctatatatcatgtcaatctggcaagaaatatgacttgctttttgctgagcttaattcagatatcagtaaaattaagtcataaaataatcatgtgtcatgtgactttggcaccctatagacatacttagttttaacttttcaaagtttggcctcctattagaaataatcatgtctcagatgagtaatgtctgtttccagggttcagaaaaggcaaactcatgaaatgccactgaaaagaactttcaacacagcatacttcatgtaaaagaaattgtttgtttgctttctttgtgtagatttctatttgtgttttatgtcatggaaatattccagaattaacagataatagtggtaaagtaatatgcagatagtctaaattcattttgagtttctaggtgtaagcagactaaatgttgcccagaatcagtgttgggttatcagtttatattaaatatactgagttgcccgttttgaaaatgcactttgaataatctcaaaaagatgtacaagttatacctgtaaaccacaaaagtgaagcctgaggcttctgttcaatttcatagactcctttaccatgtaaaatttgtctgatatttgatttgtgatacaatttctcctgctaaagctgctattattctgacaaggtagaggtccaggttcacctttatatatatttaaaacaattagtactgaattggacataaaaatattgacattctaaggagagatatatgttagcatttttctggtactcaaataagttagtagtaaagtctgcaagggcataaatttagggggaaaaagtgtcccagttctctcctacagaaaaaatactttcagtatgttttgataaaactgttgctttgtcatgagttagtcaattgtatcaggttttccaagacctttaccagtaaattatgtttctgtatgtaaaataaccccttattagagagacagtgttatatgtatttacaaaattatataagttccattgggattgtattgattttgtattttcccaaaatagtactttgaattgatagtcctttatgcaatgtcttagcaatagtctctataatgcccatccaggagaagtgggtagtaattcttcatcatgaaaatgatatattacatatttagtatcttccctttgcagtattgcacttttgtttaactagaatacacctatgagatagccaaagtttcaaacacagttatcttagtttaccggtggagtatttcaacaccaaccacatttcccttcctccctctaattctacccacatgatctttattccttcctttcgccaattaaaaaaaaaaaaaaggaaaaaaaatctgtagatcttgtcactaaaatctaatttatatcaaatttatgagagaaagtattttcctaattatggtcaaataaatttggttaacatcctagtgattctctttctatataataaggcaattacagttttcaaagcattaagtctaacataactttaaacattctcttaggtttcaagacacttctatttaatattcattggggaaaagttgtccagctatcagctaagaaaacacatgcaaatatggttgtgtaaagttaagggttataaggaaaaaaaaatcagtagaattacataatactaaagttgcagttgaaagaatatccaagtatgtgttggtagttactaaaagaattatagctgttattgccttgtatttatagcccttgtttcaggttttatgattcaagtcttagtccaatctttcttttggacatttgcaatatttaccagttgtgttttgtgtagtctgaatttgctttctgtagttgagcaaacgtcttaaaaagtcatttgtaatttattaaattactttctatgatgttctatagagcaaatggaagtttaattattttttattaaacatattctttgactaccaaaaaaaaaag

SEQ ID NO: 427802 - DNA, 4828 bp, Homo sapiens
gatatatggaagatttaaacaccattcattctttgtttttccacaaaggaccgtcctccttctaatatttggaagaaaatagatcaatccagggactataaaaatggcaatcaactcagggaatatcaactggaagggctcaactggctcttgttcaattggtacaatagacgaaactgcatcttagcagatgaaatgggtcttggcaaaactattcaatcaattacattcctctatgaaatccttctgactggtataagaggacctttcctgattattgctccactttctactattgcaaactgggagagagaatttcgtacgtggactgatattaacgttgtggtttatcatgggagcctgattagcagacaaatgatacagcaatacgagatgtacttcagggattcacaggggcgtatcattcgaggagcttacagattccaagccatcatcaccacttttgaaatgattcttggaggctgtggagagcttaatgcaattgaatggcgatgtgtgattattgatgaagcacataggttaaaaaataaaaattgtaaactcttagagggcctgaaactcatgaatctggaacacaaggtgcttttgactggcacccctctccaaaatacagttgaagaactatttagtcttcttcactttcttgaacccttaaggtttccttctgaatcaacatttatgcaagaatttggggatctgaaaacagaggaacaggtacagaaacttcaggctatcctgaaaccaatgatgttgagacgattaaaagaagatgtggaaaagaagttggcacctaaagaagaaaccatcattgaagtagaacttactaatattcaaaagaaatactaccgggctatcttggaaaagaacttttcttttttatccaaaggagcaggacaaactaatgtacctaacttggtcaataccatgatggagctcaggaaatgttgtaatcatccatatcttataaaaggtgctgaggagaaaatacttggagaatttagagatacttacaatccagctgcttctgattttcatcttcaagcaatgatccagtctgctggtaaattggtccttattgataaattgcttcccaaaatgaaagccggaggtcataaagtgctcatcttctctcaaatggttcgttgccttgacattctggaggactatctcatacataaaagatacttatatgagcgaattgatggcagagtcagaggaaatcttcggcaagctgctatagatagatttagtaaacctgattcagatagatttgtttttctcctgtgtacccgagctggtgggttgggcatcaacttaactgcagctgatacatgtataatttttgattctgattggaatcctcagaatgatcttcaggcccaagctcgttgccacagaattggtcagaacaaagcagttaaagtctacagactggtaactcgtaactcatatgagagagagatgtttgaccgagccagtttgaaactgggcctagataaagctgtgttacagagcatgagtggaagagaaagtaatgttggtggtattcagcagctttccaaaaaggaaatagaagatctgcttcgaagaggtgcttatggtgctattatggaggaagaagatgaaggctctaaattctgcgaagaggatatcgatcagattttactacgtcgtacaaaaactattacaattgaatcagaaggacgtgggtcaacatttgccaaggcgagttttgtggcatctggaaaccggacagatatttctttagatgatcccaacttctggcaaaaatgggctaaaaaggcagaaatagatatagaggccatcagtggcagaaacagcttggttattgacactccaagaattaggaagcaaacaagaccttttagtgccacaaaagatgaattggctgaattatctgaagctgaaagtgaaggagatgaaaagcccaaactccggagaccctgtgaccgttccaatggctatggaagaactgaatgctttagagttgagaaaaacctgctagtttatgggtggggccgatggagagagattctatctcatggccgtttcaaaaggcagctaaatgaacacgatgtagagataatttgccgagctctcttagcatattgccttgttcactaccgaggagatgagaagattaaaggtttcatatgggatctcattactccaactgaagatggacagacacgagagctacagaatcatctaggcctatcagctcctgtacccaggggtcgaaaagggaagaaagtaaaaactcaaacaagctcatttgatatacaaaaagcagaatggcttcgaaaatataatcccgagcagctccttcaagatgaaggctacaaaaaacatataaaacaccactgtaataaggttttgcttcgtgtgagaatgctgtattatctaaagcaagaagttattggaaatgagtgtcagaaagtatttgatggagttgatgcaagtgacattgatgtttgggtaccagaaccagaccactcagaagttcctgctgagtggtgggattttgatgctgataagtcactccttattggagtttttaaacatggatatgaaaaatataacactattcgagcagacccagcattatgcttcttggaaagagtgggaaaacctgatgagaaagcagttgctgctgaacagagagcgaatgattatatggatggggatgtggaagatccagaatacaaacctgccccagccatctttaaagatgatatagaggatgatgtttcctcaccaggagatcttgttatagcagatggagatggtcaactgatggagggtgataaagtatattggcctactcaatcagctttaaccacacgtttgaggcgtctcatcactgcataccagcgtactaataaaaacagacaaattcagcagatacaaccgactttctcggtgcctaccagtgtaatgcagcctatttatgaggaagccactcttaatcctaaaatggcagccaagatagaaagacagcaaagatggacaagaagagaagaagctgacttttatagggttgtatctacatttggagtggtttttgaccctgacagaggccaatttgattggacaaaatttagagctatggctaggctacataagaaaactgatgatagtttggaaaaatatttgtacgcattcatgtccatgtgtcggagggtttgtcgtcttccttccaaagaagaattggtggatccaaatatttttatccagcccatcacagaagaacgtgcttctaggactttgtatcgcattgaacttctaaggaaagtacgggaacaggcccttcgacatccacagttgtttgaacgcttgaagctttgccatccaaatccagatttaccagtctggtgggaatgtggccctcatgatagggatttgcttattggtgctgccaaacacggggtgagccgaacagactatcacattcttcgtgatcctgaactctcatttatggcagctcagaggaactacagtcaaagtaagatggctcattcaaggacttctaccccacttctacagcaatatcaagtagcactttctgcttctcctcttacctctctacctaggctcctagatgctaaaggtattattctagaggagatgaaagttaaaagtgaaaaccttaaagaggagcctcagtcttctgaagaagaatctatgtcttctgtggaaaccaggacactaataaaatctgagcctgtaagtccaaagaatggtgttttaccacaggctactggagaccagaaatctggtggaaaatgtgaaacagacagacgcatggttgcagccagaacagaacccctaactccaaacccagcttctaagaaaccaagagtccacaaaaggggatcagaatctagttctgattctgactcagattctgagagatcatcttgttcttccagatcatcttcttcctcatcatcctcttcttgctcccactctcgatcaggctctagttcttcttcatcttcatcttgttcttcagcatcttcttcatcctcttcctccacctcttcctcctcctcctcctcttcatcttcatcagaagaaagtgacagtgatgaagaagaagcccaaaaacgagaaagtactactcacatgaaagcctatgatgaagaaagcgtcgcgtcactgagcactacccaggatgagactcaggatagttttcagatgaacaatgggacaccagagtctgcttatatcttacaaggtggatatatgctggcagcctcgtattggccaaaggatcgtgtgatgatcaataggttggacagtatttgtcaaacagttctgaaaggaaagtggccttcagctagaagaagttatgatgctaacacagtggcttctttctataccacaaaactgctggacagccctggagcagctacagaatacagcgagcccagtgtacccactcccccaggtgccggtgttaaagaagaacatgatcagtcaacacagatgtcaaaggtgaagaagcatgtacgagaaaaggagtttacagtgaaaatcaaagacgaaggtggtttgaagttgacatttcagaagcaagggcttgctcagaaaagaccatttgatggtgaagacggtgctctggggcagcagcagtacctcactcggcttcgagagcttcaaagtgcatcttcttcatcctcttcctccacctcttcctcctcctcctcctcttcatcttcatcagaagaaagtgacagtgatgaagaatgaagcccatacgataaagtactatgtcacatgt

SEQ ID NO: 427803 - DNA, 1901 bp, Homo sapiens
gatatatggaagatttaaacaccattcattctttgtttttccacaaaggaccgtcctccttctaatatttggaagaaaatagatcaatccagggactataaaaatggcaatcaactcagggaatatcaactggaagggctcaactggctcttgttcaattggtacaatagacgaaactgcatcttagcagatgaaatgggtcttggcaaaactattcaatcaattacattcctctatgaaatccttctgactggtataagaggacctttcctgattattgctccactttctactattgcaaactgggagagagaatttcgtacgtggactgatattaacgttgtggtttatcatgggagcctgattagcagacaaatgatacagcaatacgagatgtacttcagggattcacaggggcgtatcattcgaggagcttacagattccaagccatcatcaccacttttgaaatgattcttggaggctgtggagagcttaatgcaattgaatggcgatgtgtgattattgatgaagcacataggttaaaaaataaaaattgtaaactcttagagggcctgaaactcatgaatctggaacacaaggtgcttttgactggcacccctctccaaaatacagttgaagaactatttagtcttcttcactttcttgaacccttaaggtttccttctgaatcaacatttatgcaagaatttggggatctgaaaacagaggaacaggtacagaaacttcaggctatcctgaaaccaatgatgttgagacgattaaaagaagatgtggaaaagaagttggcacctaaagaagaaaccatcattgaagtagaacttactaatattcaaaagaaatactaccgggctatcttggaaaagaacttttcttttttatccaaaggagcaggacaaactaatgtacctaacttggtcaataccatgatggagctcaggaaatgttgtaatcatccatatcttataaaaggtgctgaggagaaaatacttggagaatttagagatacttacaatccagctgcttctgattttcatcttcaagcaatgatccagtctgctggtaaattggtccttattgataaattgcttcccaaaatgaaagccggaggtcataaagtgctcatcttctctcaaatggttcgttgccttgacattctggaggactatctcatacataaaagatacttatatgagcgaattgatggcagagtcagaggaaatcttcggcaagctgctatagatagatttagtaaacctgattcagatagatttgtttttctcctgtgtacccgagctggtgggttgggcatcaacttaactgcagctgatacatgtataatttttgattctgattggaatcctcagaatgatcttcaggtaaataatttccttggctaacaaaaaatgcattttttaaaaaagtaaaattgtgtaactttttggtaatccacatcttttatttttatctggacaaactaatgtatgtttctctatgaaatatctgtgccaaataaaataggtgaagttattttaattgttatgataaaaactataatgacaaaaatttttacttttttatatgtctcactaacttatatgtcttactagcttataaaaaattatacctaattgagtacagtactttttgtttgtttatttagatatgaggtctcactatgttgcccaggctggtcttgaaccccaggactcaagcattcctcccatcttggcctccaaaagtgctgggtttacaggcacgcatcatcacgcctggcctgatatttttatagtttaaagaatattatgtaaacttgagagagacctaagctttaagaataatttatttgtaataaaattaaaatttcagaattttaatcctt

SEQ ID NO: 427804 - DNA, 1632 bp, Homo sapiens
gatatatggaagatttaaacaccattcattctttgtttttccacaaaggaccgtcctccttctaatatttggaagaaaatagatcaatccagggactataaaaatggcaatcaactcagggaatatcaactggaagggctcaactggctcttgttcaattggtacaatagacgaaactgcatcttagcagatgaaatgggtcttggcaaaactattcaatcaattacattcctctatgaaatccttctgactggtataagaggacctttcctgattattgctccactttctactattgcaaactgggagagagaatttcgtacgtggactgatattaacgttgtggtttatcatgggagcctgattagcagacaaatgatacagcaatacgagatgtacttcagggattcacaggggcgtatcattcgaggagcttacagattccaagccatcatcaccacttttgaaatgattcttggaggctgtggagagcttaatgcaattgaatggcgatgtgtgattattgatgaagcacataggttaaaaaataaaaattgtaaactcttagagggcctgaaactcatgaatctggaacacaaggtgcttttgactggcacccctctccaaaatacagttgaagaactatttagtcttcttcactttcttgaacccttaaggtttccttctgaatcaacatttatgcaagaatttggggatctgaaaacagaggaacaggtacagaaacttcaggctatcctgaaaccaatgatgttgagacgattaaaagaagatgtggaaaagaagttggcacctaaagaagaaaccatcattgaagtagaacttactaatattcaaaagaaatactaccgggctatcttggaaaagaacttttcttttttatccaaaggagcaggacaaactaatgtacctaacttggtcaataccatgatggagctcaggaaatgttgtaatcatccatatcttataaaaggtgctgaggagaaaatacttggagaatttagagatacttacaatccagctgcttctgattttcatcttcaagcaatgatccagtctgctggtaaattggtccttattgataaattgcttcccaaaatgaaagccggaggtcataaagtgctcatcttctctcaaatggttcgttgccttgacattctggaggactatctcatacataaaagatacttatatgagcgaattgatggcagagtcagaggaaatcttcggcaagctgctatagatagatttagtaaacctgattcagatagatttgtttttctcctgtgtacccgagctggtgggttgggcatcaacttaactgcagctgatacatgtataatttttgattctgattggaatcctcagaatgatcttcaggcccaagctcgttgccacagaattggtcagaacaaagcagttaaagtctacagactggtaactcgtaactcatatgagagagagatgtttgaccgagccagtttgaaactgggcctagataaagctgtgttacagagcatgagtggaagagaaagtaatgttggtggtgtatgtatagtttctttttcacttgagatttttgtgtgtttttgcatttgattttacctccaatag

SEQ ID NO: 427805 - DNA, 441 bp, Homo sapiens
caaaaagcagaatggcttcgaaaatataatcccgagcagctccttcaagatgaaggctacaaaaaacatataaaacaccactgtaataagtaggtatagggtattttaaacacaactctttaaatgtttactgttctgaatttattaatactctttaagcttgctgattttgagtacagagacagcatggtctagggccaatcctaatcctaattttacaaggtatcctacaagcaaatcatgatacctcttgtgtcattgttctcaccaacagataagtaaaactggcctccaaatgagctcattatatcttacttgtatatgaaataatgatgattatgaagattttggagaagttctttatatatatggtagtaataagattcatttaatcagaagtaatatttcattattttaaaatctgtacacaaattccttcct

SEQ ID NO: 427806 - DNA, 288 bp, Homo sapiens
tttgaaatgattcttggaggctgtggagagcttaatgcaattgaatggcgatgtgtgattattgatgaagcacataggttaaaaaataaaaattgtaaactcttagagggcctgaaactcatgaatctggtaagtaacttaatattatcattatgacaattgagtttattagatgtatagtgaaaggttatagagttaatgctaaaaatttttctttttaattttagagtgtagtacatctgaatcttatctgtgataattgagattttttggggggccttaatttgt

SEQ ID NO: 427807 - DNA, 1862 bp, Homo sapiens
gatatatggaagatttaaacaccattcattctttgtttttccacaaaggaccgtcctccttctaatatttggaagaaaatagatcaatccagggactataaaaatggcaatcaactcagggaatatcaactggaagggctcaactggctcttgttcaattggtacaatagacgaaactgcatcttagcagatgaaatgggtcttggcaaaactattcaatcaattacattcctctatgaaatccttctgactggtataagaggacctttcctgattattgctccactttctactattgcaaactgggagagagaatttcgtacgtggactgatattaacgttgtggtttatcatgggagcctgattagcagacaaatgatacagcaatacgagatgtacttcagggattcacaggggcgtatcattcgaggagcttacagattccaagccatcatcaccacttttgaaatgattcttggaggctgtggagagcttaatgcaattgaatggcgatgtgtgattattgatgaagcacataggttaaaaaataaaaattgtaaactcttagagggcctgaaactcatgaatctggaacacaaggtgcttttgactggcacccctctccaaaatacagttgaagaactatttagtcttcttcactttcttgaacccttaaggtttccttctgaatcaacatttatgcaagaatttggggatctgaaaacagaggaacaggtacagaaacttcaggctatcctgaaaccaatgatgttgagacgattaaaagaagatgtggaaaagaagttggcacctaaagaagaaaccatcattgaagtagaacttactaatattcaaaagaaatactaccgggctatcttggaaaagaacttttcttttttatccaaaggagcaggacaaactaatgtacctaacttggtcaataccatgatggagctcaggaaatgttgtaatcatccatatcttataaaaggtgctgaggagaaaatacttggagaatttagagatacttacaatccagctgcttctgattttcatcttcaagcaatgatccagtctgctggtaaattggtccttattgataaattgcttcccaaaatgaaagccggaggtcataaagtgctcatcttctctcaaatggttcgttgccttgacattctggaggactatctcatacataaaaggtaaagcatactgaatttactgtgaattatgctaagtatatgctattaagatttgtgcagcactgtaatgtaaatgaactttactcatatctttctctttgctagattagaataatgcattcaaatttataagtaaagattgtttaggattatgtgttatattttcctaacctgcatatgttgcaatattagatgtgcctgaggagtccaattaagaaaagcttgcaaataaatatttgtttacccaggaatgggtttaaaaatgtacattttacttgattaataaaccttgtggatgaaactttaaatagatatatatttacaacagtcatcttcaaaattgaaaaaagtgattcaagaactttggatctatttcattgttataattagagccttaagttgtgggacttttattcttattatatactatataaaatttgttcatgctttaattttttctgatttgtttcaatgtgggttttttgttttgttttgtttattggtacatcacaataagatagtgttaaatattgtctaatcaggccgggcgcggtggctcacgtctgtaatcccagcactttgggagcctgaggcaggcggatcatgaggtcaggagatcaagaccatcgtggcttacacggtgaaacccacgtctctact

SEQ ID NO: 427808 - DNA, 8844 bp, Homo sapiens
gatatatggaagatttaaacaccattcattctttgtttttccacaaaggaccgtcctccttctaatatttggaagaaaatagatcaatccagggactataaaaatggcaatcaactcagggaatatcaactggaagggctcaactggctcttgttcaattggtacaatagacgaaactgcatcttagcagatgaaatgggtcttggcaaaactattcaatcaattacattcctctatgaaatccttctgactggtataagaggacctttcctgattattgctccactttctactattgcaaactgggagagagaatttcgtacgtggactgatattaacgttgtggtttatcatgggagcctgattagcagacaaatgatacagcaatacgagatgtacttcagggattcacaggggcgtatcattcgaggagcttacagattccaagccatcatcaccacttttgaaatgattcttggaggctgtggagagcttaatgcaattgaatggcgatgtgtgattattgatgaagcacataggttaaaaaataaaaattgtaaactcttagagggcctgaaactcatgaatctggaacacaaggtgcttttgactggcacccctctccaaaatacagttgaagaactatttagtcttcttcactttcttgaacccttaaggtttccttctgaatcaacatttatgcaagaatttggggatctgaaaacagaggaacaggtacagaaacttcaggctatcctgaaaccaatgatgttgagacgattaaaagaagatgtggaaaagaagttggcacctaaagaagaaaccatcattgaagtagaacttactaatattcaaaagaaatactaccgggctatcttggaaaagaacttttcttttttatccaaaggagcaggacaaactaatgtacctaacttggtcaataccatgatggagctcaggaaatgttgtaatcatccatatcttataaaaggtgctgaggagaaaatacttggagaatttagagatacttacaatccagctgcttctgattttcatcttcaagcaatgatccagtctgctggtaaattggtccttattgataaattgcttcccaaaatgaaagccggaggtcataaagtgctcatcttctctcaaatggttcgttgccttgacattctggaggactatctcatacataaaagatacttatatgagcgaattgatggcagagtcagaggaaatcttcggcaagctgctatagatagatttagtaaacctgattcagatagatttgtttttctcctgtgtacccgagctggtgggttgggcatcaacttaactgcagctgatacatgtataatttttgattctgattggaatcctcagaatgatcttcaggcccaagctcgttgccacagaattggtcagaacaaagcagttaaagtctacagactggtaactcgtaactcatatgagagagagatgtttgaccgagccagtttgaaactgggcctagataaagctgtgttacagagcatgagtggaagagaaagtaatgttggtggtattcagcagctttccaaaaaggaaatagaagatctgcttcgaagaggtgcttatggtgctattatggaggaagaagatgaaggctctaaattctgcgaagaggatatcgatcagattttactacgtcgtacaaaaactattacaattgaatcagaaggacgtgggtcaacatttgccaaggcgagttttgtggcatctggaaaccggacagatatttctttagatgatcccaacttctggcaaaaatgggctaaaaaggcagaaatagatatagaggccatcagtggcagaaacagcttggttattgacactccaagaattaggaagcaaacaagaccttttagtgccacaaaagatgaattggctgaattatctgaagctgaaagtgaaggagatgaaaagcccaaactccggagaccctgtgaccgttccaatggctatggaagaactgaatgctttagagttgagaaaaacctgctagtttatgggtggggccgatggagagagattctatctcatggccgtttcaaaaggcagctaaatgaacacgatgtagagataatttgccgagctctcttagcatattgccttgttcactaccgaggagatgagaagattaaaggtttcatatgggatctcattactccaactgaagatggacagacacgagagctacagaatcatctaggcctatcagctcctgtacccaggggtcgaaaagggaagaaagtaaaaactcaaacaagctcatttgatatacaaaaagcagaatggcttcgaaaatataatcccgagcagctccttcaagatgaaggctacaaaaaacatataaaacaccactgtaataaggttttgcttcgtgtgagaatgctgtattatctaaagcaagaagttattggaaatgagtgtcagaaagtatttgatggagttgatgcaagtgacattgatgtttgggtaccagaaccagaccactcagaagttcctgctgagtggtgggattttgatgctgataagtcactccttattggagtttttaaacatggatatgaaaaatataacactattcgagcagacccagcattatgcttcttggaaagagtgggaaaacctgatgagaaagcagttgctgctgaacagagagcgaatgattatatggatggggatgtggaagatccagaatacaaacctgccccagccatctttaaagatgatatagaggatgatgtttcctcaccaggagatcttgttatagcagatggagatggtcaactgatggagggtgataaagtatattggcctactcaatcagctttaaccacacgtttgaggcgtctcatcactgcataccagcgtactaataaaaacagacaaattcagcagatacaaccgactttctcggtgcctaccagtgtaatgcagcctatttatgaggaagccactcttaatcctaaaatggcagccaagatagaaagacagcaaagatggacaagaagagaagaagctgacttttatagggttgtatctacatttggagtggtttttgaccctgacagaggccaatttgattggacaaaatttagagctatggctaggctacataagaaaactgatgatagtttggaaaaatatttgtacgcattcatgtccatgtgtcggagggtttgtcgtcttccttccaaagaagaattggtggatccaaatatttttatccagcccatcacagaagaacgtgcttctaggactttgtatcgcattgaacttctaaggaaagtacgggaacaggcccttcgacatccacagttgtttgaacgcttgaagctttgccatccaaatccagatttaccagtctggtgggaatgtggccctcatgatagggatttgcttattggtgctgccaaacacggggtgagccgaacagactatcacattcttcgtgatcctgaactctcatttatggcagctcagaggaactacagtcaaagtaagatggctcattcaaggacttctaccccacttctacagcaatatcaagtagcactttctgcttctcctcttacctctctacctaggctcctagatgctaaaggtattattctagaggagatgaaagttaaaagtgaaaaccttaaagaggagcctcagtcttctgaagaagaatctatgtcttctgtggaaaccaggacactaataaaatctgagcctgtaagtccaaagaatggtgttttaccacaggctactggagaccagaaatctggtggaaaatgtgaaacagacagacgcatggttgcagccagaacagaacccctaactccaaacccagcttctaagaaaccaagagtccacaaaaggggatcagaatctagttctgattctgactcagattctgagagatcatcttgttcttccagatcatcttcttcctcatcatcctcttcttgctcccactctcgatcaggctctagttcttcttcatcttcatcttgttcttcagcatcttcttcatcctcttcctccacctcttcctcctcctcctcctcttcatcttcatcagaagaaagtgacagtgatgaagaagaagcccaaaaacgagaaagtactactcacatgaaagcctatgatgaagaaagcgtcgcgtcactgagcactacccaggatgagactcaggatagttttcagatgaacaatgggacaccagagtctgcttatatcttacaaggtggatatatgctggcagcctcgtattggccaaaggatcgtgtgatgatcaataggttggacagtatttgtcaaacagttctgaaaggaaagtggccttcagctagaagaagttatgatgctaacacagtggcttctttctataccacaaaactgctggacagccctggagcagctacagaatacagcgagcccagtgtacccactcccccaggtgccggtgttaaagaagaacatgatcagtcaacacagatgtcaaaggtgaagaagcatgtacgagaaaaggagtttacagtgaaaatcaaagacgaaggtggtttgaagttgacatttcagaagcaagggcttgctcagaaaagaccatttgatggtgaagacggtgctctggggcagcagcagtacctcactcggcttcgagagcttcaaagtgcatcagagaccagcctcgtcaatttcccaaaatccataccagtatcaggtacttccattcaaccaacccttggtgccaatggtgtgatattagacaaccagcctatagtcaaaaaaaggcgaggaaggaggaagaatgtagaaggtgttgacatcttcttttttaacagaaataaaccacctaatcatgtttctttaggcttaacctcctcacagatttccacagggataaatccagcactatcctatactcaacctcaaggaattcctgatacagaaagtccagttccagttattaatcttaaagatggaacgagacttgcaggagatgatgcaccaaagagaaaggatttggaaaaatggcttaaggagcacccgggttatgtggaagatttgggagcttttattcctagaatgcagcttcatgagggaagacccaaacaaaaaagacaccgttgcagaaaccccaataaactagatgtgaatagtctcactggagaagaacgtgttcaactgattaacagaagaaatgctagaaaggttggaggtgcatttgctccccctttgaaagatttatgtagattcctaaaagaaaattcagaatatggagtagctcctgaatggggagatgttgttaagcaatctggatttcttccagaaagcatgtatgaacgtattctcactggtcccgttgtgagagaggaagtaagcaggcgggggagacggcctaaaagtggaattgcaaaggccacagcagcagcagctgctgcatctgccaccagtgtttcaggcaatcctttgttagccaatggactacttccaggtgtggatctcacaactcttcaggccttacaacaaaacctacaaaacttgcagtcactgcaagtaactgctgggttgatgggaatgcctaccggccttccttctggaggagaagctaaaaacatggctgctatgttccccatgctgctgtcaggaatggctggattaccaaatctgttgggcatgggaggactcctgacaaagcctacggaatctgggacagaagacaaaaagggaagtgactctaaggagtcagaaggaaaaacagaaaggacagagagccaaagttcagagaatggtggagaaaactctgtgtcaagttctccttccacatcctctactgctgcattaaatacagctgcagctgccaacccattagctcttaacccactattactatctaatatactttatccagggatgcttctcactccaggccttaatcttcatattccaactttgtcccagtccaatacttttgatgtacaaaacaaaaacagtgacttaggctcgtctaagtctgtagaagtaaaagaagaagattccagaattaaagatcaggaagacaaaggaggaactgaaccaagtcctctcaatgaaaacagcacagatgagggttcagagaaagctgatgcttcatctggatctgatagtacatcgtcgtcatctgaggattcagattctagtaatgaagactgattcccagactctgcacttaaaatatgaactgattttggattttttctttaataattaattgtaaataccccagtgttgagtgcatcaataacttactgaccgaacatttcagttatttgtttagaagtgcaaactgctttcagagactttttgcatgtaatatttcttaagattcataagtttctgaactcgtatgtactatcaaatacataaaggtgtaaaattacaacaaaaggcattataattttgttgggggttaattttatgaaaattatgctcaataagagttgtatatttaatatatttgcagtgaacacagaatactttatgcatattactgatttaatttgaatatagttttacagcctccttgacacctataatttacagatcaaaactcagcaataatttgggcagctaatgaatgtcatgaaagctgtagaatctacatcaccatccattgctttaattacatgaaaatgctctagtgttgtgatgcactgctgatgtttccaattcaggtacaagtatgttttaaagaagaaataagtttcccaatcagccaatttaactggctacctgttacctcagctgagttagtttaggaagtttacattcgtttctaattctatacttgttttcaggggttttttaaacacatcctatatatcatgtcaatctggcaagaaatatgacttgctttttgctgagcttaattcagatatcagtaaaattaagtcataaaataatcatgtgtcatgtgactttggcaccctatagacatacttagttttaacttttcaaagtttggcctcctattagaaataatcatgtctcagatgagtaatgtctgtttccagggttcagaaaaggcaaactcatgaaatgccactgaaaagaactttcaacacagcatacttcatgtaaaagaaattgtttgtttgctttctttgtgtagatttctatttgtgttttatgtcatggaaatattccagaattaacagataatagtggtaaagtaatatgcagatagtctaaattcattttgagtttctaggtgtaagcagactaaatgttgcccagaatcagtgttgggttatcagtttatattaaatatactgagttgcccgttttgaaaatgcactttgaataatctcaaaaagatgtacaagttatacctgtaaaccacaaaagtgaagcctgaggcttctgttcaatttcatagactcctttaccatgtaaaatttgtctgatatttgatttgtgatacaatttctcctgctaaagctgctattattctgacaaggtagaggtccaggttcacctttatatatatttaaaacaattagtactgaattggacataaaaatattgacattctaaggagagatatatgttagcatttttctggtactcaaataagttagtagtaaagtctgcaagggcataaatttagggggaaaaagtgtcccagttctctcctacagaaaaaatactttcagtatgttttgataaaactgttgctttgtcatgagttagtcaattgtatcaggttttccaagacctttaccagtaaattatgtttctgtatgtaaaataaccccttattagagagacagtgttatatgtatttacaaaattatataagttccattgggattgtattgattttgtattttcccaaaatagtactttgaattgatagtcctttatgcaatgtcttagcaatagtctctataatgcccatccaggagaagtgggtagtaattcttcatcatgaaaatgatatattacatatttagtatcttccctttgcagtattgcacttttgtttaactagaatacacctatgagatagccaaagtttcaaacacagttatcttagtttaccggtggagtatttcaacaccaaccacatttcccttcctccctctaattctacccacatgatctttattccttcctttcgccaattaaaaaaaaaaaaaaggaaaaaaaatctgtagatcttgtcactaaaatctaatttatatcaaatttatgagagaaagtattttcctaattatggtcaaataaatttggttaacatcctagtgattctctttctatataataaggcaattacagttttcaaagcattaagtctaacataactttaaacattctcttaggtttcaagacacttctatttaatattcattggggaaaagttgtccagctatcagctaagaaaacacatgcaaatatggttgtgtaaagttaagggttataaggaaaaaaaaatcagtagaattacataatactaaagttgcagttgaaagaatatccaagtatgtgttggtagttactaaaagaattatagctgttattgccttgtatttatagcccttgtttcaggttttatgattcaagtcttagtccaatctttcttttggacatttgcaatatttaccagttgtgttttgtgtagtctgaatttgctttctgtagttgagcaaacgtcttaaaaagtcatttgtaatttattaaattactttctatgatgttctatagagcaaatggaagtttaattattttttattaaacatattctttgactaccaaaaaaaaaag

SEQ ID NO: 427809 - DNA, 1377 bp, Homo sapiens
gcggaagccgggattcgccctccggggagcgattggtcctcgggaggggcggggaggtggacgcgggtaccggcggtcgtcgggtcggcagcctttggtcagttggcagcggcaagcgcgctgcggttccggtggcgccatgtcgttctgcagcttcttcgggggcgaggttttccagaatcactttgaacctggcgtttacgtgtgtgccaagtgtggctatgagctgttctccagccgctcgaagtatgcacactcgtctccatggccggcgttcaccgagaccattcacgccgacagcgtggccaagcgtccggagcacaatagatctgaagccttgaaggtgtcctgtggcaagtgtggcaatgggttgggccacgagttcctgaacgacggccccaagccggggcagtcccgattctgaatattcagcagctcgctgaagtttgtccctaaaggcaaagaaacttctgcctcccagggtcactaggcgggcagcccacacccaccccagacggccaccacactgaggccacacgttggccattccaccttggagttggaaccctgggcgtcgagacaggaaggcagggcgcagtggttgaaacatcaggacactcccaaggccccggctctgaacaagaccttttcgtttcttggaaaagagactcatttgctgatggttcatgccttctgctgggacaggcctgggctgtgcagccacactgtcggctgacttagccccctgctcactctaggtgcctccaggaggtgagccctgggtgcagctggtctctgaatgacgttacaccctcaccttcttttcctggccctgtctctggactctcccctgtgaggcccaattccaagacagactctcgtcctcaccgaagcttaggcccacatctcccaggctgcttaggagacagaatggaaacggaggccgcccctgccagccgccctggccctggtcactgcatgatccgctctggtcaaacccttccaggccagccagagtggggatggtctgtgacctgctgggaaggcaggctgatggggcacacccttggcctctcgtccacgaggggagaaacctaaaccctgtttcacaatctgtgcggaagtagcttgcctcacttctgcttaggaaagcggctgttgctccataactctaaccagcacagggctgaggcctgcagtgcacacctgcagggaggcccttcccaaggtgtggtgactgtgccttactgtacatgctcggaggcctggccatataggagggtgggtgatgctgaaatcaccccccatcttaagtaattactttctggagtaatcaggtggaaatccatagacaaatgaaacattcaaaaaaaaaaa

SEQ ID NO: 427810 - DNA, 711 bp, Homo sapiens
gtggcctggaggccttttctctgggactgttctcttcctgcctggagagcagagcagtgcctgggtatccagcttagggcctcgttgggcagcagggaggaccacttgagaaaggagagggaccaggtggttgggccacatcagggcccctgccctctatgttcctgggggaactaggggggcgagggggagctccgtgtcctcattggactacccaggttccttcacgctgcacacacttgtagctgagtgtctgcatcaccaagcaaagatggaaatgttaggatatgccccgtcacggggctatgagaagaatcaaggagataattgtgaaaggtgactcccctggtctctggcacatctactaaacgcgtttacgtgtgtgccaagtgtggctatgagctgttctccagccgctcgaagtatgcacactcgtctccatggccggcgttcaccgagaccattcacgccgacagcgtggccaagcgtccggagcacaatagatctgaagccttgaagctccaggggcttagaggcgtctattccaggcctgttgcctctgccagggagctgccaccccaggctatcgggagagcctggccttctggtgcaaatgtgggaaacaggacaggtttcctgtacgggctccaggacaaaggtcaacctcttatgtcggcggtcagcttgggaaataggcgtgtgggaagaaac

SEQ ID NO: 427811 - DNA, 1314 bp, Homo sapiens
cctggggaaggagcacagcctaccctcggaacgggggcagcgctgtctttgcctgggttggtggatttgggagcttgaccccggaaaggcgggagctgatgactccacatttgcctctccttccaccacaggcgtttacgtgtgtgccaagtgtggctatgagctgttctccagccgctcgaagtatgcacactcgtctccatggccggcgttcaccgagaccattcacgccgacagcgtggccaagcgtccggagcacaatagatctgaagccttgaaggtgtcctgtggcaagtgtggcaatgggttgggccacgagttcctgaacgacggccccaagccggggcagtcccgattctgaatattcagcagctcgctgaagtttgtccctaaaggcaaagaaacttctgcctcccagggtcactaggcgggcagcccacacccaccccagacggccaccacactgaggccacacgttggccattccaccttggagttggaaccctgggcgtcgagacaggaaggcagggcgcagtggttgaaacatcaggacactcccaaggccccggctctgaacaagaccttttcgtttcttggaaaagagactcatttgctgatggttcatgccttctgctgggacaggcctgggctgtgcagccacactgtcggctgacttagccccctgctcactctaggtgcctccaggaggtgagccctgggtgcagctggtctctgaatgacgttacaccctcaccttcttttcctggccctgtctctggactctcccctgtgaggcccaattccaagacagactctcgtcctcaccgaagcttaggcccacatctcccaggctgcttaggagacagaatggaaacggaggccgcccctgccagccgccctggccctggtcactgcatgatccgctctggtcaaacccttccaggccagccagagtggggatggtctgtgacctgctgggaaggcaggctgatggggcacacccttggcctctcgtccacgaggggagaaacctaaaccctgtttcacaatctgtgcggaagtagcttgcctcacttctgcttaggaaagcggctgttgctccataactctaaccagcacagggctgaggcctgcagtgcacacctgcagggaggcccttcccaaggtgtggtgactgtgccttactgtacatgctcggaggcctggccatataggagggtgggtgatgctgaaatcaccccccatcttaagtaattactttctggagtaatcaggtggaaatccatagacaaatgaaacattcaaaaaaaaaaa

SEQ ID NO: 427812 - DNA, 1225 bp, Homo sapiens
accgtggcttgtgggttactggcttcaagatgccaaaagctttaataactggggttggcatgtgtggctatgagctgttctccagccgctcgaagtatgcacactcgtctccatggccggcgttcaccgagaccattcacgccgacagcgtggccaagcgtccggagcacaatagatctgaagccttgaaggtgtcctgtggcaagtgtggcaatgggttgggccacgagttcctgaacgacggccccaagccggggcagtcccgattctgaatattcagcagctcgctgaagtttgtccctaaaggcaaagaaacttctgcctcccagggtcactaggcgggcagcccacacccaccccagacggccaccacactgaggccacacgttggccattccaccttggagttggaaccctgggcgtcgagacaggaaggcagggcgcagtggttgaaacatcaggacactcccaaggccccggctctgaacaagaccttttcgtttcttggaaaagagactcatttgctgatggttcatgccttctgctgggacaggcctgggctgtgcagccacactgtcggctgacttagccccctgctcactctaggtgcctccaggaggtgagccctgggtgcagctggtctctgaatgacgttacaccctcaccttcttttcctggccctgtctctggactctcccctgtgaggcccaattccaagacagactctcgtcctcaccgaagcttaggcccacatctcccaggctgcttaggagacagaatggaaacggaggccgcccctgccagccgccctggccctggtcactgcatgatccgctctggtcaaacccttccaggccagccagagtggggatggtctgtgacctgctgggaaggcaggctgatggggcacacccttggcctctcgtccacgaggggagaaacctaaaccctgtttcacaatctgtgcggaagtagcttgcctcacttctgcttaggaaagcggctgttgctccataactctaaccagcacagggctgaggcctgcagtgcacacctgcagggaggcccttcccaaggtgtggtgactgtgccttactgtacatgctcggaggcctggccatataggagggtgggtgatgctgaaatcaccccccatcttaagtaattactttctggagtaatcaggtggaaatccatagacaaatgaaacattcaaaaaaaaaaa

SEQ ID NO: 427813 - DNA, 1301 bp, Homo sapiens
gcggaagccgggattcgccctccggggagcgattggtcctcgggaggggcggggaggtggacgcgggtaccggcggtcgtcgggtcggcagcctttggtcagttggcagcggcaagcgcgctgcggttccggtggcgccatgtcgttctgcagcttcttcgggggcgaggttttccagaatcactttgaacctggcgtttacgtgtgtgccaagtgtggctatgagctgttctccagccgctcgaagtatgcacactcgtctccatggccggcgttcaccgagaccattcacgccgacagcgtggccaagcgtccggagcacaatagatctgaagccttgaaggtgtcctgtggcaagtgtggcaatgggttgggccacgagttcctgaacgacggccccaagccggggcagtcccgattctgaatattcagcagctcgctgaagtttgtccctaaaggcaaagaaacttctgcctcccagggtcactaggcgggcagcccacacccaccccagacggccaccacactgaggccacacgttgtcccaaggccccggctctgaacaagaccttttcgtttcttggaaaagagactcatttgctgatggttcatgccttctgctgggacaggcctgggctgtgcagccacactgtcggctgacttagccccctgctcactctaggtgcctccaggaggtgagccctgggtgcagctggtctctgaatgacgttacaccctcaccttcttttcctggccctgtctctggactctcccctgtgaggcccaattccaagacagactctcgtcctcaccgaagcttaggcccacatctcccaggctgcttaggagacagaatggaaacggaggccgcccctgccagccgccctggccctggtcactgcatgatccgctctggtcaaacccttccaggccagccagagtggggatggtctgtgacctgctgggaaggcaggctgatggggcacacccttggcctctcgtccacgaggggagaaacctaaaccctgtttcacaatctgtgcggaagtagcttgcctcacttctgcttaggaaagcggctgttgctccataactctaaccagcacagggctgaggcctgcagtgcacacctgcagggaggcccttcccaaggtgtggtgactgtgccttactgtacatgctcggaggcctggccatataggagggtgggtgatgctgaaatcaccccccatcttaagtaattactttctggagtaatcaggtggaaatccatagacaaatgaaacattcaaaaaaaaaaa

SEQ ID NO: 427814 - DNA, 1701 bp, Homo sapiens
cggcatgtacaattaaggcacaggtcaccacaccttgggaaggggcccttcccccctggaaagggtttgttgccattgcaaaggccctcaaggcccctgtcctgttaagacttatgggagcaacaagcccgctttcctaagccagaaattgaggccaacctaccttcccgcacagaattggtgaaacaggttataggtttcttcccctcgtgacgagagcccaagtggtgtgccccatcagcctaggcgcttcccaagcaggtcacaagaccatccccactctggctggcctggaaggctttgaccagagcggatcatgcagtgacccagggaccagggcggctggcaggggcggcctccgtttccattctgtctcctaagcaagcactgggagatgtgggcctaagcattcggtgaggagcgagagtctgtcattggaattgggcctcacaggggagagtacacagagacaggcgaccaggaaaagaagcgatgagggctagtaacgtgcacctcagagacacagctcgcacccagggctcacctcctggaggcacctagagtgagacagggggctaagtcagccgacagtgtggctgcacagcccaggcctgtcccagcagaaggcatgaaccatcagcaaatgaccgtgctcttattcacaagaaacgaaaaggtcttatgttccagagccggggcccttgggagtgtcctgatgtttcaaccactgcgccctgccttcctgtctcgacgcccagggttccaactccaaggtggaatgcgcaaagaaacttctgcctcccagggtcactaggcgggcagcccacacccaccccagacggccaccacactgaggccacacgttggccattccaccttggagttggaaccctgggcgtcgagacaggaaggcagggcgcagtggttgaaacatcaggacactcccaaggccccggctctgaacaagaccttttcgtttcttggaaaagagactcatttgctgatggttcatgccttctgctgggacaggcctgggctgtgcagccacactgtcggctgacttagccccctgctcactctaggtgcctccaggaggtgagccctgggtgcagctggtctctgaatgacgttacaccctcaccttcttttcctggccctgtctctggactctcccctgtgaggcccaattccaagacagactctcgtcctcaccgaagcttaggcccacatctcccaggctgcttaggagacagaatggaaacggaggccgcccctgccagccgccctggccctggtcactgcatgatccgctctggtcaaacccttccaggccagccagagtggggatggtctgtgacctgctgggaaggcaggctgatggggcacacccttggcctctcgtccacgaggggagaaacctaaaccctgtttcacaatctgtgcggaagtagcttgcctcacttctgcttaggaaagcggctgttgctccataactctaaccagcacagggctgaggcctgcagtgcacacctgcagggaggcccttcccaaggtgtggtgactgtgccttactgtacatgctcggaggcctggccatataggagggtgggtgatgctgaaatcaccccccatcttaagtaattactttctggagtaatcaggtggaaatccatagacaaatgaaacattcaaaaaaaaaaa

SEQ ID NO: 427815 - DNA, 1199 bp, Homo sapiens
cctggggaaggagcacagcctaccctcggaacgggggcagcgctgtctttgcctgggttggtggatttgggagcttgaccccggaaaggcgggagctgatgactccacatttgcctctccttccaccacaggcgtttacgtgtgtgccaagtgtggctatgagctgttctccagccgctcgaagtatgcacactcgtctccatggccggcgttcaccgagaccattcacgccgacagcgtggccaagcgtccggagcacaatagatctgaagccttgaaggcaaagaaacttctgcctcccagggtcactaggcgggcagcccacacccaccccagacggccaccacactgaggccacacgttggccattccaccttggagttggaaccctgggcgtcgagacaggaaggcagggcgcagtggttgaaacatcaggacactcccaaggccccggctctgaacaagaccttttcgtttcttggaaaagagactcatttgctgatggttcatgccttctgctgggacaggcctgggctgtgcagccacactgtcggctgacttagccccctgctcactctaggtgcctccaggaggtgagccctgggtgcagctggtctctgaatgacgttacaccctcaccttcttttcctggccctgtctctggactctcccctgtgaggcccaattccaagacagactctcgtcctcaccgaagcttaggcccacatctcccaggctgcttaggagacagaatggaaacggaggccgcccctgccagccgccctggccctggtcactgcatgatccgctctggtcaaacccttccaggccagccagagtggggatggtctgtgacctgctgggaaggcaggctgatggggcacacccttggcctctcgtccacgaggggagaaacctaaaccctgtttcacaatctgtgcggaagtagcttgcctcacttctgcttaggaaagcggctgttgctccataactctaaccagcacagggctgaggcctgcagtgcacacctgcagggaggcccttcccaaggtgtggtgactgtgccttactgtacatgctcggaggcctggccatataggagggtgggtgatgctgaaatcaccccccatcttaagtaattactttctggagtaatcaggtggaaatccatagacaaatgaaacattcaaaaaaaaaaa

SEQ ID NO: 427816 - DNA, 1199 bp, Homo sapiens
gcggaagccgggattcgccctccggggagcgattggtcctcgggaggggcggggaggtggacgcgggtaccggcggtcgtcgggtcggcagcctttggtcagttggcagcggcaagcgcgctgcggttccggtggcgccatgtcgttctgcagcttcttcgggggcgaggttttccagaatcactttgaacctggcgtttacgtgtgtgccaagtgtggctatgagctgttctccagccgctcgaagtatgcacactcgtctccatggccggcgttcaccgagaccattcacgccgacagcgtggccaagcgtccggagcacaatagatctgaagccttgaaggtgtcctgtggcaagtgtggcaatgggttgggccacgagttcctgaacgacggccccaagccggggcagtcccgattctgaatattcagcagctcgctgaagtttgtccctaaaggcaaagaaacttctgcctcccagggtcactaggcgggcagcccacacccaccccagacggccaccacactgaggccacacgttggccattccaccttggagttggaaccctgctcactctaggtgcctccaggaggtgagccctgggtgcagctggtctctgaatgacgttacaccctcaccttcttttcctggccctgtctctggactctcccctgtgaggcccaattccaagacagactctcgtcctcaccgaagcttaggcccacatctcccaggctgcttaggagacagaatggaaacggaggccgcccctgccagccgccctggccctggtcactgcatgatccgctctggtcaaacccttccaggccagccagagtggggatggtctgtgacctgctgggaaggcaggctgatggggcacacccttggcctctcgtccacgaggggagaaacctaaaccctgtttcacaatctgtgcggaagtagcttgcctcacttctgcttaggaaagcggctgttgctccataactctaaccagcacagggctgaggcctgcagtgcacacctgcagggaggcccttcccaaggtgtggtgactgtgccttactgtacatgctcggaggcctggccatataggagggtgggtgatgctgaaatcaccccccatcttaagtaattactttctggagtaatcaggtggaaatccatagacaaatgaaacattcaaaaaaaaaaa

SEQ ID NO: 427817 - DNA, 993 bp, Homo sapiens
gacagcgtgaatcggtctcgcgtgaacgccggccatcgcagacgagtgtgcatacttcgagcggctggagaacagctcatagccacacttggcacacacgtaaacgccaggttcacaacagatctgaagccttgaaggtgtcctgtggcaagtgtggcaatgggttgggccacgagttcctgaacgacggccccaagccggggcagtcccgattctgaatattcagcagctcgctgaagtttgtccctaaaggcaaagaaacttctgcctcccagggtcactaggcgggcagcccacacccaccccagacggccaccacactgaggccacacgttggccattccaccttggagttggaaccctgctcactctaggtgcctccaggaggtgagccctgggtgcagctggtctctgaatgacgttacaccctcaccttcttttcctggccctgtctctggactctcccctgtgaggcccaattccaagacagactctcgtcctcaccgaagcttaggcccacatctcccaggctgcttaggagacagaatggaaacggaggccgcccctgccagccgccctggccctggtcactgcatgatccgctctggtcaaacccttccaggccagccagagtggggatggtctgtgacctgctgggaaggcaggctgatggggcacacccttggcctctcgtccacgaggggagaaacctaaaccctgtttcacaatctgtgcggaagtagcttgcctcacttctgcttaggaaagcggctgttgctccataactctaaccagcacagggctgaggcctgcagtgcacacctgcagggaggcccttcccaaggtgtggtgactgtgccttactgtacatgctcggaggcctggccatataggagggtgggtgatgctgaaatcaccccccatcttaagtaattactttctggagtaatcaggtggaaatccatagacaaatgaaacattcaaaaaaaaaaa

SEQ ID NO: 427818 - DNA, 3000 bp, Homo sapiens
cagtccgttcgactgagcctccccaggattacaggcgtgaaccagcacgcccggtggagactcaattataaggggctcacagataacatctaattcttacagaggagtaaactgaggcacaagtaagcaggagagccgtgattagaaacctaggtctaactcacagcccgtgagctttcctccaagccccgaggcttccccttaaaaaagccagcaaggggcgagactcggagggcagaacccacggagggcggaacccacagaggacagagcccgcgctcgcgagcacggccttgtccgaccccccgtgccgccggaggagcaagtctgtcttggaatgaatgatcgtcggaacggagcttgatcaaaccactcagcagtaggcgtcgcccactttcttattggttggttttggttctcaagagtaggaaagttaggtagtccgcgaggggtctgcgagctttgcggagcctcgcccccgagcgcgcggtttccctgccgctcagtcgaacggaatcctaggcgcggatctcgcgtttccggccggaaggcttctccagcctttcccggaagctgcgctcgctacccgggtaacgggtcccggctgtggaagctcccgcggcgccgcgatggacctcgaggagtcggaagagtttaaagaacgctgtactcagtgtgctgctgtctcatggggtcttactgatgaaggcaaatattattgcacttcttgccacaatgttacagagagatatcaggaagttacaaacactgatcttattcctaatacccaaataaaagccctcaaccgggggcttaaaaaaaaaaacaatactgaaaaaggctgggattggtatgtgtgtgaaggtttccagtatattctttatcaacaagcagaagccttaaagaaccttggagtaggcccagagttaaagaacgatgttttacataatttttggaagcgctaccttcagaagagcaagcaggcatattgtaagaacccagtttataccactggaaggaaacctacggtattagaagataatctaagtcattcagactgggctagtgagcctgagctgctaagtgatgtcagctgtcctccttttcttgaaagtggagcggagtctcagtctgacatccacactcgaaaacctttccccgtcagcaaagcatcacaatcagaaacgtctgtctgctctggatctctggatggagttgaatactcacaacgaaaggagaagggaatcgtgaagatgaccatgccacagacacttgccttctgttatctgtccttactttggcagagagaagcaataacactttcagatcttttgaggtttgttgaagaggaccatattccttacataaatgcttttcagcattttccagaacagatgaaattatatggacgtgacagaggaatctttggtatagagtcttggcctgactacgaggacatctataaaaaaacaatagaagttggaacatttttagatttgcctcgttttccagacataactgaagactgctatcttcatcccaacatactgtgtatgaaatacttgatggaagtcaacctccctgatgaaatgcatagcttaacttgccacgtggtaaaaatgactggaatgggagaagtggattttctgacatttgatcctatagctaaaatggcaaaagctgttaagtacgatgtacaagctgtagctatcattgtggtggtattgaaactgctctttctattggatgacagtttcgagtggtctttgtctaatcttgctgaaaagcataatgaaaagaacaaaaaagataagccatggtttgatttcagaaagtggtaccaaattatgaagaaagcttttgatgagaaaaaacaaaaatgggaagaagcaagggccaagtacctgtggaaaagtgaaaagccactctactactcatttgtcgacaaaccagtagcatataaaaaaagagaaatggtggtgaatctacagaaacaatttagcacactggtcgagtcaacagcaactgctggaaaaaaaagcccttcaagttttcagttcaactggactgaagaggacactgatagaacgtgtttccatggacacagccttcagggagtcctgaaagagaaaggccaatcactgctgactaagaattcattatattggcttagtacacagaaattctgcagatggtaataatgcttttagaaaaagtcacatataattgaagtagttgactgtataagagccagataggttttttgttggaattagaagctggtgagcttaaagtcacgaaaatcagaattatacattgagtcttgtgtaggagttctaggaaagctggtaaaaatcaagaaagaggatacagggcaattagcacaaactatcccctctagctaaattaacctgcagtgtggcaggcaagcaatagaagtggctgtaaatgctgatcaggagaatgtgctgtattttttagtacatatcacttctctgagtcagttacctttatcatgtctttctacctcttaatacttccttaagtatttcctaaaaataaggatattctcttaagtgaccacagtacagttatcaaactcaggaaacttaatactgatacgatacctttatctcacccacagtccatattccaattttctcattagacccccagtgtccttttatagcaggatcaagttcaggagtaggtatggcattgattgattttatctcttcggtctcctttaatctgattgtccctcagcctttctttgtctttcatgacattgagctgtatttttcagaaatgtcagtgatgttacacaatgtttctgagtatggttgtgatggttcctcatgtttagattcaggttctgcatccctggccaaaacaagtgccgtgtcctcctcagggtatcatttctcagggtatggcgtctgtagactggggcggggggcggggggtccatttgcccctcaggtgttaatagtgatcacc

SEQ ID NO: 427819 - DNA, 1036 bp, Homo sapiens
cagtccgttcgactgagcctccccaggattacaggcgtgaaccagcacgcccggtggagactcaattataaggggctcacagataacatctaattcttacagaggagtaaactgaggcacaagtaagcaggagagccgtgattagaaacctaggtctaactcacagcccgtgagctttcctccaagccccgaggcttccccttaaaaaagccagcaaggggcgagactcggagggcagaacccacggagggcggaacccacagaggacagagcccgcgctcgcgagcacggccttgtccgaccccccgtgccgccggaggagcaagtctgtcttggaatgaatgatcgtcggaacggagcttgatcaaaccactcagcagtaggcgtcgcccactttcttattggttggttttggttctcaagagtaggaaagttaggtagtccgcgaggggtctgcgagctttgcggagcctcgcccccgagcgcgcggtttccctgccgctcagtcgaacggaatcctaggcgcggatctcgcgtttccggccggaaggcttctccagcctttcccggaagctgcgctcgctacccgggtaacgggtcccggctgtggaagctcccgcggcgccgcgatggacctcgaggagtcggaagagtttaaagaacgctgtactcagtgtgctgctgtctcatggggtcttactgatgaaggcaaatattattgcacttcttgccacaatgttacagagagatatcaggaagttacaaacactgatcttattcctaatacccaaataaaagccctcaaccgggggcttaaaaaaaaaaacaatactgaaaaaggctgggattggtatgtgtgtgaaggtttccagtatattctttatcaacaagcagaagccttaaagaaccttggagtaggcccagagttaaaggaacgatgttttacataatttttggaagcgctaccttcctaccggtttagaacataatctgccattcagactgggctagggaccctgacctgctaccgatgtcc

SEQ ID NO: 427820 - DNA, 620 bp, Homo sapiens
ccgcatgcgcgcgcggctttggtaaagaggctggagtttctggctcggcgaggggcaggggtctcgctatgttgtccagactggtattgaactcctgggctcaggcgatcttcctgcctcagcctcgcaaagtgctgggattataggggtgatcccccgccctcggccaaatggcacacgctttgatggaagagtttaaagaacgctgtactcagtgtgctgctgtctcatggggtcttactgatgaaggcaaatattattgcacttcttgccacaatgttacagagagatatcaggaagttacaaacactgatcttattcctaatacccaaataaaagccctcaaccgggggcttaaaaaaaaaaacaatactgaaaaaggctgggattggtatgtgtgtgaaggtttccagtatattctttatcaacaagcagaagccttaaagaaccttggagtaggcccagagttaaagggaatgtcctgtgtgttattcacaatttgagaacaaaatcgtttggtgtatgtacataacgtccatcaggacttgagttccacagaatgcactttggacagcgatatgctaaaccagtcgttcacctgagtgcatcagaatcacctg

SEQ ID NO: 427821 - DNA, 635 bp, Homo sapiens
atatacaggatgctcagccagcacaaagctgtggtgagattgggcccaagtctccgactccagattccaaaccacattaaaaaaaaaaaaatcacctgcagactgcctatagctttaacagtctctgtctccccttcttcacatccttccggtggagaaaagttggtgaatattaagtaaatttgattcaatagactttttattttttggtaaagatgatggggtcttgctatgctgctcaggatggtcttgaactcgtgacctcaggtgatcctcccacctctgtctcccaaagtgctggagtacagtggtgtgaccttggctcactgcagctttgactccctggctcaaatgctcctcctgagcctgactagctgagaccacaggcatgtgccatcatatccagctaaattttttattttttgtagagacagaggtctcagtatgttgcctaggctagtcttgaaattctcggctcaagtgatcctcccacctcagcctcccaaagtgctgggattacaggtatgagccaccacgcctggctgactacaacttttaatattttttaatttttgcaactttttttttttttttgagacagagtctcactctgtcgcccaggctggagtgcagtg

SEQ ID NO: 427822 - DNA, 3617 bp, Homo sapiens
cagtccgttcgactgagcctccccaggattacaggcgtgaaccagcacgcccggtggagactcaattataaggggctcacagataacatctaattcttacagaggagtaaactgaggcacaagtaagcaggagagccgtgattagaaacctaggtctaactcacagcccgtgagctttcctccaagccccgaggcttccccttaaaaaagccagcaaggggcgagactcggagggcagaacccacggagggcggaacccacagaggacagagcccgcgctcgcgagcacggccttgtccgaccccccgtgccgccggaggagcaagtctgtcttggaatgaatgatcgtcggaacggagcttgatcaaaccactcagcagtaggcgtcgcccactttcttattggttggttttggttctcaagagtaggaaagttaggtagtccgcgaggggtctgcgagctttgcggagcctcgcccccgagcgcgcggtttccctgccgctcagtcgaacggaatcctaggcgcggatctcgcgtttccggccggaaggcttctccagcctttcccggaagctgcgctcgctacccgggtaacgggtcccggctgtggaagctcccgcggcgccgcgatggacctcgaggagtcggaagagtttaaagaacgctgtactcagtgtgctgctgtctcatggggtcttactgatgaaggcaaatattattgcacttcttgccacaatgttacagagagatatcaggaagttacaaacactgatcttattcctaatacccaaataaaagccctcaaccgggggcttaaaaaaaaaaacaatactgaaaaaggctgggattggtatgtgtgtgaaggtttccagtatattctttatcaacaagcagaagccttaaagaaccttggagtaggcccagagttaaagaacgatgttttacataatttttggaagcgctaccttcagaagagcaagcaggcatattgtaagaacccagtttataccactggaaggaaacctacggtattagaagataatctaagtcattcagactgggctagtgagcctgagctgctaagtgatgtcagctgtcctccttttcttgaaagtggagcggagtctcagtctgacatccacactcgaaaacctttccccgtcagcaaagcatcacaatcagaaacgtctgtctgctctggatctctggatggagttgaatactcacaacgaaaggagaagggaatcgtgaagatgaccatgccacagacacttgccttctgttatctgtccttactttggcagagagaagcaataacactttcagatcttttgaggtttgttgaagaggaccatattccttacataaatgcttttcagcattttccagaacagatgaaattatatggacgtgacagaggaatctttggtatagagtcttggcctgactacgaggacatctataaaaaaacaatagaagttggaacatttttagatttgcctcgttttccagacataactgaagactgctatcttcatcccaacatactgtgtatgaaatacttgatggaagtcaacctccctgatgaaatgcatagcttaacttgccacgtggtaaaaatgactggaatgggagaagtggattttctgacatttgatcctatagctaaaatggcaaaagctgttaagtacgatgtacaagctgtagctatcattgtggtggtattgaaactgctctttctattggatgacagtttcgagtggtctttgtctaatcttgctgaaaagcataatgaaaagaacaaaaaagataagccatggtttgatttcagaaagtggtaccaaattatgaagaaagcttttgatgagaaaaaacaaaaatgggaagaagcaagggccaagtacctgtggaaaagtgaaaagccactctactactcatttgtcgacaaaccagtagcatataaaaaaagagaaatggtggtgaatctacagaaacaatttagcacactggtcgagtcaacagcaactgctggaaaaaaaagcccttcaagttttcagttcaactggactgaagaggacactgatagaacgtgtttccatggacacagccttcagggagtcctgaaagagaaaggccaatcactgctgactaagaattcattatattggcttagtacacagaaattctgcagatgctattgtacacatgtgacaacctatgaagaatcaaattattctctgagttatcagtttatactaaatctcttctccttcctgctcagaataaagacttcccttctccatgaagaagtgagcttagttgagaagaaactttttgagaaaaaatacagtgtaaaaagaaagaaatcaagatccaagaaagtgagacgacattgagaaaatgaaatagaaactttctggaaaaatattttaatagtgataataacatcagattttaatataacattccagagaattgtggaaaatactgcatatatatgtatagactctgacacatatttacatatatatcaagtgtgcttagaaaaatgtatattatgatggggtcttgctatgctgctcaggatggtcttgaactcgtgacctcaggtgatcctcccacctctgtctcccaaagtgctggaattacagatgtgagccactgcgcccagcctggtttggtagtttcttaaaagtgaaaattagacctaccatgtgacccagccattccactactaggtgtctacccaagaaaaataaaagcatgtttccacacaaagacttgtatacaaatattcatagcaactttatttggaatagcaaaaaaaagggaaaacaacccaaacagccatcagcaggtgaatggataaacacatggtggatatccatacaatgaaacactgctcagctgtgaaaaaggaacaaactattgaaacaatatccctgttcaggagcaggatttggagaatataagaagcatatcttttataatttaaaaacttgctttctaagatttgaactgaaagatcttttttgaagatgagtgtcatggaattgacatgatttgaagtgttatggcacttcctttgaataaaaaaatcaaagttgctaacaagttccatgtacttaaaaatattgggacagagcgctcaaagctatgaaaagttttgggccacccatgaatatgagataagattaacaagagaggagaaggaagtgaaaaatatggctttccatgcatttccaattgtatgaattaccattgaaggctagtgatgaaatgttactctctaggagtcagtgttttcacatctaaaaatggtatcagtcatagaaaaagcttatctgtctactgccaaaaagggaagagggtaatagcacgtattgagcacctactgtatattcagatgaggtcctgccatacgaaattcagtccccactgttctgggggccatgcaatcgtctttagataataggtgtggggctaggggttccgctgtgaagttaccttccttcccagggtgctcagccagcacaaagctgtggtgagatttgggtccaggtctcagactccagattccaaaccacatttaaaaaaataaaatcatcacctgcaga

SEQ ID NO: 427823 - DNA, 3792 bp, Homo sapiens
cagtccgttcgactgagcctccccaggattacaggcgtgaaccagcacgcccggtggagactcaattataaggggctcacagataacatctaattcttacagaggagtaaactgaggcacaagtaagcaggagagccgtgattagaaacctaggtctaactcacagcccgtgagctttcctccaagccccgaggcttccccttaaaaaagccagcaaggggcgagactcggagggcagaacccacggagggcggaacccacagaggacagagcccgcgctcgcgagcacggccttgtccgaccccccgtgccgccggaggagcaagtctgtcttggaatgaatgatcgtcggaacggagcttgatcaaaccactcagcagtaggcgtcgcccactttcttattggttggttttggttctcaagagtaggaaagttaggtagtccgcgaggggtctgcgagctttgcggagcctcgcccccgagcgcgcggtttccctgccgctcagtcgaacggaatcctaggcgcggatctcgcgtttccggccggaaggcttctccagcctttcccggaagctgcgctcgctacccgggtaacgggtcccggctgtggaagctcccgcggcgccgcgatggacctcgaggagtcggaagagtttaaagaacgctgtactcagtgtgctgctgtctcatggggtcttactgatgaaggcaaatattattgcacttcttgccacaatgttacagagagatatcaggaagttacaaacactgatcttattcctaatacccaaataaaagccctcaaccgggggcttaaaaaaaaaaacaatactgaaaaaggctgggattggtatgtgtgtgaaggtttccagtatattctttatcaacaagcagaagccttaaagaaccttggagtaggcccagagttaaagaacgatgttttacataatttttggaagcgctaccttcagaagagcaagcaggcatattgtaagaacccagtttataccactggaaggaaacctacggtattagaagataatctaagtcattcagactgggctagtgagcctgagctgctaagtgatgtcagctgtcctccttttcttgaaagtggagcggagtctcagtctgacatccacactcgaaaacctttccccgtcagcaaagcatcacaatcagaaacgtctgtctgctctggatctctggatggagttgaatactcacaacgaaaggagaagggaatcgtgaagatgaccatgccacagacacttgccttctgttatctgtccttactttggcagagagaagcaataacactttcagatcttttgaggtttgttgaagaggaccatattccttacataaatgcttttcagcattttccagaacagatgaaattatatggacgtgacagaggaatctttggtatagagtcttggcctgactacgaggacatctataaaaaaacaatagaagttggaacatttttagatttgcctcgttttccagacataactgaagactgctatcttcatcccaacatactgtgtatgaaatacttgatggaagtcaacctccctgatgaaatgcatagcttaacttgccacgtggtaaaaatgactggaatgggagaagtggattttctgacatttgatcctatagctaaaatggcaaaagctgttaagtacgatgtacaagctgtagctatcattgtggtggtattgaaactgctctttctattggatgacagtttcgagtggtctttgtctaatcttgctgaaaagcataatgaaaagaacaaaaaagataagccatggtttgatttcagaaagtggtaccaaattatgaagaaagcttttgatgagaaaaaacaaaaatgggaagaagcaagggccaagtacctgtggaaaagtgaaaagccactctactactcatttgtcgacaaaccagtagcatataaaaaaagagaaatggtggtgaatctacagaaacaatttagcacactggtcgagtcaacagcaactgctggaaaaaaaagcccttcaagttttcagttcaactggactgaagaggacactgatagaacgtgtttccatggacacagccttcagggagtcctgaaagagaaaggccaatcactgctgactaagaattcattatattggcttagtacacagaaattctgcagatgctattgtacacatgtgacaacctatgaagaatcaaattattctctgagttatcagtttatactaaatctcttctccttcctgctcagaataaagacttcccttctccatgaagaagtgagcttagttgagaagaaactttttgagaaaaaatacagtgtaaaaagaaagaaatcaagatccaagaaagtgagacgacattgagaaaatgaaatagaaactttctggaaaaatattttaatagtgataataacatcagattttaatataacattccagagaattgtggaaaatactgcatatatatgtatagactctgacacatatttacatatatatcaagtgtgcttagaaaaatgtatattatgatggggtcttgctatgctgctcaggatggtcttgaactcgtgacctcaggtgatcctcccacctctgtctcccaaagtgctggaattacagatgtgagccactgcgcccagcctggtttggtagtttcttaaaagtgaaaattagacctaccatgtgacccagccattccactactaggtgtctacccaagaaaaataaaagcatgtttccacacaaagacttgtatacaaatattcatagcaactttatttggaatagcaaaaaaaagggaaaacaacccaaacagccatcagcaggtgaatggataaacacatggtggatatccatacaatgaaacactgctcagctgtgaaaaaggaacaaactattgaaacaatatccctgttcaggagcaggatttggagaatataagaagcatatcttttataatttaaaaacttgctttctaagatttgaactgaaagatcttttttgaagatgagtgtcatggaattgacatgatttgaagtgttatggcacttcctttgaataaaaaaatcaaagttgctaacaagttccatgtacttaaaaatattgggacagagcgctcaaagctatgaaaagttttgggccacccatgaatatgagataagattaacaagagaggagaaggaagtgaaaaatatggctttccatgcatttccaattgtatgaattaccattgaaggctagtgatgaaatgttactctctaggagtcagtgttttcacatctaaaaatggtatcagtcatagaaaaagcttatctgtctactgccaaaaagggaagagggtaatagcacgtattgagcacctactgtatattcagatgaggtcctgccatacgaaattcagtccccactgttctgggggccatgcaatcgtctttagataataggtgtggggctaggggttccgctgtgaagttaccttccttcccagggtgctcagccagcacaaagctgtggtgagatttgggtccaggtctcagactccagattccaaaccacatttaaaaaaataaaatcatcacctgcagactgcctatagctttgacagtctctgtgtctccctttcgtttgcatccttcgggtggagaaaggtttatgaatattttagtaaatttgattcaaaagacatttcttgattatcacattggttctcaaagtgtggtccctggaccagtgacatcagcattacctgggcactcattag

SEQ ID NO: 427824 - DNA, 2920 bp, Homo sapiens
cagtccgttcgactgagcctccccaggattacaggcgtgaaccagcacgcccggtggagactcaattataaggggctcacagataacatctaattcttacagaggagtaaactgaggcacaagtaagcaggagagccgtgattagaaacctaggtctaactcacagcccgtgagctttcctccaagccccgaggcttccccttaaaaaagccagcaaggggcgagactcggagggcagaacccacggagggcggaacccacagaggacagagcccgcgctcgcgagcacggccttgtccgaccccccgtgccgccggaggagcaagtctgtcttggaatgaatgatcgtcggaacggagcttgatcaaaccactcagcagtaggcgtcgcccactttcttattggttggttttggttctcaagagtaggaaagttaggtagtccgcgaggggtctgcgagctttgcggagcctcgcccccgagcgcgcggtttccctgccgctcagtcgaacggaatcctaggcgcggatctcgcgtttccggccggaaggcttctccagcctttcccggaagctgcgctcgctacccgggtaacgggtcccggctgtggaagctcccgcggcgccgcgatggacctcgaggagtcggaagagtttaaagaacgctgtactcagtgtgctgctgtctcatggggtcttactgatgaaggcaaatattattgcacttcttgccacaatgttacagagagatatcaggaagttacaaacactgatcttattcctaatacccaaataaaagccctcaaccgggggcttaaaaaaaaaaacaatactgaaaaaggctgggattggtatgtgtgtgaaggtttccagtatattctttatcaacaagcagaagccttaaagaaccttggagtaggcccagagttaaagaacgatgttttacataatttttggaagcgctaccttcagaagagcaagcaggcatattgtaagaacccagtttataccactggaaggaaacctacggtattagaagataatctaagtcattcagactgggctagtgagcctgagctgctaagtgatgtcagctgtcctccttttcttgaaagtggagcggagtctcagtctgacatccacactcgaaaacctttccccgtcagcaaagcatcacaatcagaaacgtctgtctgctctggatctctggatggagttgaatactcacaacgaaaggagaagggaatcgtgaagatgaccatgccacagacacttgccttctgttatctgtccttactttggcagagagaagcaataacactttcagatcttttgaggtttgttgaagaggaccatattccttacataaatgcttttcagcattttccagaacagatgaaattatatggacgtgacagaggaatctttggtatagagtcttggcctgactacgaggacatctataaaaaaacaatagaagttggaacatttttagatttgcctcgttttccagacataactgaagactgctatcttcatcccaacatactgtgtatgaaatacttgatggaagtcaacctccctgatgaaatgcatagcttaacttgccacgtggtaaaaatgactggaatgggagaagtggattttctgacatttgatcctatagctaaaatggcaaaagctgttaagtacgatgtacaagctgtagctatcattgtggtggtattgaaactgctctttctattggatgacagtttcgagtggtctttgtctaatcttgctgaaaagcataatgaaaagaacaaaaaagataagccatggtttgatttcagaaagtggtaccaaattatgaagaaagcttttgatgagaaaaaacaaaaatgggaagaagcaagggccaagtacctgtggaaaagtgaaaagccactctactactcatttgtcgacaaaccagtagcatataaaaaaagagaaatggtggtgaatctacagaaacaatttagcacactggtcgagtcaacagcaactgctggaaaaaaaagcccttcaagttttcagttcaactggactgaagaggacactgatagaacgtgtttccatggacacagccttcagggagtcctgaaagagaaaggccaatcactgctgactaagaattcattatattggcttagtacacagaaattctgcagatgctattgtacacatgtgacaacctatgaagaatcaaattattctctgagttatcagtttatactaaatctcttctccttcctgctcagaataaagacttcccttctccatgaagaagtgagcttagttgagaagaaactttttgagaaaaaatacagtgtaaaaagaaagaaatcaagatccaagaaagtgagacgacattgagaaaatgaaatagaaactttctggaaaaatattttaatagtgataataacatcagattttaatataacattccagagaattgtggaaaatactgcatatatatgtatagactctgacacatatttacatatatatcaagtgtgcttagaaaaatgtatattgtaaagcaggtgagcttcatttgattttatttttcagagtatgaacattctaagagaaagttaaaacaatagcaaattgtataattgtatccagaaatgtatactcatcgtattttaaagctaaatttattttttaaactagatcccttcattattctttatgccccagagtaaatcccagatggatcaaagatctaaacataatctttcatatgtaaaaatataaaagtattagtagaaaacaaatatgaatgctttgatgatcttggaatggcaaagtcaatttttgcagcatatggtggacaaagaaataatttctttaatgtatcaatagctcttgcaaagcaaaaggaaaaaagcaaa

SEQ ID NO: 427825 - DNA, 3463 bp, Homo sapiens
cagtccgttcgactgagcctccccaggattacaggcgtgaaccagcacgcccggtggagactcaattataaggggctcacagataacatctaattcttacagaggagtaaactgaggcacaagtaagcaggagagccgtgattagaaacctaggtctaactcacagcccgtgagctttcctccaagccccgaggcttccccttaaaaaagccagcaaggggcgagactcggagggcagaacccacggagggcggaacccacagaggacagagcccgcgctcgcgagcacggccttgtccgaccccccgtgccgccggaggagcaagtctgtcttggaatgaatgatcgtcggaacggagcttgatcaaaccactcagcagtaggcgtcgcccactttcttattggttggttttggttctcaagagtaggaaagttaggtagtccgcgaggggtctgcgagctttgcggagcctcgcccccgagcgcgcggtttccctgccgctcagtcgaacggaatcctaggcgcggatctcgcgtttccggccggaaggcttctccagcctttcccggaagctgcgctcgctacccgggtaacgggtcccggctgtggaagctcccgcggcgccgcgatggacctcgaggagtcggaagagtttaaagaacgctgtactcagtgtgctgctgtctcatggggtcttactgatgaaggcaaatattattgcacttcttgccacaatgttacagagagatatcaggaagttacaaacactgatcttattcctaatacccaaataaaagccctcaaccgggggcttaaaaaaaaaaacaatactgaaaaaggctgggattggtatgtgtgtgaaggtttccagtatattctttatcaacaagcagaagccttaaagaaccttggagtaggcccagagttaaagaacgatgttttacataatttttggaagcgctaccttcagaagagcaagcaggcatattgtaagaacccagtttataccactggaaggaaacctacggtattagaagataatctaagtcattcagactgggctagtgagcctgagctgctaagtgatgtcagctgtcctccttttcttgaaagtggagcggagtctcagtctgacatccacactcgaaaacctttccccgtcagcaaagcatcacaatcaggtttgttgaagaggaccatattccttacataaatgcttttcagcattttccagaacagatgaaattatatggacgtgacagaggaatctttggtatagagtcttggcctgactacgaggacatctataaaaaaacaatagaagttggaacatttttagatttgcctcgttttccagacataactgaagactgctatcttcatcccaacatactgtgtatgaaatacttgatggaagtcaacctccctgatgaaatgcatagcttaacttgccacgtggtaaaaatgactggaatgggagaagtggattttctgacatttgatcctatagctaaaatggcaaaagctgttaagtacgatgtacaagctgtagctatcattgtggtggtattgaaactgctctttctattggatgacagtttcgagtggtctttgtctaatcttgctgaaaagcataatgaaaagaacaaaaaagataagccatggtttgatttcagaaagtggtaccaaattatgaagaaagcttttgatgagaaaaaacaaaaatgggaagaagcaagggccaagtacctgtggaaaagtgaaaagccactctactactcatttgtcgacaaaccagtagcatataaaaaaagagaaatggtggtgaatctacagaaacaatttagcacactggtcgagtcaacagcaactgctggaaaaaaaagcccttcaagttttcagttcaactggactgaagaggacactgatagaacgtgtttccatggacacagccttcagggagtcctgaaagagaaaggccaatcactgctgactaagaattcattatattggcttagtacacagaaattctgcagatgctattgtacacatgtgacaacctatgaagaatcaaattattctctgagttatcagtttatactaaatctcttctccttcctgctcagaataaagacttcccttctccatgaagaagtgagcttagttgagaagaaactttttgagaaaaaatacagtgtaaaaagaaagaaatcaagatccaagaaagtgagacgacattgagaaaatgaaatagaaactttctggaaaaatattttaatagtgataataacatcagattttaatataacattccagagaattgtggaaaatactgcatatatatgtatagactctgacacatatttacatatatatcaagtgtgcttagaaaaatgtatattatgatggggtcttgctatgctgctcaggatggtcttgaactcgtgacctcaggtgatcctcccacctctgtctcccaaagtgctggaattacagatgtgagccactgcgcccagcctggtttggtagtttcttaaaagtgaaaattagacctaccatgtgacccagccattccactactaggtgtctacccaagaaaaataaaagcatgtttccacacaaagacttgtatacaaatattcatagcaactttatttggaatagcaaaaaaaagggaaaacaacccaaacagccatcagcaggtgaatggataaacacatggtggatatccatacaatgaaacactgctcagctgtgaaaaaggaacaaactattgaaacaatatccctgttcaggagcaggatttggagaatataagaagcatatcttttataatttaaaaacttgctttctaagatttgaactgaaagatcttttttgaagatgagtgtcatggaattgacatgatttgaagtgttatggcacttcctttgaataaaaaaatcaaagttgctaacaagttccatgtacttaaaaatattgggacagagcgctcaaagctatgaaaagttttgggccacccatgaatatgagataagattaacaagagaggagaaggaagtgaaaaatatggctttccatgcatttccaattgtatgaattaccattgaaggctagtgatgaaatgttactctctaggagtcagtgttttcacatctaaaaatggtatcagtcatagaaaaagcttatctgtctactgccaaaaagggaagagggtaatagcacgtattgagcacctactgtatattcagatgaggtcctgccatacgaaattcagtccccactgttctgggggccatgcaatcgtctttagataataggtgtggggctaggggttccgctgtgaagttaccttccttcccagggtgctcagccagcacaaagctgtggtgagatttgggtccaggtctcagactccagattccaaaccacatttaaaaaaataaaatcatcacctgcaga

SEQ ID NO: 427826 - DNA, 2371 bp, Homo sapiens
cagtccgttcgactgagcctccccaggattacaggcgtgaaccagcacgcccggtggagactcaattataaggggctcacagataacatctaattcttacagaggagtaaactgaggcacaagtaagcaggagagccgtgattagaaacctaggtctaactcacagcccgtgagctttcctccaagccccgaggcttccccttaaaaaagccagcaaggggcgagactcggagggcagaacccacggagggcggaacccacagaggacagagcccgcgctcgcgagcacggccttgtccgaccccccgtgccgccggaggagcaagtctgtcttggaatgaatgatcgtcggaacggagcttgatcaaaccactcagcagtaggcgtcgcccactttcttattggttggttttggttctcaagagtaggaaagttaggtagtccgcgaggggtctgcgagctttgcggagcctcgcccccgagcgcgcggtttccctgccgctcagtcgaacggaatcctaggcgcggatctcgcgtttccggccggaaggcttctccagcctttcccggaagctgcgctcgctacccgggtaacgggtcccggctgtggaagctcccgcggcgccgcgatggacctcgaggagtcggaagagtttaaagaacgctgtactcagtgtgctgctgtctcatggggtcttactgatgaaggcaaatattattgcacttcttgccacaatgttacagagagatatcaggaagttacaaacactgatcttattcctaatacccaaataaaagccctcaaccgggggcttaaaaaaaaaaacaatactgaaaaaggctgggattggtatgtgtgtgaaggtttccagtatattctttatcaacaagcagaagccttaaagaaccttggagtaggcccagagttaaagaacgatgttttacataatttttggaagcgctaccttcagaagagcaagcaggcatattgtaagaacccagtttataccactggaaggaaacctacggtattagaagataatctaagtcattcagactgggctagtgagcctgagctgctaagtgatgtcagctgtcctccttttcttgaaagtggagcggagtctcagtctgacatccacactcgaaaacctttccccgtcagcaaagcatcacaatcagaaacgtctgtctgctctggatctctggatggagttgaatactcacaacgaaaggagaagggaatcgtgaagatgaccatgccacagacacttgccttctgttatctgtccttactttggcagagagaagcaataacactttcagatcttttgaggtttgttgaagaggaccatattccttacataaatgcttttcagcattttccagaacagatgaaattatatggacgtgacagaggaatctttggtatagagtcttggcctgactacgaggacatctataaaaaaacaatagaagttggaacatttttagatttgcctcgttttccagacataactgaagactgctatcttcatcccaacatactgtgtatgaaatacttgatggaagtcaacctccctgatgaaatgcatagcttaacttgccacgtggtaaaaatgactggaatgggagaagtggattttctgacatttgatcctatagctaaaatggcaaaagctgttaagtacgatgtacaagctgtagctatcattgtggtggtattgaaactgctctttctattggatgacagtttcgagtggtctttgtctaatcttgctgaaaagcataatgaaaagaacaaaaaagataagccatggtttgatttcagaaagtggtaccaaattatgaagaaagcttttgatgagaaaaaacaaaaatgggaagaagcaagggccaagtatgttctccttcctggtttagatgcacctgccttacttctgtgtctgttactttacatttgaaagctgaagcttcatcagtatacacttatctacattgtgacttttttttctggaaatattagccctacactctaattaacttttctcttttttacattactattaatcaaagtttagatttgatgtggatttcaccagtgtttttattaatgtcctctttctgttccatgatccaatgcaggataccacagtatactttttataatttaactttttataatttgcatgagacttgcctatatttctaatactcctccctcttcccctttctcaaatttagtcatttctcatctatgcttcccaatattaaaaagattacaaatgttaccttgcaacatatgtaattggaatgttcccccaaaataaagatccctgtgaaaattaaaacaaaggaaagcagatagcaa

SEQ ID NO: 427827 - DNA, 1334 bp, Homo sapiens
ccgtgcccagcctaatttttgtaactttttataatgagacttacacagtgatttaaattatatacaggatgctcagccagcacaaagctgtggtgagatttgggcccaagtctccgactccagattccaaaccacattaaaaaaaaaaaatcacctgcagactgcctatagctttaacagtctctgtctccccttcttcacatccttccggtggagaaaagtttgtgaatattaagtaaatttgattcaatagacattttatttttttgtaaagatgatggggtcttgctatgctgctcaggatggtcttgaactcgtgacctcaggtgatcctcccacctctgtctcccaaagtgctggaattacagatgtgagccactgcgcccagcctggtttggtagtttcttaaaagtgaaaattagacctaccatgtgacccagccattccactactaggtgtctacccaagaaaaataaaagcatgtttccacacaaagacttgtatacaaatattcatagcaactttatttggaatagcaaaaaaaagggaaaacaacccaaacagccatcagcaggtgaatggataaacacatggtggatatccatacaatgaaacactgctcagctgtgaaaaaggaacaaactattgaaacaatatccctgttcaggagcaggatttggagaatataagaagcatatcttttataatttaaaaacttgctttctaagatttgaactgaaagatcttttttgaagatgagtgtcatggaattgacatgatttgaagtgttatggcacttcctttgaataaaaaaatcaaagttgctaacaagttccatgtacttaaaaatattgggacagagcgctcaaagctatgaaaagttttgggccacccatgaatatgagataagattaacaagagaggagaaggaagtgaaaaatatggctttccatgcatttccaattgtatgaattaccattgaaggctagtgatgaaatgttactctctaggagtcagtgttttcacatctaaaaatggtatcagtcatagaaaaagcttatctgtctactgccaaaaagggaagagggtaatagcacgtattgagcacctactgtatattcagatgaggtcctgccatacgaaattcagtccccactgttctgggggccatgcaatcgtctttagataataggtgtggggctaggggttccgctgtgaagttaccttccttcccagggtgctcagccagcacaaagctgtggtgagatttgggtccaggtctcagactccagattccaaaccacatttaaaaaaataaaatcatcacctgcaga

SEQ ID NO: 427828 - DNA, 1799 bp, Homo sapiens
aaatctcagatagtgcttcagacaatgtgtttatgtccgtttcatctccgtcctgctccagctgtttctttaccttgtacaggtacctgtggaaaagtgaaaagccactctactactcatttgtcgacaaaccagtagcatataaaaaaagagaaatggtggtgaatctacagaaacaatttagcacactggtcgagtcaacagcaactgctggaaaaaaaagcccttcaagttttcagttcaactggactgaagaggacactgatagaacgtgtttccatggacacagccttcagggagtcctgaaagagaaaggccaatcactgctgactaagaattcattatattggcttagtacacagaaattctgcagatgctattgtacacatgtgacaacctatgaagaatcaaattattctctgagttatcagtttatactaaatctcttctccttcctgctcagaataaagacttcccttctccatgaagaagtgagcttagttgagaagaaactttttgagaaaaaatacagtgtaaaaagaaagaaatcaagatccaagaaagtgagacgacattgagaaaatgaaatagaaactttctggaaaaatattttaatagtgataataacatcagattttaatataacattccagagaattgtggaaaatactgcatatatatgtatagactctgacacatatttacatatatatcaagtgtgcttagaaaaatgtatattatgatggggtcttgctatgctgctcaggatggtcttgaactcgtgacctcaggtgatcctcccacctctgtctcccaaagtgctggaattacagatgtgagccactgcgcccagcctggtttggtagtttcttaaaagtgaaaattagacctaccatgtgacccagccattccactactaggtgtctacccaagaaaaataaaagcatgtttccacacaaagacttgtatacaaatattcatagcaactttatttggaatagcaaaaaaaagggaaaacaacccaaacagccatcagcaggtgaatggataaacacatggtggatatccatacaatgaaacactgctcagctgtgaaaaaggaacaaactattgaaacaatatccctgttcaggagcaggatttggagaatataagaagcatatcttttataatttaaaaacttgctttctaagatttgaactgaaagatcttttttgaagatgagtgtcatggaattgacatgatttgaagtgttatggcacttcctttgaataaaaaaatcaaagttgctaacaagttccatgtacttaaaaatattgggacagagcgctcaaagctatgaaaagttttgggccacccatgaatatgagataagattaacaagagaggagaaggaagtgaaaaatatggctttccatgcatttccaattgtatgaattaccattgaaggctagtgatgaaatgttactctctaggagtcagtgttttcacatctaaaaatggtatcagtcatagaaaaagcttatctgtctactgccaaaaagggaagagggtaatagcacgtattgagcacctactgtatattcagatgaggtcctgccatacgaaattcagtccccactgttctgggggccatgcaatcgtctttagataataggtgtggggctaggggttccgctgtgaagttaccttccttcccagggtgctcagccagcacaaagctgtggtgagatttgggtccaggtctcagactccagattccaaaccacatttaaaaaaataaaatcatcacctgcaga

SEQ ID NO: 427829 - DNA, 1772 bp, Homo sapiens
ttttatttgtttatatgtaatgaatatgaaataaaaaaaaataccaacaaacaaggtacctgtggaaaagtgaaaagccactctactactcatttgtcgacaaaccagtagcatataaaaaaagagaaatggtggtgaatctacagaaacaatttagcacactggtcgagtcaacagcaactgctggaaaaaaaagcccttcaagttttcagttcaactggactgaagaggacactgatagaacgtgtttccatggacacagccttcagggagtcctgaaagagaaaggccaatcactgctgactaagaattcattatattggcttagtacacagaaattctgcagatgctattgtacacatgtgacaacctatgaagaatcaaattattctctgagttatcagtttatactaaatctcttctccttcctgctcagaataaagacttcccttctccatgaagaagtgagcttagttgagaagaaactttttgagaaaaaatacagtgtaaaaagaaagaaatcaagatccaagaaagtgagacgacattgagaaaatgaaatagaaactttctggaaaaatattttaatagtgataataacatcagattttaatataacattccagagaattgtggaaaatactgcatatatatgtatagactctgacacatatttacatatatatcaagtgtgcttagaaaaatgtatattatgatggggtcttgctatgctgctcaggatggtcttgaactcgtgacctcaggtgatcctcccacctctgtctcccaaagtgctggaattacagatgtgagccactgcgcccagcctggtttggtagtttcttaaaagtgaaaattagacctaccatgtgacccagccattccactactaggtgtctacccaagaaaaataaaagcatgtttccacacaaagacttgtatacaaatattcatagcaactttatttggaatagcaaaaaaaagggaaaacaacccaaacagccatcagcaggtgaatggataaacacatggtggatatccatacaatgaaacactgctcagctgtgaaaaaggaacaaactattgaaacaatatccctgttcaggagcaggatttggagaatataagaagcatatcttttataatttaaaaacttgctttctaagatttgaactgaaagatcttttttgaagatgagtgtcatggaattgacatgatttgaagtgttatggcacttcctttgaataaaaaaatcaaagttgctaacaagttccatgtacttaaaaatattgggacagagcgctcaaagctatgaaaagttttgggccacccatgaatatgagataagattaacaagagaggagaaggaagtgaaaaatatggctttccatgcatttccaattgtatgaattaccattgaaggctagtgatgaaatgttactctctaggagtcagtgttttcacatctaaaaatggtatcagtcatagaaaaagcttatctgtctactgccaaaaagggaagagggtaatagcacgtattgagcacctactgtatattcagatgaggtcctgccatacgaaattcagtccccactgttctgggggccatgcaatcgtctttagataataggtgtggggctaggggttccgctgtgaagttaccttccttcccagggtgctcagccagcacaaagctgtggtgagatttgggtccaggtctcagactccagattccaaaccacatttaaaaaaataaaatcatcacctgcaga

SEQ ID NO: 427830 - DNA, 1721 bp, Homo sapiens
atcaagtaaattccaggctttatttgtgatttaacattacttgttattttgtttcctttttttctccggttccagaaatggtggtgaatctacagaaacaatttagcacactggtcgagtcaacagcaactgctggaaaaaaaagcccttcaagttttcagttcaactggactgaagaggacactgatagaacgtgtttccatggacacagccttcagggagtcctgaaagagaaaggccaatcactgctgactaagaattcattatattggcttagtacacagaaattctgcagatgctattgtacacatgtgacaacctatgaagaatcaaattattctctgagttatcagtttatactaaatctcttctccttcctgctcagaataaagacttcccttctccatgaagaagtgagcttagttgagaagaaactttttgagaaaaaatacagtgtaaaaagaaagaaatcaagatccaagaaagtgagacgacattgagaaaatgaaatagaaactttctggaaaaatattttaatagtgataataacatcagattttaatataacattccagagaattgtggaaaatactgcatatatatgtatagactctgacacatatttacatatatatcaagtgtgcttagaaaaatgtatattatgatggggtcttgctatgctgctcaggatggtcttgaactcgtgacctcaggtgatcctcccacctctgtctcccaaagtgctggaattacagatgtgagccactgcgcccagcctggtttggtagtttcttaaaagtgaaaattagacctaccatgtgacccagccattccactactaggtgtctacccaagaaaaataaaagcatgtttccacacaaagacttgtatacaaatattcatagcaactttatttggaatagcaaaaaaaagggaaaacaacccaaacagccatcagcaggtgaatggataaacacatggtggatatccatacaatgaaacactgctcagctgtgaaaaaggaacaaactattgaaacaatatccctgttcaggagcaggatttggagaatataagaagcatatcttttataatttaaaaacttgctttctaagatttgaactgaaagatcttttttgaagatgagtgtcatggaattgacatgatttgaagtgttatggcacttcctttgaataaaaaaatcaaagttgctaacaagttccatgtacttaaaaatattgggacagagcgctcaaagctatgaaaagttttgggccacccatgaatatgagataagattaacaagagaggagaaggaagtgaaaaatatggctttccatgcatttccaattgtatgaattaccattgaaggctagtgatgaaatgttactctctaggagtcagtgttttcacatctaaaaatggtatcagtcatagaaaaagcttatctgtctactgccaaaaagggaagagggtaatagcacgtattgagcacctactgtatattcagatgaggtcctgccatacgaaattcagtccccactgttctgggggccatgcaatcgtctttagataataggtgtggggctaggggttccgctgtgaagttaccttccttcccagggtgctcagccagcacaaagctgtggtgagatttgggtccaggtctcagactccagattccaaaccacatttaaaaaaataaaatcatcacctgcaga

SEQ ID NO: 427831 - DNA, 1487 bp, Homo sapiens
  misc_feature (55)..(55): n is a, c, g, or t
ttgtaaataataattaatcgagtgggttattgattgggtcttggtgtataatatnttattttttctattgtacacatgtgacaacctatgaagaatcaaattattctctgagttatcagtttatactaaatctcttctccttcctgctcagaataaagacttcccttctccatgaagaagtgagcttagttgagaagaaactttttgagaaaaaatacagtgtaaaaagaaagaaatcaagatccaagaaagtgagacgacattgagaaaatgaaatagaaactttctggaaaaatattttaatagtgataataacatcagattttaatataacattccagagaattgtggaaaatactgcatatatatgtatagactctgacacatatttacatatatatcaagtgtgcttagaaaaatgtatattatgatggggtcttgctatgctgctcaggatggtcttgaactcgtgacctcaggtgatcctcccacctctgtctcccaaagtgctggaattacagatgtgagccactgcgcccagcctggtttggtagtttcttaaaagtgaaaattagacctaccatgtgacccagccattccactactaggtgtctacccaagaaaaataaaagcatgtttccacacaaagacttgtatacaaatattcatagcaactttatttggaatagcaaaaaaaagggaaaacaacccaaacagccatcagcaggtgaatggataaacacatggtggatatccatacaatgaaacactgctcagctgtgaaaaaggaacaaactattgaaacaatatccctgttcaggagcaggatttggagaatataagaagcatatcttttataatttaaaaacttgctttctaagatttgaactgaaagatcttttttgaagatgagtgtcatggaattgacatgatttgaagtgttatggcacttcctttgaataaaaaaatcaaagttgctaacaagttccatgtacttaaaaatattgggacagagcgctcaaagctatgaaaagttttgggccacccatgaatatgagataagattaacaagagaggagaaggaagtgaaaaatatggctttccatgcatttccaattgtatgaattaccattgaaggctagtgatgaaatgttactctctaggagtcagtgttttcacatctaaaaatggtatcagtcatagaaaaagcttatctgtctactgccaaaaagggaagagggtaatagcacgtattgagcacctactgtatattcagatgaggtcctgccatacgaaattcagtccccactgttctgggggccatgcaatcgtctttagataataggtgtggggctaggggttccgctgtgaagttaccttccttcccagggtgctcagccagcacaaagctgtggtgagatttgggtccaggtctcagactccagattccaaaccacatttaaaaaaataaaatcatcacctgcaga

SEQ ID NO: 427832 - DNA, 786 bp, Homo sapiens
  misc_feature (51)..(51): n is a, c, g, or t
  misc_feature (53)..(53): n is a, c, g, or t
atattattattttttaagtagataatataagagtatttaaaaaatgtaaananatgtttgctattgtacacatgtgacaacctatgaagaatcaaattattctctgagttatcagtttatactaaatctcttctccttcctgctcagaataaagacttcccttctccatgaagaagtgagcttagttgagaagaaactttttgagaaaaaatacagtgtaaaaagaaagaaatcaagatccaagaaagtgagacgacattgagaaaatgaaatagaaactttctggaaaaatattttaatagtgataataacatcagattttaatataacattccagagaattgtggaaaatactgcatatatatgtatagactctgacacatatttacatatatatcaagtgtgcttagaaaaatgtatattgtaaagcaggtgagcttcatttgattttatttttcagagtatgaacattctaagagaaagttaaaacaatagcaaattgtataattgtatccagaaatgtatactcatcgtattttaaagctaaatttattttttaaactagatcccttcattattctttatgccccagagtaaatcccagatggatcaaagatctaaacataatctttcatatgtaaaaatataaaagtattagtagaaaacaaatatgaatgctttgatgatcttggaatggcaaagtcaatttttgcagcatatggtggacaaagaaataatttctttaatgtatcaatagctcttgcaaagcaaaaggaaaaaagcaaa

SEQ ID NO: 427833 - DNA, 375 bp, Homo sapiens
ctcttctgtggctgtatggtctacaaggtcatattggattaaacaattatcatattgaccagttgaaaagatttttagttaggcatggaaagagactgccttcgccagagaataatggagaataatccctgtatggagtgaaagagtgaggagtgagtttttatactttactgcattcagttctgttgtctctctaatgtctacatcttgatcacacactcacaccaactgcccagtgcagtcaattaatgaaaactcagatgaacaatgtatattattatagtgtggtttatttggttaataatcttggattttatttctttcagataagccatggtttgatttcagaaagtggtaccaaattatgaagaaagc

SEQ ID NO: 427834 - DNA, 2277 bp, Homo sapiens
tgagttacacctccctacccccggtctagtgggctgtggcagtgctcccttctcagtggctcagctgagaacaaatgatgccctccaatgcacaggcaggctgggttaggccctgtggatccacagtggggacctagaggcaagttagtttggtggggaaaagccagaggtctaggtcatctattccctgcctggtttattttcaagccaaaactgagcagtctagctttctatgggatggagaagccaggtatccagcattggagactgatggagaatgagaggaagaaagagaggaggaccttgcagctgtggaaggctccttggagcctcctttgtgggagggtatcagttctggttctgccagagcctcagccctggtagcagaacctcagggctgcccctctccccaaactcctcccagcaaggctgaccctttgagcttactccttaaacagtattaaccctgccacactcatgggcattggcaccttggttcccctgccccactttgtcctgtgacaggtccattgctggcagtggacaggtgaaatactcactccagcctacttccggctctgactctcactcctcaaggggaagggtccgttagaaagtggcccatcccatggtacatggtctcttcttgaccacactaggactcttaggtagaaattagccttcccctttttatggatcattacaaagtgacggtatcacctgtggagagaatgtcctcttccctgctggctgccctgcccatactgtgcagggtgtggtggggtgcagggtgtggtggggtgggccacagttgtgtcctaggtctggagaaaagcttgcagactctgcctttggcaggattttctgcagttagccccgtccagagcagaacgaagggtatttcctagcctatttcctgggcaggctcctcaaatccagggatgaactactttctgcagtggccagccctccttttgattttattgtggccccaattccagggctttgggggttacagagaatcaggcttccggtgggagtagattgttttccatctataggtggagaaaattccaggaggagaatattgtctggcttccccgttctctctgggcaattgtttccttggttctctctccaactccatgttgtcttagtctcccagcaccccttcaggccttccatgtgggcccctagaccacactacccaccttcacacttgcattccacaactcagtccagtggccagcttgttgatgcctccataattctcagccagagcaaatccttgattggcccaccaggtcttgctgctccagaagttgccttgtgggcattccctggcaccatttcctctctgggtcctatacgttcccaagtgcaggaggtcctgggggtatgcctgtgtgcctggcaacatccagcattgtgtttctgctccatctaggtgtcccatttctccagttgcccctcataaggcatcaaacctccagcaaaggaaggcaacaacccatggcctgaccacgggatctacaggttcagatctcaccagggatagcccagacttcaattcttgcttttttgggtatcagggccccaatcccttagtggccagggactcaaagtttggaataatcccagccctgccaagcattaagggtgctggtggggagtgtttgctggctgttcatgaacctctggtgtcctgggcctctctccactagacatggcagcatctctgagttacagattgcaatgtgttgccctgcatggttgaactgcttcggacatctgctaggcatcccatgtgccctgtcccctcttcaatgccagtgagtcacaatggcctatgcttattcacagcaataatacctagggagtccccatgaagcccttttgtcctggtccctcactctgcgtgggtctcctggggaggcagctgctgagtgggtcagttcatgagaacctgcatttatgaagccctgggctgtgtaggcatcaccctgggatgcagacaggttagaggcccagcccttaggggagccatggcagggagagtgccttccaccctgaggccacccagacctggaggagatgcaggccccagctctgctaaagggcctttgaggtgggtgggactgtctcccagttgggcagctcttgagaaggacacacgaccggtttgtgcgcccattgcctgctctgtgtctccgttggtccctctgtctcttccttttcacatttgtgcacataaaatatactggtgtttgtgttcca

SEQ ID NO: 427835 - DNA, 1888 bp, Homo sapiens
tgagttacacctccctacccccggtctagtgggctgtggcagtgctcccttctcagtggctcagctgagaacaaatgatgccctccaatgcacaggcaggctgggttaggccctgtggatccacagtggggacctagaggcaagttagtttggtggggaaaagccagaggtctaggtcatctattccctgcctggtttattttcaagccaaaactgagcagtctagctttctatgggatggagaagccaggtatccagcattggagactgatggagaatgagaggaagaaagagaggaggaccttgcagctgtggaaggctccttggagcctcctttgtgggagggtatcagttctggttctgccagagcctcagccctggtagcagaacctcagggctgcccctctccccaaactcctcccagcaaggctgaccctttgagcttactccttaaacagtattaaccctgccacactcatgggcattggcaccttggttcccctgccccactttgtcctgtgacaggtccattgctggcagtggacaggtgaaatactcactccagcctacttccggctctgactctcactcctcaaggggaagggtccgttagaaagtggcccatcccatggtacatggtctcttcttgaccacactaggactcttaggtagaaattagccttcccctttttatggatcattacaaagtgacggtatcacctgtggagagaatgtcctcttccctgctggctgccctgcccatactgtgcagggtgtggtggggtgcagggtgtggtggggtgggccacagttgtgtcctaggtctggagaaaagcttgcagactctgcctttggcaggattttctgcagttagccccgtccagagcagaacgaagggtatttcctagcctatttcctgggcaggctcctcaaatccagggatgaactactttctgcagtggccagccctccttttgattttattgtggccccaattccagggctttgggggttacagagaatcaggcttccggtgggagtagattgttttccatctataggtggagaaaattccaggaggagaatattgtctggcttccccgttctctctgggcaattgtttccttggttctctctccaactccatgttgtcttagtctcccagcaccccttcaggccttccatgtgggcccctagaccacactacccaccttcacacttgcattccacaactcagtccagtggccagcttgttgatgcctccataattctcagccagagcaaatccttgattggcccaccaggtcttgctgctccagaagttgccttgtgggcattccctggcaccatttcctctctgggtcctatacgttcccaagtgcaggaggtcctgggggtatgcctgtgtgcctggcaacatccagcattgtgtttctgctccatctaggtgtcccatttctccagttgcccctcataaggcatcaaacctccagcaaaggaaggcaacaacccatggcctgaccacgggatctacaggttcagatctcaccagggatagcccagacttcaattcttgcttttttgggtatcagggccccaatcccttagtggccagggactcaaagtttggaataatcccagccccttaggggagccatggcagggagagtgccttccaccctgaggccacccagacctggaggagatgcaggccccagctctgctaaagggcctttgaggtgggtgggactgtctcccagttgggcagctcttgagaaggacacacgaccggtttgtgcgcccattgcctgctctgtgtctccgttggtccctctgtctcttccttttcacatttgtgcacataaaatatactggtgtttgtgttcca

SEQ ID NO: 427836 - DNA, 751 bp, Homo sapiens
ggtgggaggcaaggcctgacctccctccctccctccgatctggatttagttgagctttggctggttccattaggcaatattcaggtgttgggggatggggtgtggaggcagcagagggacattgggaagggtccatggatcgcggcccagttcaggggttggtaccaggaggcctgtggctgagcagcgatggactatgtagttgactttggaagcagcaggccctgtcctggccaagggacaaatgagaacctgcatttatgaagccctgggctgtgtaggcatcaccctgggatgcagacaggttagaggcccagcccttaggggagccatggcagggagagtgccttccaccctgaggccacccagacctggaggagatgcaggccccagctctgctaaagggcctttgaggtgggtgggactgtctcccagttgggcagctcttgagaaggacacacgaccggtttgtgcgcccattgcctgctctgtgtctccgttggtccctctgtctcttccttttcacatttgtgcacataaaatatactggtgtttgtgttccaaaaaaaaaaaaaaaaaaaaaaaaaagagaaaaaagagggagaaaaaaaagggggaggaagaagtgaggacgagaaggggaagtggtaaaagaggatagctgagacacatgtgttgaaagaagagataaagggggtggagaggaactggatggagataatgaaaaggaggaaagatgtgcgtgggatag

SEQ ID NO: 427837 - DNA, 1610 bp, Homo sapiens
gagcgggagccagccctggagacggcgctcctagccgcacctgcgcctggcaggcggccggctctgccagcccctacccacggccccggccccgcaccgggacacatggaagctgccagccccccagccaaggatcagctgagccctagggctgatgcttgcctacgttgctgagaatggcactgaggcccagccaacaaaggttaacccaggacactcctggacagtgatcctgatgtctgttgtgagctgcacactcaagggtgtgataaccagccccagtcggcgccatggcgtctgccgagcccctgacggcgctgtcccgctggtacctgtatgccatccacggctacttctgcgaggtgatgttcacagcggcctgggagttcgtggtgaacttgaactggaagttccctggggtcacgagcgtgtgggccctcttcatctacggcacctccatcctcatcgtggagcgcatgtacctgcggctgcgcggccgctgcccgctgctcctgcgctgcctcatctacacgctctggacctacctgtgggagttcaccaccggcttcatcctgcgccagttcaacgcctgcccctgggactactcccagttcgactttgacttcatgggcctcatcaccctggagtacgccgtgccctggttctgcggggccctcatcatggagcagttcatcatccgcaacaccctccgcctccgcttcgacaaggacgctgagcccggggagcccagcggcgccctagccctggccaacggccatgtcaagactgactgagcaggaagcgggtggggggcctggggatctctcatggaactcatggacaaagagaccaagctggtgaggttgccccatccatgcagcaaaagccctgctccggccaagcctcagccctatagggcacacagagccccctaacgtccgcgggggccggtgttggggggccgtggtcaggtgttgggggatggggtgtggaggcagcagagggacattgggaagggtccatggatcgcggcccagttcaggggttggtaccaggaggcctgtggctgagcagcgatggactatgtagttgactttggaagcagcaggccctgtcctggccaagggacaatgagaatggggccgcaggtgggaggcaaggcctgacctccctccctccgatctggatttagttgagctttggctggttccattaggcaatattcaggtgcttgcttgcaaccaatacctccccaggggcctgctgagctgcagccgaggagagactgggcagccaggaggctgcgtggcagcaacgctggtctgcaagggctgggagaccctcccttggctcctctcccctcccccagggccctgcgctgctcccttggccttctggggcccccgtggtgctggattcccaccaaccttgggcttttggaggtttcaatccccgtgtgttcggtggcgtttcccccttttctgtcttgttttcaaagcctttaccactagcggctctttatccacgtcggtcgccacacctgccccaccccagctccctagccagcacaggagctgccggagatgaagccctgagacacccccaaccct

SEQ ID NO: 427838 - DNA, 485 bp, Homo sapiens
ggatcagctgagccctagggctgatgcttgcctacgttgctgagaatggcactgaggcccagccaacaaaggttaacccaggacactcctggacagtgatcctgatgtctgttgtgagctgcacactcaagggtgtgataagtgagtatgttacaagcacccaggggatcaccagcccagcgatcctgcctgctcggcacctcatcagcatgggcacgagtctggaggttctagttctgagtctgttccccatccaaggtcctgtcacagggcaatgggaggggaatgtcaagcaatattgggccatcacatgcgggagccgtcttatggccacatggcctctaaaatccaggccagacccagtgtattagtttgttttcgtgctgctgataaagacatacgtaagagtggaaaatgtatacagaaaaagagggttaattccacgtgtctggggaagcctcacaatcatggtggaaggcaagggg

SEQ ID NO: 427839 - DNA, 1675 bp, Homo sapiens
gagcgggagccagccctggagacggcgctcctagccgcacctgcgcctggcaggcggccggctctgccagcccctacccacggccccggccccgcaccgggcagtgggcagccatgccgagtcatgaaggtggcatgcagggatgggaaatgctgccttaggagggacacatggaagctgccagccccccagccaaggatcagctgagccctagggctgatgcttgcctacgttgctgagaatggcactgaggcccagccaacaaaggttaacccaggacactcctggacagtgatcctgatgtctgttgtgagctgcacactcaagggtgtgataaccagccccagtcggcgccatggcgtctgccgagcccctgacggcgctgtcccgctggtacctgtatgccatccacggctacttctgcgaggtgatgttcacagcggcctgggagttcgtggtgaacttgaactggaagttccctggggtcacgagcgtgtgggccctcttcatctacggcacctccatcctcatcgtggagcgcatgtacctgcggctgcgcggccgctgcccgctgctcctgcgctgcctcatctacacgctctggacctacctgtgggagttcaccaccggcttcatcctgcgccagttcaacgcctgcccctgggactactcccagttcgactttgacttcatgggcctcatcaccctggagtacgccgtgccctggttctgcggggccctcatcatggagcagttcatcatccgcaacaccctccgcctccgcttcgacaaggacgctgagcccggggagcccagcggcgccctagccctggccaacggccatgtcaagactgactgagcaggaagcgggtggggggcctggggatctctcatggaactcatggacaaagagaccaagctggtgaggttgccccatccatgcagcaaaagccctgctccggccaagcctcagccctatagggcacacagagccccctaacgtccgcgggggccggtgttggggggccgtggtcaggtgttgggggatggggtgtggaggcagcagagggacattgggaagggtccatggatcgcggcccagttcaggggttggtaccaggaggcctgtggctgagcagcgatggactatgtagttgactttggaagcagcaggccctgtcctggccaagggacaatgagaatggggccgcaggtgggaggcaaggcctgacctccctccctccgatctggatttagttgagctttggctggttccattaggcaatattcaggtgcttgcttgcaaccaatacctccccaggggcctgctgagctgcagccgaggagagactgggcagccaggaggctgcgtggcagcaacgctggtctgcaagggctgggagaccctcccttggctcctctcccctcccccagggccctgcgctgctcccttggccttctggggcccccgtggtgctggattcccaccaaccttgggcttttggaggtttcaatccccgtgtgttcggtggcgtttcccccttttctgtcttgttttcaaagcctttaccactagcggctctttatccacgtcggtcgccacacctgccccaccccagctccctagccagcacaggagctgccggagatgaagccctgagacacccccaaccct

SEQ ID NO: 427840 - DNA, 287 bp, Homo sapiens
actagatggaaggcatgagagcaatccaataaaattgggaatccgggagccataaaatatagttgattccatctacaaatagggcaattgcttcagagagaataacagctcaggacactcacacaaccagtgattgagctcccgttgtctactagatcttgcagtgctatggagagtgtaaagatgattaagctactctccttagcctcaagcaacttagcatggcagatgggagataacctgaaagctgctgattagaatagaccaagagtgataaggaccttctg

SEQ ID NO: 427841 - DNA, 686 bp, Homo sapiens
caattcagacgcacgtgagggaaatcagatgactggacttgtagatactaacggttctgaagcggaatggcttattcagaagagcataaaggtatgccctgtggtttcatccgccagaattccggcaactccatttccttggactttgagcccagtatagagtaccagtttgtggagcggttggaagagcgctacaaatgtgccttctgccactcggtgcttcacaacccccaccagacaggatgtgggcaccgcttctgccagcactgcatcctgtccctgagagaaattagaagacagtgcaatacatggccatgtagataaagaggtcatcaaatctaaggagggttataaaggagcaagtgtggcaaaaacagagaaattcctcagagttattatgctacgtataggcagcaaaggctcactggatggtaactgccaaaggattatctgatgggaccgagataacagagattgtgggaacacatcatagtcacaacagaatcaagacaaggcaagagccgacaggaaagacaacaaggtgcacaaaacagcgaaaaaacctagaggagcccacaccgagtcataacagaggccaaaaaaataggccaaaaagaaaaaatacggaccacaggggacatgcggaaagtgaaaccaggagacaaacaagaaaagaaagacagaaa

SEQ ID NO: 427842 - DNA, 3981 bp, Homo sapiens
atcagtgcagggatgtgcagatgagtgggctgtggggtgtcctgctcacggtttcatggatgaatggcttattcagaagagcataaaggtatgccctgtggtttcatccgccagaattccggcaactccatttccttggactttgagcccagtatagagtaccagtttgtggagcggttggaagagcgctacaaatgtgccttctgccactcggtgcttcacaacccccaccagacaggatgtgggcaccgcttctgccagcactgcatcctgtccctgagagaattaaacacagtgccaatctgccctgtagataaagaggtcatcaaatctcaggaggtttttaaagacaattgttgcaaaagagaagtcctcaacttatatgtatattgcagcaatgctcctggatgtaatgccaaggttattctgggccggtaccaggatcaccttcagcagtgcttatttcaacctgtgcagtgttctaatgagaagtgccgggagccagtcctacggaaagacctgaaagagcatttgagtgcatcctgtcagtttcgaaaggaaaaatgcctttattgcaaaaaggatgtggtagtcatcaatctacagaatcatgaggaaaacttgtgtcctgaatacccagtattttgtcccaacaattgtgcgaagattattctaaaaactgaggtagatgaacacctggctgtatgtcctgaagctgagcaagactgtccttttaagcactatggctgtgctgtaacggataaacggaggaacctgcagcaacatgagcattcagccttacgggagcacatgcgtttggttttagaaaagaatgtccaattagaagaacagatttctgacttacacaagagcctagaacagaaagaaagtaaaatccagcagctagcagaaactataaagaaacttgaaaaggagttcaagcagtttgcacagttgtttggcaaaaatggaagcttcctcccaaacatccaggtttttgccagtcacattgacaagtcagcttggctagaagctcaagtgcatcaattattacaaatggttaaccagcaacaaaataaatttgacctgagacctttgatggaagcagttgatacagtgaaacagaaaattaccctgctagaaaacaatgatcaaagattagccgttttagaagaggaaactaacaaacatgatacccacattaatattcataaagcacagctgagtaaaaatgaagagcgatttaaactgctggagggtacttgctataatggaaagctcatttggaaggtgacagattacaagatgaagaagagagaggcggtggatgggcacacagtgtccatcttcagccagtccttctacaccagccgctgtggctaccggctctgtgctagagcatacctgaatggggatgggtcagggagggggtcacacctgtccctatactttgtggtcatgcgaggagagtttgactcactgttgcagtggccattcaggcagagggtgaccctgatgcttctggaccagagtggcaaaaagaacattatggagaccttcaaacctgaccccaatagcagcagctttaaaagacctgatggggagatgaacattgcatctggctgtccccgctttgtggctcattctgttttggagaatgccaagaacgcctacattaaagatgacactctgttcttgaaagtggccgtggacttaactgacctggaggatctctagtcactgttatggggtgataagaggacttcttggggccagaactgtggaggagagcacatttgattatcatattgacctggatttagactcaaagcacatttgtatttgcctttttccttaacgtttgaagtcagtttaaaacttctgaagtgctgtctttttacattttactctgtcccagtttgaaacttaaaactcttagaatattctcttattatttatatttttatatttcttgaaagatggtaagtttcttgaagtttttggggcgtttctcttttactggtgcttagcgcagtgtctcgggcactctaaatattgagtgttatggaggacacagaggtagcagaatcccagttgaaaatgttttgatattttattgtttggcctattgattctagacctggccttaagtctgcaaaagccatctttataaggtaggctgttccagttaagtagtgggtgatgtagttacaaagataatatgctcagtttggacctttttttcagttaaatgctaaatatatgaaaattactatacctctaagtattttcatgaaattcaccagcagtttgcaagcacagttttgcaaggctgcataagaactggtgaatggggtaagcattttcattcttcctgctgaagtaaagcagaaagtactgcatagtatatgagatatagccagctagctaaagttcagattttgttaggttcaaccctatgaaaaaaactattttcataggtcaaaaatggtaaaaaattagcagtttcataagattcaaccaaataaatatatatatacacacacacatacatatacacctatatatgtgtgtatacaaacagttcgaatgtattttggtgacagtaataaatcaatgtgaggatggatagaatttagtatatgatagagaaaatgtcataaatggataaaaggaatttacaacttgaggagaaaacctttacaatttcctatgggtgtcagaagtactctcagcgaaaactgatggctaaaacagtatctactattctctgataactttttttttgagacagagtttcattgtcacccaggctggagtacagtggcatgatctcagctcactgcaaactctgcctcccgaattcaagtgattctcctgcctcagcctcctgagtagctgggattacaggcgcccgtcaccacacccaggtaatttttgtatttttagtagagacggagttttgccatgttggccaagctgatctcaaactcctgacctcaagtgatctgcccgcctcggcctcccaaagtgctgagattacaggcatgacccaccgcgtcaagcctctgacaactattgaatttgtaagctgctatgcaaatgggcatttatataaacttgtgatgtttcttgtcagaattctgagtactctgtgaagaacagaaatgatcatattcttatgcatctatctgtatgggtctgaaggtgtatatacaaactgagatgagtccttatgactcttgataagcctgagtttaacaacaacaaaaatgccaagttgtcctgagcccttctgcgttgttatgccacttccctactgctcatatgcacgctggctcccctgggcacgcaaggatgagtatgggccatgggcccctgtagagctgcttacctggtgatgaccatgcaccttacaatttctgaacagttaaccctatagaagcatgctttatatgagtgtcttctgggaagaggaaccttcttaatctcttctgtgggattttcaaaatgctaaagactcacactgcagcaatcatcccagatgattaaattcaaagaaataggttcacaacaggaatatactgaagaactagagtgtcactgctggtgaactgtggcacggttgctcaacacatcacctcggacaaattcaggaagcatttctttagcccacaagtccagacccaggtgctctgtatgtttgtttttaatattcatcatatccaagttcactctgtcttcctgagcagtggaagatcatattgctgtaacttcttttaagtagttgatgtggaaaacattttaaagtgaatttgtcaaaatgctggttttgtgttttatccaacttttgtgcatatatataaagtatgtcatggcatggtttgcttaggagttcagagttccttcatcatcgaaatagtgattaagtgatcccagaacaaggaatactagagtaaaaagcacctctttttcacaaaa

SEQ ID NO: 427843 - DNA, 3175 bp, Homo sapiens
gaagatgtagcctctacccttgaagaactaacataaatgtaaacagatttctgacttacacaagagcctagaacagaaagaaagtaaaatccagcagctagcagaaactataaagaaacttgaaaaggagttcaagcagtttgcacagttgtttggcaaaaatggaagcttcctcccaaacatccaggtttttgccagtcacattgacaagtcagcttggctagaagctcaagtgcatcaattattacaaatggttaaccagcaacaaaataaatttgacctgagacctttgatggaagcagttgatacagtgaaacagaaaattaccctgctagaaaacaatgatcaaagattagccgttttagaagaggaaactaacaaacatgatacccacattaatattcataaagcacagctgagtaaaaatgaagagcgatttaaactgctggagggtacttgctataatggaaagctcatttggaaggtgacagattacaagatgaagaagagagaggcggtggatgggcacacagtgtccatcttcagccagtccttctacaccagccgctgtggctaccggctctgtgctagagcatacctgaatggggatgggtcagggagggggtcacacctgtccctatactttgtggtcatgcgaggagagtttgactcactgttgcagtggccattcaggcagagggtgaccctgatgcttctggaccagagtggcaaaaagaacattatggagaccttcaaacctgaccccaatagcagcagctttaaaagacctgatggggagatgaacattgcatctggctgtccccgctttgtggctcattctgttttggagaatgccaagaacgcctacattaaagatgacactctgttcttgaaagtggccgtggacttaactgacctggaggatctctagtcactgttatggggtgataagaggacttcttggggccagaactgtggaggagagcacatttgattatcatattgacctggatttagactcaaagcacatttgtatttgcctttttccttaacgtttgaagtcagtttaaaacttctgaagtgctgtctttttacattttactctgtcccagtttgaaacttaaaactcttagaatattctcttattatttatatttttatatttcttgaaagatggtaagtttcttgaagtttttggggcgtttctcttttactggtgcttagcgcagtgtctcgggcactctaaatattgagtgttatggaggacacagaggtagcagaatcccagttgaaaatgttttgatattttattgtttggcctattgattctagacctggccttaagtctgcaaaagccatctttataaggtaggctgttccagttaagtagtgggtgatgtagttacaaagataatatgctcagtttggacctttttttcagttaaatgctaaatatatgaaaattactatacctctaagtattttcatgaaattcaccagcagtttgcaagcacagttttgcaaggctgcataagaactggtgaatggggtaagcattttcattcttcctgctgaagtaaagcagaaagtactgcatagtatatgagatatagccagctagctaaagttcagattttgttaggttcaaccctatgaaaaaaactattttcataggtcaaaaatggtaaaaaattagcagtttcataagattcaaccaaataaatatatatatacacacacacatacatatacacctatatatgtgtgtatacaaacagttcgaatgtattttggtgacagtaataaatcaatgtgaggatggatagaatttagtatatgatagagaaaatgtcataaatggataaaaggaatttacaacttgaggagaaaacctttacaatttcctatgggtgtcagaagtactctcagcgaaaactgatggctaaaacagtatctactattctctgataactttttttttgagacagagtttcattgtcacccaggctggagtacagtggcatgatctcagctcactgcaaactctgcctcccgaattcaagtgattctcctgcctcagcctcctgagtagctgggattacaggcgcccgtcaccacacccaggtaatttttgtatttttagtagagacggagttttgccatgttggccaagctgatctcaaactcctgacctcaagtgatctgcccgcctcggcctcccaaagtgctgagattacaggcatgacccaccgcgtcaagcctctgacaactattgaatttgtaagctgctatgcaaatgggcatttatataaacttgtgatgtttcttgtcagaattctgagtactctgtgaagaacagaaatgatcatattcttatgcatctatctgtatgggtctgaaggtgtatatacaaactgagatgagtccttatgactcttgataagcctgagtttaacaacaacaaaaatgccaagttgtcctgagcccttctgcgttgttatgccacttccctactgctcatatgcacgctggctcccctgggcacgcaaggatgagtatgggccatgggcccctgtagagctgcttacctggtgatgaccatgcaccttacaatttctgaacagttaaccctatagaagcatgctttatatgagtgtcttctgggaagaggaaccttcttaatctcttctgtgggattttcaaaatgctaaagactcacactgcagcaatcatcccagatgattaaattcaaagaaataggttcacaacaggaatatactgaagaactagagtgtcactgctggtgaactgtggcacggttgctcaacacatcacctcggacaaattcaggaagcatttctttagcccacaagtccagacccaggtgctctgtatgtttgtttttaatattcatcatatccaagttcactctgtcttcctgagcagtggaagatcatattgctgtaacttcttttaagtagttgatgtggaaaacattttaaagtgaatttgtcaaaatgctggttttgtgttttatccaacttttgtgcatatatataaagtatgtcatggcatggtttgcttaggagttcagagttccttcatcatcgaaatagtgattaagtgatcccagaacaaggaatactagagtaaaaagcacctctttttcacaaaa

SEQ ID NO: 427844 - DNA, 1690 bp, Homo sapiens
gcagcagccgcgcctgcagaccggcctcgcggagcccgcgcgccgagccccacaatggcttattcagaagagcataaaggtatgccctgtggtttcatccgccagaattccggcaactccatttccttggactttgagcccagtatagagtaccagtttgtggagcggttggaagagcgctacaaatgtgccttctgccactcggtgcttcacaacccccaccagacaggatgtgggcaccgcttctgccagcactgcatcctgtccctgagagaattaaacacagtgccaatctgccctgtagataaagaggtcatcaaatctcaggaggtttttaaagacaattgttgcaaaagagaagtcctcaacttatatgtatattgcagcaatgctcctggatgtaatgccaaggttattctgggccggtaccaggatcaccttcagcagtgcttatttcaacctgtgcagtgttctaatgagaagtgccgggagccagtcctacggaaagacctgaaagagcatttgagtgcatcctgtcagtttcgaaaggaaaaatgcctttattgcaaaaaggatgtggtagtcatcaatctacagaatcatgaggaaaacttgtgtcctgaatacccagtattttgtcccaacaattgtgcgaagattattctaaaaactgaggtagatgaacacctggctgtatgtcctgaagctgagcaagactgtccttttaagcactatggctgtgctgtaacggataaacggaggaacctgcagcaacatgagcattcagccttacgggagcacatgcgtttggttttagaaaagaatgtccaattagaagaacagatttctgacttacacaagagcctagaacagaaagaaagtaaaatccagcagctagcagaaactataaagaaacttgaaaaggagttcaagcagtttgcacagttgtttggcaaaaatggaagcttcctcccaaacatccaggtttttgccagtcacattgacaagtcagcttggctagaagctcaagtgcatcaattattacaaatggttaaccagcaacaaaataaatttgacctgagacctttgatggaagcagttgatacagtgaaacagaaaattaccctgctagaaaacaatgatcaaagattagccgttttagaagaggaaactaacaaacatgatacccacattaatattcataaagcacagctgagtaaaaatgaagagcgatttaaactgctggagggtacttgctataatggaaagctcatttggaaggtgacagattacaagatgaagaagagagaggcggtggatgggcacacagtgtccatcttcagccagtccttctacaccagccgctgtggctaccggctctgtgctagagcatacctgaatggggatgggtcagggagggggtcacacctgtccctatactttgtggtcatgcgaggagagtttgactcactgttgcagtggccattcaggcagagggtgaccctgatgcttctggaccagagtggcaaaaagaacattatggagaccttcaaacctgaccccaatagcagcagctttaaaagacctgatggggagatgaacattgcatctggctgtccccgctttgtggctcattctgttttggagaatgccaagaacgcctacattaaagatgacactctgttcttga

SEQ ID NO: 427845 - DNA, 378 bp, Homo sapiens
tagtaggttaggtatagaaaaggctgatgagaaattctgtagatgtggctttttggaaccacctgtgaatatcttcctataattatgtaggaatctaccctgtaaatattttcctagaaataaatatgtagattttttcctagaaatactttcttagctgcaagtgcatgcatattttaactatatgcatgcagttatattcagtgactttatttttcctcacgttcctgttattagatttctgacttacacaagagcctagaacagaaagaaagtaaaatccagcagctagcagaaactataaagaaacttgaaaaggagttcaagcagtttgcacagttgtttggcaaaaatggaagcttcctcccaaacatccag

SEQ ID NO: 427846 - DNA, 494 bp, Homo sapiens
caggaatatactgaagaactagagtgtcactgctggtgaactgtggcacggttgctcaacacatcacctcggacaaattcaggaagcatttctttagcccacaagtccagacccaggtgctctgtatgtttgtttttaatattcatcatatccaagttcactctgtcttcctgagcagtggaagatcatattgctgtaacttcttttaagtagttgatgtggaaaacattttaaagtgaatttgtcaaaatgctggttttgtgttttatccaacttttgtgcatatatataaagtatgtcatggcatggtttgcttaggagttcagagttccttcatcatcgaaatagtgattaagtgatcccagaacaaggaatactagagtaaaaagcacctctttttcacaaaacgagttgtgatttttgttttaaacaaggtggatccatgtaaactatttttcctttttttatgaacaggacagtaatttttcttctgt

SEQ ID NO: 427847 - DNA, 3972 bp, Homo sapiens
gcagcagccgcgcctgcagaccggcctcgcggagcccgcgcgccgagccccacaatggcttattcagaagagcataaaggtatgccctgtggtttcatccgccagaattccggcaactccatttccttggactttgagcccagtatagagtaccagtttgtggagcggttggaagagcgctacaaatgtgccttctgccactcggtgcttcacaacccccaccagacaggatgtgggcaccgcttctgccagcactgcatcctgtccctgagagaattaaacacagtgccaatctgccctgtagataaagaggtcatcaaatctcaggaggtttttaaagacaattgttgcaaaagagaagtcctcaacttatatgtatattgcagcaatgctcctggatgtaatgccaaggttattctgggccggtaccaggatcaccttcagcagtgcttatttcaacctgtgcagtgttctaatgagaagtgccgggagccagtcctacggaaagacctgaaagagcatttgagtgcatcctgtcagtttcgaaaggaaaaatgcctttattgcaaaaaggatgtggtagtcatcaatctacagaatcatgaggaaaacttgtgtcctgaatacccagtattttgtcccaacaattgtgcgaagattattctaaaaactgaggtagatgaacacctggctgtatgtcctgaagctgagcaagactgtccttttaagcactatggctgtgctgtaacggataaacggaggaacctgcagcaacatgagcattcagccttacgggagcacatgcgtttggttttagaaaagaatgtccaattagaagaacagatttctgacttacacaagagcctagaacagaaagaaagtaaaatccagcagctagcagaaactataaagaaacttgaaaaggagttcaagcagtttgcacagttgtttggcaaaaatggaagcttcctcccaaacatccaggtttttgccagtcacattgacaagtcagcttggctagaagctcaagtgcatcaattattacaaatggttaaccagcaacaaaataaatttgacctgagacctttgatggaagcagttgatacagtgaaacagaaaattaccctgctagaaaacaatgatcaaagattagccgttttagaagaggaaactaacaaacatgatacccacattaatattcataaagcacagctgagtaaaaatgaagagcgatttaaactgctggagggtacttgctataatggaaagctcatttggaaggtgacagattacaagatgaagaagagagaggcggtggatgggcacacagtgtccatcttcagccagtccttctacaccagccgctgtggctaccggctctgtgctagagcatacctgaatggggatgggtcagggagggggtcacacctgtccctatactttgtggtcatgcgaggagagtttgactcactgttgcagtggccattcaggcagagggtgaccctgatgcttctggaccagagtggcaaaaagaacattatggagaccttcaaacctgaccccaatagcagcagctttaaaagacctgatggggagatgaacattgcatctggctgtccccgctttgtggctcattctgttttggagaatgccaagaacgcctacattaaagatgacactctgttcttgaaagtggccgtggacttaactgacctggaggatctctagtcactgttatggggtgataagaggacttcttggggccagaactgtggaggagagcacatttgattatcatattgacctggatttagactcaaagcacatttgtatttgcctttttccttaacgtttgaagtcagtttaaaacttctgaagtgctgtctttttacattttactctgtcccagtttgaaacttaaaactcttagaatattctcttattatttatatttttatatttcttgaaagatggtaagtttcttgaagtttttggggcgtttctcttttactggtgcttagcgcagtgtctcgggcactctaaatattgagtgttatggaggacacagaggtagcagaatcccagttgaaaatgttttgatattttattgtttggcctattgattctagacctggccttaagtctgcaaaagccatctttataaggtaggctgttccagttaagtagtgggtgatgtagttacaaagataatatgctcagtttggacctttttttcagttaaatgctaaatatatgaaaattactatacctctaagtattttcatgaaattcaccagcagtttgcaagcacagttttgcaaggctgcataagaactggtgaatggggtaagcattttcattcttcctgctgaagtaaagcagaaagtactgcatagtatatgagatatagccagctagctaaagttcagattttgttaggttcaaccctatgaaaaaaactattttcataggtcaaaaatggtaaaaaattagcagtttcataagattcaaccaaataaatatatatatacacacacacatacatatacacctatatatgtgtgtatacaaacagttcgaatgtattttggtgacagtaataaatcaatgtgaggatggatagaatttagtatatgatagagaaaatgtcataaatggataaaaggaatttacaacttgaggagaaaacctttacaatttcctatgggtgtcagaagtactctcagcgaaaactgatggctaaaacagtatctactattctctgataactttttttttgagacagagtttcattgtcacccaggctggagtacagtggcatgatctcagctcactgcaaactctgcctcccgaattcaagtgattctcctgcctcagcctcctgagtagctgggattacaggcgcccgtcaccacacccaggtaatttttgtatttttagtagagacggagttttgccatgttggccaagctgatctcaaactcctgacctcaagtgatctgcccgcctcggcctcccaaagtgctgagattacaggcatgacccaccgcgtcaagcctctgacaactattgaatttgtaagctgctatgcaaatgggcatttatataaacttgtgatgtttcttgtcagaattctgagtactctgtgaagaacagaaatgatcatattcttatgcatctatctgtatgggtctgaaggtgtatatacaaactgagatgagtccttatgactcttgataagcctgagtttaacaacaacaaaaatgccaagttgtcctgagcccttctgcgttgttatgccacttccctactgctcatatgcacgctggctcccctgggcacgcaaggatgagtatgggccatgggcccctgtagagctgcttacctggtgatgaccatgcaccttacaatttctgaacagttaaccctatagaagcatgctttatatgagtgtcttctgggaagaggaaccttcttaatctcttctgtgggattttcaaaatgctaaagactcacactgcagcaatcatcccagatgattaaattcaaagaaataggttcacaacaggaatatactgaagaactagagtgtcactgctggtgaactgtggcacggttgctcaacacatcacctcggacaaattcaggaagcatttctttagcccacaagtccagacccaggtgctctgtatgtttgtttttaatattcatcatatccaagttcactctgtcttcctgagcagtggaagatcatattgctgtaacttcttttaagtagttgatgtggaaaacattttaaagtgaatttgtcaaaatgctggttttgtgttttatccaacttttgtgcatatatataaagtatgtcatggcatggtttgcttaggagttcagagttccttcatcatcgaaatagtgattaagtgatcccagaacaaggaatactagagtaaaaagcacctctttttcacaaaa

SEQ ID NO: 427848 - DNA, 4047 bp, Homo sapiens
gcagcagccgcgcctgcagaccggcctcgcggagcccgcgcgccgagccccacaatggcttattcagaagagcataaaggtatgccctgtggtttcatccgccagaattccggcaactccatttccttggactttgagcccagtatagagtaccagtttgtggagcggttggaagagcgctacaaatgtgccttctgccactcggtgcttcacaacccccaccagacaggatgtgggcaccgcttctgccagcactgcatcctgtccctgagagaattaaacacagtgccaatctgccctgtagataaagaggtcatcaaatctcaggaggtttttaaagacaattgttgcaaaagagaagtcctcaacttatatgtatattgcagcaatgctcctggatgtaatgccaaggttattctgggccggtaccaggatcaccttcagcagtgcttatttcaacctgtgcagtgttctaatgagaagtgccgggagccagtcctacggaaagacctgaaagagcatttgagtgcatcctgtcagtttcgaaaggaaaaatgcctttattgcaaaaaggatgtggtagtcatcaatctacagaatcatgaggaaaacttgtgtcctgaatacccagtattttgtcccaacaattgtgcgaagattattctaaaaactgaggtagatgaacacctggctgtatgtcctgaagctgagcaagactgtccttttaagcactatggctgtgctgtaacggataaacggaggaacctgcagcaacatgagcattcagccttacgggagcacatgcgtttggttttagaaaagaatgtccaattagaagaacagatttctgacttacacaagagcctagaacagaaagaaagtaaaatccagcagctagcagaaactataaagaaacttgaaaaggagttcaagcagtttgcacagttgtttggcaaaaatggaagcttcctcccaaacatccaggtttttgccagtcacattgacaagtcagcttggctagaagctcaagtgcatcaattattacaaatggttaaccagcaacaaaataaatttgacctgagacctttgatggaagcagttgatacagtgaaacagaaaattaccctgctagaaaacaatgatcaaagattagccgttttagaagaggaaactaacaaacatgatacccacattaatattcataaagcacagctgagtaaaaatgaagagcgatttaaactgctggagggtacttgctataatggaaagctcatttggaaggtgacagattacaagatgaagaagagagaggcggtggatgggcacacagtgtccatcttcagccagtccttctacaccagccgctgtggctaccggctctgtgctagagcatacctgaatggggatgggtcagggagggggtcacacctgtccctatactttgtggtcatgcgaggagagtttgactcactgttgcagtggccattcaggcagagggtgaccctgatgcttctggaccagagtggcaaaaagaacattatggagaccttcaaacctgaccccaatagcagcagctttaaaagacctgatggggagatgaacattgcatctggctgtccccgctttgtggctcattctgttttggagaatgccaagaacgcctacattaaagatgacactctgttcttgaaagtggccgtggacttaactgacctggaggatctctagtcactgttatggggtgataagaggacttcttggggccagaactgtggaggagagcacatttgattatcatattgacctggatttagactcaaagcacatttgtatttgcctttttccttaacgtttgaagtcagtttaaaacttctgaagtgctgtctttttacattttactctgtcccagtttgaaacttaaaactcttagaatattctcttattatttatatttttatatttcttgaaagatggtaagtttcttgaagtttttggggcgtttctcttttactggtgcttagcgcagtgtctcgggcactctaaatattgagtgttatggaggacacagaggtagcagaatcccagttgaaaatgttttgatattttattgtttggcctattgattctagacctggccttaagtctgcaaaagccatctttataaggtaggctgttccagttaagtagtgggtgatgtagttacaaagataatatgctcagtttggacctttttttcagttaaatgctaaatatatgaaaattactatacctctaagtattttcatgaaattcaccagcagtttgcaagcacagttttgcaaggctgcataagaactggtgaatggggtaagcattttcattcttcctgctgaagtaaagcagaaagtactgcatagtatatgagatatagccagctagctaaagttcagattttgttaggttcaaccctatgaaaaaaactattttcataggtcaaaaatggtaaaaaattagcagtttcataagattcaaccaaataaatatatatatacacacacacatacatatacacctatatatgtgtgtatacaaacagttcgaatgtattttggtgacagtaataaatcaatgtgaggatggatagaatttagtatatgatagagaaaatgtcataaatggataaaaggaatttacaacttgaggagaaaacctttacaatttcctatgggtgtcagaagtactctcagcgaaaactgatggctaaaacagtatctactattctctgataactttttttttgagacagagtttcattgtcacccaggctggagtacagtggcatgatctcagctcactgcaaactctgcctcccgaattcaagtgattctcctgcctcagcctcctgagtagctgggattacaggcgcccgtcaccacacccaggtaatttttgtatttttagtagagacggagttttgccatgttggccaagctgatctcaaactcctgacctcaagtgatctgcccgcctcggcctcccaaagtgctgagattacaggcatgacccaccgcgtcaagcctctgacaactattgaatttgtaagctgctatgcaaatgggcatttatataaacttgtgatgtttcttgtcagaattctgagtactctgtgaagaacagaaatgatcatattcttatgcatctatctgtatgggtctgaaggtgtatatacaaactgagatgagtccttatgactcttgataagcctgagtttaacaacaacaaaaatgccaagttgtcctgagcccttctgcgttgttatgccacttccctactgctcatatgcacgctggctcccctgggcacgcaaggatgagtatgggccatgggcccctgtagagctgcttacctggtgatgaccatgcaccttacaatttctgaacagttaaccctatagaagcatgctttatatgagtgtcttctgggaagaggaaccttcttaatctcttctgtgggattttcaaaatgctaaagactcacactgcagcaatcatcccagatgattaaattcaaagaaataggttcacaacaggaatatactgaagaactagagtgtcactgctggtgaactgtggcacggttgctcaacacatcacctcggacaaattcaggaagcatttctttagcccacaagtccagacccaggtgctctgtatgtttgtttttaatattcatcatatccaagttcactctgtcttcctgagcagtggaagatcatattgctgtaacttcttttaagtagttgatgtggaaaacattttaaagtgaatttgtcaaaatgctggttttgtgttttatccaacttttgtgcatatatataaagtatgtcatggcatggtttgcttaggagttcagagttccttcatcatcgaaatagtgattaagtgatcccagaacaaggaatactagagtaaaaagcacctctttttcacaaaaaaggtaaaaaaacttcaggggggccccggtcccaatttgccttataggagtgtattacattcacttgcccgcctt

SEQ ID NO: 427849 - DNA, 3918 bp, Homo sapiens
gcagcagccgcgcctgcagaccggcctcgcggagcccgcgcgccgagccccacaatggcttattcagaagagcataaaggtatgccctgtggtttcatccgccagaattccggcaactccatttccttggactttgagcccagtatagagtaccagtttgtggagcggttggaagagcgctacaaatgtgccttctgccactcggtgcttcacaacccccaccagacaggatgtgggcaccgcttctgccagcactgcatcctgtccctgagagaattaaacacagtgccaatctgccctgtagataaagaggtcatcaaatctcaggaggtttttaaagacaattgttgcaaaagagaagtcctcaacttatatgtatattgcagcaatgctcctggatgtaatgccaaggttattctgggccggtaccaggatcaccttcagcagtgcttatttcaacctgtgcagtgttctaatgagaagtgccgggagccagtcctacggaaagacctgaaagagcatttgagtgcatcctgtcagtttcgaaaggaaaaatgcctttattgcaaaaaggatgtggtagtcatcaatctacagaatcatgaggaaaacttgtgtcctgaatacccagtattttgtcccaacaattgtgcgaagattattctaaaaactgaggtagatgaacacctggctgtatgtcctgaagctgagcaagactgtccttttaagcactatggctgtgctgtaacggataaacggaggaacctgcagcaacatgagcattcagccttacgggagcacatgcgtttggttttagaaaagaatgtccaattagaagaacagatttctgacttacacaagagcctagaacagaaagaaagtaaaatccagcagctagcagaaactataaagaaacttgaaaaggagttcaagcagtttgcacagttgtttggcaaaaatggaagcttcctcccaaacatccaggtttttgccagtcacattgacaagtcagcttggctagaagctcaagtgcatcaattattacaaatggttaaccagcaacaaaataaatttgacctgagacctttgatggaagcagttgatacagtgaaacagaaaattaccctgctagaaaacaatgatcaaagattagccgttttagaagaggaaactaacaaacatgatacccacattaatattcataaagcacagctgagtaaaaatgaagagcgatttaaactgctggagggtacttgctataatggaaagctcatttggaaggtgacagattacaagatgaagaagagagaggcggtggatgggcacacagtgtccatcttcagccagtccttctacaccagccgctgtggctaccggctctgtgctagagcatacctgaatggggatgggtcagggagggggtcacacctgtccctatactttgtggtcatgcgaggagagtttgactcactgttgcagtggccattcaggcagagggtgaccctgatgcttctggaccagagtggcaaaaagaacattatggagaccttcaaacctgaccccaatagcagcagctttaaaagacctgatggggagatgaacattgcatctggctgtccccgctttgtggctcattctgttttggagaatgccaagaacgcctacattaaagatgacactctgttcttgaaagtggccgtggacttaactgacctggaggatctctagtcactgttatggggtgataagaggacttcttggggccagaactgtggaggagagcacatttgattatcatattgacctggatttagactcaaagcacatttgtatttgcctttttccttaacgtttgaagtcagtttaaaacttctgaagtgctgtctttttacattttactctgtcccagtttgaaacttaaaactcttagaatattctcttattatttatatttttatatttcttgaaagatggtaagtttcttgaagtttttggggcgtttctcttttactggtgcttagcgcagtgtctcgggcactctaaatattgagtgttatggaggacacagaggtagcagaatcccagttgaaaatgttttgatattttattgtttggcctattgattctagacctggccttaagtctgcaaaagccatctttataaggtaggctgttccagttaagtagtgggtgatgtagttacaaagataatatgctcagtttggacctttttttcagttaaatgctaaatatatgaaaattactatacctctaagtattttcatgaaattcaccagcagtttgcaagcacagttttgcaaggctgcataagaactggtgaatggggtaagcattttcattcttcctgctgaagtaaagcagaaagtactgcatagtatatgagatatagccagctagctaaagttcagattttgttaggttcaaccctatgaaaaaaactattttcataggtcaaaaatggtaaaaaattagcagtttcataagattcaaccaaataaatatatatatacacacacacatacatatacacctatatatgtgtgtatacaaacagttcgaatgtattttggtgacagtaataaatcaatgtgaggatggatagaatttagtatatgatagagaaaatgtcataaatggataaaaggaatttacaacttgaggagaaaacctttacaatttcctatgggtgtcagaagtactctcagcgaaaactgatggctaaaacagtatctactattctctgataactttttttttgagacagagtttcattgtcacccaggctggagtacagtggcatgatctcagctcactgcaaactctgcctcccgaattcaagtgattctcctgcctcagcctcctgagtagctgggattacaggcgcccgtcaccacacccaggtaatttttgtatttttagtagagacggagttttgccatgttggccaagctgatctcaaactcctgacctcaagtgatctgcccgcctcggcctcccaaagtgctgagattacaggcatgacccaccgcgtcaagcctctgacaactattgaatttgtaagctgctatgcaaatgggcatttatataaacttgtgatgtttcttgtcagaattctgagtactctgtgaagaacagaaatgatcatattcttatgcatctatctgtatgggtctgaaggtgtatatacaaactgagatgagtccttatgactcttgataagcctgagtttaacaacaacaaaaatgccaagttgtcctgagcccttctgcgttgttatgccacttccctactgctcatatgcacgctggctcccctgggcacgcaaggatgagtatgggccatgggcccctgtagagctgcttacctggtgatgaccatgcaccttacaatttctgaacagttaaccctatagaagcatgctttatatgagtgtcttctgggaagaggaaccttcttaatctcttctgtgggattttcaaaatgttcacaacaggaatatactgaagaactagagtgtcactgctggtgaactgtggcacggttgctcaacacatcacctcggacaaattcaggaagcatttctttagcccacaagtccagacccaggtgctctgtatgtttgtttttaatattcatcatatccaagttcactctgtcttcctgagcagtggaagatcatattgctgtaacttcttttaagtagttgatgtggaaaacattttaaagtgaatttgtcaaaatgctggttttgtgttttatccaacttttgtgcatatatataaagtatgtcatggcatggtttgcttaggagttcagagttccttcatcatcgaaatagtgattaagtgatcccagaacaaggaatactagagtaaaaagcacctctttttcacaaaa

SEQ ID NO: 427850 - DNA, 7473 bp, Homo sapiens
  misc_feature (4376)..(4376): n is a, c, g, or t
  misc_feature (4414)..(4414): n is a, c, g, or t
  misc_feature (4753)..(4753): n is a, c, g, or t
  misc_feature (5048)..(5048): n is a, c, g, or t
acttatgggcggagatggatggtggatggggggcgggggaggcagcggagggagatgaggagataggcgggagcgagggagcgagggagggagcgaaggaggtagagaagagtggaggcgccaggggagggagcgtagcttggttgctccgtagtacggcggctcgcgaggaagaatcccgagcgggctccgggacggacagagaggcgggcggggatggtgtgcggggctgcggctcctgcgtccctcccagcggcgcgtgagcggcactgatttgtccctggggcggcagcgcggacccgcccggagatgaggcgtcgattagcaaggtaaaagtaacagaaccatggctcagtttccaacaccttttggtggcagcctggatatctgggccataactgtagaggaaagagcgaagcatgatcagcagttccatagtttaaagccaatatctggattcattactggtgatcaagctagaaactttttttttcaatctgggttacctcaacctgttttagcacagatatgggcactagctgacatgaataatgatggaagaatggatcaagtggagttttccatagctatgaaacttatcaaactgaagctacaaggatatcagctaccctctgcacttccccctgtcatgaaacagcaaccagttgctatttctagcgcaccagcatttggtatgggaggtatcgccagcatgccaccgcttacagctgttgctccagtgccaatgggatccattccagttgttggaatgtctccaaccctagtatcttctgttcccacagcagctgtgccccccctggctaacggggctccccctgttatacaacctctgcctgcatttgctcatcctgcagccacattgccaaagagttcttcctttagtagatctggtccagggtcacaactaaacactaaattacaaaaggcacagtcatttgatgtggccagtgtcccaccagtggcagagtgggctgttcctcagtcatcaagactgaaatacaggcaattattcaatagtcatgacaaaactatgagtggacacttaacaggtccccaagcaagaactattcttatgcagtcaagtttaccacaggctcagctggcttcaatatggaatctttctgacattgatcaagatggaaaacttacagcagaggaatttatcctggcaatgcacctcattgatgtagctatgtctggccaaccactgccacctgtcctgcctccagaatacattccaccttcttttagaagagttcgatctggcagtggtatatctgtcataagctcaacatctgtagatcagaggctaccagaggaaccagttttagaagatgaacaacaacaattagaaaagaaattacctgtaacgtttgaagataagaagcgggagaactttgaacgtggcaacctggaactggagaaacgaaggcaagctctcctggaacagcagcgcaaggagcaggagcgcctggcccagctggagcgggcggagcaggagaggaaggagcgtgagcgccaggagcaagagcgcaaaagacaactggaactggagaagcaactggaaaagcagcgggagctagaacggcagagagaggaggagaggaggaaagaaattgagaggcgagaggctgcaaaacgggaacttgaaaggcaacgacaacttgagtgggaacggaatcgaaggcaagaactactaaatcaaagaaacaaagaacaagaggacatagttgtactgaaagcaaagaaaaagactttggaatttgaattagaagctctaaatgataaaaagcatcaactagaagggaaacttcaagatatcagatgtcgattgaccacccaaaggcaagaaattgagagcacaaacaaatctagagagttgagaattgccgaaatcacccatctacagcaacaattacaggaatctcagcaaatgcttggaagacttattccagaaaaacagatactcaatgaccaattaaaacaagttcagcagaacagtttgcacagagattcacttgttacacttaaaagagccttagaagcaaaagaactagctcggcagcacctacgagaccaactggatgaagtggagaaagaaactagatcaaaactacaggagattgatattttcaataatcagctgaaggaactaagagaaatacacaataagcaacaactccagaagcaaaagtccatggaggctgaacgactgaaacagaaagaacaagaacgaaagatcatagaattagaaaaacaaaaagaagaagcccaaagacgagctcaggaaagggacaagcagtggctggagcatgtgcagcaggaggacgagcatcagagaccaagaaaactccacgaagaggaaaaactgaaaagggaggagagtgtcaaaaagaaggatggcgaggaaaaaggcaaacaggaagcacaagacaagctgggtcggcttttccatcaacaccaagaaccagctaagccagctgtccaggcaccctggtccactgcagaaaaaggtccacttaccatttctgcacaggaaaatgtaaaagtggtgtattaccgggcactgtacccctttgaatccagaagccatgatgaaatcactatccagccaggagacatagtcaatggtggatgaaagccaaactggagaacccggctggcttggaggagaattaaaaggaaagacagggtggttccctgcaaactatgcagagaaaatcccagaaaatgaggttcccgctccagtgaaaccagtgactgattcaacatctgcccctgcccccaaactggccttgcgtgagacccccgcccctttggcagtaacctcttcagagccctccacgacccctaataactgggccgacttcagctccacgtggcccaccagcacgaatgagaaaccagaaacggataactgggatgcatgggcagcccagccctctctcaccgttccaagtgccggccagttaaggcagaggtccgcctttactccagccacggccactggctcctccccgtctcctgtgctaggccagggtgaaaaggtggaggggctacaagctcaagccctatatccttggagagccaaaaaagacaaccacttaaattttaacaaaaatgatgtcatcaccgtcctggaacagcaagacatgtggtggtttggagaagttcaaggtcagaagggttggttccccaagtcttacgtgaaactcatttcagggcccataaggaagtctacaagcatggattctggttcttcagagagtcctgctagtctaaagcgagtagcctctccagcagccaagccggtcgtttcgggagaagaatttattgccatgtacacttacgagagttctgagcaaggagatttaacctttcagcaaggggatgtgattttggttaccaagaaagatggtgactggtggacaggaacagtgggcgacaaggccggagtcttcccttctaactatgtgaggcttaaagattcagagggctctggaactgctgggaaaacagggagtttaggaaaaaaacctgaaattgcccaggttattgcctcatacaccgccaccggccccgagcagctcactctcgcccctggtcagctgattttgatccgaaaaaagaacccaggtggatggtgggaaggagagctgcaagcacgtgggaaaaagcgccagataggctggttcccagctaattatgtaaagcttctaagccctgggacgagcaaaatcactccaacagagccacctaagtcaacagcattagcggcagtgtgccaggtgattgggatgtacgactacaccgcgcagaatgacgatgagctggccttcaacaagggccagatcatcaacgtcctcaacaaggaggaccctgactggtggaaaggagaagtcaatggacaagtggggctcttcccatccaattatgtgaagctgaccacagacatggacccaagccagcaatggtgttcagacttacatctcttggatatgttgaccccaactgaaagaaagcgacaaggatacatccacgagctcattgtcaccgaggagaactatgtgaatgacctgcagctggtcacagagatttttcaaaaacccctgatggagtctgagctgctgacagaaaaagaggttgctatgatttttgtgaactggaaggagctgattatgtgtaatatcaaactactaaaagcgctgagagtccgcaagaagatgtccggggagaagatgcctgtgaagatgattggagacatcctgagcgcacagctgccgcacatgcagccctacatccgcttctgcagccgccagctcaacggggctgccctgatccagcagaagacggangaggccccagacttcaaggagttcgtcaaaagattggnaatggatcctcggtgtaaagggatgccactctctagttttatactgaagcctatgcaacgggtaacaagatacccactgatcattaaaaatatcctggaaaacacccctgaaaaccacccggaccacagccacttgaagcacgccctggagaaggcggaagagctctgttcccaggtgaacgaaggggtgcgggagaaggagaactctgaccggctggagtggatccaggcccacgtgcagtgtgaaggcctgtctgagcaacttgtgttcaattcagtgaccaattgcttggggccgcgcaaatttctgcacagtgggaagctctacaaggccaagancaacaaggagctgtatggcttccttttcaacgacttcctcctgctgactcagatcacgaagcctttggggtcttctggcaccgacaaagtcttcagccccaaatcaaacctgcagtataaaatgtataaaacacctattttcctaaatgaggttctagtaaaattacccaccgacccttctggagacgagcccatcttccacatctcccacattgaccgcgtctatactctccgagcagaaagcataaatgaaaggactgcctgggtgcagaaaatcaaagctgcttctgaactntacatagagactgagaaaaagaagcgcgagaaagcgtacctggtccgttcccaaagggcaacaggcattggaaggttgatggtgaacgtggttgaaggcatcgagttgaaaccctgtcggtcacatggaaagagcaacccgtactgtgaggtgaccatgggttcccagtgccacatcaccaagacgatccaggacactctgaaccccaagtggaattccaactgccagttcttcatccgagacctggagcaggaagtcctctgcatcactgtgttcgagagggaccagttctcaccagatgattttttgggtcggacggagatccgtgtggcggacatcaagaaagaccagggctccaaaggtccagttacgaagtgtcttctgctgcacgaagtccccacgggagagattgtggtccgcttggacctgcagttgtttgatgagccgtaggcagcgggctcagggtgtgctcagcagggtcccagcccacggccacacatgctgtctggaaattgtattccttttctaagaaaccaccatttggtattcagtcacagggatatgggatggcaaagacaggcccctcaaagctcctaggaatcattctcgacaatcctccctgccccgaaacaatttcctgtttcatgaaacaaagctgtgttttcctttgtcctcactacaggtctcattatggcttctagggtcgctgaaatcccatagccctcaacagggtgcagctgggagtctagccccttcccgggcttgagggatgggtctggttactataaaatagatttataaatgcaatgtctatatttttggagaactcatgtaaccctcctgtttcttacatccaccagtccccaagtagacttcttggcctacaatgcccagtccttggtgtgagtttagaaacaattatgacggtcctgtcattgcttcagaatcccatctctcctgcagggaaatgctgcctagagctgatcactcggtgagacggtctgatcaggccctggcttagctctttgaagagctggtctatggaagtttccagcatgtgcaccgttatagccgttccttccccctctaggccttgtattaatatatgtcaatgaaaacacactggtgtattgttgcgtggattcagttctgattcccagcatgcttagaatatggtcacagaaagtcattatctagaaagtcacccctctgctggatcagatcactacaggtcactggaaaggcaactttacaatgttgggtcactgggtctcggttggcagccatgttggaaaaatctcttttggctcggaggcctgtgatatttcatagcagcagtcgttgctggtgacctgttctgtgcttgaatgtgctgaatcctgattgttgtaggacatttcaacagctctttttggtacgttccccaaaaagccatgtcctagatccccaaggcgtgaaaaggaaaaatatcaagctggaggttgggaaagaaaatgaaggcagtccattatgtggtgggtgaaagaccctaggaggatgcaagccccgcacatcccggggcaaagacctaagacacttttccaccctccaccaccccaacctcacataatatgcttgttgcaagagtcaggactttatgactatgtgccaagctgtttggtttgagttctttaatttttttttcccttaaatgccaggagatcatctggttagttagatagtaacttgatttgctaatgaaaagtgggggccgtgttttgtttgcatgttaatattctcataatcctagtttgttgtggtcatgaaatgccctttgcatgttctgttggtactggagtctagctttcctgtactagatggtgttctctttgattgtaggtccttagactttaattagggttatcaaagtgctttctaaatgatagcatcagcgttgtggcagagtacctcctttgctgggaactgaatgtgtagggttatcatttcccatgagagcccggtcatacttcaagcaatttttttaaaagtgtgtgttggaaaggacaacaaagtttacatttcatacttttaagaaatactttattatttatttattgaagatagtgtagaattttgtatcaagaacaacagacataagtattttttgaaacaagcaaatataccctgtagttagaaactttcaactgaacatgttagagaccaagtttaacttcaggcatgcatttgtttaccatttcccagcagaaaacatggttaaaatactttaagtttatattttttgatgttgttaagaaacttttaaattaaatctataaatagacatgcaactcatgctttcctatttctataaccaacaccgtttgtttagtgtatttatgaaagatatgctaccatggtagaaagaaaagtattcaatgtgtaaatt

SEQ ID NO: 427851 - DNA, 5505 bp, Homo sapiens
acttatgggcggagatggatggtggatggggggcgggggaggcagcggagggagatgaggagataggcgggagcgagggagcgagggagggagcgaaggaggtagagaagagtggaggcgccaggggagggagcgtagcttggttgctccgtagtacggcggctcgcgaggaagaatcccgagcgggctccgggacggacagagaggcgggcggggatggtgtgcggggctgcggctcctgcgtccctcccagcggcgcgtgagcggcactgatttgtccctggggcggcagcgcggacccgcccggagatgaggcgtcgattagcaaggtaaaagtaacagaaccatggctcagtttccaacaccttttggtggcagcctggatatctgggccataactgtagaggaaagagcgaagcatgatcagcagttccatagtttaaagccaatatctggattcattactggtgatcaagctagaaactttttttttcaatctgggttacctcaacctgttttagcacagatatgggcactagctgacatgaataatgatggaagaatggatcaagtggagttttccatagctatgaaacttatcaaactgaagctacaaggatatcagctaccctctgcacttccccctgtcatgaaacagcaaccagttgctatttctagcgcaccagcatttggtatgggaggtatcgccagcatgccaccgcttacagctgttgctccagtgccaatgggatccattccagttgttggaatgtctccaaccctagtatcttctgttcccacagcagctgtgccccccctggctaacggggctccccctgttatacaacctctgcctgcatttgctcatcctgcagccacattgccaaagagttcttcctttagtagatctggtccagggtcacaactaaacactaaattacaaaaggcacagtcatttgatgtggccagtgtcccaccagtggcagagtgggctgttcctcagtcatcaagactgaaatacaggcaattattcaatagtcatgacaaaactatgagtggacacttaacaggtccccaagcaagaactattcttatgcagtcaagtttaccacaggctcagctggcttcaatatggaatctttctgacattgatcaagatggaaaacttacagcagaggaatttatcctggcaatgcacctcattgatgtagctatgtctggccaaccactgccacctgtcctgcctccagaatacattccaccttcttttagaagagttcgatctggcagtggtatatctgtcataagctcaacatctgtagatcagaggctaccagaggaaccagttttagaagatgaacaacaacaattagaaaagaaattacctgtaacgtttgaagataagaagcgggagaactttgaacgtggcaacctggaactggagaaacgaaggcaagctctcctggaacagcagcgcaaggagcaggagcgcctggcccagctggagcgggcggagcaggagaggaaggagcgtgagcgccaggagcaagagcgcaaaagacaactggaactggagaagcaactggaaaagcagcgggagctagaacggcagagagaggaggagaggaggaaagaaattgagaggcgagaggctgcaaaacgggaacttgaaaggcaacgacaacttgagtgggaacggaatcgaaggcaagaactactaaatcaaagaaacaaagaacaagaggacatagttgtactgaaagcaaagaaaaagactttggaatttgaattagaagctctaaatgataaaaagcatcaactagaagggaaacttcaagatatcagatgtcgattgaccacccaaaggcaagaaattgagagcacaaacaaatctagagagttgagaattgccgaaatcacccatctacagcaacaattacaggaatctcagcaaatgcttggaagacttattccagaaaaacagatactcaatgaccaattaaaacaagttcagcagaacagtttgcacagagattcacttgttacacttaaaagagccttagaagcaaaagaactagctcggcagcacctacgagaccaactggatgaagtggagaaagaaactagatcaaaactacaggagattgatattttcaataatcagctgaaggaactaagagaaatacacaataagcaacaactccagaagcaaaagtccatggaggctgaacgactgaaacagaaagaacaagaacgaaagatcatagaattagaaaaacaaaaagaagaagcccaaagacgagctcaggaaagggacaagcagtggctggagcatgtgcagcaggaggacgagcatcagagaccaagaaaactccacgaagaggaaaaactgaaaagggaggagagtgtcaaaaagaaggatggcgaggaaaaaggcaaacaggaagcacaagacaagctgggtcggcttttccatcaacaccaagaaccagctaagccagctgtccaggcaccctggtccactgcagaaaaaggtccacttaccatttctgcacaggaaaatgtaaaagtggtgtattaccgggcactgtacccctttgaatccagaagccatgatgaaatcactatccagccaggagacatagtcaatggtggatgaaagccaaactggagaacccggctggcttggaggagaattaaaaggaaagacagggtggttccctgcaaactatgcagagaaaatcccagaaaatgaggttcccgctccagtgaaaccagtgactgattcaacatctgcccctgcccccaaactggccttgcgtgagacccccgcccctttggcagtaacctcttcagagccctccacgacccctaataactgggccgacttcagctccacgtggcccaccagcacgaatgagaaaccagaaacggataactgggatgcatgggcagcccagccctctctcaccgttccaagtgccggccagttaaggcagaggtccgcctttactccagccacggccactggctcctccccgtctcctgtgctaggccagggtgaaaaggtggaggggctacaagctcaagccctatatccttggagagccaaaaaagacaaccacttaaattttaacaaaaatgatgtcatcaccgtcctggaacagcaagacatgtggtggtttggagaagttcaaggtcagaagggttggttccccaagtcttacgtgaaactcatttcagggcccataaggaagtctacaagcatggattctggttcttcagagagtcctgctagtctaaagcgagtagcctctccagcagccaagccggtcgtttcgggagaagaatttattgccatgtacacttacgagagttctgagcaaggagatttaacctttcagcaaggggatgtgattttggttaccaagaaagatggtgactggtggacaggaacagtgggcgacaaggccggagtcttcccttctaactatgtgaggcttaaagattcagagggctctggaactgctgggaaaacagggagtttaggaaaaaaacctgaaattgcccaggttattgcctcatacaccgccaccggccccgagcagctcactctcgcccctggtcagctgattttgatccgaaaaaagaacccaggtggatggtgggaaggagagctgcaagcacgtgggaaaaagcgccagataggctggttcccagctaattatgtaaagcttctaagccctgggacgagcaaaatcactccaacagagccacctaagtcaacagcattagcggcagtgtgccaggtgattgggatgtacgactacaccgcgcagaatgacgatgagctggccttcaacaagggccagatcatcaacgtcctcaacaaggaggaccctgactggtggaaaggagaagtcaatggacaagtggggctcttcccatccaattatgtgaagctgaccacagacatggacccaagccagcaatgaatcatatgttgtccatccccccctcaggcttgaaagtcctcaaagagacccactatcccatatcactgcccagagggatgatgggagatgcagccttgatcatgtgacttccagcatgatcacctactgccttctgagtagaagaactcactgcagagcagtttacctcattttaccttagttgcatgtgatcgcaatgtttgagttattacttgcagagataggagcaaaaattacaaaaacacacagggtagtgggtccttttgtggctttcctagttactcaaattgactttcccccacctttgcacaggtgctttcaatagttttaaaattatttttaaatatatattttagctttttaataaacaaaataaataaatgacttctttgctattttggttttgcaaaaagacccactatcaaggaatgctgcatgtgctattaaaaattgttccaaatgtccataaatctgagacttgatgtattttttcattttgtccagtgttaccaactaaattgtgcagtttggggcttttcccccttaccatagaagtgcagaggagttcagtatctctgttttaaagacgtatagaatgagcccaattaaagcgaaggtgtttgtgcttgtttgtgtgtatcagctgtaccttgttgagcatgtaatacatcctgtacataagaaattagttctttccatggcaaagctattaccttgtacgatgctctaatcatattgcatttaattttattttgcacagtgaccttgtagccacatgagaaagcactctgtgtttttgttcggtctcagatttatctggttgagttggtgttttgtttggggtttttaattttgcgtgtttgcatagcataaaatcagtagacaacaccactgaggtcgttacgatcaacgatatccacagtctctttttagtctctgttacatgaagttttattccagttacttttcatggaatgacctattttgaacaagtaattttcttgacaagaaagaatgtatagaagtctccctgcaattaatttccaatgtttacattttttaactagactgtggaatttctacagattaatatgaaatggagctcatggtccgtttgtgtgttagatatgctgtagctgaagccctgtttgtcttttaaacactagttggaagctctcaataaaaatgcctgctgctcacagcacagaaaatggggcagggggagcctcaagcacaatctagctgtcctcctaaagactctgtaatgctcactcccctcgcgttctcccggcgctgtcgggaggctgtgctggtggtcgtgtagaggtccttctcctttcacatggtgcagagagcgaggacctctcctcctcgttcagttgcacttcagtattttcacggatatgaatgtaaaatatataaatatataaacctgcggctttaacaactgtaatacaaccttttgaattagttccgtgtatagataattaaattcttcatacaaaagtta

SEQ ID NO: 427852 - DNA, 235 bp, Homo sapiens
gagacggagtctggctctgtcacccaggctagagtgcgatggcgccggttgacagtggctggagcatgtgcagcaggaggacgagcatcagagaccaagaaaactccacgaagaggaaaaactgaaaagggaggagagtgtcaaaaagaaggatggcgctcaggaagcatggcactctggcgggcataccagcgggcctgccgctcacccgtgaaagcacgtcaacccactgcca

SEQ ID NO: 427853 - DNA, 6171 bp, Homo sapiens
acttatgggcggagatggatggtggatggggggcgggggaggcagcggagggagatgaggagataggcgggagcgagggagcgagggagggagcgaaggaggtagagaagagtggaggcgccaggggagggagcgtagcttggttgctccgtagtacggcggctcgcgaggaagaatcccgagcgggctccgggacggacagagaggcgggcggggatggtgtgcggggctgcggctcctgcgtccctcccagcggcgcgtgagcggcactgatttgtccctggggcggcagcgcggacccgcccggagatgaggcgtcgattagcaaggtaaaagtaacagaaccatggctcagtttccaacaccttttggtggcagcctggatatctgggccataactgtagaggaaagagcgaagcatgatcagcagttccatagtttaaagccaatatctggattcattactggtgatcaagctagaaactttttttttcaatctgggttacctcaacctgttttagcacagatatgggcactagctgacatgaataatgatggaagaatggatcaagtggagttttccatagctatgaaacttatcaaactgaagctacaaggatatcagctaccctctgcacttccccctgtcatgaaacagcaaccagttgctatttctagcgcaccagcatttggtatgggaggtatcgccagcatgccaccgcttacagctgttgctccagtgccaatgggatccattccagttgttggaatgtctccaaccctagtatcttctgttcccacagcagctgtgccccccctggctaacggggctccccctgttatacaacctctgcctgcatttgctcatcctgcagccacattgccaaagagttcttcctttagtagatctggtccagggtcacaactaaacactaaattacaaaaggcacagtcatttgatgtggccagtgtcccaccagtggcagagtgggctgttcctcagtcatcaagactgaaatacaggcaattattcaatagtcatgacaaaactatgagtggacacttaacaggtccccaagcaagaactattcttatgcagtcaagtttaccacaggctcagctggcttcaatatggaatctttctgacattgatcaagatggaaaacttacagcagaggaatttatcctggcaatgcacctcattgatgtagctatgtctggccaaccactgccacctgtcctgcctccagaatacattccaccttcttttagaagagttcgatctggcagtggtatatctgtcataagctcaacatctgtagatcagaggctaccagaggaaccagttttagaagatgaacaacaacaattagaaaagaaattacctgtaacgtttgaagataagaagcgggagaactttgaacgtggcaacctggaactggagaaacgaaggcaagctctcctggaacagcagcgcaaggagcaggagcgcctggcccagctggagcgggcggagcaggagaggaaggagcgtgagcgccaggagcaagagcgcaaaagacaactggaactggagaagcaactggaaaagcagcgggagctagaacggcagagagaggaggagaggaggaaagaaattgagaggcgagaggctgcaaaacgggaacttgaaaggcaacgacaacttgagtgggaacggaatcgaaggcaagaactactaaatcaaagaaacaaagaacaagaggacatagttgtactgaaagcaaagaaaaagactttggaatttgaattagaagctctaaatgataaaaagcatcaactagaagggaaacttcaagatatcagatgtcgattgaccacccaaaggcaagaaattgagagcacaaacaaatctagagagttgagaattgccgaaatcacccatctacagcaacaattacaggaatctcagcaaatgcttggaagacttattccagaaaaacagatactcaatgaccaattaaaacaagttcagcagaacagtttgcacagagattcacttgttacacttaaaagagccttagaagcaaaagaactagctcggcagcacctacgagaccaactggatgaagtggagaaagaaactagatcaaaactacaggagattgatattttcaataatcagctgaaggaactaagagaaatacacaataagcaacaactccagaagcaaaagtccatggaggctgaacgactgaaacagaaagaacaagaacgaaagatcatagaattagaaaaacaaaaagaagaagcccaaagacgagctcaggaaagggacaagcagtggctggagcatgtgcagcaggaggacgagcatcagagaccaagaaaactccacgaagaggaaaaactgaaaagggaggagagtgtcaaaaagaaggatggcgaggaaaaaggcaaacaggaagcacaagacaagctgggtcggcttttccatcaacaccaagaaccagctaagccagctgtccaggcaccctggtccactgcagaaaaaggtccacttaccatttctgcacaggaaaatgtaaaagtggtgtattaccgggcactgtacccctttgaatccagaagccatgatgaaatcactatccagccaggagacatagtcaatggtggatgaaagccaaactggagaacccggctggcttggaggagaattaaaaggaaagacagggtggttccctgcaaactatgcagagaaaatcccagaaaatgaggttcccgctccagtgaaaccagtgactgattcaacatctgcccctgcccccaaactggccttgcgtgagacccccgcccctttggcagtaacctcttcagagccctccacgacccctaataactgggccgacttcagctccacgtggcccaccagcacgaatgagaaaccagaaacggataactgggatgcatgggcagcccagccctctctcaccgttccaagtgccggccagttaaggcagaggtccgcctttactccagccacggccactggctcctccccgtctcctgtgctaggccagggtgaaaaggtggaggggctacaagctcaagccctatatccttggagagccaaaaaagacaaccacttaaattttaacaaaaatgatgtcatcaccgtcctggaacagcaagacatgtggtggtttggagaagttcaaggtcagaagggttggttccccaagtcttacgtgaaactcatttcagggcccataaggaagtctacaagcatggattctggttcttcagagagtcctgctagtctaaagcgagtagcctctccagcagccaagccggtcgtttcgggagaagaatttattgccatgtacacttacgagagttctgagcaaggagatttaacctttcagcaaggggatgtgattttggttaccaagaaagatggtgactggtggacaggaacagtgggcgacaaggccggagtcttcccttctaactatgtgaggcttaaagattcagagggctctggaactgctgggaaaacagggagtttaggaaaaaaacctgaaattgcccaggttattgcctcatacaccgccaccggccccgagcagctcactctcgcccctggtcagctgattttgatccgaaaaaagaacccaggtggatggtgggaaggagagctgcaagcacgtgggaaaaagcgccagataggctggttcccagctaattatgtaaagcttctaagccctgggacgagcaaaatcactccaacagagccacctaagtcaacagcattagcggcagtgtgccaggtgattgggatgtacgactacaccgcgcagaatgacgatgagctggccttcaacaagggccagatcatcaacgtcctcaacaaggaggaccctgactggtggaaaggagaagtcaatggacaagtggggctcttcccatccaattatgtgaagctgaccacagacatggacccaagccagcaatgaatcatatgttgtccatccccccctcaggcttgaaagtcctcaaagagacccactatcccatatcactgcccagagggatgatgggagatgcagccttgatcatgtgacttccagcatgatcacctactgccttctgagtagaagaactcactgcagagcagtttacctcattttaccttagttgcatgtgatcgcaatgtttgagttattacttgcagagataggagcaaaaattacaaaaacacacagggtagtgggtccttttgtggctttcctagttactcaaattgactttcccccacctttgcacaggtgctttcaatagttttaaaattatttttaaatatatattttagctttttaataaacaaaataaataaatgacttctttgctattttggttttgcaaaaagacccactatcaaggaatgctgcatgtgctattaaaaattgttccaaatgtccataaatctgagacttgatgtattttttcattttgtccagtgttaccaactaaattgtgcagtttggggcttttcccccttaccatagaagtgcagaggagttcagtatctctgttttaaagacgtatagaatgagcccaattaaagcgaaggtgtttgtgcttgtttgtgtgtatcagctgtaccttgttgagcatgtaatacatcctgtacataagaaattagttctttccatggcaaagctattaccttgtacgatgctctaatcatattgcatttaattttattttgcacagtgaccttgtagccacatgagaaagcactctgtgtttttgttcggtctcagatttatctggttgagttggtgttttgtttggggtttttaattttgcgtgtttgcatagcataaaatcagtagacaacaccactgaggtcgttacgatcaacgatatccacagtctctttttagtctctgttacatgaagttttattccagttacttttcatggaatgacctattttgaacaagtaattttcttgacaagaaagaatgtatagaagtctccctgcaattaatttccaatgtttacattttttaactagactgtggaatttctacagattaatatgaaatggagctcatggtccgtttgtgtgttagatatgctgtagctgaagccctgtttgtcttttaaacactagttggaagctctcaataaaaatgcctgctgctcacagcacagaaaatggggcagggggagcctcaagcacaatctagctgtcctcctaaagactctgtaatgctcactcccctcgcgttctcccggcgctgtcgggaggctgtgctggtggtcgtgtagaggtccttctcctttcacatggtgcagagagcgaggacctctcctcctcgttcagttgcacttcagtattttcacggatatgaatgtaaaatatataaatatataaacctgcggctttaacaactgtaatacaaccttttgaattagttccgtgtatagataattaaattcttcatacaaaagttaaaaaaaaaaaaaaaaaaaaaaaaaaaaaacctttgggggggccggggcccggaaaggtttttaagacccatccgtctggggggcgcgggcgggcccaacaggggtacgtgagacacgggcgccaacaccggcggcacccgagggaaactccggggcgcaccagacctaacgggcgggggtttccccccaaataaaaaaaggcgcgggggggcacccgggccgctttcgggaacacactcccaagtgggcttcgcgaggggccacagcggggctcataccaacgcggggcgcccaggcagcgccgatatcaatttagccccggcccggagggggttaaaaaagacggaccagccaacacacaggcaacgacggacggaccaaacgccgaccacacggagacaagcaacccaacccacgacgaaaacaagacggaaggacgaagcgagcgccgagaacgagccggaacaaccagcaaaaggacagcgacaacagcacagacagaacagacggagacgaccaaggaccgaagagacaaggcagctcacacgctacagacacacaacaagacagaacacagagaacaaaacaagaggcaccagagcgaaaaacagaaaacgaaagagacagaagacacaaacaacagagccgaagcaagaacaataaaaa

SEQ ID NO: 427854 - DNA, 5292 bp, Homo sapiens
acttatgggcggagatggatggtggatggggggcgggggaggcagcggagggagatgaggagataggcgggagcgagggagcgagggagggagcgaaggaggtagagaagagtggaggcgccaggggagggagcgtagcttggttgctccgtagtacggcggctcgcgaggaagaatcccgagcgggctccgggacggacagagaggcgggcggggatggtgtgcggggctgcggctcctgcgtccctcccagcggcgcgtgagcggcactgatttgtccctggggcggcagcgcggacccgcccggagatgaggcgtcgattagcaaggtaaaagtaacagaaccatggctcagtttccaacaccttttggtggcagcctggatatctgggccataactgtagaggaaagagcgaagcatgatcagcagttccatagtttaaagccaatatctggattcattactggtgatcaagctagaaactttttttttcaatctgggttacctcaacctgttttagcacagatatgggcactagctgacatgaataatgatggaagaatggatcaagtggagttttccatagctatgaaacttatcaaactgaagctacaaggatatcagctaccctctgcacttccccctgtcatgaaacagcaaccagttgctatttctagcgcaccagcatttggtatgggaggtatcgccagcatgccaccgcttacagctgttgctccagtgccaatgggatccattccagttgttggaatgtctccaaccctagtatcttctgttcccacagcagctgtgccccccctggctaacggggctccccctgttatacaacctctgcctgcatttgctcatcctgcagccacattgccaaagagttcttcctttagtagatctggtccagggtcacaactaaacactaaattacaaaaggcacagtcatttgatgtggccagtgtcccaccagtggcagagtgggctgttcctcagtcatcaagactgaaatacaggcaattattcaatagtcatgacaaaactatgagtggacacttaacaggtccccaagcaagaactattcttatgcagtcaagtttaccacaggctcagctggcttcaatatggaatctttctgacattgatcaagatggaaaacttacagcagaggaatttatcctggcaatgcacctcattgatgtagctatgtctggccaaccactgccacctgtcctgcctccagaatacattccaccttcttttagaagagttcgatctggcagtggtatatctgtcataagctcaacatctgtagatcagaggctaccagaggaaccagttttagaagatgaacaacaacaattagaaaagaaattacctgtaacgtttgaagataagaagcgggagaactttgaacgtggcaacctggaactggagaaacgaaggcaagctctcctggaacagcagcgcaaggagcaggagcgcctggcccagctggagcgggcggagcaggagaggaaggagcgtgagcgccaggagcaagagcgcaaaagacaactggaactggagaagcaactggaaaagcagcgggagctagaacggcagagagaggaggagaggaggaaagaaattgagaggcgagaggctgcaaaacgggaacttgaaaggcaacgacaacttgagtgggaacggaatcgaaggcaagaactactaaatcaaagaaacaaagaacaagaggacatagttgtactgaaagcaaagaaaaagactttggaatttgaattagaagctctaaatgataaaaagcatcaactagaagggaaacttcaagatatcagatgtcgattgaccacccaaaggcaagaaattgagagcacaaacaaatctagagagttgagaattgccgaaatcacccatctacagcaacaattacaggaatctcagcaaatgcttggaagacttattccagaaaaacagatactcaatgaccaattaaaacaagttcagcagaacagtttgcacagagattcacttgttacacttaaaagagccttagaagcaaaagaactagctcggcagcacctacgagaccaactggatgaagtggagaaagaaactagatcaaaactacaggagattgatattttcaataatcagctgaaggaactaagagaaatacacaataagcaacaactccagaagcaaaagtccatggaggctgaacgactgaaacagaaagaacaagaacgaaagatcatagaattagaaaaacaaaaagaagaagcccaaagacgagctcaggaaagggacaagcagtggctggagcatgtgcagcaggaggacgagcatcagagaccaagaaaactccacgaagaggaaaaactgaaaagggaggagagtgtcaaaaagaaggatggcgaggaaaaaggcaaacaggaagcacaagacaagctgggtcggcttttccatcaacaccaagaaccagctaagccagctgtccaggcaccctggtccactgcagaaaaaggtccacttaccatttctgcacaggaaaatgtaaaagtggtgtattaccgggcactgtacccctttgaatccagaagccatgatgaaatcactatccagccaggagacatagtcaatggtggatgaaagccaaactggagaacccggctggcttggaggagaattaaaaggaaagacagggtggttccctgcaaactatgcagagaaaatcccagaaaatgaggttcccgctccagtgaaaccagtgactgattcaacatctgcccctgcccccaaactggccttgcgtgagacccccgcccctttggcagtaacctcttcagagccctccacgacccctaataactgggccgacttcagctccacgtggcccaccagcacgaatgagaaaccagaaacggataactgggatgcatgggcagcccagccctctctcaccgttccaagtgccggccagttaaggcagaggtccgcctttactccagccacggccactggctcctccccgtctcctgtgctaggccagggtgaaaaggtggaggggctacaagctcaagccctatatccttggagagccaaaaaagacaaccacttaaattttaacaaaaatgatgtcatcaccgtcctggaacagcaagacatgtggtggtttggagaagttcaaggtcagaagggttggttccccaagtcttacgtgaaactcatttcagggcccataaggaagtctacaagcatggattctggttcttcagagagtcctgctagtctaaagcgagtagcctctccagcagccaagccggtcgtttcgggagaagaaattgcccaggttattgcctcatacaccgccaccggccccgagcagctcactctcgcccctggtcagctgattttgatccgaaaaaagaacccaggtggatggtgggaaggagagctgcaagcacgtgggaaaaagcgccagataggctggttcccagctaattatgtaaagcttctaagccctgggacgagcaaaatcactccaacagagccacctaagtcaacagcattagcggcagtgtgccaggtgattgggatgtacgactacaccgcgcagaatgacgatgagctggccttcaacaagggccagatcatcaacgtcctcaacaaggaggaccctgactggtggaaaggagaagtcaatggacaagtggggctcttcccatccaattatgtgaagctgaccacagacatggacccaagccagcaatgaatcatatgttgtccatccccccctcaggcttgaaagtcctcaaagagacccactatcccatatcactgcccagagggatgatgggagatgcagccttgatcatgtgacttccagcatgatcacctactgccttctgagtagaagaactcactgcagagcagtttacctcattttaccttagttgcatgtgatcgcaatgtttgagttattacttgcagagataggagcaaaaattacaaaaacacacagggtagtgggtccttttgtggctttcctagttactcaaattgactttcccccacctttgcacaggtgctttcaatagttttaaaattatttttaaatatatattttagctttttaataaacaaaataaataaatgacttctttgctattttggttttgcaaaaagacccactatcaaggaatgctgcatgtgctattaaaaattgttccaaatgtccataaatctgagacttgatgtattttttcattttgtccagtgttaccaactaaattgtgcagtttggggcttttcccccttaccatagaagtgcagaggagttcagtatctctgttttaaagacgtatagaatgagcccaattaaagcgaaggtgtttgtgcttgtttgtgtgtatcagctgtaccttgttgagcatgtaatacatcctgtacataagaaattagttctttccatggcaaagctattaccttgtacgatgctctaatcatattgcatttaattttattttgcacagtgaccttgtagccacatgagaaagcactctgtgtttttgttcggtctcagatttatctggttgagttggtgttttgtttggggtttttaattttgcgtgtttgcatagcataaaatcagtagacaacaccactgaggtcgttacgatcaacgatatccacagtctctttttagtctctgttacatgaagttttattccagttacttttcatggaatgacctattttgaacaagtaattttcttgacaagaaagaatgtatagaagtctccctgcaattaatttccaatgtttacattttttaactagactgtggaatttctacagattaatatgaaatggagctcatggtccgtttgtgtgttagatatgctgtagctgaagccctgtttgtcttttaaacactagttggaagctctcaataaaaatgcctgctgctcacagcacagaaaatggggcagggggagcctcaagcacaatctagctgtcctcctaaagactctgtaatgctcactcccctcgcgttctcccggcgctgtcgggaggctgtgctggtggtcgtgtagaggtccttctcctttcacatggtgcagagagcgaggacctctcctcctcgttcagttgcacttcagtattttcacggatatgaatgtaaaatatataaatatataaacctgcggctttaacaactgtaatacaaccttttgaattagttccgtgtatagataattaaattcttcatacaaaagtta

SEQ ID NO: 427855 - DNA, 5181 bp, Homo sapiens
acttatgggcggagatggatggtggatggggggcgggggaggcagcggagggagatgaggagataggcgggagcgagggagcgagggagggagcgaaggaggtagagaagagtggaggcgccaggggagggagcgtagcttggttgctccgtagtacggcggctcgcgaggaagaatcccgagcgggctccgggacggacagagaggcgggcggggatggtgtgcggggctgcggctcctgcgtccctcccagcggcgcgtgagcggcactgatttgtccctggggcggcagcgcggacccgcccggagatgaggcgtcgattagcaaggtaaaagtaacagaaccatggctcagtttccaacaccttttggtggcagcctggatatctgggccataactgtagaggaaagagcgaagcatgatcagcagttccatagtttaaagccaatatctggattcattactggtgatcaagctagaaactttttttttcaatctgggttacctcaacctgttttagcacagatatgggcactagctgacatgaataatgatggaagaatggatcaagtggagttttccatagctatgaaacttatcaaactgaagctacaaggatatcagctaccctctgcacttccccctgtcatgaaacagcaaccagttgctatttctagcgcaccagcatttgcagctgtgccccccctggctaacggggctccccctgttatacaacctctgcctgcatttgctcatcctgcagccacattgccaaagagttcttcctttagtagatctggtccagggtcacaactaaacactaaattacaaaaggcacagtcatttgatgtggccagtgtcccaccagtggcagagtgggctgttcctcagtcatcaagactgaaatacaggcaattattcaatagtcatgacaaaactatgagtggacacttaacaggtccccaagcaagaactattcttatgcagtcaagtttaccacaggctcagctggcttcaatatggaatctttctgacattgatcaagatggaaaacttacagcagaggaatttatcctggcaatgcacctcattgatgtagctatgtctggccaaccactgccacctgtcctgcctccagaatacattccaccttcttttagaagagttcgatctggcagtggtatatctgtcataagctcaacatctgtagatcagaggctaccagaggaaccagttttagaagatgaacaacaacaattagaaaagaaattacctgtaacgtttgaagataagaagcgggagaactttgaacgtggcaacctggaactggagaaacgaaggcaagctctcctggaacagcagcgcaaggagcaggagcgcctggcccagctggagcgggcggagcaggagaggaaggagcgtgagcgccaggagcaagagcgcaaaagacaactggaactggagaagcaactggaaaagcagcgggagctagaacggcagagagaggaggagaggaggaaagaaattgagaggcgagaggctgcaaaacgggaacttgaaaggcaacgacaacttgagtgggaacggaatcgaaggcaagaactactaaatcaaagaaacaaagaacaagaggacatagttgtactgaaagcaaagaaaaagactttggaatttgaattagaagctctaaatgataaaaagcatcaactagaagggaaacttcaagatatcagatgtcgattgaccacccaaaggcaagaaattgagagcacaaacaaatctagagagttgagaattgccgaaatcacccatctacagcaacaattacaggaatctcagcaaatgcttggaagacttattccagaaaaacagatactcaatgaccaattaaaacaagttcagcagaacagtttgcacagagattcacttgttacacttaaaagagccttagaagcaaaagaactagctcggcagcacctacgagaccaactggatgaagtggagaaagaaactagatcaaaactacaggagattgatattttcaataatcagctgaaggaactaagagaaatacacaataagcaacaactccagaagcaaaagtccatggaggctgaacgactgaaacagaaagaacaagaacgaaagatcatagaattagaaaaacaaaaagaagaagcccaaagacgagctcaggaaagggacaagcagtggctggagcatgtgcagcaggaggacgagcatcagagaccaagaaaactccacgaagaggaaaaactgaaaagggaggagagtgtcaaaaagaaggatggcgaggaaaaaggcaaacaggaagcacaagacaagctgggtcggcttttccatcaacaccaagaaccagctaagccagctgtccaggcaccctggtccactgcagaaaaaggtccacttaccatttctgcacaggaaaatgtaaaagtggtgtattaccgggcactgtacccctttgaatccagaagccatgatgaaatcactatccagccaggagacatagtcaatggtggatgaaagccaaactggagaacccggctggcttggaggagaattaaaaggaaagacagggtggttccctgcaaactatgcagagaaaatcccagaaaatgaggttcccgctccagtgaaaccagtgactgattcaacatctgcccctgcccccaaactggccttgcgtgagacccccgcccctttggcagtaacctcttcagagccctccacgacccctaataactgggccgacttcagctccacgtggcccaccagcacgaatgagaaaccagaaacggataactgggatgcatgggcagcccagccctctctcaccgttccaagtgccggccagttaaggcagaggtccgcctttactccagccacggccactggctcctccccgtctcctgtgctaggccagggtgaaaaggtggaggggctacaagctcaagccctatatccttggagagccaaaaaagacaaccacttaaattttaacaaaaatgatgtcatcaccgtcctggaacagcaagacatgtggtggtttggagaagttcaaggtcagaagggttggttccccaagtcttacgtgaaactcatttcagggcccataaggaagtctacaagcatggattctggttcttcagagagtcctgctagtctaaagcgagtagcctctccagcagccaagccggtcgtttcgggagaagaaattgcccaggttattgcctcatacaccgccaccggccccgagcagctcactctcgcccctggtcagctgattttgatccgaaaaaagaacccaggtggatggtgggaaggagagctgcaagcacgtgggaaaaagcgccagataggctggttcccagctaattatgtaaagcttctaagccctgggacgagcaaaatcactccaacagagccacctaagtcaacagcattagcggcagtgtgccaggtgattgggatgtacgactacaccgcgcagaatgacgatgagctggccttcaacaagggccagatcatcaacgtcctcaacaaggaggaccctgactggtggaaaggagaagtcaatggacaagtggggctcttcccatccaattatgtgaagctgaccacagacatggacccaagccagcaatgaatcatatgttgtccatccccccctcaggcttgaaagtcctcaaagagacccactatcccatatcactgcccagagggatgatgggagatgcagccttgatcatgtgacttccagcatgatcacctactgccttctgagtagaagaactcactgcagagcagtttacctcattttaccttagttgcatgtgatcgcaatgtttgagttattacttgcagagataggagcaaaaattacaaaaacacacagggtagtgggtccttttgtggctttcctagttactcaaattgactttcccccacctttgcacaggtgctttcaatagttttaaaattatttttaaatatatattttagctttttaataaacaaaataaataaatgacttctttgctattttggttttgcaaaaagacccactatcaaggaatgctgcatgtgctattaaaaattgttccaaatgtccataaatctgagacttgatgtattttttcattttgtccagtgttaccaactaaattgtgcagtttggggcttttcccccttaccatagaagtgcagaggagttcagtatctctgttttaaagacgtatagaatgagcccaattaaagcgaaggtgtttgtgcttgtttgtgtgtatcagctgtaccttgttgagcatgtaatacatcctgtacataagaaattagttctttccatggcaaagctattaccttgtacgatgctctaatcatattgcatttaattttattttgcacagtgaccttgtagccacatgagaaagcactctgtgtttttgttcggtctcagatttatctggttgagttggtgttttgtttggggtttttaattttgcgtgtttgcatagcataaaatcagtagacaacaccactgaggtcgttacgatcaacgatatccacagtctctttttagtctctgttacatgaagttttattccagttacttttcatggaatgacctattttgaacaagtaattttcttgacaagaaagaatgtatagaagtctccctgcaattaatttccaatgtttacattttttaactagactgtggaatttctacagattaatatgaaatggagctcatggtccgtttgtgtgttagatatgctgtagctgaagccctgtttgtcttttaaacactagttggaagctctcaataaaaatgcctgctgctcacagcacagaaaatggggcagggggagcctcaagcacaatctagctgtcctcctaaagactctgtaatgctcactcccctcgcgttctcccggcgctgtcgggaggctgtgctggtggtcgtgtagaggtccttctcctttcacatggtgcagagagcgaggacctctcctcctcgttcagttgcacttcagtattttcacggatatgaatgtaaaatatataaatatataaacctgcggctttaacaactgtaatacaaccttttgaattagttccgtgtatagataattaaattcttcatacaaaagtta

SEQ ID NO: 427856 - DNA, 5088 bp, Homo sapiens
acttatgggcggagatggatggtggatggggggcgggggaggcagcggagggagatgaggagataggcgggagcgagggagcgagggagggagcgaaggaggtagagaagagtggaggcgccaggggagggagcgtagcttggttgctccgtagtacggcggctcgcgaggaagaatcccgagcgggctccgggacggacagagaggcgggcggggatggtgtgcggggctgcggctcctgcgtccctcccagcggcgcgtgagcggcactgatttgtccctggggcggcagcgcggacccgcccggagatgaggcgtcgattagcaaggtaaaagtaacagaaccatggctcagtttccaacaccttttggtggcagcctggatatctgggccataactgtagaggaaagagcgaagcatgatcagcagttccatagtttaaagccaatatctggattcattactggtgatcaagctagaaactttttttttcaatctgggttacctcaacctgttttagcacagatatgggcactagctgacatgaataatgatggaagaatggatcaagtggagttttccatagctatgaaacttatcaaactgaagctacaaggatatcagctaccctctgcacttccccctgtcatgaaacagcaaccagttgctatttctagcgcaccagcatttggtatgggaggtatcgccagcatgccaccgcttacagctgttgctccagtgccaatgggatccattccagttgttggaatgtctccaaccctagtatcttctgttcccacagcagctgtgccccccctggctaacggggctccccctgttatacaacctctgcctgcatttgctcatcctgcagccacattgccaaagagttcttcctttagtagatctggtccagggtcacaactaaacactaaattacaaaaggcacagtcatttgatgtggccagtgtcccaccagtggcagagtgggctgttcctcagtcatcaagactgaaatacaggcaattattcaatagtcatgacaaaactatgagtggacacttaacaggtccccaagcaagaactattcttatgcagtcaagtttaccacaggctcagctggcttcaatatggaatctttctgacattgatcaagatggaaaacttacagcagaggaatttatcctggcaatgcacctcattgatgtagctatgtctggccaaccactgccacctgtcctgcctccagaatacattccaccttcttttagaagagttcgatctggcagtggtatatctgtcataagctcaacatctgtagatcagaggctaccagaggaaccagttttagaagatgaacaacaacaattagaaaagaaattacctgtaacgtttgaagataagaagcgggagaactttgaacgtggcaacctggaactggagaaacgaaggcaagctctcctggaacagcagcgcaaggagcaggagcgcctggcccagctggagcgggcggagcaggagaggaaggagcgtgagcgccaggagcaagagcgcaaaagacaactggaactggagaagcaactggaaaagcagcgggagctagaacggcagagagaggaggagaggaggaaagaaattgagaggcgagaggctgcaaaacgggaacttgaaaggcaacgacaacttgagtgggaacggaatcgaaggcaagaactactaaatcaaagaaacaaagaacaagaggacatagttgtactgaaagcaaagaaaaagactttggaatttgaattagaagctctaaatgataaaaagcatcaactagaagggaaacttcaagatatcagatgtcgattgaccacccaaaggcaagaaattgagagcacaaacaaatctagagagttgagaattgccgaaatcacccatctacagcaacaattacaggaatctcagcaaatgcttggaagacttattccagaaaaacagatactcaatgaccaattaaaacaagttcagcagaacagtttgcacagagattcacttgttacacttaaaagagccttagaagcaaaagaactagctcggcagcacctacgagaccaactggatgaagtggagaaagaaactagatcaaaactacaggaggacgagcatcagagaccaagaaaactccacgaagaggaaaaactgaaaagggaggagagtgtcaaaaagaaggatggcgaggaaaaaggcaaacaggaagcacaagacaagctgggtcggcttttccatcaacaccaagaaccagctaagccagctgtccaggcaccctggtccactgcagaaaaaggtccacttaccatttctgcacaggaaaatgtaaaagtggtgtattaccgggcactgtacccctttgaatccagaagccatgatgaaatcactatccagccaggagacatagtcaatggtggatgaaagccaaactggagaacccggctggcttggaggagaattaaaaggaaagacagggtggttccctgcaaactatgcagagaaaatcccagaaaatgaggttcccgctccagtgaaaccagtgactgattcaacatctgcccctgcccccaaactggccttgcgtgagacccccgcccctttggcagtaacctcttcagagccctccacgacccctaataactgggccgacttcagctccacgtggcccaccagcacgaatgagaaaccagaaacggataactgggatgcatgggcagcccagccctctctcaccgttccaagtgccggccagttaaggcagaggtccgcctttactccagccacggccactggctcctccccgtctcctgtgctaggccagggtgaaaaggtggaggggctacaagctcaagccctatatccttggagagccaaaaaagacaaccacttaaattttaacaaaaatgatgtcatcaccgtcctggaacagcaagacatgtggtggtttggagaagttcaaggtcagaagggttggttccccaagtcttacgtgaaactcatttcagggcccataaggaagtctacaagcatggattctggttcttcagagagtcctgctagtctaaagcgagtagcctctccagcagccaagccggtcgtttcgggagaagaaattgcccaggttattgcctcatacaccgccaccggccccgagcagctcactctcgcccctggtcagctgattttgatccgaaaaaagaacccaggtggatggtgggaaggagagctgcaagcacgtgggaaaaagcgccagataggctggttcccagctaattatgtaaagcttctaagccctgggacgagcaaaatcactccaacagagccacctaagtcaacagcattagcggcagtgtgccaggtgattgggatgtacgactacaccgcgcagaatgacgatgagctggccttcaacaagggccagatcatcaacgtcctcaacaaggaggaccctgactggtggaaaggagaagtcaatggacaagtggggctcttcccatccaattatgtgaagctgaccacagacatggacccaagccagcaatgaatcatatgttgtccatccccccctcaggcttgaaagtcctcaaagagacccactatcccatatcactgcccagagggatgatgggagatgcagccttgatcatgtgacttccagcatgatcacctactgccttctgagtagaagaactcactgcagagcagtttacctcattttaccttagttgcatgtgatcgcaatgtttgagttattacttgcagagataggagcaaaaattacaaaaacacacagggtagtgggtccttttgtggctttcctagttactcaaattgactttcccccacctttgcacaggtgctttcaatagttttaaaattatttttaaatatatattttagctttttaataaacaaaataaataaatgacttctttgctattttggttttgcaaaaagacccactatcaaggaatgctgcatgtgctattaaaaattgttccaaatgtccataaatctgagacttgatgtattttttcattttgtccagtgttaccaactaaattgtgcagtttggggcttttcccccttaccatagaagtgcagaggagttcagtatctctgttttaaagacgtatagaatgagcccaattaaagcgaaggtgtttgtgcttgtttgtgtgtatcagctgtaccttgttgagcatgtaatacatcctgtacataagaaattagttctttccatggcaaagctattaccttgtacgatgctctaatcatattgcatttaattttattttgcacagtgaccttgtagccacatgagaaagcactctgtgtttttgttcggtctcagatttatctggttgagttggtgttttgtttggggtttttaattttgcgtgtttgcatagcataaaatcagtagacaacaccactgaggtcgttacgatcaacgatatccacagtctctttttagtctctgttacatgaagttttattccagttacttttcatggaatgacctattttgaacaagtaattttcttgacaagaaagaatgtatagaagtctccctgcaattaatttccaatgtttacattttttaactagactgtggaatttctacagattaatatgaaatggagctcatggtccgtttgtgtgttagatatgctgtagctgaagccctgtttgtcttttaaacactagttggaagctctcaataaaaatgcctgctgctcacagcacagaaaatggggcagggggagcctcaagcacaatctagctgtcctcctaaagactctgtaatgctcactcccctcgcgttctcccggcgctgtcgggaggctgtgctggtggtcgtgtagaggtccttctcctttcacatggtgcagagagcgaggacctctcctcctcgttcagttgcacttcagtattttcacggatatgaatgtaaaatatataaatatataaacctgcggctttaacaactgtaatacaaccttttgaattagttccgtgtatagataattaaattcttcatacaaaagtta

SEQ ID NO: 427857 - DNA, 5283 bp, Homo sapiens
acttatgggcggagatggatggtggatggggggcgggggaggcagcggagggagatgaggagataggcgggagcgagggagcgagggagggagcgaaggaggtagagaagagtggaggcgccaggggagggagcgtagcttggttgctccgtagtacggcggctcgcgaggaagaatcccgagcgggctccgggacggacagagaggcgggcggggatggtgtgcggggctgcggctcctgcgtccctcccagcggcgcgtgagcggcactgatttgtccctggggcggcagcgcggacccgcccggagatgaggcgtcgattagcaaggtaaaagtaacagaaccatggctcagtttccaacaccttttggtggcagcctggatatctgggccataactgtagaggaaagagcgaagcatgatcagcagttccatagtttaaagccaatatctggattcattactggtgatcaagctagaaactttttttttcaatctgggttacctcaacctgttttagcacagatatgggcactagctgacatgaataatgatggaagaatggatcaagtggagttttccatagctatgaaacttatcaaactgaagctacaaggatatcagctaccctctgcacttccccctgtcatgaaacagcaaccagttgctatttctagcgcaccagcatttggtatgggaggtatcgccagcatgccaccgcttacagctgttgctccagtgccaatgggatccattccagttgttggaatgtctccaaccctagtatcttctgttcccacagcagctgtgccccccctggctaacggggctccccctgttatacaacctctgcctgcatttgctcatcctgcagccacattgccaaagagttcttcctttagtagatctggtccagggtcacaactaaacactaaattacaaaaggcacagtcatttgatgtggccagtgtcccaccagtggcagagtgggctgttcctcagtcatcaagactgaaatacaggcaattattcaatagtcatgacaaaactatgagtggacacttaacaggtccccaagcaagaactattcttatgcagtcaagtttaccacaggctcagctggcttcaatatggaatctttctgacattgatcaagatggaaaacttacagcagaggaatttatcctggcaatgcacctcattgatgtagctatgtctggccaaccactgccacctgtcctgcctccagaatacattccaccttcttttagaagagttcgatctggcagtggtatatctgtcataagctcaacatctgtagatcagaggctaccagaggaaccagttttagaagatgaacaacaacaattagaaaagaaattacctgtaacgtttgaagataagaagcgggagaactttgaacgtggcaacctggaactggagaaacgaaggcaagctctcctggaacagcagcgcaaggagcaggagcgcctggcccagctggagcgggcggagcaggagaggaaggagcgtgagcgccaggagcaagagcgcaaaagacaactggaactggagaagcaactggaaaagcagcgggagctagaacggcagagagaggaggagaggaggaaagaaattgagaggcgagaggctgcaaaacgggaacttgaaaggcaacgacaacttgagtgggaacggaatcgaaggcaagaactactaaatcaaagaaacaaagaacaagaggacatagttgtactgaaagcaaagaaaaagactttggaatttgaattagaagctctaaatgataaaaagcatcaactagaagggaaacttcaagatatcagatgtcgattgaccacccaaaggcaagaaattgagagcacaaacaaatctagagagttgagaattgccgaaatcacccatctacagcaacaattacaggaatctcagcaaatgcttggaagacttattccagaaaaacagatactcaatgaccaattaaaacaagttcagcagaacagtttgcacagagattcacttgttacacttaaaagagccttagaagcaaaagaactagctcggcagcacctacgagaccaactggatgaagtggagaaagaaactagatcaaaactacaggagattgatattttcaataatcagctgaaggaactaagagaaatacacaataagcaacaactccagaagcaaaagtccatggaggctgaacgactgaaacagaaagaacaagaacgaaagatcatagaattagaaaaacaaaaagaagaagcccaaagacgagctcaggaaagggacaagcagtggctggagcatgtgcagcaggaggacgagcatcagagaccaagaaaactccacgaagaggaaaaactgaaaagggaggagagtgtcaaaaagaaggatggcgaggaaaaaggcaaacaggaagcacaagacaagctgggtcggcttttccatcaacaccaagaaccagctaagccagctgtccaggcaccctggtccactgcagaaaaaggtccacttaccatttctgcacaggaaaatgtaaaagtggtgtattaccgggcactgtacccctttgaatccagaagccatgatgaaatcactatccagccaggagacatagtcaatggtggatgaaagccaaactggagaacccggctggcttggaggagaattaaaaggaaagacagggtggttccctgcaaactatgcagagaaaatcccagaaaatgaggttcccgctccagtgaaaccagtgactgattcaacatctgcccctgcccccaaactggccttgcgtgagacccccgcccctttggcagtaacctcttcagagccctccacgacccctaataactgggccgacttcagctccacgtggcccaccagcacgaatgagaaaccagaaacggataactgggatgcatgggcagcccagccctctctcaccgttccaagtgccggccagttaaggcagaggtccgcctttactccagccacggccactggctcctccccgtctcctgtgctaggccagggtgaaaaggtggaggggctacaagctcaagccctatatccttggagagccaaaaaagacaaccacttaaattttaacaaaaatgatgtcatcaccgtcctggaacagcaagacatgtggtggtttggagaagttcaaggtcagaagggttggttccccaagtcttacgtgaaactcatttcagggcccataaggaagtctacaagcatggattctggttcttcagagagtcctgctagtctaaagcgagtagcctctccagcagccaagccggtcgtttcgggagaagaatttattgccatgtacacttacgagagttctgagcaaggagatttaacctttcagcaaggggatgtgattttggttaccaagaaagatggtgactggtggacaggaacagtgggcgacaaggccggagtcttcccttctaactatgtgaggcttaaagattcagagggctctggaactgctgggaaaacagggagtttaggaaaaaaacctgaaattgcccaggttattgcctcatacaccgccaccggccccgagcagctcactctcgcccctggtcagctgattttgatccgaaaaaagaacccaggtggatggtgggaaggagagctgcaagcacgtgggaaaaagcgccagataggctggttcccagctaattatgtaaagcttctaagccctgggacgagcaaaatcactccaacagagccacctaagtcaacagcattagcggcagtgtgccaggtgattgggatgtacgactacaccgcgcagaatgacgatgagctggccttcaacaagggccagatcatcaacgtcctcaacaaggaggaccctgactggtggaaaggagaagtcaatggacaagtggggctcttcccatccaattatgtgaagctgaccacagacatggacccaagccagcaatgaatcatatgttgtccatccccccctcaggcttgaaagtccttttgtggctttcctagttactcaaattgactttcccccacctttgcacaggtgctttcaatagttttaaaattatttttaaatatatattttagctttttaataaacaaaataaataaatgacttctttgctattttggttttgcaaaaagacccactatcaaggaatgctgcatgtgctattaaaaattgttccaaatgtccataaatctgagacttgatgtattttttcattttgtccagtgttaccaactaaattgtgcagtttggggcttttcccccttaccatagaagtgcagaggagttcagtatctctgttttaaagacgtatagaatgagcccaattaaagcgaaggtgtttgtgcttgtttgtgtgtatcagctgtaccttgttgagcatgtaatacatcctgtacataagaaattagttctttccatggcaaagctattaccttgtacgatgctctaatcatattgcatttaattttattttgcacagtgaccttgtagccacatgagaaagcactctgtgtttttgttcggtctcagatttatctggttgagttggtgttttgtttggggtttttaattttgcgtgtttgcatagcataaaatcagtagacaacaccactgaggtcgttacgatcaacgatatccacagtctctttttagtctctgttacatgaagttttattccagttacttttcatggaatgacctattttgaacaagtaattttcttgacaagaaagaatgtatagaagtctccctgcaattaatttccaatgtttacattttttaactagactgtggaatttctacagattaatatgaaatggagctcatggtccgtttgtgtgttagatatgctgtagctgaagccctgtttgtcttttaaacactagttggaagctctcaataaaaatgcctgctgctcacagcacagaaaatggggcagggggagcctcaagcacaatctagctgtcctcctaaagactctgtaatgctcactcccctcgcgttctcccggcgctgtcgggaggctgtgctggtggtcgtgtagaggtccttctcctttcacatggtgcagagagcgaggacctctcctcctcgttcagttgcacttcagtattttcacggatatgaatgtaaaatatataaatatataaacctgcggctttaacaactgtaatacaaccttttgaattagttccgtgtatagataattaaattcttcatacaaaagtta

SEQ ID NO: 427858 - DNA, 5451 bp, Homo sapiens
acttatgggcggagatggatggtggatggggggcgggggaggcagcggagggagatgaggagataggcgggagcgagggagcgagggagggagcgaaggaggtagagaagagtggaggcgccaggggagggagcgtagcttggttgctccgtagtacggcggctcgcgaggaagaatcccgagcgggctccgggacggacagagaggcgggcggggatggtgtgcggggctgcggctcctgcgtccctcccagcggcgcgtgagcggcactgatttgtccctggggcggcagcgcggacccgcccggagatgaggcgtcgattagcaaggtaaaagtaacagaaccatggctcagtttccaacaccttttggtggcagcctggatatctgggccataactgtagaggaaagagcgaagcatgatcagcagttccatagtttaaagccaatatctggattcattactggtgatcaagctagaaactttttttttcaatctgggttacctcaacctgttttagcacagatatgggcactagctgacatgaataatgatggaagaatggatcaagtggagttttccatagctatgaaacttatcaaactgaagctacaaggatatcagctaccctctgcacttccccctgtcatgaaacagcaaccagttgctatttctagcgcaccagcatttggtatgggaggtatcgccagcatgccaccgcttacagctgttgctccagtgccaatgggatccattccagttgttggaatgtctccaaccctagtatcttctgttcccacagcagctgtgccccccctggctaacggggctccccctgttatacaacctctgcctgcatttgctcatcctgcagccacattgccaaagagttcttcctttagtagatctggtccagggtcacaactaaacactaaattacaaaaggcacagtcatttgatgtggccagtgtcccaccagtggcagagtgggctgttcctcagtcatcaagactgaaatacaggcaattattcaatagtcatgacaaaactatgagtggacacttaacaggtccccaagcaagaactattcttatgcagtcaagtttaccacaggctcagctggcttcaatatggaatctttctgacattgatcaagatggaaaacttacagcagaggaatttatcctggcaatgcacctcattgatgtagctatgtctggccaaccactgccacctgtcctgcctccagaatacattccaccttcttttagaagagttcgatctggcagtggtatatctgtcataagctcaacatctgtagatcagaggctaccagaggaaccagttttagaagatgaacaacaacaattagaaaagaaattacctgtaacgtttgaagataagaagcgggagaactttgaacgtggcaacctggaactggagaaacgaaggcaagctctcctggaacagcagcgcaaggagcaggagcgcctggcccagctggagcgggcggagcaggagaggaaggagcgtgagcgccaggagcaagagcgcaaaagacaactggaactggagaagcaactggaaaagcagcgggagctagaacggcagagagaggaggagaggaggaaagaaattgagaggcgagaggctgcaaaacgggaacttgaaaggcaacgacaacttgagtgggaacggaatcgaaggcaagaactactaaatcaaagaaacaaagaacaagaggacatagttgtactgaaagcaaagaaaaagactttggaatttgaattagaagctctaaatgataaaaagcatcaactagaagggaaacttcaagatatcagatgtcgattgaccacccaaaggcaagaaattgagagcacaaacaaatctagagagttgagaattgccgaaatcacccatctacagcaacaattacaggaatctcagcaaatgcttggaagacttattccagaaaaacagatactcaatgaccaattaaaacaagttcagcagaacagtttgcacagagattcacttgttacacttaaaagagccttagaagcaaaagaactagctcggcagcacctacgagaccaactggatgaagtggagaaagaaactagatcaaaactacaggagattgatattttcaataatcagctgaaggaactaagagaaatacacaataagcaacaactccagaagcaaaagtccatggaggctgaacgactgaaacagaaagaacaagaacgaaagatcatagaattagaaaaacaaaaagaagaagcccaaagacgagctcaggaaagggacaagcagtggctggagcatgtgcagcaggaggacgagcatcagagaccaagaaaactccacgaagaggaaaaactgaaaagggaggagagtgtcaaaaagaaggatggcgaggaaaaaggcaaacaggaagcacaagacaagctgggtcggcttttccatcaacaccaagaaccagctaagccagctgtccaggcaccctggtccactgcagaaaaaggtccacttaccatttctgcacaggaaaatgtaaaagtggtgtattaccgggcactgtacccctttgaatccagaagccatgatgaaatcactatccagccaggagacatagtcaatggtggatgaaagccaaactggagaacccggctggcttggaggagaattaaaaggaaagacagggtggttccctgcaaactatgcagagaaaatcccagaaaatgaggttcccgctccagtgaaaccagtgactgattcaacatctgcccctgcccccaaactggccttgcgtgagacccccgcccctttggcagtaacctcttcagagccctccacgacccctaataactgggccgacttcagctccacgtggcccaccagcacgaatgagaaaccagaaacggataactgggatgcatgggcagcccagccctctctcaccgttccaagtgccggccagttaaggcagaggtccgcctttactccagccacggccactggctcctccccgtctcctgtgctaggccagggtgaaaaggtggaggggctacaagctcaagccctatatccttggagagccaaaaaagacaaccacttaaattttaacaaaaatgatgtcatcaccgtcctggaacagcaagacatgtggtggtttggagaagttcaaggtcagaagggttggttccccaagtcttacgtgaaactcatttcagggcccataaggaagtctacaagcatggattctggttcttcagagagtcctgctagtctaaagcgagtagcctctccagcagccaagccggtcgtttcgggagaagaatttattgccatgtacacttacgagagttctgagcaaggagatttaacctttcagcaaggggatgtgattttggttaccaagaaagatggtgactggtggacaggaacagtgggcgacaaggccggagtcttcccttctaactatgtgaggcttaaagattcagagggctctggaactgctgggaaaacagggagtttaggaaaaaaacctgaaattgcccaggttattgcctcatacaccgccaccggccccgagcagctcactctcgcccctggtcagctgattttgatccgaaaaaagaacccaggtggatggtgggaaggagagctgcaagcacgtgggaaaaagcgccagataggctggttcccagctaattatgtaaagcttctaagccctgggacgagcaaaatcactccaacagagccacctaagtcaacagcattagcggcagtgtgccaggtgattgggatgtacgactacaccgcgcagaatgacgatgagctggccttcaacaagggccagatcatcaacgtcctcaacaaggaggaccctgactggtggaaaggagaagtcaatggacaagtggggctcttcccatccaattatgtgaagctgaccacagacatggacccaagccagcaatgaatcatatgttgtccatccccccctcaggcttgaaagtcctcaaagagacccactatcccatatcactgcccagagggatgatgggagatgcagccttgatcatgtgacttccagcatgatcacctactgccttctgagtagaagaactcactgcagagcagtttacctcattttaccttagttgcatgtgatcgcaatgtttgagttattacttgcagagataggagcaaaaattacaaaaacacacagggtagtgggtccttttgtggctttcctagttactcaaattgactttcccccacctttgcacaggtgctttcaatagttttaaaattatttttaaatatatattttagctttttaataaacaaaataaataaatgacttctttgctattttggttttgcaaaaagacccactatcaaggaatgctgcatgtgctattaccagtgttaccaactaaattgtgcagtttggggcttttcccccttaccatagaagtgcagaggagttcagtatctctgttttaaagacgtatagaatgagcccaattaaagcgaaggtgtttgtgcttgtttgtgtgtatcagctgtaccttgttgagcatgtaatacatcctgtacataagaaattagttctttccatggcaaagctattaccttgtacgatgctctaatcatattgcatttaattttattttgcacagtgaccttgtagccacatgagaaagcactctgtgtttttgttcggtctcagatttatctggttgagttggtgttttgtttggggtttttaattttgcgtgtttgcatagcataaaatcagtagacaacaccactgaggtcgttacgatcaacgatatccacagtctctttttagtctctgttacatgaagttttattccagttacttttcatggaatgacctattttgaacaagtaattttcttgacaagaaagaatgtatagaagtctccctgcaattaatttccaatgtttacattttttaactagactgtggaatttctacagattaatatgaaatggagctcatggtccgtttgtgtgttagatatgctgtagctgaagccctgtttgtcttttaaacactagttggaagctctcaataaaaatgcctgctgctcacagcacagaaaatggggcagggggagcctcaagcacaatctagctgtcctcctaaagactctgtaatgctcactcccctcgcgttctcccggcgctgtcgggaggctgtgctggtggtcgtgtagaggtccttctcctttcacatggtgcagagagcgaggacctctcctcctcgttcagttgcacttcagtattttcacggatatgaatgtaaaatatataaatatataaacctgcggctttaacaactgtaatacaaccttttgaattagttccgtgtatagataattaaattcttcatacaaaagtta

SEQ ID NO: 427859 - DNA, 4639 bp, Homo sapiens
cagaagtacccacagcagaatagatcatgtgtcccaccagtggcagagtgggctgttcctcagtcatcaagactgaaatacaggcaattattcaatagtcatgacaaaactatgagtggacacttaacagatggagcttcactcttgttgcccaggccggagtgcaatggtgtgatctcagctcactgcaatctccacctcctgggttcaagtgagtctcctgcctcagcctcccaagtagctgggattacaggcatgtaccaccacgcccggctaattttgtatttttagtagaaacagggtttcaccatgttgctcaggctggtctcaaactcctgacctcaggtgatccacccacctcagcctcccaaagtgctgggattacaggcatgagccaccacacccggcccactgaaggtccccaagcaagaactattcttatgcagtcaagtttaccacaggctcagctggcttcaatatggaatctttctgacattgatcaagatggaaaacttacagcagaggaatttatcctggcaatgcacctcattgatgtagctatgtctggccaaccactgccacctgtcctgcctccagaatacattccaccttcttttagaagagttcgatctggcagtggtatatctgtcataagctcaacatctgtagatcagaggctaccagaggaaccagttttagaagatgaacaacaacaattagaaaagaaattacctgtaacgtttgaagataagaagcgggagaactttgaacgtggcaacctggaactggagaaacgaaggcaagctctcctggaacagcagcgcaaggagcaggagcgcctggcccagctggagcgggcggagcaggagaggaaggagcgtgagcgccaggagcaagagcgcaaaagacaactggaactggagaagcaactggaaaagcagcgggagctagaacggcagagagaggaggagaggaggaaagaaattgagaggcgagaggctgcaaaacgggaacttgaaaggcaacgacaacttgagtgggaacggaatcgaaggcaagaactactaaatcaaagaaacaaagaacaagaggacatagttgtactgaaagcaaagaaaaagactttggaatttgaattagaagctctaaatgataaaaagcatcaactagaagggaaacttcaagatatcagatgtcgattgaccacccaaaggcaagaaattgagagcacaaacaaatctagagagttgagaattgccgaaatcacccatctacagcaacaattacaggaatctcagcaaatgcttggaagacttattccagaaaaacagatactcaatgaccaattaaaacaagttcagcagaacagtttgcacagagattcacttgttacacttaaaagagccttagaagcaaaagaactagctcggcagcacctacgagaccaactggatgaagtggagaaagaaactagatcaaaactacaggagattgatattttcaataatcagctgaaggaactaagagaaatacacaataagcaacaactccagaagcaaaagtccatggaggctgaacgactgaaacagaaagaacaagaacgaaagatcatagaattagaaaaacaaaaagaagaagcccaaagacgagctcaggaaagggacaagcagtggctggagcatgtgcagcaggaggacgagcatcagagaccaagaaaactccacgaagaggaaaaactgaaaagggaggagagtgtcaaaaagaaggatggcgaggaaaaaggcaaacaggaagcacaagacaagctgggtcggcttttccatcaacaccaagaaccagctaagccagctgtccaggcaccctggtccactgcagaaaaaggtccacttaccatttctgcacaggaaaatgtaaaagtggtgtattaccgggcactgtacccctttgaatccagaagccatgatgaaatcactatccagccaggagacatagtcaatggtggatgaaagccaaactggagaacccggctggcttggaggagaattaaaaggaaagacagggtggttccctgcaaactatgcagagaaaatcccagaaaatgaggttcccgctccagtgaaaccagtgactgattcaacatctgcccctgcccccaaactggccttgcgtgagacccccgcccctttggcagtaacctcttcagagccctccacgacccctaataactgggccgacttcagctccacgtggcccaccagcacgaatgagaaaccagaaacggataactgggatgcatgggcagcccagccctctctcaccgttccaagtgccggccagttaaggcagaggtccgcctttactccagccacggccactggctcctccccgtctcctgtgctaggccagggtgaaaaggtggaggggctacaagctcaagccctatatccttggagagccaaaaaagacaaccacttaaattttaacaaaaatgatgtcatcaccgtcctggaacagcaagacatgtggtggtttggagaagttcaaggtcagaagggttggttccccaagtcttacgtgaaactcatttcagggcccataaggaagtctacaagcatggattctggttcttcagagagtcctgctagtctaaagcgagtagcctctccagcagccaagccggtcgtttcgggagaagaaattgcccaggttattgcctcatacaccgccaccggccccgagcagctcactctcgcccctggtcagctgattttgatccgaaaaaagaacccaggtggatggtgggaaggagagctgcaagcacgtgggaaaaagcgccagataggctggttcccagctaattatgtaaagcttctaagccctgggacgagcaaaatcactccaacagagccacctaagtcaacagcattagcggcagtgtgccaggtgattgggatgtacgactacaccgcgcagaatgacgatgagctggccttcaacaagggccagatcatcaacgtcctcaacaaggaggaccctgactggtggaaaggagaagtcaatggacaagtggggctcttcccatccaattatgtgaagctgaccacagacatggacccaagccagcaatgaatcatatgttgtccatccccccctcaggcttgaaagtcctcaaagagacccactatcccatatcactgcccagagggatgatgggagatgcagccttgatcatgtgacttccagcatgatcacctactgccttctgagtagaagaactcactgcagagcagtttacctcattttaccttagttgcatgtgatcgcaatgtttgagttattacttgcagagataggagcaaaaattacaaaaacacacagggtagtgggtccttttgtggctttcctagttactcaaattgactttcccccacctttgcacaggtgctttcaatagttttaaaattatttttaaatatatattttagctttttaataaacaaaataaataaatgacttctttgctattttggttttgcaaaaagacccactatcaaggaatgctgcatgtgctattaaaaattgttccaaatgtccataaatctgagacttgatgtattttttcattttgtccagtgttaccaactaaattgtgcagtttggggcttttcccccttaccatagaagtgcagaggagttcagtatctctgttttaaagacgtatagaatgagcccaattaaagcgaaggtgtttgtgcttgtttgtgtgtatcagctgtaccttgttgagcatgtaatacatcctgtacataagaaattagttctttccatggcaaagctattaccttgtacgatgctctaatcatattgcatttaattttattttgcacagtgaccttgtagccacatgagaaagcactctgtgtttttgttcggtctcagatttatctggttgagttggtgttttgtttggggtttttaattttgcgtgtttgcatagcataaaatcagtagacaacaccactgaggtcgttacgatcaacgatatccacagtctctttttagtctctgttacatgaagttttattccagttacttttcatggaatgacctattttgaacaagtaattttcttgacaagaaagaatgtatagaagtctccctgcaattaatttccaatgtttacattttttaactagactgtggaatttctacagattaatatgaaatggagctcatggtccgtttgtgtgttagatatgctgtagctgaagccctgtttgtcttttaaacactagttggaagctctcaataaaaatgcctgctgctcacagcacagaaaatggggcagggggagcctcaagcacaatctagctgtcctcctaaagactctgtaatgctcactcccctcgcgttctcccggcgctgtcgggaggctgtgctggtggtcgtgtagaggtccttctcctttcacatggtgcagagagcgaggacctctcctcctcgttcagttgcacttcagtattttcacggatatgaatgtaaaatatataaatatataaacctgcggctttaacaactgtaatacaaccttttgaattagttccgtgtatagataattaaattcttcatacaaaagtta

SEQ ID NO: 427860 - DNA, 5451 bp, Homo sapiens
acttatgggcggagatggatggtggatggggggcgggggaggcagcggagggagatgaggagataggcgggagcgagggagcgagggagggagcgaaggaggtagagaagagtggaggcgccaggggagggagcgtagcttggttgctccgtagtacggcggctcgcgaggaagaatcccgagcgggctccgggacggacagagaggcgggcggggatggtgtgcggggctgcggctcctgcgtccctcccagcggcgcgtgagcggcactgatttgtccctggggcggcagcgcggacccgcccggagatgaggcgtcgattagcaaggtaaaagtaacagaaccatggctcagtttccaacaccttttggtggcagcctggatatctgggccataactgtagaggaaagagcgaagcatgatcagcagttccatagtttaaagccaatatctggattcattactggtgatcaagctagaaactttttttttcaatctgggttacctcaacctgttttagcacagatatgggcactagctgacatgaataatgatggaagaatggatcaagtggagttttccatagctatgaaacttatcaaactgaagctacaaggatatcagctaccctctgcacttccccctgtcatgaaacagcaaccagttgctatttctagcgcaccagcatttggtatgggaggtatcgccagcatgccaccgcttacagctgttgctccagtgccaatgggatccattccagttgttggaatgtctccaaccctagtatcttctgttcccacagcagctgtgccccccctggctaacggggctccccctgttatacaacctctgcctgcatttgctcatcctgcagccacattgccaaagagttcttcctttagtagatctggtccagggtcacaactaaacactaaattacaaaaggcacagtcatttgatgtggccagtgtcccaccagtggcagagtgggctgttcctcagtcatcaagactgaaatacaggcaattattcaatagtcatgacaaaactatgagtggacacttaacaggtccccaagcaagaactattcttatgcagtcaagtttaccacaggctcagctggcttcaatatggaatctttctgacattgatcaagatggaaaacttacagcagaggaatttatcctggcaatgcacctcattgatgtagctatgtctggccaaccactgccacctgtcctgcctccagaatacattccaccttcttttagaagagttcgatctggcagtggtatatctgtcataagctcaacatctgtagatcagaggctaccagaggaaccagttttagaagatgaacaacaacaattagaaaagaaattacctgtaacgtttgaagataagaagcgggagaactttgaacgtggcaacctggaactggagaaacgaaggcaagctctcctggaacagcagcgcaaggagcaggagcgcctggcccagctggagcgggcggagcaggagaggaaggagcgtgagcgccaggagcaagagcgcaaaagacaactggaactggagaagcaactggaaaagcagcgggagctagaacggcagagagaggaggagaggaggaaagaaattgagaggcgagaggctgcaaaacgggaacttgaaaggcaacgacaacttgagtgggaacggaatcgaaggcaagaactactaaatcaaagaaacaaagaacaagaggacatagttgtactgaaagcaaagaaaaagactttggaatttgaattagaagctctaaatgataaaaagcatcaactagaagggaaacttcaagatatcagatgtcgattgaccacccaaaggcaagaaattgagagcacaaacaaatctagagagttgagaattgccgaaatcacccatctacagcaacaattacaggaatctcagcaaatgcttggaagacttattccagaaaaacagatactcaatgaccaattaaaacaagttcagcagaacagtttgcacagagattcacttgttacacttaaaagagccttagaagcaaaagaactagctcggcagcacctacgagaccaactggatgaagtggagaaagaaactagatcaaaactacaggagattgatattttcaataatcagctgaaggaactaagagaaatacacaataagcaacaactccagaagcaaaagtccatggaggctgaacgactgaaacagaaagaacaagaacgaaagatcatagaattagaaaaacaaaaagaagaagcccaaagacgagctcaggaaagggacaagcagtggctggagcatgtgcagcaggaggacgagcatcagagaccaagaaaactccacgaagaggaaaaactgaaaagggaggagagtgtcaaaaagaaggatggcgaggaaaaaggcaaacaggaagcacaagacaagctgggtcggcttttccatcaacaccaagaaccagctaagccagctgtccaggcaccctggtccactgcagaaaaaggtccacttaccatttctgcacaggaaaatgtaaaagtggtgtattaccgggcactgtacccctttgaatccagaagccatgatgaaatcactatccagccaggagacatagtcaatggtggatgaaagccaaactggagaacccggctggcttggaggagaattaaaaggaaagacagggtggttccctgcaaactatgcagagaaaatcccagaaaatgaggttcccgctccagtgaaaccagtgactgattcaacatctgcccctgcccccaaactggccttgcgtgagacccccgcccctttggcagtaacctcttcagagccctccacgacccctaataactgggccgacttcagctccacgtggcccaccagcacgaatgagaaaccagaaacggataactgggatgcatgggcagcccagccctctctcaccgttccaagtgccggccagttaaggcagaggtccgcctttactccagccacggccactggctcctccccgtctcctgtgctaggccagggtgaaaaggtggaggggctacaagctcaagccctatatccttggagagccaaaaaagacaaccacttaaattttaacaaaaatgatgtcatcaccgtcctggaacagcaagacatgtggtggtttggagaagttcaaggtcagaagggttggttccccaagtcttacgtgaaactcatttcagggcccataaggaagtctacaagcatggattctggttcttcagagagtcctgctagtctaaagcgagtagcctctccagcagccaagccggtcgtttcgggagaagaatttattgccatgtacacttacgagagttctgagcaaggagatttaacctttcagcaaggggatgtgattttggttaccaagaaagatggtgactggtggacaggaacagtgggcgacaaggccggagtcttcccttctaactatgtgaggcttaaagattcagagggctctggaactgctgggaaaacagggagtttaggaaaaaaacctgaaattgcccaggttattgcctcatacaccgccaccggccccgagcagctcactctcgcccctggtcagctgattttgatccgaaaaaagaacccaggtggatggtgggaaggagagctgcaagcacgtgggaaaaagcgccagataggctggttcccagctaattatgtaaagcttctaagccctgggacgagcaaaatcactccaacagagccacctaagtcaacagcattagcggcagtgtgccaggtgattgggatgtacgactacaccgcgcagaatgacgatgagctggccttcaacaagggccagatcatcaacgtcctcaacaaggaggaccctgactggtggaaaggagaagtcaatggacaagtggggctcttcccatccaattatgtgaagctgaccacagacatggacccaagccagcaatgaatcatatgttgtccatccccccctcaggcttgaaagtcctcaaagagacccactatcccatatcactgcccagagggatgatgggagatgcagccttgatcatgtgacttccagcatgatcacctactgccttctgagtagaagaactcactgcagagcagtttacctcattttaccttagttgcatgtgatcgcaatgtttgagttattacttgcagagataggagcaaaaattacaaaaacacacagggtagtgggtccttttgtggctttcctagttactcaaattgactttcccccacctttgcacaggtgctttcaatagttttaaaattatttttaaatatatattttagctttttaataaacaaaataaataaatgacttctttgctattttggttttgcaaaaagacccactatcaaggaatgctgcatgtgctattaaaaattgttccaaatgtccataaatctgagacttgatgtattttttcattttgtccagtgttaccaactaaattgtgcagtttggggcttttcccccttaccatagaagtgcagaggagttcagtatctctgttttaaagacgtatagaatgagcccaattaaagcgaaggtgtttgtgcttgtttgtgtgtatcagctgtaccttgttgagcatgtaatacatcctgtacataagaaattagttctttccatggcaaagctattaccttgtacgatgctctaatcatattgcatttaattttattttgcacagtgaccttgtagccacatgagaaagcactctgtgtttttgttcggtctcagatttatctggttgagttggtgttttgtttggggtttttaattttgcgtgtttgcatagcataaaatcagtagacaacaccactgaggtcgttacgatcaacgatatccacagtctctttttagtctctgttacatgaagttttattccagttacttttcatggaatgacctattttgaacaagtaattttcttgacaagaaagaatgtatagaagtctccctgcaattaatttccaatgtttacattttttaactagactgtggaatttctacagattaatatgaaatggagctcatggtccgtttgtgtgttagatatgctgtagctgaagccctgtttgtcttttaaacactagttggaagctctcaataaaaatgcctgctgctcacagcacaggtaatgctcactcccctcgcgttctcccggcgctgtcgggaggctgtgctggtggtcgtgtagaggtccttctcctttcacatggtgcagagagcgaggacctctcctcctcgttcagttgcacttcagtattttcacggatatgaatgtaaaatatataaatatataaacctgcggctttaacaactgtaatacaaccttttgaattagttccgtgtatagataattaaattcttcatacaaaagtta

SEQ ID NO: 427861 - DNA, 2687 bp, Homo sapiens
ctagatggtcagacaatgactttgtgaagaggctggaaggctttggcctccacttttggaaataaacaattgttgggaaacagtgaagcatccagccctcctgctgtgctgcctcagggccctttgtggctgtgtgtgcttgtctggcctgtgcttgttggagaggtgccatgctcacgtctgccctaattgataacaaagcgcaacataacgagaggtcctttatgttattccacacaagggtgaaaaggtggaggggctacaagctcaagccctatatccttggagagccaaaaaagacaaccacttaaattttaacaaaaatgatgtcatcaccgtcctggaacagcaagacatgtggtggtttggagaagttcaaggtcagaagggttggttccccaagtcttacgtgaaactcatttcagggcccataaggaagtctacaagcatggattctggttcttcagagagtcctgctagtctaaagcgagtagcctctccagcagccaagccggtcgtttcgggagaagaatttattgccatgtacacttacgagagttctgagcaaggagatttaacctttcagcaaggggatgtgattttggttaccaagaaagatggtgactggtggacaggaacagtgggcgacaaggccggagtcttcccttctaactatgtgaggcttaaagattcagagggctctggaactgctgggaaaacagggagtttaggaaaaaaacctgaaattgcccaggttattgcctcatacaccgccaccggccccgagcagctcactctcgcccctggtcagctgattttgatccgaaaaaagaacccaggtggatggtgggaaggagagctgcaagcacgtgggaaaaagcgccagataggctggttcccagctaattatgtaaagcttctaagccctgggacgagcaaaatcactccaacagagccacctaagtcaacagcattagcggcagtgtgccaggtgattgggatgtacgactacaccgcgcagaatgacgatgagctggccttcaacaagggccagatcatcaacgtcctcaacaaggaggaccctgactggtggaaaggagaagtcaatggacaagtggggctcttcccatccaattatgtgaagctgaccacagacatggacccaagccagcaatgaatcatatgttgtccatccccccctcaggcttgaaagtcctcaaagagacccactatcccatatcactgcccagagggatgatgggagatgcagccttgatcatgtgacttccagcatgatcacctactgccttctgagtagaagaactcactgcagagcagtttacctcattttaccttagttgcatgtgatcgcaatgtttgagttattacttgcagagataggagcaaaaattacaaaaacacacagggtagtgggtccttttgtggctttcctagttactcaaattgactttcccccacctttgcacaggtgctttcaatagttttaaaattatttttaaatatatattttagctttttaataaacaaaataaataaatgacttctttgctattttggttttgcaaaaagacccactatcaaggaatgctgcatgtgctattaaaaattgttccaaatgtccataaatctgagacttgatgtattttttcattttgtccagtgttaccaactaaattgtgcagtttggggcttttcccccttaccatagaagtgcagaggagttcagtatctctgttttaaagacgtatagaatgagcccaattaaagcgaaggtgtttgtgcttgtttgtgtgtatcagctgtaccttgttgagcatgtaatacatcctgtacataagaaattagttctttccatggcaaagctattaccttgtacgatgctctaatcatattgcatttaattttattttgcacagtgaccttgtagccacatgagaaagcactctgtgtttttgttcggtctcagatttatctggttgagttggtgttttgtttggggtttttaattttgcgtgtttgcatagcataaaatcagtagacaacaccactgaggtcgttacgatcaacgatatccacagtctctttttagtctctgttacatgaagttttattccagttacttttcatggaatgacctattttgaacaagtaattttcttgacaagaaagaatgtatagaagtctccctgcaattaatttccaatgtttacattttttaactagactgtggaatttctacagattaatatgaaatggagctcatggtccgtttgtgtgttagatatgctgtagctgaagccctgtttgtcttttaaacactagttggaagctctcaataaaaatgcctgctgctcacagcacagaaaatggggcagggggagcctcaagcacaatctagctgtcctcctaaagactctgtaatgctcactcccctcgcgttctcccggcgctgtcgggaggctgtgctggtggtcgtgtagaggtccttctcctttcacatggtgcagagagcgaggacctctcctcctcgttcagttgcacttcagtattttcacggatatgaatgtaaaatatataaatatataaacctgcggctttaacaactgtaatacaaccttttgaattagttccgtgtatagataattaaattcttcatacaaaagtta

SEQ ID NO: 427862 - DNA, 2435 bp, Homo sapiens
agtggtttctgaggaaaatgggcttctctttctactgtacttggcagctagaaaagctattgagtcctttagtcacttcaaagtagcactttagccattgggtgctactgtgctggggtgggtggtgaatgaggccccacccttggcctcagggcattctgggtaattatgggaggggtgtgacagaaggtgccaggagtgggcaaggagcggacttcgtggagggaagttggtaagtaagtttcacgggatgacaagggagtctgcagcccactgagggctcaaggatcagccaggcccttgaatgccgtgtctgcctggtagctctgggaacgggcgattcagggagccttactcgttgggtagaaatccagctcaatacattggttttgatgtgttcatctgtgaacctgggaggcgcctgcatcttcttggccttttctcctgctgactcttaacagtgcactgccgtgtttgatcttgtttttcacaaattgcccaggttattgcctcatacaccgccaccggccccgagcagctcactctcgcccctggtcagctgattttgatccgaaaaaagaacccaggtggatggtgggaaggagagctgcaagcacgtgggaaaaagcgccagataggctggttcccagctaattatgtaaagcttctaagccctgggacgagcaaaatcactccaacagagccacctaagtcaacagcattagcggcagtgtgccaggtgattgggatgtacgactacaccgcgcagaatgacgatgagctggccttcaacaagggccagatcatcaacgtcctcaacaaggaggaccctgactggtggaaaggagaagtcaatggacaagtggggctcttcccatccaattatgtgaagctgaccacagacatggacccaagccagcaatgaatcatatgttgtccatccccccctcaggcttgaaagtcctcaaagagacccactatcccatatcactgcccagagggatgatgggagatgcagccttgatcatgtgacttccagcatgatcacctactgccttctgagtagaagaactcactgcagagcagtttacctcattttaccttagttgcatgtgatcgcaatgtttgagttattacttgcagagataggagcaaaaattacaaaaacacacagggtagtgggtccttttgtggctttcctagttactcaaattgactttcccccacctttgcacaggtgctttcaatagttttaaaattatttttaaatatatattttagctttttaataaacaaaataaataaatgacttctttgctattttggttttgcaaaaagacccactatcaaggaatgctgcatgtgctattaaaaattgttccaaatgtccataaatctgagacttgatgtattttttcattttgtccagtgttaccaactaaattgtgcagtttggggcttttcccccttaccatagaagtgcagaggagttcagtatctctgttttaaagacgtatagaatgagcccaattaaagcgaaggtgtttgtgcttgtttgtgtgtatcagctgtaccttgttgagcatgtaatacatcctgtacataagaaattagttctttccatggcaaagctattaccttgtacgatgctctaatcatattgcatttaattttattttgcacagtgaccttgtagccacatgagaaagcactctgtgtttttgttcggtctcagatttatctggttgagttggtgttttgtttggggtttttaattttgcgtgtttgcatagcataaaatcagtagacaacaccactgaggtcgttacgatcaacgatatccacagtctctttttagtctctgttacatgaagttttattccagttacttttcatggaatgacctattttgaacaagtaattttcttgacaagaaagaatgtatagaagtctccctgcaattaatttccaatgtttacattttttaactagactgtggaatttctacagattaatatgaaatggagctcatggtccgtttgtgtgttagatatgctgtagctgaagccctgtttgtcttttaaacactagttggaagctctcaataaaaatgcctgctgctcacagcacagaaaatggggcagggggagcctcaagcacaatctagctgtcctcctaaagactctgtaatgctcactcccctcgcgttctcccggcgctgtcgggaggctgtgctggtggtcgtgtagaggtccttctcctttcacatggtgcagagagcgaggacctctcctcctcgttcagttgcacttcagtattttcacggatatgaatgtaaaatatataaatatataaacctgcggctttaacaactgtaatacaaccttttgaattagttccgtgtatagataattaaattcttcatacaaaagtta

SEQ ID NO: 427863 - DNA, 3569 bp, Homo sapiens
acttatgggcggagatggatggtggatggggggcgggggaggcagcggagggagatgaggagataggcgggagcgagggagcgagggagggagcgaaggaggtagagaagagtggaggcgccaggggagggagcgtagcttggttgctccgtagtacggcggctcgcgaggaagaatcccgagcgggctccgggacggacagagaggcgggcggggatggtgtgcggggctgcggctcctgcgtccctcccagcggcgcgtgagcggcactgatttgtccctggggcggcagcgcggacccgcccggagatgaggcgtcgattagcaaggtaaaagtaacagaaccatggctcagtttccaacaccttttggtggcagcctggatatctgggccataactgtagaggaaagagcgaagcatgatcagcagttccatagtttaaagccaatatctggattcattactggtgatcaagctagaaactttttttttcaatctgggttacctcaacctgttttagcacagatatgggcactagctgacatgaataatgatggaagaatggatcaagtggagttttccatagctatgaaacttatcaaactgaagctacaaggatatcagctaccctctgcacttccccctgtcatgaaacagcaaccagttgctatttctagcgcaccagcatttggtatgggaggtatcgccagcatgccaccgcttacagctgttgctccagtgccaatgggatccattccagttgttggaatgtctccaaccctagtatcttctgttcccacagcagctgtgccccccctggctaacggggctccccctgttatacaacctctgcctgcatttgctcatcctgcagccacattgccaaagagttcttcctttagtagatctggtccagggtcacaactaaacactaaattacaaaaggcacagtcatttgatgtggccagtgtcccaccagtggcagagtgggctgttcctcagtcatcaagactgaaatacaggcaattattcaatagtcatgacaaaactatgagtggacacttaacaggtccccaagcaagaactattcttatgcagtcaagtttaccacaggctcagctggcttcaatatggaatctttctgacattgatcaagatggaaaacttacagcagaggaatttatcctggcaatgcacctcattgatgtagctatgtctggccaaccactgccacctgtcctgcctccagaatacattccaccttcttttagaagagttcgatctggcagtggtatatctgtcataagctcaacatctgtagatcagaggctaccagaggaaccagttttagaagatgaacaacaacaattagaaaagaaattacctgtaacgtttgaagataagaagcgggagaactttgaacgtggcaacctggaactggagaaacgaaggcaagctctcctggaacagcagcgcaaggagcaggagcgcctggcccagctggagcgggcggagcaggagaggaaggagcgtgagcgccaggagcaagagcgcaaaagacaactggaactggagaagcaactggaaaagcagcgggagctagaacggcagagagaggaggagaggaggaaagaaattgagaggcgagaggctgcaaaacgggaacttgaaaggcaacgacaacttgagtgggaacggaatcgaaggcaagaactactaaatcaaagaaacaaagaacaagaggacatagttgtactgaaagcaaagaaaaagactttggaatttgaattagaagctctaaatgataaaaagcatcaactagaagggaaacttcaagatatcagatgtcgattgaccacccaaaggcaagaaattgagagcacaaacaaatctagagagttgagaattgccgaaatcacccatctacagcaacaattacaggaatctcagcaaatgcttggaagacttattccagaaaaacagatactcaatgaccaattaaaacaagttcagcagaacagtttgcacagagattcacttgttacacttaaaagagccttagaagcaaaagaactagctcggcagcacctacgagaccaactggatgaagtggagaaagaaactagatcaaaactacaggagattgatattttcaataatcagctgaaggaactaagagaaatacacaataagcaacaactccagaagcaaaagtccatggaggctgaacgactgaaacagaaagaacaagaacgaaagatcatagaattagaaaaacaaaaagaagaagcccaaagacgagctcaggaaagggacaagcagtggctggagcatgtgcagcaggaggacgagcatcagagaccaagaaaactccacgaagaggaaaaactgaaaagggaggagagtgtcaaaaagaaggatggcgaggaaaaaggcaaacaggaagcacaagacaagctgggtcggcttttccatcaacaccaagaaccagctaagccagctgtccaggcaccctggtccactgcagaaaaaggtccacttaccatttctgcacaggaaaatgtaaaagtggtgtattaccgggcactgtacccctttgaatccagaagccatgatgaaatcactatccagccaggagacatagtcaatggtggatgaaagccaaactggagaacccggctggcttggaggagaattaaaaggaaagacagggtggttccctgcaaactatgcagagaaaatcccagaaaatgaggttcccgctccagtgaaaccagtgactgattcaacatctgcccctgcccccaaactggccttgcgtgagacccccgcccctttggcagtaacctcttcagagccctccacgacccctaataactgggccgacttcagctccacgtggcccaccagcacgaatgagaaaccagaaacggataactgggatgcatgggcagcccagccctctctcaccgttccaagtgccggccagttaaggcagaggtccgcctttactccagccacggccactggctcctccccgtctcctgtgctaggccagcctgacttcctcctccacccctccatgagactaggccacatgcagccccggattgtgcttctcttcccggaccccctgcagtgttccacctcgaggcttttgcccatgctgcgccctcggcctggagtgcccttcctccgaagccctagctgtcaaagtccttctcatccttcaaggcccatctcagatgctgccccctctgtgaaatttacgctgatgcccccaggcagaattcatccctgttttctctttattcctgcagtgaatagtaggaactcctttttagtatatttcattctgccaggtggtacacttggttgtttttatctctgtcttccccattacttgtgaattacctgctagtaatactgcccatctttatagtgctttgtggttaataaagtgcttttccctaaattatctgggggaggcagagactgtttttttcatctgtaatctcatggggcagtgcatgtagatgtacaataaatggtaattacaatgaattta

SEQ ID NO: 427864 - DNA, 2890 bp, Homo sapiens
acttatgggcggagatggatggtggatggggggcgggggaggcagcggagggagatgaggagataggcgggagcgagggagcgagggagggagcgaaggaggtagagaagagtggaggcgccaggggagggagcgtagcttggttgctccgtagtacggcggctcgcgaggaagaatcccgagcgggctccgggacggacagagaggcgggcggggatggtgtgcggggctgcggctcctgcgtccctcccagcggcgcgtgagcggcactgatttgtccctggggcggcagcgcggacccgcccggagatgaggcgtcgattagcaaggtaaaagtaacagaaccatggctcagtttccaacaccttttggtggcagcctggatatctgggccataactgtagaggaaagagcgaagcatgatcagcagttccatagtttaaagccaatatctggattcattactggtgatcaagctagaaactttttttttcaatctgggttacctcaacctgttttagcacagatatgggcactagctgacatgaataatgatggaagaatggatcaagtggagttttccatagctatgaaacttatcaaactgaagctacaaggatatcagctaccctctgcacttccccctgtcatgaaacagcaaccagttgctatttctagcgcaccagcatttggtatgggaggtatcgccagcatgccaccgcttacagctgttgctccagtgccaatgggatccattccagttgttggaatgtctccaaccctagtatcttctgttcccacagcagctgtgccccccctggctaacggggctccccctgttatacaacctctgcctgcatttgctcatcctgcagccacattgccaaagagttcttcctttagtagatctggtccagggtcacaactaaacactaaattacaaaaggcacagtcatttgatgtggccagtgtcccaccagtggcagagtgggctgttcctcagtcatcaagactgaaatacaggcaattattcaatagtcatgacaaaactatgagtggacacttaacaggtccccaagcaagaactattcttatgcagtcaagtttaccacaggctcagctggcttcaatatggaatctttctgacattgatcaagatggaaaacttacagcagaggaatttatcctggcaatgcacctcattgatgtagctatgtctggccaaccactgccacctgtcctgcctccagaatacattccaccttcttttagaagagttcgatctggcagtggtatatctgtcataagctcaacatctgtagatcagaggctaccagaggaaccagttttagaagatgaacaacaacaattagaaaagaaattacctgtaacgtttgaagataagaagcgggagaactttgaacgtggcaacctggaactggagaaacgaaggcaagctctcctggaacagcagcgcaaggagcaggagcgcctggcccagctggagcgggcggagcaggagaggaaggagcgtgagcgccaggagcaagagcgcaaaagacaactggaactggagaagcaactggaaaagcagcgggagctagaacggcagagagaggaggagaggaggaaagaaattgagaggcgagaggctgcaaaacgggaacttgaaaggcaacgacaacttgagtgggaacggaatcgaaggcaagaactactaaatcaaagaaacaaagaacaagaggacatagttgtactgaaagcaaagaaaaagactttggaatttgaattagaagctctaaatgataaaaagcatcaactagaagggaaacttcaagatatcagatgtcgattgaccacccaaaggcaagaaattgagagcacaaacaaatctagagagttgagaattgccgaaatcacccatctacagcaacaattacaggaatctcagcaaatgcttggaagacttattccagaaaaacagatactcaatgaccaattaaaacaagttcagcagaacagtttgcacagagattcacttgttacacttaaaagagccttagaagcaaaagaactagctcggcagcacctacgagaccaactggatgaagtggagaaagaaactagatcaaaactacaggagattgatattttcaataatcagctgaaggaactaagagaaatacacaataagcaacaactccagaagcaaaagtccatggaggctgaacgactgaaacagaaagaacaagaacgaaagatcatagaattagaaaaacaaaaagaagaagcccaaagacgagctcaggaaagggacaagcagtggctggagcatgtgcagcaggaggacgagcatcagagaccaagaaaactccacgaagaggaaaaactgaaaagggaggagagtgtcaaaaagaaggatggcgaggaaaaaggcaaacaggaagcacaagacaagctgggtcggcttttccatcaacaccaagaaccagctaagccagctgtccaggcaccctggtccactgcagaaaaaggtccacttaccatttctgcacaggaaaatgtaaaagtggtgtattaccgggcactgtacccctttgaatccagaagccatgatgaaatcactatccagccaggagacatagtcaatggtggatgaaagccaaactggagaacccggctggcttggaggagaattaaaaggaaagacagggtggttccctgcaaactatgcagagaaaatcccagaaaatgaggttcccgctccagtgaaaccagtgactgattcaacatctgcccctgcccccaaactggccctttggcctggaagaacctccccgcccctctttgtgggcgagattaaactctctttataaagaagccctctctc

SEQ ID NO: 427865 - DNA, 2436 bp, Homo sapiens
  misc_feature (2356)..(2356): n is a, c, g, or t
acttatgggcggagatggatggtggatggggggcgggggaggcagcggagggagatgaggagataggcgggagcgagggagcgagggagggagcgaaggaggtagagaagagtggaggcgccaggggagggagcgtagcttggttgctccgtagtacggcggctcgcgaggaagaatcccgagcgggctccgggacggacagagaggcgggcggggatggtgtgcggggctgcggctcctgcgtccctcccagcggcgcgtgagcggcactgatttgtccctggggcggcagcgcggacccgcccggagatgaggcgtcgattagcaaggtaaaagtaacagaaccatggctcagtttccaacaccttttggtggcagcctggatatctgggccataactgtagaggaaagagcgaagcatgatcagcagttccatagtttaaagccaatatctggattcattactggtgatcaagctagaaactttttttttcaatctgggttacctcaacctgttttagcacagatatgggcactagctgacatgaataatgatggaagaatggatcaagtggagttttccatagctatgaaacttatcaaactgaagctacaaggatatcagctaccctctgcacttccccctgtcatgaaacagcaaccagttgctatttctagcgcaccagcatttggtatgggaggtatcgccagcatgccaccgcttacagctgttgctccagtgccaatgggatccattccagttgttggaatgtctccaaccctagtatcttctgttcccacagcagctgtgccccccctggctaacggggctccccctgttatacaacctctgcctgcatttgctcatcctgcagccacattgccaaagagttcttcctttagtagatctggtccagggtcacaactaaacactaaattacaaaaggcacagtcatttgatgtggccagtgtcccaccagtggcagagtgggctgttcctcagtcatcaagactgaaatacaggcaattattcaatagtcatgacaaaactatgagtggacacttaacaggtccccaagcaagaactattcttatgcagtcaagtttaccacaggctcagctggcttcaatatggaatctttctgacattgatcaagatggaaaacttacagcagaggaatttatcctggcaatgcacctcattgatgtagctatgtctggccaaccactgccacctgtcctgcctccagaatacattccaccttcttttagaagagttcgatctggcagtggtatatctgtcataagctcaacatctgtagatcagaggctaccagaggaaccagttttagaagatgaacaacaacaattagaaaagaaattacctgtaacgtttgaagataagaagcgggagaactttgaacgtggcaacctggaactggagaaacgaaggcaagctctcctggaacagcagcgcaaggagcaggagcgcctggcccagctggagcgggcggagcaggagaggaaggagcgtgagcgccaggagcaagagcgcaaaagacaactggaactggagaagcaactggaaaagcagcgggagctagaacggcagagagaggaggagaggaggaaagaaattgagaggcgagaggctgcaaaacgggaacttgaaaggcaacgacaacttgagtgggaacggaatcgaaggcaagaactactaaatcaaagaaacaaagaacaagaggacatagttgtactgaaagcaaagaaaaagactttggaatttgaattagaagctctaaatgataaaaagcatcaactagaagggaaacttcaagatatcagatgtcgattgaccacccaaaggcaagaaattgagagcacaaacaaatctagagagttgagaattgccgaaatcacccatctacagcaacaattacaggaatctcagcaaatgcttggaagacttattccagaaaaacagatactcaatgaccaattaaaacaagttcagcagaacagtttgcacagagattcacttgttacacttaaaagagccttagaagcaaaagaactagctcggcagcacctacgagaccaactggatgaagtggagaaagaaactagatcaaaactacaggagattgatattttcaataatcagctgaaggaactaagagaaatacacaataagcaacaactccagaagcaaaagtccatggaggctgaacgactgaaacagaaagaacaagaacgaaagatcatagaattagaaaaacaaaaagaagaagcccaaagattcctaattctagccgatgacctgtgtgcgttaccattgttcacaggatggcagttncagggtggagacttctgggaccaggctgcctgggattgaagcccatgcatgtatggctgtgtgacgtggacaagtcattt

SEQ ID NO: 427866 - DNA, 1012 bp, Homo sapiens
acttatgggcggagatggatggtggatggggggcgggggaggcagcggagggagatgaggagataggcgggagcgagggagcgagggagggagcgaaggaggtagagaagagtggaggcgccaggggagggagcgtagcttggttgctccgtagtacggcggctcgcgaggaagaatcccgagcgggctccgggacggacagagaggcgggcggggatggtgtgcggggctgcggctcctgcgtccctcccagcggcgcgtgagcggcactgatttgtccctggggcggcagcgcggacccgcccggagatgaggcgtcgattagcaaggtaaaagtaacagaaccatggctcagtttccaacaccttttggtggcagcctggatatctgggccataactgtagaggaaagagcgaagcatgatcagcagttccatagtttaaagccaatatctggattcattactggtgatcaagctagaaactttttttttcaatctgggttacctcaacctgttttagcacagatatgggcactagctgacatgaataatgatggaagaatggatcaagtggagttttccatagctatgaaacttatcaaactgaagctacaaggatatcagctaccctctgcacttccccctgtcatgaaacagcaaccagttgctatttctagcgcaccagcatttggaggtaattctgtctgaaaaatgatggccccctgcaggaagatagtgctggggagaagaaggagcatgttcacatttgaaccctgggatgtaaagtaatcaaaatgaaagcagagatgcaggccgccagtcaggggaaaaggaagaaacttacagtccgctgctgcagcttctgggtttttttttttttttctcttccattatccttcaggttgttgcatacttccttttgattttcggtttccataatgtctgtttctccttgtgcataaacaattcctttggattatggcatctagaaatatatatattttgaatcac

SEQ ID NO: 427867 - DNA, 257 bp, Homo sapiens
aggaacagtgggcgacaaggccggagtcttcccttctaactatgtgaggcttaaagattcagaggtaaacccacattaactgtttcctctccctttctgtgcggtgattctctttgtggggagtcacgatgtttgacagcggaactttgttgggttttgctaagttctggaatgtgacagtaaatccagtgtgacctgtcattgtttgatcttgtcatttggcactgcgcagtaagcactggcttcccccaagcaga

SEQ ID NO: 427868 - DNA, 437 bp, Homo sapiens
tagcaaaaatattcaatgagcatctctcagtcagtcatgccttgaaataaactagtacataagccatgtgtccagtatagcaaagtgctgaaaaataagaatgcgagcttagagtcatgcctctgtagtaccttattatgtgtttttaacctagctaagtacaactatttcagctgtgggtcgtttaaagttttaaaagttaagcagttttaacagaaaaatcagtgtcattgtacgattttctttgaagataaaaattaaaatactctcttcttccattattgcagcatggattctggttcttcagagagtcctgctagtctaaagcgagtagcctctccagcagccaagccggtcgtttcgggagaaggtgagggcctgagttgtattatgttcttcagaagggtcaaggacattgtgtaaatgtttgaaatgag

SEQ ID NO: 427869 - DNA, 595 bp, Homo sapiens
gtggcccaccagcacgaatgagaaaccagaaacggataactgggatgcatgggcagcccagccctctctcaccgttccaagtgccggccagttaaggcagaggtccgcctttactccagccacggccactggctcctccccgtctcctgtgctaggccaggtaaaggcagccagtgagagtgtgaagacttagcatgctatctagtgccaaaaacttcagcaaatgctttttggcaatgtcattttgaagcaagccttgttatgtgtgtcttggttggctggcagtatgggaatccagtgcaggagccagaaatctgctgtgaatagttgggagttgggggtgggggtgggacacagtcaacttctcctgcctgggttgatgaaggaagcttcattgcagaagtggcacttgagctgcatcttgaccagtgggtaagatcttactagaaaatggagagagcctgcctgtcagacagaaactgctgggaaggctcgaaggcagacagtcagaatgtatttaaggaaaatcacatacccctccatttgtctagaccattgagttttttttggaaaaggtagaccaattaaaggttaa

SEQ ID NO: 427870 - DNA, 730 bp, Homo sapiens
tgcatcgtccagaattgcttccgagtcggcgcggcgcaaggcttgctgggagacacataacctcgattttcttccgccatccggctaaatagtcccatgtgcactttgttccatggataaataaacactaggaacgcatttccaccctagatttcagcagaaatgctgaatgtaaaggaatatttgagtaaagtgagttgccgttcttgaagcccgtctcctaaggattctcccggtgtccgcgtagggatctcatgctatataggagggccctgccaggcaccgtctcctgtctccggtccgtgcctccaagatgacaaagaaaagaaggaacaatggtcgtgccaaaaagggccgcggccacgtgcagcctattcgctgcactaactgtgcccgatgcgtgcccaaggacaaggccattaagaaattcgtcattcgaaacatagtggaggccgcagcagtcagggacatttctgaagcgagcgtcttcgatgcctatgtgcttcccaagctgtatgtgaagctacattactgtgtgagttgtgcaattcacagcaaagtagtcaggaatcgatctcgtgaagcccgcaaggaccgaacacccccaccccgatttagacctgcgggtgctgccccacgtcccccaccaaagcccatgtaaggagctgagttcttaaagactgaagacaggctattctctggagaaaaataaaatggaaattgtacttaa

SEQ ID NO: 427871 - DNA, 958 bp, Homo sapiens
tgcatcgtccagaattgcttccgagtcggcgcggcgcaaggcttgctgggagacacataacctcgattttcttccgccatccggctaaatagtcccatgtgcactttgttccatggataaataaacactaggaacgcatttccaccctagatttcagcagaaatgctgaatgtaaaggaatatttgagtaaagtgagttgccgttcttgaagcccgtctcctaaggattctcccggtgtccgcgtagggatctcatgctatataggagggccctgccaggcaccgtctcctgtctccggtccgtgcctccaagatgacaaagaaaagaaggaacaatggtcgtgccaaaaagggccgcggccacgtgcagcctattcgctgcactaactgtgcccgatgcgtgcccaaggacaaggccattaagaaattcgtcattcgaaacatagtggaggccgcagcagtcagggacatttctgaagcgagcgtcttcgatgcctatgtgcttcccaagctgtatgtgaagctacattactgtgtgagttgtgcaattcacagcaaagtagtcaggaatcgatctcgtgaagcccgcaaggaccgaacacccccaccccgatttagacctgcgggtgctgccccacgtcccccaccaaagcccatgtaaggagctgagttcttaaagactgaagacaggctattctctggagaaaaataaaatggaaattgtacttaacaaaaacaacacgaagaaaaaaaaacttggggcgcggcccccagaaaagtttacaacacactgggggggggcgcgagagagaaccggcaacgcggcccaggaacggcacgaggggggccccaaaaacggcgccgcgctaaacaaggtggcaggcacacggcagcgatacccgcggggaaaaccaacagacagcaaaggaaccgaagcaggcacacaaccaacaccaag

SEQ ID NO: 427872 - DNA, 661 bp, Homo sapiens
tgcatcgtccagaattgcttccgagtcggcgcggcgcaaggcttgctgggagacacataacctcgattttcttccgccatccggctaaatagtcccatgtgcactttgttccatggataaataaacactaggaacgcatttccaccctagatttcagcagaaatgctgaatgtaaaggaatatttgagtaaagtgagttgccgttcttgaagcccgtctcctgtctccggtccgtgcctccaagatgacaaagaaaagaaggaacaatggtcgtgccaaaaagggccgcggccacgtgcagcctattcgctgcactaactgtgcccgatgcgtgcccaaggacaaggccattaagaaattcgtcattcgaaacatagtggaggccgcagcagtcagggacatttctgaagcgagcgtcttcgatgcctatgtgcttcccaagctgtatgtgaagctacattactgtgtgagttgtgcaattcacagcaaagtagtcaggaatcgatctcgtgaagcccgcaaggaccgaacacccccaccccgatttagacctgcgggtgctgccccacgtcccccaccaaagcccatgtaaggagctgagttcttaaagactgaagacaggctattctctggagaaaaataaaatggaaattgtacttaa

SEQ ID NO: 427873 - DNA, 1492 bp, Homo sapiens
tgcatcgtccagaattgcttccgagtcggcgcggcgcaaggcttgctgggagacacataacctcgattttcttccgccatccggctaaatagtcccatgtgcactttgttccatggataaataaacactaggaacgcatttccaccctagatttcagcagaaatgctgaatgtaaaggaatatttgagtaaagtgagttgccgttcttgaagcccgtctcctaaggattctcccggtgtccgcgtagggatctcatgctatataggagggccctgccaggcaccgtctcctgtctccggtccgtgcctccaagatgacaaagaaaagaaggaacaatggtcgtgccaaaaagggccgcggccacgtgcagcctattcgctgcactaactgtgcccgatgcgtgcccaaggacaaggccattaagaaattcgtcattcgaaacatagtggaggccgcagcagtcagggacatttctgaagcgagcgtcttcgatggtaagtgggtcaccggcgcgaactgtgtgaggatcccagtatcttaaagccttcgcccaacttcgcccttttggaggctctgttcgttggagcctctcaggcaatttccacgtatttaaggttgttactggtagaagagaattctcttgtttgccgttttgattcttttctgggcagagggtgactttgtgatagagtgcacagcctttactctgaggtaaaggtttgcctgtttcggttatgagattgcaaaaactagaaacttggtaaatttgacaattcttgtgctattgattatttgaatatttgtgaaaatatacaggtgaggaagaatgtcttcaacgtttcgagaatggaggccgtctagtttggtgtgcaaggatgatgtttggagcaataagaacgtcgctttgtttttttccttttatagaaagagcaaggttcagggtaggcattagggcgggtgtaggtgtagaaggaactggattattggtttattgcatttagaatgtcagtctggtccttgcggtgtcacagatgaactcacgtgggatgttaattcacttgtaaaactgagggttatacatatgtgcctcaggtattgggctgaacaggtgctttgggggtgcttttatgtgcccgacaggcatttaaataggtttagttttaattgacgtaaacatgtaaggtgctcttcattcatgtaacaaaaaagcaaggtaggtatataataccagtataactctattttctattccttagcctatgtgcttcccaagctgtatgtgaagctacattactgtgtgagttgtgcaattcacagcaaagtagtcaggaatcgatctcgtgaagcccgcaaggaccgaacacccccaccccgatttagacctgcgggtgctgccccacgtcccccaccaaagcccatgtaaggagctgagttcttaaagactgaagacaggctattctctggagaaaaataaaatggaaattgtacttaa

SEQ ID NO: 427874 - DNA, 1117 bp, Homo sapiens
  misc_feature (8)..(8): n is a, c, g, or t
caaagganggaacaatggtcgtgccatgcccaaggacaaggccattaagaaattcgtcattcgaaacatagtggaggccgcagcagtcagggacatttctgaagcgagcgtcttcgatggtaagtgggtcaccggcgcgaactgtgtgaggatcccagtatcttaaagccttcgcccaacttcgcccttttggaggctctgttcgttggagcctctcaggcaatttccacgtatttaaggttgttactggtagaagagaattctcttgtttgccgttttgattcttttctgggcagagggtgactttgtgatagagtgcacagcctttactctgaggtaaaggtttgcctgtttcggttatgagattgcaaaaactagaaacttggtaaatttgacaattcttgtgctattgattatttgaatatttgtgaaaatatacaggtgaggaagaatgtcttcaacgtttcgagaatggaggccgtctagtttggtgtgcaaggatgatgtttggagcaataagaacgtcgctttgtttttttccttttatagaaagagcaaggttcagggtaggcattagggcgggtgtaggtgtagaaggaactggattattggtttattgcatttagaatgtcagtctggtccttgcggtgtcacagatgaactcacgtgggatgttaattcacttgtaaaactgagggttatacatatgtgcctcaggtattgggctgaacaggtgctttgggggtgcttttatgtgcccgacaggcatttaaataggtttagttttaattgacgtaaacatgtaaggtgctcttcattcatgtaacaaaaaagcaaggtaggtatataataccagtataactctattttctattccttagcctatgtgcttcccaagctgtatgtgaagctacattactgtgtgagttgtgcaattcacagcaaagtagtcaggaatcgatctcgtgaagcccgcaaggaccgaacacccccaccccgatttagacctgcgggtgctgccccacgtcccccaccaaagcccatgtaaggagctgagttcttaaagactgaagacaggctattctctggagaaaaataaaatggaaattgtacttaa

SEQ ID NO: 427875 - DNA, 308 bp, Homo sapiens
ttttcccatcctgtcgcagacaaagaaaagaaggaacaatggtcgtgccaaaaagggccgcggccacgtgcagcctattcgctgcactaactgtgcccgatgcgtgcccaaggacaaggccattaagaaattcgtcattcgaaacatagtggaggccgcagcagtcagggacatttctgaagcgagcgtcttcgatggtaagtgggtcaccggcgcgaactgtgtgaggatcccagtatcttaaagccttcgcccaacttcgcccttttggaggctctgttcgttggagcctctcaggcaatttccac

SEQ ID NO: 427876 - DNA, 3703 bp, Homo sapiens
ggtgaatgggctggtggtgctcgctgctgctgctgagaggaggaggaggatgaagagttgggcttgtttgttcctcctcctcctgcttctcctgctcagagttcctgcctccagctgccaggggggacagccagccagcagcaggaggggggctagagagctgaaggagagccagtttccccaaaattggacttctcagaacctttaatatgctaatgtgcattgtgaatctccaagagggggatatgatatgcagcattcttgaatacttctaatgacagggagcccactacctcataagctgcagtgagaagaggagtttgttactttaaacagaggctgaagaaactatagaattagcagagaaagtggagaaggtagaggatggagttgcagactctacaggaggctcttaaagtggaaattcaggttcaccagaaactggttgctcaaatgaagcaggatccacagaatgctgacttaaagaaacagcttcatgaactccaagccaaaatcacagctttgagtgagaaacagaaaagagtagttgaacagctacggaagaacctgatagtaaagcaagaacaaccggacaagttccaaatacagccattgccacaatctgaaaacaaactacaaacagcacagcagcaaccactacagcaactacaacaacagcagcagtaccaccaccaccacgcccagcagtcagctgcagcctctcccaacctgactgcttcacagaagactgtaactacagcttctatgattaccacaaagacactacctctcgtcttgaaagcagcaactgcgaccatgcctgcctctgtggtgggccagagacctaccattgctatggtgaccgccatcaacagtcagaaggctgtgctcagcactgatgtgcagaacacaccagtcaacctccagacgtctagtaaggtcactgggcctggggcagaggctgtccaaattgtggcaaaaaacacagtcactctgcaggttcaggcaacacctcctcagcccatcaaagtaccacagtttatcccccctcctagactcactccacgtccaaactttcttccacaggttcgacccaagcctgtggcccagaataacattcctattgccccagcaccacctcccatgctcgcagctcctcagcttatccagaggcccgtcatgctgaccaagttcacccccacaacccttcccacatcccagaattccatccaccccgtccgtgtcgtcaatgggcagactgcaaccatagccaaaacgttccccatggcccagctcaccagcattgtgatagctactccagggaccagactcgctggacctcaaactgtacagcttagcaagccaagtcttgaaaaacagacagttaaatctcacacagaaacagatgagaaacaaacagagagccgcaccatcaccccacctgctgcacccaaaccaaaacgggaggagaaccctcagaaacttgccttcatggtgtctctagggttggtaacacatgaccatctagaagaaatccaaagcaagaggcaagagcgaaaaagaagaacaacagcaaatccggtctacagtggagcagtctttgagccagagcgtaagaagagtgcagtgacatacctaaacagcacaatgcaccctgggacccggaagagagccaatgaggaacactggccaaagggtgatattcatgaggatttttgcagcgtttgcagaaaaagtggccagttactgatgtgcgacacatgttcccgtgtatatcatttggactgcttagacccccctctgaaaacaattcccaagggcatgtggatctgtcccagatgtcaggaccagatgctgaagaaggaagaagcaattccatggcctggaactttagcaattgttcattcctatattgcctacaaagcagcaaaagaagaagagaaacagaagttacttaaatggagttcagatttaaaacaagaacgagaacaactagagcaaaaggtgaaacagctcagcaattccataagtaaatgcatggaaatgaagaacaccatcctggcccggcagaaggagatgcacagctccctggagaaggtaaaacagctgattcgcctcatccacggcatcgacctctccaaacctgtagactctgaggccactgtgggggccatctccaatggcccggactgcaccccccctgccaatgccgccacctccacgccggccccttccccctcctcccagagctgcacagcgaactgtaaccagggggaagagactaaataacagagcccctctaggagaagccacgggatcccggcggcaaggagaacagaacactgaagactctagaaaagcaaagccggatttctggaaagtgcagaattcttttggttctttggttccagagagagagaagatgcttgtgccaggtggcaccagagtttgccaattgatccttcttattctgtgtgtacatgcaaagattggaccatgttacatgaaatagtgccagctggaggttctttgccagcaccatgccaagtgaaataatatatttactctctctattatacaccagtgtgtgcctgcagcagcctccacagccacgatgggtttgtttctgttttcttgggtggggagcagggacgggcggagggaggagagcaggtttcagatccttacttgccgagccgtttgtttaggtagagaagacaagtccaaagagtgtgtgggctttcctgtttctaaactttcgctactataaaaccaaaaaaaggaattgagatttcaccaaccccagtgcccagaagagggaaggggagtggctggagggagcagggggtgggacagtgtatcaaataagcagtatttaatcacctctggcgggggcctcgtgcaaggggagactgacaccaagaacagccagtaggttcttctcccctgcactctgctccctgcgcggtaaccccaccactcctgaagcctgcccagtctccttccttccctgcttggtgagtcgcgcatctccgtggttatcccgctgtctcctctccaagaacaagcagagcccgggccactggcccttgcccaaggcagggaagaaggatgtgtgtgtccaggaaggaaaaaaaggtggatcagtgattttacttgaaaacaagctccatcccttttctatatttataagaagagaagatcttgagtgaagcagcacgcgacccaggtgtgtgtgaattgaatggagacgtttcttttctctttctttaatttttgtttttgttctttttttctttaaggaaagttttattttactgttcattttactttcttggtaacaaaaactaaaataaggaatagaaaagctgtttttcaggctgacagtccaattaagggtagccaagaccttgcatggtagagtaggaatcatagtgtcagtgaggtcccgtgagtctttgtgagtccttgtgtcatcgttcgggcactgtttttttatgcaagggcaaaaatctttgtatctggggaaaaaaaacttttttttaaattaaaaaggaaaataaaagatattgaggtcttcctagtgttacttaaattaagatcaaggtaagaaacattgtaaaaaaaaattacaaaagtgctatttgtttcctaaaaacagtgatttctattaaaaaggtgtcagaactggaaaaaaaaaaaa

SEQ ID NO: 427877 - DNA, 645 bp, Homo sapiens
gggtgtcatgtggcgtcacgagaaaagataggaatgctcagccaagtcccagctccttctaagcctgggctcaagtgtcctggctcttcctgccttgaacttgattctcctaagctgatatttggaactttttagtccagaaactatagaccagggttttgcaacactgctaccataaatccttcctggattttatctgccagtagccacagataccactgctagctgttacatagaggatgtgtgtttaaacctccttctcaaggtaaaattctaaaaatcttttcagatgctgaagaaggaagaagcaattccatggcctggaactttagcaattgttcattcctatattgcctacaaagcagcaaaagaagaagagaaacagaagttacttaaatggagttcagatttaaaacaagaacgagaacaactagagcacagtcgatacataggtgcagagacctaggcctttccaatatacgtaacagtacgtgtgggccccaggctgtttcgggtccttctgtttattaacgtgattaacttgggcaaatgcagtttgccatccagttagagttcagacctcaggtacaggcggccagttggtaggtggtgccttacccaagctctgtaacatcctcttggctt

SEQ ID NO: 427878 - DNA, 3662 bp, Homo sapiens
gtgagagagagaggagaggagaggaggaggaggaggagggagaagggaacaacctaccatcttaacacactaatatctaaaaagtgcgagaggcccagagcagcagcagaagcagcagcagcagctccagcttcttccctcctcctcctcctcctgcttctcctgctcagagttcctgcctccagctgccaggggggacagccagccagcagcaggaggggggctagagagctgaaggagagccagtttccccaaaattgctgcagtgagaagaggagtttgttactttaaacagaggctgaagaaactatagaattagcagagaaagtggagaaggtagaggatggagttgcagactctacaggaggctcttaaagtggaaattcaggttcaccagaaactggttgctcaaatgaagcaggatccacagaatgctgacttaaagaaacagcttcatgaactccaagccaaaatcacagctttgagtgagaaacagaaaagagtagttgaacagctacggaagaacctgatagtaaagcaagaacaaccggacaagttccaaatacagccattgccacaatctgaaaacaaactacaaacagcacagcagcaaccactacagcaactacaacaacagcagcagtaccaccaccaccacgcccagcagtcagctgcagcctctcccaacctgactgcttcacagaagactgtaactacagcttctatgattaccacaaagacactacctctcgtcttgaaagcagcaactgcgaccatgcctgcctctgtggtgggccagagacctaccattgctatggtgaccgccatcaacagtcagaaggctgtgctcagcactgatgtgcagaacacaccagtcaacctccagacgtctagtaaggtcactgggcctggggcagaggctgtccaaattgtggcaaaaaacacagtcactctgcaggttcaggcaacacctcctcagcccatcaaagtaccacagtttatcccccctcctagactcactccacgtccaaactttcttccacaggttcgacccaagcctgtggcccagaataacattcctattgccccagcaccacctcccatgctcgcagctcctcagcttatccagaggcccgtcatgctgaccaagttcacccccacaacccttcccacatcccagaattccatccaccccgtccgtgtcgtcaatgggcagactgcaaccatagccaaaacgttccccatggcccagctcaccagcattgtgatagctactccagggaccagactcgctggacctcaaactgtacagcttagcaagccaagtcttgaaaaacagacagttaaatctcacacagaaacagatgagaaacaaacagagagccgcaccatcaccccacctgctgcacccaaaccaaaacgggaggagaaccctcagaaacttgccttcatggtgtctctagggttggtaacacatgaccatctagaagaaatccaaagcaagaggcaagagcgaaaaagaagaacaacagcaaatccggtctacagtggagcagtctttgagccagagcgtaagaagagtgcagtgacatacctaaacagcacaatgcaccctgggacccggaagagagccaatgaggaacactggccaaagggtgatattcatgaggatttttgcagcgtttgcagaaaaagtggccagttactgatgtgcgacacatgttcccgtgtatatcatttggactgcttagacccccctctgaaaacaattcccaagggcatgtggatctgtcccagatgtcaggaccagatgctgaagaaggaagaagcaattccatggcctggaactttagcaattgttcattcctatattgcctacaaagcagcaaaagaagaagagaaacagaagttacttaaatggagttcagatttaaaacaagaacgagaacaactagagcaaaaggtgaaacagctcagcaattccataagtaaatgcatggaaatgaagaacaccatcctggcccggcagaaggagatgcacagctccctggagaaggtaaaacagctgattcgcctcatccacggcatcgacctctccaaacctgtagactctgaggccactgtgggggccatctccaatggcccggactgcaccccccctgccaatgccgccacctccacgccggccccttccccctcctcccagagctgcacagcgaactgtaaccagggggaagagactaaataacagagcccctctaggagaagccacgggatcccggcggcaaggagaacagaacactgaagactctagaaaagcaaagccggatttctggaaagtgcagaattcttttggttctttggttccagagagagagaagatgcttgtgccaggtggcaccagagtttgccaattgatccttcttattctgtgtgtacatgcaaagattggaccatgttacatgaaatagtgccagctggaggttctttgccagcaccatgccaagtgaaataatatatttactctctctattatacaccagtgtgtgcctgcagcagcctccacagccacgatgggtttgtttctgttttcttgggtggggagcagggacgggcggagggaggagagcaggtttcagatccttacttgccgagccgtttgtttaggtagagaagacaagtccaaagagtgtgtgggctttcctgtttctaaactttcgctactataaaaccaaaaaaaggaattgagatttcaccaaccccagtgcccagaagagggaaggggagtggctggagggagcagggggtgggacagtgtatcaaataagcagtatttaatcacctctggcgggggcctcgtgcaaggggagactgacaccaagaacagccagtaggttcttctcccctgcactctgctccctgcgcggtaaccccaccactcctgaagcctgcccagtctccttccttccctgcttggtgagtcgcgcatctccgtggttatcccgctgtctcctctccaagaacaagcagagcccgggccactggcccttgcccaaggcagggaagaaggatgtgtgtgtccaggaaggaaaaaaaggtggatcagtgattttacttgaaaacaagctccatcccttttctatatttataagaagagaagatcttgagtgaagcagcacgcgacccaggtgtgtgtgaattgaatggagacgtttcttttctctttctttaatttttgtttttgttctttttttctttaaggaaagttttattttactgttcattttactttcttggtaacaaaaactaaaataaggaatagaaaagctgtttttcaggctgacagtccaattaagggtagccaagaccttgcatggtagagtaggaatcatagtgtcagtgaggtcccgtgagtctttgtgagtccttgtgtcatcgttcgggcactgtttttttatgcaagggcaaaaatctttgtatctggggaaaaaaaacttttttttaaattaaaaaggaaaataaaagatattgaggtcttcctagtgttacttaaattaagatcaaggtaagaaacattgtaaaaaaaaattacaaaagtgctatttgtttcctaaaaacagtgatttctattaaaaaggtgtcagaactggaaaaaaaaaaaa

SEQ ID NO: 427879 - DNA, 3088 bp, Homo sapiens
aaggtattggaaattaccgcccccccccgggcgttagtgatatgtcgaccacgcgctcggcagcagcagtaccaccaccaccacgcccagcagtcagctgcagcctctcccaacctgactgcttcacagaagactgtaactacagcttctatgattaccacaaagacactacctctcgtcttgaaagcagcaactgcgaccatgcctgcctctgtggtgggccagagacctaccattgctatggtgaccgccatcaacagtcagaaggctgtgctcagcactgatgtgcagaacacaccagtcaacctccagacgtctagtaaggtcactgggcctggggcagaggctgtccaaattgtggcaaaaaacacagtcactctgcaggttcaggcaacacctcctcagcccatcaaagtaccacagtttatcccccctcctagactcactccacgtccaaactttcttccacaggttcgacccaagcctgtggcccagaataacattcctattgccccagcaccacctcccatgctcgcagctcctcagcttatccagaggcccgtcatgctgaccaagttcacccccacaacccttcccacatcccagaattccatccaccccgtccgtgtcgtcaatgggcagactgcaaccatagccaaaacgttccccatggcccagctcaccagcattgtgatagctactccagggaccagactcgctggacctcaaactgtacagcttagcaagccaagtcttgaaaaacagacagttaaatctcacacagaaacagatgagaaacaaacagagagccgcaccatcaccccacctgctgcacccaaaccaaaacgggaggagaaccctcagaaacttgccttcatggtgtctctagggttggtaacacatgaccatctagaagaaatccaaagcaagaggcaagagcgaaaaagaagaacaacagcaaatccggtctacagtggagcagtctttgagccagagcgtaagaagagtgcagtgacatacctaaacagcacaatgcaccctgggacccggaagagagccaatgaggaacactggccaaagggtgatattcatgaggatttttgcagcgtttgcagaaaaagtggccagttactgatgtgcgacacatgttcccgtgtatatcatttggactgcttagacccccctctgaaaacaattcccaagggcatgtggatctgtcccagatgtcaggaccagatgctgaagaaggaagaagcaattccatggcctggaactttagcaattgttcattcctatattgcctacaaagcagcaaaagaagaagagaaacagaagttacttaaatggagttcagatttaaaacaagaacgagaacaactagagcaaaaggtgaaacagctcagcaattccataagtaaatgcatggaaatgaagaacaccatcctggcccggcagaaggagatgcacagctccctggagaaggtaaaacagctgattcgcctcatccacggcatcgacctctccaaacctgtagactctgaggccactgtgggggccatctccaatggcccggactgcaccccccctgccaatgccgccacctccacgccggccccttccccctcctcccagagctgcacagcgaactgtaaccagggggaagagactaaataacagagcccctctaggagaagccacgggatcccggcggcaaggagaacagaacactgaagactctagaaaagcaaagccggatttctggaaagtgcagaattcttttggttctttggttccagagagagagaagatgcttgtgccaggtggcaccagagtttgccaattgatccttcttattctgtgtgtacatgcaaagattggaccatgttacatgaaatagtgccagctggaggttctttgccagcaccatgccaagtgaaataatatatttactctctctattatacaccagtgtgtgcctgcagcagcctccacagccacgatgggtttgtttctgttttcttgggtggggagcagggacgggcggagggaggagagcaggtttcagatccttacttgccgagccgtttgtttaggtagagaagacaagtccaaagagtgtgtgggctttcctgtttctaaactttcgctactataaaaccaaaaaaaggaattgagatttcaccaaccccagtgcccagaagagggaaggggagtggctggagggagcagggggtgggacagtgtatcaaataagcagtatttaatcacctctggcgggggcctcgtgcaaggggagactgacaccaagaacagccagtaggttcttctcccctgcactctgctccctgcgcggtaaccccaccactcctgaagcctgcccagtctccttccttccctgcttggtgagtcgcgcatctccgtggttatcccgctgtctcctctccaagaacaagcagagcccgggccactggcccttgcccaaggcagggaagaaggatgtgtgtgtccaggaaggaaaaaaaggtggatcagtgattttacttgaaaacaagctccatcccttttctatatttataagaagagaagatcttgagtgaagcagcacgcgacccaggtgtgtgtgaattgaatggagacgtttcttttctctttctttaatttttgtttttgttctttttttctttaaggaaagttttattttactgttcattttactttcttggtaacaaaaactaaaataaggaatagaaaagctgtttttcaggctgacagtccaattaagggtagccaagaccttgcatggtagagtaggaatcatagtgtcagtgaggtcccgtgagtctttgtgagtccttgtgtcatcgttcgggcactgtttttttatgcaagggcaaaaatctttgtatctggggaaaaaaaacttttttttaaattaaaaaggaaaataaaagatattgaggtcttcctagtgttacttaaattaagatcaaggtaagaaacattgtaaaaaaaaattacaaaagtgctatttgtttcctaaaaacagtgatttctattaaaaaggtgtcagaactggaaaaaaaaaaaa

SEQ ID NO: 427880 - DNA, 3803 bp, Homo sapiens
gtgagagagagaggagaggagaggaggaggaggaggagggagaagggaacaacctaccatcttaacacactaatatctaaaaagtgcgagaggcccagagcagcagcagaagcagcagcagcagctccagcttcttccctcctcctcctcctcctgcttctcctgctcagagttcctgcctccagctgccaggggggacagccagccagcagcaggaggggggctagagagctgaaggagagccagtttccccaaaattgctgcagtgagaagaggagtttgttactttaaacagaggctgaagaaactatagaattagcagagaaagtggagaaggtagaggatggagttgcagactctacaggaggctcttaaagtggaaattcaggttcaccagaaactggttgctcaaatgaagcaggatccacagaatgctgacttaaagaaacagcttcatgaactccaagccaaaatcacagctttgagtgagaaacagaaaagagtagttgaacagctacggaagaacctgatagtaaagcaagaacaaccggacaagttccaaatacagccattgccacaatctgaaaacaaactacaaacagcacagcagcaaccactacagcaactacaacaacagcagcagtaccaccaccaccacgcccagcagtcagctgcagcctctcccaacctgactgcttcacagaagactgtaactacagcttctatgattaccacaaagacactacctctcgtcttgaaagcagcaactgcgaccatgcctgcctctgtggtgggccagagacctaccattgctatggtgaccgccatcaacagtcagaaggctgtgctcagcactgatgtgcagaacacaccagtcaacctccagacgtctagtaaggtcactgggcctggggcagaggctgtccaaattgtggcaaaaaacacagtcactctgcaggttcaggcaacacctcctcagcccatcaaagtaccacagtttatcccccctcctagactcactccacgtccaaactttcttccacaggttcgacccaagcctgtggcccagaataacattcctattgccccagcaccacctcccatgctcgcagctcctcagcttatccagaggcccgtcatgctgaccaagttcacccccacaacccttcccacatcccagaattccatccaccccgtccgtgtcgtcaatgggcagactgcaaccatagccaaaacgttccccatggcccagctcaccagcattgtgatagctactccagggaccagactcgctggacctcaaactgtacagcttagcaagccaagtcttgaaaaacagacagttaaatctcacacagaaacagatgagaaacaaacagagagccgcaccatcaccccacctgctgcacccaaaccaaaacgggaggagaaccctcagaaacttgccttcatggtgtctctagggttggtaacacatgaccatctagaagaaatccaaagcaagaggcaagagcgaaaaagaagaacaacagcaaatccggtctacagtggagcagtctttgagccagagcgtaagaagagtgcagtgacatacctaaacagcacaatgcaccctgggacccggaagagaggtcgtcctccaaaatacaatgcagtgctggggtttggagcccttaccccaacatccccccaatccagtcatcctgactcccctgaaaatgaaaagacagagaccacattcactttccctgcacctgttcagcctgtgtccctgcccagccccacctccacagacggtgatattcatgaggatttttgcagcgtttgcagaaaaagtggccagttactgatgtgcgacacatgttcccgtgtatatcatttggactgcttagacccccctctgaaaacaattcccaagggcatgtggatctgtcccagatgtcaggaccagatgctgaagaaggaagaagcaattccatggcctggaactttagcaattgttcattcctatattgcctacaaagcagcaaaagaagaagagaaacagaagttacttaaatggagttcagatttaaaacaagaacgagaacaactagagcaaaaggtgaaacagctcagcaattccataagtaaatgcatggaaatgaagaacaccatcctggcccggcagaaggagatgcacagctccctggagaaggtaaaacagctgattcgcctcatccacggcatcgacctctccaaacctgtagactctgaggccactgtgggggccatctccaatggcccggactgcaccccccctgccaatgccgccacctccacgccggccccttccccctcctcccagagctgcacagcgaactgtaaccagggggaagagactaaataacagagcccctctaggagaagccacgggatcccggcggcaaggagaacagaacactgaagactctagaaaagcaaagccggatttctggaaagtgcagaattcttttggttctttggttccagagagagagaagatgcttgtgccaggtggcaccagagtttgccaattgatccttcttattctgtgtgtacatgcaaagattggaccatgttacatgaaatagtgccagctggaggttctttgccagcaccatgccaagtgaaataatatatttactctctctattatacaccagtgtgtgcctgcagcagcctccacagccacgatgggtttgtttctgttttcttgggtggggagcagggacgggcggagggaggagagcaggtttcagatccttacttgccgagccgtttgtttaggtagagaagacaagtccaaagagtgtgtgggctttcctgtttctaaactttcgctactataaaaccaaaaaaaggaattgagatttcaccaaccccagtgcccagaagagggaaggggagtggctggagggagcagggggtgggacagtgtatcaaataagcagtatttaatcacctctggcgggggcctcgtgcaaggggagactgacaccaagaacagccagtaggttcttctcccctgcactctgctccctgcgcggtaaccccaccactcctgaagcctgcccagtctccttccttccctgcttggtgagtcgcgcatctccgtggttatcccgctgtctcctctccaagaacaagcagagcccgggccactggcccttgcccaaggcagggaagaaggatgtgtgtgtccaggaaggaaaaaaaggtggatcagtgattttacttgaaaacaagctccatcccttttctatatttataagaagagaagatcttgagtgaagcagcacgcgacccaggtgtgtgtgaattgaatggagacgtttcttttctctttctttaatttttgtttttgttctttttttctttaaggaaagttttattttactgttcattttactttcttggtaacaaaaactaaaataaggaatagaaaagctgtttttcaggctgacagtccaattaagggtagccaagaccttgcatggtagagtaggaatcatagtgtcagtgaggtcccgtgagtctttgtgagtccttgtgtcatcgttcgggcactgtttttttatgcaagggcaaaaatctttgtatctggggaaaaaaaacttttttttaaattaaaaaggaaaataaaagatattgaggtcttcctagtgttacttaaattaagatcaaggtaagaaacattgtaaaaaaaaattacaaaagtgctatttgtttcctaaaaacagtgatttctattaaaaaggtgtcagaactggaaaaaaaaaaaa

SEQ ID NO: 427881 - DNA, 3865 bp, Homo sapiens
gtgagagagagaggagaggagaggaggaggaggaggagggagaagggaacaacctaccatcttaacacactaatatctaaaaagtgcgagaggcccagagcagcagcagaagcagcagcagcagctccagcttcttccctccctccccatgaagaagagttccctcctcctcctcctcctgcttctcctgctcagagttcctgcctccagctgccaggggggacagccagccagcagcaggaggggggctagagagctgaaggagagccagtttccccaaaattgctgcagtgagaagaggagtttgttactttaaacagaggctgaagaaactatagaattagcagagaaagtggagaaggtagaggatggagttgcagactctacaggaggctcttaaagtggaaattcaggttcaccagaaactggttgctcaaatgaagcaggatccacagaatgctgacttaaagaaacagcttcatgaactccaagccaaaatcacagctttgagtgagaaacagaaaagagtagttgaacagctacggaagaacctgatagtaaagcaagaacaaccggacaagttccaaatacagccattgccacaatctgaaaacaaactacaaacagcacagcagcaaccactacagcaactacaacaacagcagcagtaccaccaccaccacgcccagcagtcagctgcagcctctcccaacctgactgcttcacagaagactgtaactacagcttctatgattaccacaaagacactacctctcgtcttgaaagcagcaactgcgaccatgcctgcctctgtggtgggccagagacctaccattgctatggtgaccgccatcaacagtcagaaggctgtgctcagcactgatgtgcagaacacaccagtcaacctccagacgtctagtaaggtcactgggcctggggcagaggctgtccaaattgtggcaaaaaacacagtcactctgcaggttcaggcaacacctcctcagcccatcaaagtaccacagtttatcccccctcctagactcactccacgtccaaactttcttccacaggttcgacccaagcctgtggcccagaataacattcctattgccccagcaccacctcccatgctcgcagctcctcagcttatccagaggcccgtcatgctgaccaagttcacccccacaacccttcccacatcccagaattccatccaccccgtccgtgtcgtcaatgggcagactgcaaccatagccaaaacgttccccatggcccagctcaccagcattgtgatagctactccagggaccagactcgctggacctcaaactgtacagcttagcaagccaagtcttgaaaaacagacagttaaatctcacacagaaacagatgagaaacaaacagagagccgcaccatcaccccacctgctgcacccaaaccaaaacgggaggagaaccctcagaaacttgccttcatggtgtctctagggttggtaacacatgaccatctagaagaaatccaaagcaagaggcaagagcgaaaaagaagaacaacagcaaatccggtctacagtggagcagtctttgagccagagcgtaagaagagtgcagtgacatacctaaacagcacaatgcaccctgggacccggaagagaggtcgtcctccaaaatacaatgcagtgctggggtttggagcccttaccccaacatccccccaatccagtcatcctgactcccctgaaaatgaaaagacagagaccacattcactttccctgcacctgttcagcctgtgtccctgcccagccccacctccacagacggtgatattcatgaggatttttgcagcgtttgcagaaaaagtggccagttactgatgtgcgacacatgttcccgtgtatatcatttggactgcttagacccccctctgaaaacaattcccaagggcatgtggatctgtcccagatgtcaggaccagatgctgaagaaggaagaagcaattccatggcctggaactttagcaattgttcattcctatattgcctacaaagcagcaaaagaagaagagaaacagaagttacttaaatggagttcagatttaaaacaagaacgagaacaactagagcaaaaggtgaaacagctcagcaattccataagttgtgaggaagcgggctttctagagacaagtattggaaaaatgcatggaaatgaagaacaccatcctggcccggcagaaggagatgcacagctccctggagaaggtaaaacagctgattcgcctcatccacggcatcgacctctccaaacctgtagactctgaggccactgtgggggccatctccaatggcccggactgcaccccccctgccaatgccgccacctccacgccggccccttccccctcctcccagagctgcacagcgaactgtaaccagggggaagagactaaataacagagcccctctaggagaagccacgggatcccggcggcaaggagaacagaacactgaagactctagaaaagcaaagccggatttctggaaagtgcagaattcttttggttctttggttccagagagagagaagatgcttgtgccaggtggcaccagagtttgccaattgatccttcttattctgtgtgtacatgcaaagattggaccatgttacatgaaatagtgccagctggaggttctttgccagcaccatgccaagtgaaataatatatttactctctctattatacaccagtgtgtgcctgcagcagcctccacagccacgatgggtttgtttctgttttcttgggtggggagcagggacgggcggagggaggagagcaggtttcagatccttacttgccgagccgtttgtttaggtagagaagacaagtccaaagagtgtgtgggctttcctgtttctaaactttcgctactataaaaccaaaaaaaggaattgagatttcaccaaccccagtgcccagaagagggaaggggagtggctggagggagcagggggtgggacagtgtatcaaataagcagtatttaatcacctctggcgggggcctcgtgcaaggggagactgacaccaagaacagccagtaggttcttctcccctgcactctgctccctgcgcggtaaccccaccactcctgaagcctgcccagtctccttccttccctgcttggtgagtcgcgcatctccgtggttatcccgctgtctcctctccaagaacaagcagagcccgggccactggcccttgcccaaggcagggaagaaggatgtgtgtgtccaggaaggaaaaaaaggtggatcagtgattttacttgaaaacaagctccatcccttttctatatttataagaagagaagatcttgagtgaagcagcacgcgacccaggtgtgtgtgaattgaatggagacgtttcttttctctttctttaatttttgtttttgttctttttttctttaaggaaagttttattttactgttcattttactttcttggtaacaaaaactaaaataaggaatagaaaagctgtttttcaggctgacagtccaattaagggtagccaagaccttgcatggtagagtaggaatcatagtgtcagtgaggtcccgtgagtctttgtgagtccttgtgtcatcgttcgggcactgtttttttatgcaagggcaaaaatctttgtatctggggaaaaaaaacttttttttaaattaaaaaggaaaataaaagatattgaggtcttcctagtgttacttaaattaagatcaaggtaagaaacattgtaaaaaaaaattacaaaagtgctatttgtttcctaaaaacagtgatttctattaaaaaggtgtcagaactggaaaaaaaaaaaa

SEQ ID NO: 427882 - DNA, 3954 bp, Homo sapiens
gtgagagagagaggagaggagaggaggaggaggaggagggagaagggaacaacctaccatcttaacacactaatatctaaaaagtgcgagaggcccagagcagcagcagaagcagcagcagcagctccagcttcttccctccctccccatgaagaagagttccctcctcctcctcctcctgcttctcctgctcagagttcctgcctccagctgccaggggggacagccagccagcagcaggaggggggctagagagctgaaggagagccagtttccccaaaattgctgcagtgagaagaggagtttgttactttaaacagaggctgaagaaactatagaattagcagagaaagtggagaaggtagaggatggagttgcagactctacaggaggctcttaaagtggaaattcaggttcaccagaaactggttgctcaaatgaagcaggatccacagaatgctgacttaaagaaacagcttcatgaactccaagccaaaatcacagctttgagtgagaaacagaaaagagtagttgaacagctacggaagaacctgatagtaaagcaagaacaaccggacaagttccaaatacagccattgccacaatctgaaaacaaactacaaacagcacagcagcaaccactacagcaactacaacaacagcagcagtaccaccaccaccacgcccagcagtcagctgcagcctctcccaacctgactgcttcacagaagactgtaactacagcttctatgattaccacaaagacactacctctcgtcttgaaagcagcaactgcgaccatgcctgcctctgtggtgggccagagacctaccattgctatggtgaccgccatcaacagtcagaaggctgtgctcagcactgatgtgcagaacacaccagtcaacctccagacgtctagtaaggtcactgggcctggggcagaggctgtccaaattgtggcaaaaaacacagtcactctgcaggttcaggcaacacctcctcagcccatcaaagtaccacagtttatcccccctcctagactcactccacgtccaaactttcttccacaggttcgacccaagcctgtggcccagaataacattcctattgccccagcaccacctcccatgctcgcagctcctcagcttatccagaggcccgtcatgctgaccaagttcacccccacaacccttcccacatcccagaattccatccaccccgtccgtgtcgtcaatgggcagactgcaaccatagccaaaacgttccccatggcccagctcaccagcattgtgatagctactccagggaccagactcgctggacctcaaactgtacagcttagcaagccaagtcttgaaaaacagacagttaaatctcacacagaaacagatgagaaacaaacagagagccgcaccatcaccccacctgctgcacccaaaccaaaacgggaggagaaccctcagaaacttgccttcatggtgtctctagggttggtaacacatgaccatctagaagaaatccaaagcaagaggcaagagcgaaaaagaagaacaacagcaaatccggtctacagtggagcagtctttgagccagagcgtaagaagagtgcagtgacatacctaaacagcacaatgcaccctgggacccggaagagaggtcgtcctccaaaatacaatgcagtgctggggtttggagcccttaccccaacatccccccaatccagtcatcctgactcccctgaaaatgaaaagacagagaccacattcactttccctgcacctgttcagcctgtgtccctgcccagccccacctccacagacggtgatattcatgaggatttttgcagcgtttgcagaaaaagtggccagttactgatgtgcgacacatgttcccgtgtatatcatttggactgcttagacccccctctgaaaacaattcccaagggcatgtggatctgtcccagatgtcaggaccagatgctgaagaaggaagaagcaattccatggcctggaactttagcaattgttcattcctatattgcctacaaagcagcaaaagaagaagagaaacagaagttacttaaatggagttcagatttaaaacaagaacgagaacaactagagcaaaaggtgaaacagctcagcaattccataagttcacctgagcgagtgggcccatccgtacggccctccctcgctctttcttccacaccatgctgattgcatttcccggttttcctgaccagtgtgaggaagcgggctttctagagacaagtattggaaaaatgcatggaaatgaagaacaccatcctggcccggcagaaggagatgcacagctccctggagaaggtaaaacagctgattcgcctcatccacggcatcgacctctccaaacctgtagactctgaggccactgtgggggccatctccaatggcccggactgcaccccccctgccaatgccgccacctccacgccggccccttccccctcctcccagagctgcacagcgaactgtaaccagggggaagagactaaataacagagcccctctaggagaagccacgggatcccggcggcaaggagaacagaacactgaagactctagaaaagcaaagccggatttctggaaagtgcagaattcttttggttctttggttccagagagagagaagatgcttgtgccaggtggcaccagagtttgccaattgatccttcttattctgtgtgtacatgcaaagattggaccatgttacatgaaatagtgccagctggaggttctttgccagcaccatgccaagtgaaataatatatttactctctctattatacaccagtgtgtgcctgcagcagcctccacagccacgatgggtttgtttctgttttcttgggtggggagcagggacgggcggagggaggagagcaggtttcagatccttacttgccgagccgtttgtttaggtagagaagacaagtccaaagagtgtgtgggctttcctgtttctaaactttcgctactataaaaccaaaaaaaggaattgagatttcaccaaccccagtgcccagaagagggaaggggagtggctggagggagcagggggtgggacagtgtatcaaataagcagtatttaatcacctctggcgggggcctcgtgcaaggggagactgacaccaagaacagccagtaggttcttctcccctgcactctgctccctgcgcggtaaccccaccactcctgaagcctgcccagtctccttccttccctgcttggtgagtcgcgcatctccgtggttatcccgctgtctcctctccaagaacaagcagagcccgggccactggcccttgcccaaggcagggaagaaggatgtgtgtgtccaggaaggaaaaaaaggtggatcagtgattttacttgaaaacaagctccatcccttttctatatttataagaagagaagatcttgagtgaagcagcacgcgacccaggtgtgtgtgaattgaatggagacgtttcttttctctttctttaatttttgtttttgttctttttttctttaaggaaagttttattttactgttcattttactttcttggtaacaaaaactaaaataaggaatagaaaagctgtttttcaggctgacagtccaattaagggtagccaagaccttgcatggtagagtaggaatcatagtgtcagtgaggtcccgtgagtctttgtgagtccttgtgtcatcgttcgggcactgtttttttatgcaagggcaaaaatctttgtatctggggaaaaaaaacttttttttaaattaaaaaggaaaataaaagatattgaggtcttcctagtgttacttaaattaagatcaaggtaagaaacattgtaaaaaaaaattacaaaagtgctatttgtttcctaaaaacagtgatttctattaaaaaggtgtcagaactggaaaaaaaaaaaa

SEQ ID NO: 427883 - DNA, 3664 bp, Homo sapiens
gtgagagagagaggagaggagaggaggaggaggaggagggagaagggaacaacctaccatcttaacacactaatatctaaaaagtgcgagaggcccagagcagcagcagaagcagcagcagcagctccagcttcttccctccctccccatgaagaagagttccctcctcctcctcctcctgcttctcctgctcagagttcctgcctccagctgccaggggggacagccagccagcagcaggaggggggctagagagctgaaggagagccagtttccccaaaattgctgcagtgagaagaggagtttgttactttaaacagaggctgaagaaactatagaattagcagagaaagtggagaaggtagaggatggagttgcagactctacaggaggctcttaaagtggaaattcaggttcaccagaaactggttgctcaaatgaagcaggatccacagaatgctgacttaaagaaacagcttcatgaactccaagccaaaatcacagctttgagtgagaaacagaaaagagtagttgaacagctacggaagaacctgatagtaaagcaagaacaaccggacaagttccaaatacagccattgccacaatctgaaaacaaactacaaacagcacagcagcaaccactacagcaactacaacaacagcagcagtaccaccaccaccacgcccagcagtcagctgcagcctctcccaacctgactgcttcacagaagactgtaactacagcttctatgattaccacaaagacactacctctcgtcttgaaagcagcaactgcgaccatgcctgcctctgtggtgggccagagacctaccattgctatggtgaccgccatcaacagtcagaaggctgtgctcagcactgatgtgcagaacacaccagtcaacctccagacgtctagtaaggtcactgggcctggggcagaggctgtccaaattgtggcaaaaaacacagtcactctgcaggttcaggcaacacctcctcagcccatcaaagtaccacagtttatcccccctcctagactcactccacgtccaaactttcttccacaggttcgacccaagcctgtggcccagaataacattcctattgccccagcaccacctcccatgctcgcagctcctcagcttatccagaggcccgtcatgctgaccaagttcacccccacaacccttcccacatcccagaattccatccaccccgtccgtgtcgtcaatgggcagactgcaaccatagccaaaacgttccccatggcccagctcaccagcattgtgatagctactccagggaccagactcgctggacctcaaactgtacagcttagcaagccaagtcttgaaaaacagacagttaaatctcacacagaaacagatgagaaacaaacagagagccgcaccatcaccccacctgctgcacccaaaccaaaacgggaggagaaccctcagaaacttgccttcatggtgtctctagggttggtaacacatgaccatctagaagaaatccaaagcaagaggcaagagcgaaaaagaagaacaacagcaaatccggtctacagtggagcagtctttgagccagagcgtaagaagagtgcagtgacatacctaaacagcacaatgcaccctgggacccggaagagagggtgatattcatgaggatttttgcagcgtttgcagaaaaagtggccagttactgatgtgcgacacatgttcccgtgtatatcatttggactgcttagacccccctctgaaaacaattcccaagggcatgtggatctgtcccagatgtcaggaccagatgctgaagaaggaagaagcaattccatggcctggaactttagcaattgttcattcctatattgcctacaaagcagcaaaagaagaagagaaacagaagttacttaaatggagttcagatttaaaacaagaacgagaacaactagagcaaaaggtgaaacagctcagcaattccataagtaaatgcatggaaatgaagaacaccatcctggcccggcagaaggagatgcacagctccctggagaaggtaaaacagctgattcgcctcatccacggcatcgacctctccaaacctgtagactctgaggccactgtgggggccatctccaatggcccggactgcaccccccctgccaatgccgccacctccacgccggccccttccccctcctcccagagctgcacagcgaactgtaaccagggggaagagactaaataacagagcccctctaggagaagccacgggatcccggcggcaaggagaacagaacactgaagactctagaaaagcaaagccggatttctggaaagtgcagaattcttttggttctttggttccagagagagagaagatgcttgtgccaggtggcaccagagtttgccaattgatccttcttattctgtgtgtacatgcaaagattggaccatgttacatgaaatagtgccagctggaggttctttgccagcaccatgccaagtgaaataatatatttactctctctattatacaccagtgtgtgcctgcagcagcctccacagccacgatgggtttgtttctgttttcttgggtggggagcagggacgggcggagggaggagagcaggtttcagatccttacttgccgagccgtttgtttaggtagagaagacaagtccaaagagtgtgtgggctttcctgtttctaaactttcgctactataaaaccaaaaaaaggaattgagatttcaccaaccccagtgcccagaagagggaaggggagtggctggagggagcagggggtgggacagtgtatcaaataagcagtatttaatcacctctggcgggggcctcgtgcaaggggagactgacaccaagaacagccagtaggttcttctcccctgcactctgctccctgcgcggtaaccccaccactcctgaagcctgcccagtctccttccttccctgcttggtgagtcgcgcatctccgtggttatcccgctgtctcctctccaagaacaagcagagcccgggccactggcccttgcccaaggcagggaagaaggatgtgtgtgtccaggaaggaaaaaaaggtggatcagtgattttacttgaaaacaagctccatcccttttctatatttataagaagagaagatcttgagtgaagcagcacgcgacccaggtgtgtgtgaattgaatggagacgtttcttttctctttctttaatttttgtttttgttctttttttctttaaggaaagttttattttactgttcattttactttcttggtaacaaaaactaaaataaggaatagaaaagctgtttttcaggctgacagtccaattaagggtagccaagaccttgcatggtagagtaggaatcatagtgtcagtgaggtcccgtgagtctttgtgagtccttgtgtcatcgttcgggcactgtttttttatgcaagggcaaaaatctttgtatctggggaaaaaaaacttttttttaaattaaaaaggaaaataaaagatattgaggtcttcctagtgttacttaaattaagatcaaggtaagaaacattgtaaaaaaaaattacaaaagtgctatttgtttcctaaaaacagtgatttctattaaaaaggtgtcagaactggaaaaaaaaaaaa

SEQ ID NO: 427884 - DNA, 2531 bp, Homo sapiens
  misc_feature (2513)..(2513): n is a, c, g, or t
gtgagagagagaggagaggagaggaggaggaggaggagggagaagggaacaacctaccatcttaacacactaatatctaaaaagtgcgagaggcccagagcagcagcagaagcagcagcagcagctccagcttcttccctccctccccatgaagaagagttccctcctcctcctcctcctgcttctcctgctcagagttcctgcctccagctgccaggggggacagccagccagcagcaggaggggggctagagagctgaaggagagccagtttccccaaaattgctgcagtgagaagaggagtttgttactttaaacagaggctgaagaaactatagaattagcagagaaagtggagaaggtagaggatggagttgcagactctacaggaggctcttaaagtggaaattcaggttcaccagaaactggttgctcaaatgaagcaggatccacagaatgctgacttaaagaaacagcttcatgaactccaagccaaaatcacagctttgagtgagaaacagaaaagagtagttgaacagctacggaagaacctgatagtaaagcaagaacaaccggacaagttccaaatacagccattgccacaatctgaaaacaaactacaaacagcacagcagcaaccactacagcaactacaacaacagcagcagtaccaccaccaccacgcccagcagtcagctgcagcctctcccaacctgactgcttcacagaagactgtaactacagcttctatgattaccacaaagacactacctctcgtcttgaaagcagcaactgcgaccatgcctgcctctgtggtgggccagagacctaccattgctatggtgaccgccatcaacagtcagaaggctgtgctcagcactgatgtgcagaacacaccagtcaacctccagacgtctagtaaggtcactgggcctggggcagaggctgtccaaattgtggcaaaaaacacagtcactctgcaggttcaggcaacacctcctcagcccatcaaagtaccacagtttatcccccctcctagactcactccacgtccaaactttcttccacaggttcgacccaagcctgtggcccagaataacattcctattgccccagcaccacctcccatgctcgcagctcctcagcttatccagaggcccgtcatgctgaccaagttcacccccacaacccttcccacatcccagaattccatccaccccgtccgtgtcgtcaatgggcagactgcaaccatagccaaaacgttccccatggcccagctcaccagcattgtgatagctactccagggaccagactcgctggacctcaaactgtacagcttagcaagccaagtcttgaaaaacagacagttaaatctcacacagaaacagatgagaaacaaacagagagccgcaccatcaccccacctgctgcacccaaaccaaaacgggaggagaaccctcagaaacttgccttcatggtgtctctagggttggtaacacatgaccatctagaagaaatccaaagcaagaggcaagagcgaaaaagaagaacaacagcaaatccggtctacagtggagcagtctttgagccagagcgtaagaagagtgcagtgacatacctaaacagcacaatgcaccctgggacccggaagagaggtcgtcctccaaaatacaatgcagtgctggggtttggagcccttaccccaacatccccccaatccagtcatcctgactcccctgaaaatgaaaagacagagaccacattcactttccctgcacctgttcagcctgtgtccctgcccagccccacctccacagacggtgatattcatgaggatttttgcagcgtttgcagaaaaagtggccagttactgatgtgcgacacatgttcccgtgtatatcatttggactgcttagacccccctctgaaaacaattcccaagggcatgtggatctgtcccagatgtcaggaccagatgctgaagaaggaagaagcaattccatggcctggaactttagcaattgttcattcctatattgcctacaaagcagcaaaagaagaagagaaacagaagttacttaaatggagttcagatttaaaacaagaacgagaacaactagagcaaaaggtgaaacagctcagcaattccataagtaaatgcatggaaatgaagaacaccatcctggcccggcagaaggagatgcacagctccctggagaaggtaaaacagctgattcgcctcatccacggcatcgacctctccaaacctgtagactctgaggccactgtgggggccatctccaatggcccggactgcaccccccctgccaatgccgccgggatcccgtggcttctcccacagtttatcccccctcctagactcactccacgtccaaactttcttccacaggttcgacccaagcctgtggcccagaataacattcctattgccccagcaccacctcccatgctcgcagctcctcagcttatccagaggcgcgtcatgctgacnagttcaccccacaacctt

SEQ ID NO: 427885 - DNA, 3687 bp, Homo sapiens
gtgagagagagaggagaggagaggaggaggaggaggagggagaagggaacaacctaccatcttaacacactaatatctaaaaagtgcgagaggcccagagcagcagcagaagcagcagcagcagctccagcttcttccctccctccccatgaagaagagttccctcctcctcctcctcctgcttctcctgctcagagttcctgcctccagctgccaggggggacagccagccagcagcaggaggggggctagagagctgaaggagagccagtttccccaaaattgctgcagtgagaagaggagtttgttactttaaacagaggctgaagaaactatagaattagcagagaaagtggagaaggtagaggatggagttgcagactctacaggaggctcttaaagtggaaattcaggttcaccagaaactggttgctcaaatgaagcaggatccacagaatgctgacttaaagaaacagcttcatgaactccaagccaaaatcacagctttgagtgagaaacagaaaagagtagttgaacagctacggaagaacctgatagtaaagcaagaacaaccggacaagttccaaatacagccattgccacaatctgaaaacaaactacaaacagcacagcagcaaccactacagcaactacaacaacagcagcagtaccaccaccaccacgcccagcagtcagctgcagcctctcccaacctgactgcttcacagaagactgtaactacagcttctatgattaccacaaagacactacctctcgtcttgaaagcagcaactgcgaccatgcctgcctctgtggtgggccagagacctaccattgctatggtgaccgccatcaacagtcagaaggctgtgctcagcactgatgtgcagaacacaccagtcaacctccagacgtctagtaaggtcactgggcctggggcagaggctgtccaaattgtggcaaaaaacacagtcactctgcaggttcaggcaacacctcctcagcccatcaaagtaccacagtttatcccccctcctagactcactccacgtccaaactttcttccacaggttcgacccaagcctgtggcccagaataacattcctattgccccagcaccacctcccatgctcgcagctcctcagcttatccagaggcccgtcatgctgaccaagttcacccccacaacccttcccacatcccagaattccatccaccccgtccgtgtcgtcaatgggcagactgcaaccatagccaaaacgttccccatggcccagctcaccagcattgtgatagctactccagggaccagactcgctggacctcaaactgtacagcttagcaagccaagtcttgaaaaacagacagttaaatctcacacagaaacagatgagaaacaaacagagagccgcaccatcaccccacctgctgcacccaaaccaaaacgggaggagaaccctcagaaacttgccttcatggtgtctctagggttggtaacacatgaccatctagaagaaatccaaagcaagaggcaagagcgaaaaagaagaacaacagcaaatccggtctacagtggagcagtctttgagccagagcgtaagaagagtgcagtgacatacctaaacagcacaatgcaccctgggacccggaagagagccaatgaggaacactggccaaagggtgatattcatgaggatttttgcagcgtttgcagaaaaagtggccagttactgatgtgcgacacatgttcccgtgtatatcatttggactgcttagacccccctctgaaaacaattcccaagggcatgtggatctgtcccagatgtcaggaccagatgctgaagaaggaagaagcaattccatggcctggaactttagcaattgttcattcctatattgcctacaaagcagcaaaagaagaagagaaacagaagttacttaaatggagttcagatttaaaacaagaacgagaacaactagagcaaaaggtgaaacagctcagcaattccataagtaaatgcatggaaatgaagaacaccatcctggcccggcagaaggagatgcacagctccctggagaaggtaaaacagctgattcgcctcatccacggcatcgacctctccaaacctgtagactctgaggccactgtgggggccatctccaatggcccggactgcaccccccctgccaatgccgccacctccacgccggccccttccccctcctcccagagctgcacagcgaactgtaaccagggggaagagactaaataacagagcccctctaggagaagccacgggatcccggcggcaaggagaacagaacactgaagactctagaaaagcaaagccggatttctggaaagtgcagaattcttttggttctttggttccagagagagagaagatgcttgtgccaggtggcaccagagtttgccaattgatccttcttattctgtgtgtacatgcaaagattggaccatgttacatgaaatagtgccagctggaggttctttgccagcaccatgccaagtgaaataatatatttactctctctattatacaccagtgtgtgcctgcagcagcctccacagccacgatgggtttgtttctgttttcttgggtggggagcagggacgggcggagggaggagagcaggtttcagatccttacttgccgagccgtttgtttaggtagagaagacaagtccaaagagtgtgtgggctttcctgtttctaaactttcgctactataaaaccaaaaaaaggaattgagatttcaccaaccccagtgcccagaagagggaaggggagtggctggagggagcagggggtgggacagtgtatcaaataagcagtatttaatcacctctggcgggggcctcgtgcaaggggagactgacaccaagaacagccagtaggttcttctcccctgcactctgctccctgcgcggtaaccccaccactcctgaagcctgcccagtctccttccttccctgcttggtgagtcgcgcatctccgtggttatcccgctgtctcctctccaagaacaagcagagcccgggccactggcccttgcccaaggcagggaagaaggatgtgtgtgtccaggaaggaaaaaaaggtggatcagtgattttacttgaaaacaagctccatcccttttctatatttataagaagagaagatcttgagtgaagcagcacgcgacccaggtgtgtgtgaattgaatggagacgtttcttttctctttctttaatttttgtttttgttctttttttctttaaggaaagttttattttactgttcattttactttcttggtaacaaaaactaaaataaggaatagaaaagctgtttttcaggctgacagtccaattaagggtagccaagaccttgcatggtagagtaggaatcatagtgtcagtgaggtcccgtgagtctttgtgagtccttgtgtcatcgttcgggcactgtttttttatgcaagggcaaaaatctttgtatctggggaaaaaaaacttttttttaaattaaaaaggaaaataaaagatattgaggtcttcctagtgttacttaaattaagatcaaggtaagaaacattgtaaaaaaaaattacaaaagtgctatttgtttcctaaaaacagtgatttctattaaaaaggtgtcagaactggaaaaaaaaaaaa

SEQ ID NO: 427886 - DNA, 3658 bp, Homo sapiens
gtccatcctttttcctattcagtcttctggaaggagctgcctctgaaatactcttcttctgcttacatgaagatctctaaatgctatccagcaggaggtgctacagcaagataaaggaaatttttgaattttgagggtcttgctacttattacagctctgcttagcttcagctaagcaacaggattaacaccttaaagttccagaaagattttgaggggctagagagctgaaggagagccagtttccccaaaattgctgcagtgagaagaggagtttgttactttaaacagaggctgaagaaactatagaattagcagagaaagtggagaaggtagaggatggagttgcagactctacaggaggctcttaaagtggaaattcaggttcaccagaaactggttgctcaaatgaagcaggatccacagaatgctgacttaaagaaacagcttcatgaactccaagccaaaatcacagctttgagtgagaaacagaaaagagtagttgaacagctacggaagaacctgatagtaaagcaagaacaaccggacaagttccaaatacagccattgccacaatctgaaaacaaactacaaacagcacagcagcaaccactacagcaactacaacaacagcagcagtaccaccaccaccacgcccagcagtcagctgcagcctctcccaacctgactgcttcacagaagactgtaactacagcttctatgattaccacaaagacactacctctcgtcttgaaagcagcaactgcgaccatgcctgcctctgtggtgggccagagacctaccattgctatggtgaccgccatcaacagtcagaaggctgtgctcagcactgatgtgcagaacacaccagtcaacctccagacgtctagtaaggtcactgggcctggggcagaggctgtccaaattgtggcaaaaaacacagtcactctgcaggttcaggcaacacctcctcagcccatcaaagtaccacagtttatcccccctcctagactcactccacgtccaaactttcttccacaggttcgacccaagcctgtggcccagaataacattcctattgccccagcaccacctcccatgctcgcagctcctcagcttatccagaggcccgtcatgctgaccaagttcacccccacaacccttcccacatcccagaattccatccaccccgtccgtgtcgtcaatgggcagactgcaaccatagccaaaacgttccccatggcccagctcaccagcattgtgatagctactccagggaccagactcgctggacctcaaactgtacagcttagcaagccaagtcttgaaaaacagacagttaaatctcacacagaaacagatgagaaacaaacagagagccgcaccatcaccccacctgctgcacccaaaccaaaacgggaggagaaccctcagaaacttgccttcatggtgtctctagggttggtaacacatgaccatctagaagaaatccaaagcaagaggcaagagcgaaaaagaagaacaacagcaaatccggtctacagtggagcagtctttgagccagagcgtaagaagagtgcagtgacatacctaaacagcacaatgcaccctgggacccggaagagagccaatgaggaacactggccaaagggtgatattcatgaggatttttgcagcgtttgcagaaaaagtggccagttactgatgtgcgacacatgttcccgtgtatatcatttggactgcttagacccccctctgaaaacaattcccaagggcatgtggatctgtcccagatgtcaggaccagatgctgaagaaggaagaagcaattccatggcctggaactttagcaattgttcattcctatattgcctacaaagcagcaaaagaagaagagaaacagaagttacttaaatggagttcagatttaaaacaagaacgagaacaactagagcaaaaggtgaaacagctcagcaattccataagtaaatgcatggaaatgaagaacaccatcctggcccggcagaaggagatgcacagctccctggagaaggtaaaacagctgattcgcctcatccacggcatcgacctctccaaacctgtagactctgaggccactgtgggggccatctccaatggcccggactgcaccccccctgccaatgccgccacctccacgccggccccttccccctcctcccagagctgcacagcgaactgtaaccagggggaagagactaaataacagagcccctctaggagaagccacgggatcccggcggcaaggagaacagaacactgaagactctagaaaagcaaagccggatttctggaaagtgcagaattcttttggttctttggttccagagagagagaagatgcttgtgccaggtggcaccagagtttgccaattgatccttcttattctgtgtgtacatgcaaagattggaccatgttacatgaaatagtgccagctggaggttctttgccagcaccatgccaagtgaaataatatatttactctctctattatacaccagtgtgtgcctgcagcagcctccacagccacgatgggtttgtttctgttttcttgggtggggagcagggacgggcggagggaggagagcaggtttcagatccttacttgccgagccgtttgtttaggtagagaagacaagtccaaagagtgtgtgggctttcctgtttctaaactttcgctactataaaaccaaaaaaaggaattgagatttcaccaaccccagtgcccagaagagggaaggggagtggctggagggagcagggggtgggacagtgtatcaaataagcagtatttaatcacctctggcgggggcctcgtgcaaggggagactgacaccaagaacagccagtaggttcttctcccctgcactctgctccctgcgcggtaaccccaccactcctgaagcctgcccagtctccttccttccctgcttggtgagtcgcgcatctccgtggttatcccgctgtctcctctccaagaacaagcagagcccgggccactggcccttgcccaaggcagggaagaaggatgtgtgtgtccaggaaggaaaaaaaggtggatcagtgattttacttgaaaacaagctccatcccttttctatatttataagaagagaagatcttgagtgaagcagcacgcgacccaggtgtgtgtgaattgaatggagacgtttcttttctctttctttaatttttgtttttgttctttttttctttaaggaaagttttattttactgttcattttactttcttggtaacaaaaactaaaataaggaatagaaaagctgtttttcaggctgacagtccaattaagggtagccaagaccttgcatggtagagtaggaatcatagtgtcagtgaggtcccgtgagtctttgtgagtccttgtgtcatcgttcgggcactgtttttttatgcaagggcaaaaatctttgtatctggggaaaaaaaacttttttttaaattaaaaaggaaaataaaagatattgaggtcttcctagtgttacttaaattaagatcaaggtaagaaacattgtaaaaaaaaattacaaaagtgctatttgtttcctaaaaacagtgatttctattaaaaaggtgtcagaactggaaaaaaaaaaaa

SEQ ID NO: 427887 - DNA, 3097 bp, Homo sapiens
tacgacctggacttttacagggagaccgtctatatcttgcagtccggaacacacctcgtgagtactacacagcagcagtaccaccaccaccacgcccagcagtcagctgcagcctctcccaacctgactgcttcacagaagactgtaactacagcttctatgattaccacaaagacactacctctcgtcttgaaagcagcaactgcgaccatgcctgcctctgtggtgggccagagacctaccattgctatggtgaccgccatcaacagtcagaaggctgtgctcagcactgatgtgcagaacacaccagtcaacctccagacgtctagtaaggtcactgggcctggggcagaggctgtccaaattgtggcaaaaaacacagtcactctgcaggttcaggcaacacctcctcagcccatcaaagtaccacagtttatcccccctcctagactcactccacgtccaaactttcttccacaggttcgacccaagcctgtggcccagaataacattcctattgccccagcaccacctcccatgctcgcagctcctcagcttatccagaggcccgtcatgctgaccaagttcacccccacaacccttcccacatcccagaattccatccaccccgtccgtgtcgtcaatgggcagactgcaaccatagccaaaacgttccccatggcccagctcaccagcattgtgatagctactccagggaccagactcgctggacctcaaactgtacagcttagcaagccaagtcttgaaaaacagacagttaaatctcacacagaaacagatgagaaacaaacagagagccgcaccatcaccccacctgctgcacccaaaccaaaacgggaggagaaccctcagaaacttgccttcatggtgtctctagggttggtaacacatgaccatctagaagaaatccaaagcaagaggcaagagcgaaaaagaagaacaacagcaaatccggtctacagtggagcagtctttgagccagagcgtaagaagagtgcagtgacatacctaaacagcacaatgcaccctgggacccggaagagagccaatgaggaacactggccaaagggtgatattcatgaggatttttgcagcgtttgcagaaaaagtggccagttactgatgtgcgacacatgttcccgtgtatatcatttggactgcttagacccccctctgaaaacaattcccaagggcatgtggatctgtcccagatgtcaggaccagatgctgaagaaggaagaagcaattccatggcctggaactttagcaattgttcattcctatattgcctacaaagcagcaaaagaagaagagaaacagaagttacttaaatggagttcagatttaaaacaagaacgagaacaactagagcaaaaggtgaaacagctcagcaattccataagtaaatgcatggaaatgaagaacaccatcctggcccggcagaaggagatgcacagctccctggagaaggtaaaacagctgattcgcctcatccacggcatcgacctctccaaacctgtagactctgaggccactgtgggggccatctccaatggcccggactgcaccccccctgccaatgccgccacctccacgccggccccttccccctcctcccagagctgcacagcgaactgtaaccagggggaagagactaaataacagagcccctctaggagaagccacgggatcccggcggcaaggagaacagaacactgaagactctagaaaagcaaagccggatttctggaaagtgcagaattcttttggttctttggttccagagagagagaagatgcttgtgccaggtggcaccagagtttgccaattgatccttcttattctgtgtgtacatgcaaagattggaccatgttacatgaaatagtgccagctggaggttctttgccagcaccatgccaagtgaaataatatatttactctctctattatacaccagtgtgtgcctgcagcagcctccacagccacgatgggtttgtttctgttttcttgggtggggagcagggacgggcggagggaggagagcaggtttcagatccttacttgccgagccgtttgtttaggtagagaagacaagtccaaagagtgtgtgggctttcctgtttctaaactttcgctactataaaaccaaaaaaaggaattgagatttcaccaaccccagtgcccagaagagggaaggggagtggctggagggagcagggggtgggacagtgtatcaaataagcagtatttaatcacctctggcgggggcctcgtgcaaggggagactgacaccaagaacagccagtaggttcttctcccctgcactctgctccctgcgcggtaaccccaccactcctgaagcctgcccagtctccttccttccctgcttggtgagtcgcgcatctccgtggttatcccgctgtctcctctccaagaacaagcagagcccgggccactggcccttgcccaaggcagggaagaaggatgtgtgtgtccaggaaggaaaaaaaggtggatcagtgattttacttgaaaacaagctccatcccttttctatatttataagaagagaagatcttgagtgaagcagcacgcgacccaggtgtgtgtgaattgaatggagacgtttcttttctctttctttaatttttgtttttgttctttttttctttaaggaaagttttattttactgttcattttactttcttggtaacaaaaactaaaataaggaatagaaaagctgtttttcaggctgacagtccaattaagggtagccaagaccttgcatggtagagtaggaatcatagtgtcagtgaggtcccgtgagtctttgtgagtccttgtgtcatcgttcgggcactgtttttttatgcaagggcaaaaatctttgtatctggggaaaaaaaacttttttttaaattaaaaaggaaaataaaagatattgaggtcttcctagtgttacttaaattaagatcaaggtaagaaacattgtaaaaaaaaattacaaaagtgctatttgtttcctaaaaacagtgatttctattaaaaaggtgtcagaactggaaaaaaaaaaaa

SEQ ID NO: 427888 - DNA, 3828 bp, Homo sapiens
gtgagagagagaggagaggagaggaggaggaggaggagggagaagggaacaacctaccatcttaacacactaatatctaaaaagtgcgagaggcccagagcagcagcagaagcagcagcagcagctccagcttcttccctccctccccatgaagaagagttccctcctcctcctcctcctgcttctcctgctcagagttcctgcctccagctgccaggggggacagccagccagcagcaggaggggggctagagagctgaaggagagccagtttccccaaaattgctgcagtgagaagaggagtttgttactttaaacagaggctgaagaaactatagaattagcagagaaagtggagaaggtagaggatggagttgcagactctacaggaggctcttaaagtggaaattcaggttcaccagaaactggttgctcaaatgaagcaggatccacagaatgctgacttaaagaaacagcttcatgaactccaagccaaaatcacagctttgagtgagaaacagaaaagagtagttgaacagctacggaagaacctgatagtaaagcaagaacaaccggacaagttccaaatacagccattgccacaatctgaaaacaaactacaaacagcacagcagcaaccactacagcaactacaacaacagcagcagtaccaccaccaccacgcccagcagtcagctgcagcctctcccaacctgactgcttcacagaagactgtaactacagcttctatgattaccacaaagacactacctctcgtcttgaaagcagcaactgcgaccatgcctgcctctgtggtgggccagagacctaccattgctatggtgaccgccatcaacagtcagaaggctgtgctcagcactgatgtgcagaacacaccagtcaacctccagacgtctagtaaggtcactgggcctggggcagaggctgtccaaattgtggcaaaaaacacagtcactctgcaggttcaggcaacacctcctcagcccatcaaagtaccacagtttatcccccctcctagactcactccacgtccaaactttcttccacaggttcgacccaagcctgtggcccagaataacattcctattgccccagcaccacctcccatgctcgcagctcctcagcttatccagaggcccgtcatgctgaccaagttcacccccacaacccttcccacatcccagaattccatccaccccgtccgtgtcgtcaatgggcagactgcaaccatagccaaaacgttccccatggcccagctcaccagcattgtgatagctactccagggaccagactcgctggacctcaaactgtacagcttagcaagccaagtcttgaaaaacagacagttaaatctcacacagaaacagatgagaaacaaacagagagccgcaccatcaccccacctgctgcacccaaaccaaaacgggaggagaaccctcagaaacttgccttcatggtgtctctagggttggtaacacatgaccatctagaagaaatccaaagcaagaggcaagagcgaaaaagaagaacaacagcaaatccggtctacagtggagcagtctttgagccagagcgtaagaagagtgcagtgacatacctaaacagcacaatgcaccctgggacccggaagagaggtcgtcctccaaaatacaatgcagtgctggggtttggagcccttaccccaacatccccccaatccagtcatcctgactcccctgaaaatgaaaagacagagaccacattcactttccctgcacctgttcagcctgtgtccctgcccagccccacctccacagacggtgatattcatgaggatttttgcagcgtttgcagaaaaagtggccagttactgatgtgcgacacatgttcccgtgtatatcatttggactgcttagacccccctctgaaaacaattcccaagggcatgtggatctgtcccagatgtcaggaccagatgctgaagaaggaagaagcaattccatggcctggaactttagcaattgttcattcctatattgcctacaaagcagcaaaagaagaagagaaacagaagttacttaaatggagttcagatttaaaacaagaacgagaacaactagagcaaaaggtgaaacagctcagcaattccataagtaaatgcatggaaatgaagaacaccatcctggcccggcagaaggagatgcacagctccctggagaaggtaaaacagctgattcgcctcatccacggcatcgacctctccaaacctgtagactctgaggccactgtgggggccatctccaatggcccggactgcaccccccctgccaatgccgccacctccacgccggccccttccccctcctcccagagctgcacagcgaactgtaaccagggggaagagactaaataacagagcccctctaggagaagccacgggatcccggcggcaaggagaacagaacactgaagactctagaaaagcaaagccggatttctggaaagtgcagaattcttttggttctttggttccagagagagagaagatgcttgtgccaggtggcaccagagtttgccaattgatccttcttattctgtgtgtacatgcaaagattggaccatgttacatgaaatagtgccagctggaggttctttgccagcaccatgccaagtgaaataatatatttactctctctattatacaccagtgtgtgcctgcagcagcctccacagccacgatgggtttgtttctgttttcttgggtggggagcagggacgggcggagggaggagagcaggtttcagatccttacttgccgagccgtttgtttaggtagagaagacaagtccaaagagtgtgtgggctttcctgtttctaaactttcgctactataaaaccaaaaaaaggaattgagatttcaccaaccccagtgcccagaagagggaaggggagtggctggagggagcagggggtgggacagtgtatcaaataagcagtatttaatcacctctggcgggggcctcgtgcaaggggagactgacaccaagaacagccagtaggttcttctcccctgcactctgctccctgcgcggtaaccccaccactcctgaagcctgcccagtctccttccttccctgcttggtgagtcgcgcatctccgtggttatcccgctgtctcctctccaagaacaagcagagcccgggccactggcccttgcccaaggcagggaagaaggatgtgtgtgtccaggaaggaaaaaaaggtggatcagtgattttacttgaaaacaagctccatcccttttctatatttataagaagagaagatcttgagtgaagcagcacgcgacccaggtgtgtgtgaattgaatggagacgtttcttttctctttctttaatttttgtttttgttctttttttctttaaggaaagttttattttactgttcattttactttcttggtaacaaaaactaaaataaggaatagaaaagctgtttttcaggctgacagtccaattaagggtagccaagaccttgcatggtagagtaggaatcatagtgtcagtgaggtcccgtgagtctttgtgagtccttgtgtcatcgttcgggcactgtttttttatgcaagggcaaaaatctttgtatctggggaaaaaaaacttttttttaaattaaaaaggaaaataaaagatattgaggtcttcctagtgttacttaaattaagatcaaggtaagaaacattgtaaaaaaaaattacaaaagtgctatttgtttcctaaaaacagtgatttctattaaaaaggtgtcagaactggaaaaaaaaaaaa

SEQ ID NO: 427889 - DNA, 3672 bp, Homo sapiens
gtgagagagagaggagaggagaggaggaggaggaggagggagaagggaacaacctaccatcttaacacactaatatctaaaaagtgcgagaggcccagagcagcagcagaagcagcagcagcagctccagcttcttccctccctccccatgaagaagagttccctcctcctcctcctcctgcttctcctgctcagagttcctgcctccagctgccaggggggacagccagccagcagcaggaggggggctagagagctgaaggagagccagtttccccaaaattgctgcagtgagaagaggagtttgttactttaaacagaggctgaagaaactatagaattagcagagaaagtggagaaggtagaggatggagttgcagactctacaggaggctcttaaagtggaaattcaggttcaccagaaactggttgctcaaatgaagcaggatccacagaatgctgacttaaagaaacagcttcatgaactccaagccaaaatcacagctttgagtgagaaacagaaaagagtagttgaacagctacggaagaacctgatagtaaagcaagaacaaccggacaagttccaaatacagccattgccacaatctgaaaacaaactacaaacagcacagcagcaaccactacagcaactacaacaacagcagcagtaccaccaccaccacgcccagcagtcagctgcagcctctcccaacctgactgcttcacagaagactgtaactacagcttctatgattaccacaaagacactacctctcgtcttgaaagcagcaactgcgaccatgcctgcctctgtggtgggccagagacctaccattgctatggtgaccgccatcaacagtcagaaggctgtgctcagcactgatgtgcagaacacaccagtcaacctccagacgtctagtaaggtcactgggcctggggcagaggctgtccaaattgtggcaaaaaacacagtcactctgcaggttcaggcaacacctcctcagcccatcaaagtaccacagtttatcccccctcctagactcactccacgtccaaactttcttccacaggttcgacccaagcctgtggcccagaataacattcctattgccccagcaccacctcccatgctcgcagctcctcagcttatccagaggcccgtcatgctgaccaagttcacccccacaacccttcccacatcccagaattccatccaccccgtccgtgtcgtcaatgggcagactgcaaccatagccaaaacgttccccatggcccagctcaccagcattgtgatagctactccagggaccagactcgctggacctcaaactgtacagcttagcaagccaagtcttgaaaaacagacagttaaatctcacacagaaacagatgagaaacaaacagagagccgcaccatcaccccacctgctgcacccaaaccaaaacgggaggagaaccctcagaaacttgccttcatggtgtctctagggttggtaacacatgaccatctagaagaaatccaaagcaagaggcaagagcgaaaaagaagaacaacagcaaatccggtctacagtggagcagtctttgagccagagcgtaagaagagtgcagtgacatacctaaacagcacaatgcaccctgggacccggaagagaggtcgtcctccaaaatacaatgcagtgctggggtttggagcccttaccccaacatccccccaatccagtcatcctgactcccctgaaaatgaaaagacagagaccacattcactttccctgcacctgttcagcctgtgtccctgcccagccccacctccacagacatgctgaagaaggaagaagcaattccatggcctggaactttagcaattgttcattcctatattgcctacaaagcagcaaaagaagaagagaaacagaagttacttaaatggagttcagatttaaaacaagaacgagaacaactagagcaaaaggtgaaacagctcagcaattccataagtaaatgcatggaaatgaagaacaccatcctggcccggcagaaggagatgcacagctccctggagaaggtaaaacagctgattcgcctcatccacggcatcgacctctccaaacctgtagactctgaggccactgtgggggccatctccaatggcccggactgcaccccccctgccaatgccgccacctccacgccggccccttccccctcctcccagagctgcacagcgaactgtaaccagggggaagagactaaataacagagcccctctaggagaagccacgggatcccggcggcaaggagaacagaacactgaagactctagaaaagcaaagccggatttctggaaagtgcagaattcttttggttctttggttccagagagagagaagatgcttgtgccaggtggcaccagagtttgccaattgatccttcttattctgtgtgtacatgcaaagattggaccatgttacatgaaatagtgccagctggaggttctttgccagcaccatgccaagtgaaataatatatttactctctctattatacaccagtgtgtgcctgcagcagcctccacagccacgatgggtttgtttctgttttcttgggtggggagcagggacgggcggagggaggagagcaggtttcagatccttacttgccgagccgtttgtttaggtagagaagacaagtccaaagagtgtgtgggctttcctgtttctaaactttcgctactataaaaccaaaaaaaggaattgagatttcaccaaccccagtgcccagaagagggaaggggagtggctggagggagcagggggtgggacagtgtatcaaataagcagtatttaatcacctctggcgggggcctcgtgcaaggggagactgacaccaagaacagccagtaggttcttctcccctgcactctgctccctgcgcggtaaccccaccactcctgaagcctgcccagtctccttccttccctgcttggtgagtcgcgcatctccgtggttatcccgctgtctcctctccaagaacaagcagagcccgggccactggcccttgcccaaggcagggaagaaggatgtgtgtgtccaggaaggaaaaaaaggtggatcagtgattttacttgaaaacaagctccatcccttttctatatttataagaagagaagatcttgagtgaagcagcacgcgacccaggtgtgtgtgaattgaatggagacgtttcttttctctttctttaatttttgtttttgttctttttttctttaaggaaagttttattttactgttcattttactttcttggtaacaaaaactaaaataaggaatagaaaagctgtttttcaggctgacagtccaattaagggtagccaagaccttgcatggtagagtaggaatcatagtgtcagtgaggtcccgtgagtctttgtgagtccttgtgtcatcgttcgggcactgtttttttatgcaagggcaaaaatctttgtatctggggaaaaaaaacttttttttaaattaaaaaggaaaataaaagatattgaggtcttcctagtgttacttaaattaagatcaaggtaagaaacattgtaaaaaaaaattacaaaagtgctatttgtttcctaaaaacagtgatttctattaaaaaggtgtcagaactggaaaaaaaaaaaa

SEQ ID NO: 427890 - DNA, 2178 bp, Homo sapiens
gggtgtcatgtggcgtcacgagaaaagataggaatgctcagccaagtcccagctccttctaagcctgggctcaagtgtcctggctcttcctgccttgaacttgattctcctaagctgatatttggaactttttagtccagaaactatagaccagggttttgcaacactgctaccataaatccttcctggattttatctgccagtagccacagataccactgctagctgttacatagaggatgtgtgtttaaacctccttctcaaggtaaaattctaaaaatcttttcagatgctgaagaaggaagaagcaattccatggcctggaactttagcaattgttcattcctatattgcctacaaagcagcaaaagaagaagagaaacagaagttacttaaatggagttcagatttaaaacaagaacgagaacaactagagcaaaaggtgaaacagctcagcaattccataagttgtgaggaagcgggctttctagagacaagtattggaaaaatgcatggaaatgaagaacaccatcctggcccggcagaaggagatgcacagctccctggagaaggtaaaacagctgattcgcctcatccacggcatcgacctctccaaacctgtagactctgaggccactgtgggggccatctccaatggcccggactgcaccccccctgccaatgccgccacctccacgccggccccttccccctcctcccagagctgcacagcgaactgtaaccagggggaagagactaaataacagagcccctctaggagaagccacgggatcccggcggcaaggagaacagaacactgaagactctagaaaagcaaagccggatttctggaaagtgcagaattcttttggttctttggttccagagagagagaagatgcttgtgccaggtggcaccagagtttgccaattgatccttcttattctgtgtgtacatgcaaagattggaccatgttacatgaaatagtgccagctggaggttctttgccagcaccatgccaagtgaaataatatatttactctctctattatacaccagtgtgtgcctgcagcagcctccacagccacgatgggtttgtttctgttttcttgggtggggagcagggacgggcggagggaggagagcaggtttcagatccttacttgccgagccgtttgtttaggtagagaagacaagtccaaagagtgtgtgggctttcctgtttctaaactttcgctactataaaaccaaaaaaaggaattgagatttcaccaaccccagtgcccagaagagggaaggggagtggctggagggagcagggggtgggacagtgtatcaaataagcagtatttaatcacctctggcgggggcctcgtgcaaggggagactgacaccaagaacagccagtaggttcttctcccctgcactctgctccctgcgcggtaaccccaccactcctgaagcctgcccagtctccttccttccctgcttggtgagtcgcgcatctccgtggttatcccgctgtctcctctccaagaacaagcagagcccgggccactggcccttgcccaaggcagggaagaaggatgtgtgtgtccaggaaggaaaaaaaggtggatcagtgattttacttgaaaacaagctccatcccttttctatatttataagaagagaagatcttgagtgaagcagcacgcgacccaggtgtgtgtgaattgaatggagacgtttcttttctctttctttaatttttgtttttgttctttttttctttaaggaaagttttattttactgttcattttactttcttggtaacaaaaactaaaataaggaatagaaaagctgtttttcaggctgacagtccaattaagggtagccaagaccttgcatggtagagtaggaatcatagtgtcagtgaggtcccgtgagtctttgtgagtccttgtgtcatcgttcgggcactgtttttttatgcaagggcaaaaatctttgtatctggggaaaaaaaacttttttttaaattaaaaaggaaaataaaagatattgaggtcttcctagtgttacttaaattaagatcaaggtaagaaacattgtaaaaaaaaattacaaaagtgctatttgtttcctaaaaacagtgatttctattaaaaaggtgtcagaactggaaaaaaaaaaaa

SEQ ID NO: 427891 - DNA, 1807 bp, Homo sapiens
gtgagagagagaggagaggagaggaggaggaggaggagggagaagggaacaacctaccatcttaacacactaatatctaaaaagtgcgagaggcccagagcagcagcagaagcagcagcagcagctccagcttcttccctccctccccatgaagaagagttccctcctcctcctcctcctgcttctcctgctcagagttcctgcctccagctgccaggggggacagccagccagcagcaggaggggggctagagagctgaaggagagccagtttccccaaaattgctgcagtgagaagaggagtttgttactttaaacagaggctgaagaaactatagaattagcagagaaagtggagaaggtagaggatggagttgcagactctacaggaggctcttaaagtggaaattcaggttcaccagaaactggttgctcaaatgaagcaggatccacagaatgctgacttaaagaaacagcttcatgaactccaagccaaaatcacagctttgagtgagaaacagaaaagagtagttgaacagctacggaagaacctgatagtaaagcaagaacaaccggacaagttccaaatacagccattgccacaatctgaaaacaaactacaaacagcacagcagcaaccactacagcaactacaacaacagcagcagtaccaccaccaccacgcccagcagtcagctgcagcctctcccaacctgactgcttcacagaagactgtaactacagcttctatgattaccacaaagacactacctctcgtcttgaaagcagcaactgcgaccatgcctgcctctgtggtgggccagagacctaccattgctatggtgaccgccatcaacagtcagaaggctgtgctcagcactgatgtgcagaacacaccagtcaacctccagacgtctagtaaggtcactgggcctggggcagaggctgtccaaattgtggcaaaaaacacagtcactctgcaggttcaggcaacacctcctcagcccatcaaagtaccacagtttatcccccctcctagactcactccacgtccaaactttcttccacaggttcgacccaagcctgtggcccagaataacattcctattgccccagcaccacctcccatgctcgcagctcctcagcttatccagaggcccgtcatgctgaccaagttcacccccacaacccttcccacatcccagaattccatccaccccgtccgtgtcgtcaatgggcagactgcaaccatagccaaaacgttccccatggcccagctcaccagcattgtgatagctactccagggaccagactcgctggacctcaaactgtacagcttagcaagccaagtcttgaaaaacagacagttaaatctcacacagaaacagatgagaaacaaacagagagccgcaccatcaccccacctgctgcacccaaaccaaaacgggaggagaaccctcagaaacttgccttcatggtgtctctagggttggtaacacatgaccatctagaagaaatccaaagcaagaggcaagagcgaaaaagaagaacaacagcaaatccggtctacagtggagcagtctttgagccagagcgtaagaagagtgcagtgacatacctaaacagcacaatgcaccctgggacccggaagagagccaatgaggaacactggccaaagggtgatattcatgaggatttttgcagcgtttgcagaaaaagtggccagttactgatgtgcgacacatgttcccgtgtatatcatttggactgcttagaccccctctaccccctctagagcaaaaaaaa

SEQ ID NO: 427892 - DNA, 1275 bp, Homo sapiens
caattagcggcccaacgccccttccgcgcctcatccgggttcccgggacgggaaagtggcgtggtaaccaggcaactactgatcaatcccctccccggctgatttgcgcatcaggaggaggactgagcttatctgactccagagctttcaggagggaagaaagatgtcagatgaagatgatctagaagactctgagccagaccaggatgattctgagaaagaagaggacgagaaggagacagaggagggggaggactacagaaaagagggggaagagttccctgaggaatggctgcccacccccctcacggaggacatgatgaaggaagggctttctctgctctgtaagacaggcaatgggctggctcatgcttatgtcaagctggaggttaaagagagggacctgacagacatctacttgctgcgctcctacatccatctgcgctatgtggatatttctgagaaccacctgacagacctgtctccactcaactacctcacccacctgctctggctcaaggctgatggcaatcggctgcgaagtgcccagatgaatgaactgccctacctgcagattgctagttttgcttataaccagattactgacactgaaggcatctctcatcctcgtcttgaaaccctgaatctcaaagggaacagcatccacatggtgacaggtctggaccccgagaagttgatcagcctgcacacagtggagcttcgggggaaccagctggaaagcaccctgggaatcaatcttcctaagctgaagaacctctacctggcccaaaacatgctgaagaaggtggaaggcttggaggatctgagcaatctcaccaccttgcatcttcgagacaaccagattgacaccctgagtggcttctccagagaaatgaaatcattgcagtacctcaacctgaggagatcaaagacgctggccttcagacctgatcagactcccaggggcagccaccacatgtatgacagagaacagaggatgcctgtttttgccccaaagctggaaattcatcacaacctgaggcccaggatctgctctgtgccggtcctctgggcagtgtggggtgcagaatggggtgcctaggcctgagcgttgcctggagcctaggccgggggccgccctcgggcaggcgtgggtgagagccaagaccgcgtgggccgcggggtgctggtaggagtggttggagagacttgcgaaggcggctggggtgttcggatttccaataaagaaacagagtgatgctcctgtgtctgacc

SEQ ID NO: 427893 - DNA, 1165 bp, Homo sapiens
caattagcggcccaacgccccttccgcgcctcatccgggttcccgggacgggaaagtggcgtggtaaccaggcaactactgatcaatcccctccccggctgatttgcgcatcaggaggaggactgagcttatctgactccagagctttcaggagggaagaaagatgtcagatgaagatgatctagaagactctgagccagaccaggatgattctgagaaagaagaggacgagaaggagacagaggagggggaggactacagaaaagagggggaagagttccctgaggaaggacctgacagacatctacttgctgcgctcctacatccatctgcgctatgtggatatttctgagaaccacctgacagacctgtctccactcaactacctcacccacctgctctggctcaaggctgatggcaatcggctgcgaagtgcccagatgaatgaactgccctacctgcagattgctagttttgcttataaccagattactgacactgaaggcatctctcatcctcgtcttgaaaccctgaatctcaaagggaacagcatccacatggtgacaggtctggaccccgagaagttgatcagcctgcacacagtggagcttcgggggaaccagctggaaagcaccctgggaatcaatcttcctaagctgaagaacctctacctggcccaaaacatgctgaagaaggtggaaggcttggaggatctgagcaatctcaccaccttgcatcttcgagacaaccagattgacaccctgagtggcttctccagagaaatgaaatcattgcagtacctcaacctgaggagatcaaagacgctggccttcagacctgatcagactcccaggggcagccaccacatgtatgacagagaacagaggatgcctgtttttgccccaaagctggaaattcatcacaacctgaggcccaggatctgctctgtgccggtcctctgggcagtgtggggtgcagaatggggtgcctaggcctgagcgttgcctggagcctaggccgggggccgccctcgggcaggcgtgggtgagagccaagaccgcgtgggccgcggggtgctggtaggagtggttggagagacttgcgaaggcggctggggtgttcggatttccaataaagaaacagagtgatgctcctgtgtctgacc

SEQ ID NO: 427894 - DNA, 1060 bp, Homo sapiens
caattagcggcccaacgccccttccgcgcctcatccgggttcccgggacgggaaagtggcgtggtaaccaggcaactactgatcaatcccctccccggctgatttgcgcatcaggaggaggactgagcttatctgactccagagctttcaggagggaagaaagatgtcagatgaagatgatctagaagactctgagccagaccaggatgattctgagaaagaagaggacgagaaggagacagaggagggggaggactacagaaaagagggggaagagttccctgaggaaggacctgacagacatctacttgctgcgctcctacatccatctgcgctatgtggatatttctgagaaccacctgacagacctgtctccactcaactacctcacccacctgctctggctcaaggctgatggcaatcggctgcgaagtgcccagatgaatgaactgccctacctgcagattgctagttttgcttataaccagattactgacactgaaggcatctctcatcctcgtcttgaaaccctgaatctcaaagggaacagcatccacatggtgacaggtctggaccccgagaagttgatcagcctgcacacagtggagcttcgggggaaccagctggaaagcaccctgggaatcaatcttcctaagctgaagaacctctacctggtagctcactgggtcagagggtggtgcagggaagagggcactgtcctgggggtcaggatgcctgctttctagtaggctcagctactaacttcatcattatgataataactggtattattatcaagaccatagttggttccagatgctgtggagatacacagccacctagcagggctgataatatataatgtgtggataatacagagataatttaccttgatacaggtagtagcaaaatggaccataattgaggtacaaacatcagtctgtggaaatgttttaggaaaaccctcctctcagactgggtttttcttcagctcttacactaccaccacaacaatcatcaacatacgacttccgggaccaaaggtgtgggggtttctccc

SEQ ID NO: 427895 - DNA, 804 bp, Homo sapiens
tcgtctagaggattccctctggatgcaagtgtcagatgaatgactgccctacctgcagattgctagttttgcttataaccagattactgacactgaaggcatctctcatcctcgtcttgaaaccctgagaaccacctgacagacctgtctccactcaactacctcacccacctgctctggctcaaggctgatggcaatcggctgcgaagtgcccagatgaatgaactgccctacctgcagattgctagttttgcttataaccagattactgacactgaaggcatctctcatcctcgtcttgaaaccctgaatctcaaagggaacagcatccacatggtgacaggtctggaccccgagaagttgatcagcctgcacacagtggagcttcgggggaaccagctggaaagcaccctgggaatcaatcttcctaagctgaagaacctctacctggagatcaaagacgctggccttcagacctgatcagactcccaggggcagccaccacatgtatgacagagaacagaggatgcctgtttttgccccaaagctggaaattcatcacaacctgaggcccaggatctgctctgtgccggtcctctgggcagtgtggggtgcagaatggggtgcctaggcctgagcgttgcctggagcctaggccgggggccgccctcgggcaggcgtgggtgagagccaagaccgcgtgggccgcggggtgctggtaggagtggttggagagacttgcgaaggcggctggggtgttcggatttccaataaagaaacagagtgatgctcctgtgtctgacc

SEQ ID NO: 427896 - DNA, 524 bp, Homo sapiens
tccactgtgccctgggggtctaggcccaaaacatgctgaagaaggtggaaggcttggaggatctgagcaatctcaccaccttgcatcttcgagacaaccagattgacaccctgagtggcttctccagagaaatgaaatcattgcagtacctcaacctgaggtatgcaccctctccaagccccaccttgcccctacccctgaccaggtgcagcttttgagtctgtgttcttccctggcccaatcccccagtcctagcccacagctggattctcaaggaaagcccggctttccttcctttcttctgcactgagttgcaacactaaatcccttatagcttgtgacccctgaatttttattcattcaatccacaattattgagaatgtgctatgtgccaggccttgtgctgtgttttggggacatttaaagcaatcagaggctgggcatggtggttcatgcctgtactcccagcactttaggaggaaggatcacttgaggccaggagttcaggaccagcctgggcaac

SEQ ID NO: 427897 - DNA, 1463 bp, Homo sapiens
caattagcggcccaacgccccttccgcgcctcatccgggttcccgggacgggaaagtggcgtggtaaccaggcaactactgatcaatcccctccccggctgatttgcgcatcaggaggaggactgagcttatctgactccagagctttcaggagggaagaaagatgtcagatgaagatgatctagaagactctgagccagaccaggatgattctgagaaagaagaggacgagaaggagacagaggagggggaggactacagaaaagagggggaagagttccctgaggaaggacctgacagacatctacttgctgcgctcctacatccatctgcgctatgtggatatttctgagaaccacctgacagacctgtctccactcaactacctcacccacctgctctggctcaaggctgatggcaatcggctgcgaagtgcccagatgaatgaactgccctacctgcagattgctagttttgcttataaccagattactgacactgaaggcatctctcatcctcgtcttgaaaccctgaatctcaaagggaacagcatccacatggtgacaggtctggaccccgagaagttgatcagcctgcacacagtggagcttcgggggaaccagctggaaagcaccctgggaatcaatcttcctaagctgaagaacctctacctggcccaaaacatgctgaagaaggtggaaggcttggaggatctgagcaatctcaccaccttgcatcttcgagacaaccagattgacaccctgagtggcttctccagagaaatgaaatcattgcagtacctcaacctgaggggcaacatggtggccaacctgggggagctggccaagcttcgagacctgcccaagctgcgagcgttggtgctgcttgataacccatgcacggacgaaaccagctaccgccaggaggccctggtgcagatgccataccttgaacgcctggacaaggaattctatgaggaggaggaacgggctgaggctgatgtgattcgacagaggctgaaggaagaaaaggagcaggagcctgagccccagcgtgacctggaacccgaacagtcattgatctagcagcagttctagcctctaaagatagagatcaaagacgctggccttcagacctgatcagactcccaggggcagccaccacatgtatgacagagaacagaggatgcctgtttttgccccaaagctggaaattcatcacaacctgaggcccaggatctgctctgtgccggtcctctgggcagtgtggggtgcagaatggggtgcctaggcctgagcgttgcctggagcctaggccgggggccgccctcgggcaggcgtgggtgagagccaagaccgcgtgggccgcggggtgctggtaggagtggttggagagacttgcgaaggcggctggggtgttcggatttccaataaagaaacagagtgatgctcctgtgtctgacc

SEQ ID NO: 427898 - DNA, 1573 bp, Homo sapiens
caattagcggcccaacgccccttccgcgcctcatccgggttcccgggacgggaaagtggcgtggtaaccaggcaactactgatcaatcccctccccggctgatttgcgcatcaggaggaggactgagcttatctgactccagagctttcaggagggaagaaagatgtcagatgaagatgatctagaagactctgagccagaccaggatgattctgagaaagaagaggacgagaaggagacagaggagggggaggactacagaaaagagggggaagagttccctgaggaatggctgcccacccccctcacggaggacatgatgaaggaagggctttctctgctctgtaagacaggcaatgggctggctcatgcttatgtcaagctggaggttaaagagagggacctgacagacatctacttgctgcgctcctacatccatctgcgctatgtggatatttctgagaaccacctgacagacctgtctccactcaactacctcacccacctgctctggctcaaggctgatggcaatcggctgcgaagtgcccagatgaatgaactgccctacctgcagattgctagttttgcttataaccagattactgacactgaaggcatctctcatcctcgtcttgaaaccctgaatctcaaagggaacagcatccacatggtgacaggtctggaccccgagaagttgatcagcctgcacacagtggagcttcgggggaaccagctggaaagcaccctgggaatcaatcttcctaagctgaagaacctctacctggcccaaaacatgctgaagaaggtggaaggcttggaggatctgagcaatctcaccaccttgcatcttcgagacaaccagattgacaccctgagtggcttctccagagaaatgaaatcattgcagtacctcaacctgaggggcaacatggtggccaacctgggggagctggccaagcttcgagacctgcccaagctgcgagcgttggtgctgcttgataacccatgcacggacgaaaccagctaccgccaggaggccctggtgcagatgccataccttgaacgcctggacaaggaattctatgaggaggaggaacgggctgaggctgatgtgattcgacagaggctgaaggaagaaaaggagcaggagcctgagccccagcgtgacctggaacccgaacagtcattgatctagcagcagttctagcctctaaagatagagatcaaagacgctggccttcagacctgatcagactcccaggggcagccaccacatgtatgacagagaacagaggatgcctgtttttgccccaaagctggaaattcatcacaacctgaggcccaggatctgctctgtgccggtcctctgggcagtgtggggtgcagaatggggtgcctaggcctgagcgttgcctggagcctaggccgggggccgccctcgggcaggcgtgggtgagagccaagaccgcgtgggccgcggggtgctggtaggagtggttggagagacttgcgaaggcggctggggtgttcggatttccaataaagaaacagagtgatgctcctgtgtctgacc

SEQ ID NO: 427899 - DNA, 1288 bp, Homo sapiens
caattagcggcccaacgccccttccgcgcctcatccgggttcccgggacgggaaagtggcgtggtaaccaggcaactactgatcaatcccctccccggctgatttgcgcatcagggacctgacagacatctacttgctgcgctcctacatccatctgcgctatgtggatatttctgagaaccacctgacagacctgtctccactcaactacctcacccacctgctctggctcaaggctgatggcaatcggctgcgaagtgcccagatgaatgaactgccctacctgcagattgctagttttgcttataaccagattactgacactgaaggcatctctcatcctcgtcttgaaaccctgaatctcaaagggaacagcatccacatggtgacaggtctggaccccgagaagttgatcagcctgcacacagtggagcttcgggggaaccagctggaaagcaccctgggaatcaatcttcctaagctgaagaacctctacctggcccaaaacatgctgaagaaggtggaaggcttggaggatctgagcaatctcaccaccttgcatcttcgagacaaccagattgacaccctgagtggcttctccagagaaatgaaatcattgcagtacctcaacctgaggggcaacatggtggccaacctgggggagctggccaagcttcgagacctgcccaagctgcgagcgttggtgctgcttgataacccatgcacggacgaaaccagctaccgccaggaggccctggtgcagatgccataccttgaacgcctggacaaggaattctatgaggaggaggaacgggctgaggctgatgtgattcgacagaggctgaaggaagaaaaggagcaggagcctgagccccagcgtgacctggaacccgaacagtcattgatctagcagcagttctagcctctaaagatagagatcaaagacgctggccttcagacctgatcagactcccaggggcagccaccacatgtatgacagagaacagaggatgcctgtttttgccccaaagctggaaattcatcacaacctgaggcccaggatctgctctgtgccggtcctctgggcagtgtggggtgcagaatggggtgcctaggcctgagcgttgcctggagcctaggccgggggccgccctcgggcaggcgtgggtgagagccaagaccgcgtgggccgcggggtgctggtaggagtggttggagagacttgcgaaggcggctggggtgttcggatttccaataaagaaacagagtgatgctcctgtgtctgacc

SEQ ID NO: 427900 - DNA, 1810 bp, Homo sapiens
caattagcggcccaacgccccttccgcgcctcatccgggttcccgggacgggaaagtggcgtggtaaccaggcaactactgatcaatcccctccccggctgatttgcgcatcaggtagtcgccgctctactctcaacggtggcgagctgcagttgccaagtgccccgtccccgttgccataacagcagtacacaacccctccttcccctcgcccgcttgctaaacagtccttccctctcgggaccaagggcctctccagaactgcttctgattgagcagaaacagggtctgagcccctttgctaaggcgaattgagtgggagggttggagactgcgctttaggctggtgtaccagagggcccaaggaaattggcccagtggggagggaaaagtagaagaaatgaatggagcagggattacggatggcgcaatgggagctgagaggagaggaggaggaattggaggaggactgagcttatctgactccagagctttcaggagggaagaaagatgtcagatgaagatgatctagaagactctgagccagaccaggatgattctgagaaagaagaggacgagaaggagacagaggagggggaggactacagaaaagagggggaagagttccctgaggaaggacctgacagacatctacttgctgcgctcctacatccatctgcgctatgtggatatttctgagaaccacctgacagacctgtctccactcaactacctcacccacctgctctggctcaaggctgatggcaatcggctgcgaagtgcccagatgaatgaactgccctacctgcagattgctagttttgcttataaccagattactgacactgaaggcatctctcatcctcgtcttgaaaccctgaatctcaaagggaacagcatccacatggtgacaggtctggaccccgagaagttgatcagcctgcacacagtggagcttcgggggaaccagctggaaagcaccctgggaatcaatcttcctaagctgaagaacctctacctggcccaaaacatgctgaagaaggtggaaggcttggaggatctgagcaatctcaccaccttgcatcttcgagacaaccagattgacaccctgagtggcttctccagagaaatgaaatcattgcagtacctcaacctgaggggcaacatggtggccaacctgggggagctggccaagcttcgagacctgcccaagctgcgagcgttggtgctgcttgataacccatgcacggacgaaaccagctaccgccaggaggccctggtgcagatgccataccttgaacgcctggacaaggaattctatgaggaggaggaacgggctgaggctgatgtgattcgacagaggctgaaggaagaaaaggagcaggagcctgagccccagcgtgacctggaacccgaacagtcattgatctagcagcagttctagcctctaaagatagagatcaaagacgctggccttcagacctgatcagactcccaggggcagccaccacatgtatgacagagaacagaggatgcctgtttttgccccaaagctggaaattcatcacaacctgaggcccaggatctgctctgtgccggtcctctgggcagtgtggggtgcagaatggggtgcctaggcctgagcgttgcctggagcctaggccgggggccgccctcgggcaggcgtgggtgagagccaagaccgcgtgggccgcggggtgctggtaggagtggttggagagacttgcgaaggcggctggggtgttcggatttccaataaagaaacagagtgatgctcctgtgtctgacc

SEQ ID NO: 427901 - DNA, 1239 bp, Homo sapiens
tcgtctagaggattccctctggatgcaagtgtcagatgaatgactgccctacctgcagattgctagttttgcttataaccagattactgacactgaaggcatctctcatcctcgtcttgaaaccctgagaaccacctgacagacctgtctccactcaactacctcacccacctgctctggctcaaggctgatggcaatcggctgcgaagtgcccagatgaatgaactgccctacctgcagattgctagttttgcttataaccagattactgacactgaaggcatctctcatcctcgtcttgaaaccctgaatctcaaagggaacagcatccacatggtgacaggtctggaccccgagaagttgatcagcctgcacacagtggagcttcgggggaaccagctggaaagcaccctgggaatcaatcttcctaagctgaagaacctctacctggcccaaaacatgctgaagaaggtggaaggcttggaggatctgagcaatctcaccaccttgcatcttcgagacaaccagattgacaccctgagtggcttctccagagaaatgaaatcattgcagtacctcaacctgaggggcaacatggtggccaacctgggggagctggccaagcttcgagacctgcccaagctgcgagcgttggtgctgcttgataacccatgcacggacgaaaccagctaccgccaggaggccctggtgcagatgccataccttgaacgcctggacaaggaattctatgaggaggaggaacgggctgaggctgatgtgattcgacagaggctgaaggaagaaaaggagcaggagcctgagccccagcgtgacctggaacccgaacagtcattgatctagcagcagttctagcctctaaagatagagatcaaagacgctggccttcagacctgatcagactcccaggggcagccaccacatgtatgacagagaacagaggatgcctgtttttgccccaaagctggaaattcatcacaacctgaggcccaggatctgctctgtgccggtcctctgggcagtgtggggtgcagaatggggtgcctaggcctgagcgttgcctggagcctaggccgggggccgccctcgggcaggcgtgggtgagagccaagaccgcgtgggccgcggggtgctggtaggagtggttggagagacttgcgaaggcggctggggtgttcggatttccaataaagaaacagagtgatgctcctgtgtctgacc

SEQ ID NO: 427902 - DNA, 1175 bp, Homo sapiens
caattagcggcccaacgccccttccgcgcctcatccgggttcccgggacgggaaagtggcgtggtaaccaggcaactactgatcaatcccctccccggctgatttgcgcatcaggaggaggactgagcttatctgactccagagctttcaggagggaagaaagatgtcagatgaagatgatctagaagactctgagccagaccaggatgattctgagaaagaagaggacgagaaggagacagaggagggggaggactacagaaaagagggggaagagttccctgaggaaggacctgacagacatctacttgctgcgctcctacatccatctgcgctatgtggatatttctgagaaccacctgacagacctgtctccactcaactacctcacccacctgctctggctcaaggctgatggcaatcggctgcgaagtgcccagatgaatgaactgccctacctgcagattgctagttttgcttataaccagattactgacactgaaggcatctctcatcctcgtcttgaaaccctgaatctcaaagggaacagcatccacatggtgacaggtctggaccccgagaagttgatcagcctgcacacagtggagcttcgggggaaccagctggaaagcaccctgggaatcaatcttcctaagctgaagaacctctacctggcccaaaacatgctgaagaaggtggaaggcttggaggatctgagcaatctcaccaccttgcatcttcgagacaaccagattgacaccctgagtggcttctccagagaaatgaaatcattgcagtacctcaacctgaggtatgcaccctctccaagccccaccttgcccctacccctgaccaggtgcagcttttgagtctgtgttcttccctggcccaatcccccagtcctagcccacagctggattctcaaggaaagcccggctttccttcctttcttctgcactgagttgcaacactaaatcccttatagcttgtgacccctgaatttttattcattcaatccacaattattgagaatgtgctatgtgccaggccttgtgctgtgttttggggacatttaaagcaatcagaggctgggcatggtggttcatgcctgtactcccagcactttaggaggaaggatcacttgaggccaggagttcaggaccagcctgggcaac

SEQ ID NO: 427903 - DNA, 815 bp, Homo sapiens
caattagcggcccaacgccccttccgcgcctcatccgggttcccgggacgggaaagtggcgtggtaaccaggcaactactgatcaatcccctccccggctgatttgcgcatcaggaggaggactgagcttatctgactccagagctttcaggagggaagaaagatgtcagatgaagatgatctagaagactctgagccagaccaggatgattctgagaaagaagaggacgagaaggagacagaggagggggaggactacagaaaagagggggaagagttccctgaggaaggacctgacagacatctacttgctgcgctcctacatccatctgcgctatgtggatatttctgagaaccacctgacagacctgtctccactcaactacctcacccacctgctctggctcaaggctgatggcaatcggctgcgaagtgcccagatgaatgaactgccctacctgcagattgctagttttgcttataaccagattactgacactgaaggcatctctcatcctcgtcttgaaaccctgaatctcaaaggtgggtctttaggatgggctacacaagattctttccttcctagcctgaggccaacagaagtgggcagtatggtccttggctagggcacatggcagtctgcattcattcattcattcagatacgcaatatgattcattatgacagttctacatgctaaccatataggatccaataagacaaggaacgtccctattctcatatagcttatattctaattgggagagacaaacaagtaacaacaaacacagtaagtacattcatgtagcatgtta

SEQ ID NO: 427904 - DNA, 1745 bp, Homo sapiens
caattagcggcccaacgccccttccgcgcctcatccgggttcccgggacgggaaagtggcgtggtaaccaggcaactactgatcaatcccctccccggctgatttgcgcatcaggtagtcgccgctctactctcaacggtggcgagctgcagttgccaagtgccccgtccccgttgccataacagcagtacacaacccctccttcccctcgcccgcttgctaaacagtccttccctctcgggaccaagggcctctccagaactgcttctgattgagcagaaacagggaggaggactgagcttatctgactccagagctttcaggagggaagaaagatgtcagatgaagatgatctagaagactctgagccagaccaggatgattctgagaaagaagaggacgagaaggagacagaggagggggaggactacagaaaagagggggaagagttccctgaggaatggctgcccacccccctcacggaggacatgatgaaggaagggctttctctgctctgtaagacaggcaatgggctggctcatgcttatgtcaagctggaggttaaagagagggacctgacagacatctacttgctgcgctcctacatccatctgcgctatgtggatatttctgagaaccacctgacagacctgtctccactcaactacctcacccacctgctctggctcaaggctgatggcaatcggctgcgaagtgcccagatgaatgaactgccctacctgcagattgctagttttgcttataaccagattactgacactgaaggcatctctcatcctcgtcttgaaaccctgaatctcaaagggaacagcatccacatggtgacaggtctggaccccgagaagttgatcagcctgcacacagtggagcttcgggggaaccagctggaaagcaccctgggaatcaatcttcctaagctgaagaacctctacctggcccaaaacatgctgaagaaggtggaaggcttggaggatctgagcaatctcaccaccttgcatcttcgagacaaccagattgacaccctgagtggcttctccagagaaatgaaatcattgcagtacctcaacctgaggggcaacatggtggccaacctgggggagctggccaagcttcgagacctgcccaagctgcgagcgttggtgctgcttgataacccatgcacggacgaaaccagctaccgccaggaggccctggtgcagatgccataccttgaacgcctggacaaggaattctatgaggaggaggaacgggctgaggctgatgtgattcgacagaggctgaaggaagaaaaggagcaggagcctgagccccagcgtgacctggaacccgaacagtcattgatctagcagcagttctagcctctaaagatagagatcaaagacgctggccttcagacctgatcagactcccaggggcagccaccacatgtatgacagagaacagaggatgcctgtttttgccccaaagctggaaattcatcacaacctgaggcccaggatctgctctgtgccggtcctctgggcagtgtggggtgcagaatggggtgcctaggcctgagcgttgcctggagcctaggccgggggccgccctcgggcaggcgtgggtgagagccaagaccgcgtgggccgcggggtgctggtaggagtggttggagagacttgcgaaggcggctggggtgttcggatttccaataaagaaacagagtgatgctcctgtgtctgacc

SEQ ID NO: 427905 - DNA, 1028 bp, Homo sapiens
caattagcggcccaacgccccttccgcgcctcatccgggttcccgggacgggaaagtggcgtggtaaccaggcaactactgatcaatcccctccccggctgatttgcgcatcaggaggaggactgagcttatctgactccagagctttcaggagggaagaaagatgtcagatgaagatgatctagaagactctgagccagaccaggatgattctgagaaagaagaggacgagaaggagacagaggagggggaggactacagaaaagagggggaagagttccctgaggaaggacctgacagacatctacttgctgcgctcctacatccatctgcgctatgtggatatttctgagaaccacctgacagacctgtctccactcaactacctcacccacctgctctggctcaaggctgatggcaatcggctgcgaagtgcccagatgaatgaactgccctacctgcagattgctagttttgcttataaccagattactgacactgaaggcatctctcatcctcgtcttgaaaccctgaatctcaaagggaacagcatccacatggtgacaggtctggaccccgagaagttgatcagcctgcacacagtggagcttcgggggaaccagctggaaagcaccctgggaatcaatcttcctaagctgaagaacctctacctggagatcaaagacgctggccttcagacctgatcagactcccaggggcagccaccacatgtatgacagagaacagaggatgcctgtttttgccccaaagctggaaattcatcacaacctgaggcccaggatctgctctgtgccggtcctctgggcagtgtggggtgcagaatggggtgcctaggcctgagcgttgcctggagcctaggccgggggccgccctcgggcaggcgtgggtgagagccaagaccgcgtgggccgcggggtgctggtaggagtggttggagagacttgcgaaggcggctggggtgttcggatttccaataaagaaacagagtgatgctcctgtgtctgacc

SEQ ID NO: 427906 - DNA, 1310 bp, Homo sapiens
caattagcggcccaacgccccttccgcgcctcatccgggttcccgggacgggaaagtggcgtggtaaccaggcaactactgatcaatcccctccccggctgatttgcgcatcaggtagtcgccgctctactctcaacggtggcgagctgcagttgccaagtgccccgtccccgttgccataacagcagtacacaacccctccttcccctcgcccgcttgctaaacagtccttccctctcgggaccaagggcctctccagaactgcttctgattgagcagaaacagggaggaggactgagcttatctgactccagagctttcaggagggaagaaagatgtcagatgaagatgatctagaagactctgagccagaccaggatgattctgagaaagaagaggacgagaaggagacagaggagggggaggactacagaaaagagggggaagagttccctgaggaatggctgcccacccccctcacggaggacatgatgaaggaagggctttctctgctctgtaagacaggcaatgggctggctcatgcttatgtcaagctggaggttaaagagagggacctgacagacatctacttgctgcgctcctacatccatctgcgctatgtggatatttctgagaaccacctgacagacctgtctccactcaactacctcacccacctgctctggctcaaggctgatggcaatcggctgcgaagtgcccagatgaatgaactgccctacctgcagattgctagttttgcttataaccagattactgacactgaaggcatctctcatcctcgtcttgaaaccctgaatctcaaagggaacagcatccacatggtgacaggtctggaccccgagaagttgatcagcctgcacacagtggagcttcgggggaaccagctggaaagcaccctgggaatcaatcttcctaagctgaagaacctctacctggagatcaaagacgctggccttcagacctgatcagactcccaggggcagccaccacatgtatgacagagaacagaggatgcctgtttttgccccaaagctggaaattcatcacaacctgaggcccaggatctgctctgtgccggtcctctgggcagtgtggggtgcagaatggggtgcctaggcctgagcgttgcctggagcctaggccgggggccgccctcgggcaggcgtgggtgagagccaagaccgcgtgggccgcggggtgctggtaggagtggttggagagacttgcgaaggcggctggggtgttcggatttccaataaagaaacagagtgatgctcctgtgtctgacc

SEQ ID NO: 427907 - DNA, 2753 bp, Homo sapiens
  misc_feature (233)..(233): n is a, c, g, or t
  misc_feature (267)..(267): n is a, c, g, or t
  misc_feature (332)..(332): n is a, c, g, or t
gaaaaaagtcgtggggactgagttcaggacaccctgaaactatgcgaccagtaatttttttaaggtactttttcctacaagtaaggtatctgaaaagtcaacgttttgagggtggaatcaagacttttcacttctcctggcaaagagcaacaaggctcttgtctcgtgtccttctgtgtgtctctgtcaggatcacagcagctgtgctcttggtctgcttactcctctgtaanccacgtatgcagaagggagttaataaggtgatcnccatctccccagaattcaaaggtctttgcctctataaggtctgcccctatggggccaggaaaatntaaacctatataaggacttgcaagagagcataaagaaggtagaaaaggtttacttgttgggttttcaagccttcaagttgaatgagtcttagcttttgctgggcagttgttctggacaagtcatcagtttcatgtggagaactcagtgtaagcccaaggctaatgaatgagaggggtcccatggaaacacagctgaaatgaaatgggactttatccatcttctttgagaatggaagagcttttgtgaagcagtacatcattgctcaagataatggttgataagcattagattttatagatctaataaggaaaatattttattatctcaagttaacaaaacatttttttacctctcgagtgcctcataggaccaactattactctttggcttttatttttctttttgtattatttttatatattctttaaccttgctgagctagtattgactgaaatctttagaactttgcctctgggcaatgaagtaatgtttctctaccctaagatatctatttgtataatctctggctgtaatgatcactttggaagatttcctttgcatctctaattatttctttttaatggaataaggcataagggggaataaatatattgtaaccaatgttatgtaaacccatatccatacaggccaggaaagccaaatgaagtcatttccagaattctagtgtgaaaaacctatttttgaaaagtggggagatggctttgtgtagaactgggtgggttttctctgcagactaagtctagccatgagcttccagatcctttagttttatcagccttgtgcttaccccattttcataaatgctactttaacagccagtcttcataagtcatggttcctaggttttcctgtcacctcattgtattcatctgtggtaggatattaacgggctcattcaaccaaatgtaatgtgtgcctcagacctatttagcatggttggggggcatcagcaggacaaaccaacaggtactccgcaagtgtactggcacagcaagcccaccaattattagcagctcttcatcagcctgctgtctactcagacgcttgcctactgaagggacctgtccagagatcttctggaatcccaggttgggaatctctgcagaatgtcgtgacagttgtggcccaactagcttctgagtagaaacaaggaagctaccctgagatatagtcagctgcccacctgccatagtatttgctactgaatgccagccttttaacataccatttcagatttgtccttcaacaaaaatataaattgcaagtcataccatttaagggtcttttacaaatatgtctaaattgtgtgtcatttttaagttccaaaggtctactggactaagtactatcagaccagctgtagaacctgatggcgctgatccggggtggaataaccctcagtactggtgtgtagaagatgaattgtaggcaggttttgctgatcagcagcctaaggattgatgggctctcttttggcctctgatcctgagcactatggaggcagcatcagagaatggggacctgagctacataggttctcaatgttaaaacaactctgttcggagtgacatataagagcaagaaatctacagctggtgtaaaatacctttgccttttctatcccgaaagtaacaaatggcatctgtacatgtaggggtaaaaactcagatgtctactcctccaggccatggacaagaaaaagtacagcagtcagaacagtggaacaagtgatttgcattctcttcttcacgctttcctagatctgccattggtagcgcagccctcgccctccagacataatgcatcgagcccagttgcagggaacatcactgtgtgtgtgtgatgtcatggtgttatatgtgttgagtttaatgttgagctgaagcaagttggtgaccttcctctttgctctttgtaaagaagacaccaatgtttgtcagagaaaaatccccagcagtcgtgttgaagaggcagtgtcatccacctactgtcccctttggaacagttcaactgcagaaaggtcggattgaggttttgtgctttgtcgtttttcttttttaaacaaaacatgacaaccttggcttttccgatatggaacacttttgttgttgtggagttccctcttgctgtatcttctatgcaattccttttctaaaaaaaccccccggcagaggcagagtgccctccggatatctgtccggcgccttgctgagtggtggaggtgagggataccagctccgggtgtgcctcttttctctccctggctgccaatcctgattttccctgcagtccccttggtttgtaaattgcctgcatttattctgtcagccaacatgtacaaaatgtaagaaagaatttttaaacaggtaataaattatatttataagcaacaaaaaaat

SEQ ID NO: 427908 - DNA, 2145 bp, Homo sapiens
ctcaagcaatctgcctgccttggcttcccaaagtgctaggattacaggcgggagccaccatgcctggcctctttgttttttgagacagagtcccgctctgtcgcccaggccagagtgcagtggtgcgatctcggctcactgcaacctccacctctcaggttcaggcaattctcctgcctcagtctcccaagtagctgggattacaggcgcgcatcaccatacttggctaatttttgtgttttttagggtttcgccatgttggccagggtgggtctcaaactcctgacctcaggtgatctgcccacctcgacctcccaaagtgctgggattacaggcatgagccaccatgcccggccacaatgaatccaattctgtgtccccagtgtccagccaacagcccggttcctagtggatgttaagccaccttggttgggtggacggacagatagatgaatggacagatgggtgtgcaggaagttgagccaagggcacagaacagagatcaccatttctcatcccatcagacagtgacataacttccatggtttccggggtctctgtccccagccaagcctagaccagtgccagccgcgtctgtgatgtgagagacagccccttgccagcagctctgcctgagtgttggtgtccagcgactactttggagcaagcccagctggcatcgtaaatgcatgctcttcctacatcagccttgtacccagcagtgtatcacctacagctagggctaggccagcgtgtgccacgaatatgcaggggggaaagtgggcgtgtggatgggagaggaacagagatgagccggtaacagaggggcaaacctccagcctcattttcgggtttagcatctaatccttttgtcagggtttccctggaccccgaggagagaaaggtgatcggagcgagcgtggagagaagggagaacgaggggtccccggccggaaaggagtgaagggccagaagggcgagccgggaccaccaggcctggaccagccgtgtcccgtgggccccgacgggctgcctgtgcctggctgctggcataagtgacccacaggcccagctcacacctgtacagatccgtgtggacatttttaatttttgtaaaaacaaaacagtaatatattgatcttttttcatggaatgcgctacctgtggccttttaacattcaagagtatgcccacccagccccaaagccaccggcatgtgaagctgccggaaagtggacaggccagaccagggagatgtgtacctgaggggcacccttgggcctgggctttcccaggaaggagatgaaggtagaagcacctggctcgggcaaggctagaaagatgctacgttgggccttcagtcacctgatcagcagagagactctcagctgtggtactgccctgtaagaacctgctcccgcaaaactctggagtccctgggacacaccctatccaagaagacccaggggtggaacagcggctgctgttgctcctggcctcatcagcctccaaactcaaccacaaccagctgcctctgcagttggacaagacttggcccccggacaagactcgcccagcacttgcggctgggcccggggagcagtgagtggaaatcccccacgagggtctagctctaccacattcaggaggcctcaggaggccagcctgccatgagagcacatgtcctctggccaggagtagtggctgagctctgtgatcgctgtgatgtggacccagctccagggagcagagtgtcggggatggaggggcccagcctggactgactgctacttcctgtctctgtttccattatcacccagagagggacaagataggacatggcctggaccagggaggcaggcctcccactcagagtctgggtctcactggccccaagtctcccacccagaactctggccaaaaatggctctctaggtgggctgtgcaggcaaagcaaagctcagggctggttcccagctggcctgagcagggggcctgccaccagacccacccacgctctgacgagaggcttttccacctccagcaagtgttcccagcaaccagctccatcctggctgcttgccttccatttccgtgtagatggagatcactgtgtgtaataaaccacaagtgcgtgtcaaagtg

SEQ ID NO: 427909 - DNA, 1934 bp, Homo sapiens
ctcaagcaatctgcctgccttggcttcccaaagtgctaggattacaggcgggagccaccatgcctggcctctttgttttttgagacagagtcccgctctgtcgcccaggccagagtgcagtggtgcgatctcggctcactgcaacctccacctctcaggttcaggcaattctcctgcctcagtctcccaagtagctgggattacaggcgcgcatcaccatacttggctaatttttgtgttttttagggtttcgccatgttggccagggtgggtctcaaactcctgacctcaggtgatctgcccacctcgacctcccaaagtgctgggattacaggcatgagccaccatgcccggccacaatgaatccaattctgtgtccccagtgtccagccaacagcccggttcctagtggatgttaagccaccttggttgggtggacggacagatagatgaatggacagatgggtgtgcaggaagttgagccaagggcacagaacagagatcaccatttctcatcccatcagacagtgacataacttccatggtttccggggtctctgtccccagccaagcctagaccagtgccagccgcgtctgtgatgtgagagacagccccttgccagcagctctgcctgagtgttggtgtccagcgactactttggagcaagcccagctggcatcgtaaatgcatgctcttcctacatcagccttgtacccagcagtgtatcacctacagctagggctaggccagcgtgtgccacgaatatgcaggggggaaagtgggcgtgtggatgggagaggaacagagatgagccggtaacagaggggcaaacctccagcctcattttcgggtttagcatctaatccttttgtcagggtttccctggaccccgaggagagaaaggtgatcggagcgagcgtggagagaagggagaacgaggggtccccggccggaaaggagtgaagggccagaagggcgagccgggaccaccaggcctggaccagccgtgtcccgtgggccccgacgggctgcctgtgcctggctgctggcataagtgacccacaggcccagctcacacctgtacagatccgtgtggacatttttaatttttgtaaaaacaaaacagtaatatattgatcttttttcatggaatgcgctacctgtggccttttaacattcaagagtatgcccacccagccccaaagccaccggcatgtgaagctgccggaaagtggacaggccagaccagggagatgtgtacctgaggggcacccttgggcctgggctttcccaggaaggagatgaaggtagaagcacctggctcgggcaaggctagaaagatgctacgttgggccttcagtcacctgatcagcagagagactctcagctgtggtactgccctgtaagaacctgctcccgcaaaactctggagtccctgggacacaccctatccaagaagacccaggggtggaacagcggctgctgttgctcctggcctcatcagcctccaaactcaaccacaaccagctgcctctgcagttggacaagacttggcccccggacaagactcgcccagcacttgcggctgggcccggggagcagtgagtggaaatcccccacgagggtctagctctaccacattcaggaggcctcccactcagagtctgggtctcactggccccaagtctcccacccagaactctggccaaaaatggctctctaggtgggctgtgcaggcaaagcaaagctcagggctggttcccagctggcctgagcagggggcctgccaccagacccacccacgctctgacgagaggcttttccacctccagcaagtgttcccagcaaccagctccatcctggctgcttgccttccatttccgtgtagatggagatcactgtgtgtaataaaccacaagtgcgtgtcaaagtg

SEQ ID NO: 427910 - DNA, 1549 bp, Homo sapiens
  misc_feature (1503)..(1503): n is a, c, g, or t
ctcaagcaatctgcctgccttggcttcccaaagtgctaggattacaggcgggagccaccatgcctggcctctttgttttttgagacagagtcccgctctgtcgcccaggccagagtgcagtggtgcgatctcggctcactgcaacctccacctctcaggttcaggcaattctcctgcctcagtctcccaagtagctgggattacaggcgcgcatcaccatacttggctaatttttgtgttttttagggtttcgccatgttggccagggtgggtctcaaactcctgacctcaggtgatctgcccacctcgacctcccaaagtgctgggattacaggcatgagccaccatgcccggccacaatgaatccaattctgtgtccccagtgtccagccaacagcccggttcctagtggatgttaagccaccttggttgggtggacggacagatagatgaatggacagatgggtgtgcaggaagttgagccaagggcacagaacagagatcaccatttctcatcccatcagacagtgacataacttccatggtttccggggtctctgtccccagccaagcctagaccagtgccagccgcgtctgtgatgtgagagacagccccttgccagcagctctgcctgagtgttggtgtccagcgactactttggagcaagcccagctggcatcgtaaatgcatgctcttcctacatcagccttgtacccagcagtgtatcacctacagctagggctaggccagcgtgtgccacgaatatgcaggggggaaagtgggcgtgtggatgggagaggaacagagatgagccggtaacagaggggcaaacctccagcctcattttcgggtttagcatctaatccttttgtcagggtttccctggaccccgaggagagaaaggtgatcggagcgagcgtggagagaagggagaacgaggggtccccggccggaaaggagtgaagggccagaagggcgagccgggaccaccaggcctggaccagccgtgtcccgtgggccccgacgggctgcctgtgcctggctgctggcataagtgacccacaggcccagctcacacctgtacagatccgtgtggacatttttaatttttgtaaaaacaaaacagtaatatattgatcttttttcatggaatgcgctacctgtggccttttaacattcaagagtatgcccacccagccccaaagccaccggcatgtgaagctgccggaaagtggacaggccagaccagggagatgtgtacctgaggggcacccttgggcctgggctttcccaggaaggagatgaaggtagaagcacctggctcgggcaaggctagaaagatgctacgttgggccttcagtcacctgatcagcagagagactctcagctgtggtactgccctgtaagaacctgctcccgcaaaactctggagtccctgggacacacccttcgtgcgcacgacggggtgtcccagtgtgtgcacgggagtgcctcgcagggcncagtgtcaaggttgtgtcctccagcataaggacaccccgtgggtac

SEQ ID NO: 427911 - DNA, 390 bp, Homo sapiens
agtcaggcagatctggtcccggcatcgttgttcctgggctctgtgacctgaagcaagtcacttaaccctccaagcctcagcgcccgaatctgtgacataacaacttacaggtgatagccatgggctacatctgctcgtgatgggctgaggaaacagaggaggcggtgggtcctggcacagctagaggtccaactgcaaagacccaccctgggccgggtgcacagtgtgtcctggccctctggctgctgacacctctttaggaaaggaaggcataacccctcttgccatctcttcccttccagggcgagcttggattgcccggtgccccaggaatcgatggagagaaggtctctgggcctttcatttccttggtgatgccagtgcctggta

SEQ ID NO: 427912 - DNA, 409 bp, Homo sapiens
tcctgcccatttatctcaagagaaagagccaacaactttgaagtcaggcagatctggtcccggcatcgttgttcctgggctctgtgacctgaagcaagtcacttaaccctccaagcctcagcgcccgaatctgtgacataacaacttacaggtgatagccatgggctacatctgctcgtgatgggctgaggaaacagaggaggcggtgggtcctggcacagctagaggtccaactgcaaagacccaccctgggccgggtgcacagtgtgtcctggccctctggctgctgacacctctttaggaaaggaaggcataacccctcttgccatctcttcccttccagggcgagcttggattgcccggtgccccaggaatcgatggagagaaggtctctgggcctttcatttcc

SEQ ID NO: 427913 - DNA, 1695 bp, Homo sapiens
ggcgagcttggattgcccggtgccccaggaatcgatggagagaagggccccaaaggacagaaaggagacccaggagagcctgggccagcaggactcaaaggggaagcaggcgagatgggcttgtccggcctcccgggcgctgacggcctcaagggggagaagggggagtcggcatctgacagcctacaggagagcctggctcagctcatagtggagccagggccccctggcccccctggccccccaggcccgatgggcctccagggaatccagggtcccaagggcttggatggagcaaagggagagaagggtgcgtcgggtgagagaggccccagcggcctgcctgggccagttggcccaccgggccttattgggctgccaggaaccaaaggagagaagggcagacccggggagccaggactagatggtttccctggaccccgaggagagaaaggtgatcggagcgagcgtggagagaagggagaacgaggggtccccggccggaaaggagtgaagggccagaagggcgagccgggaccaccaggcctggaccagccgtgtcccgtgggccccgacgggctgcctgtgcctggctgctggcataagtgacccacaggcccagctcacacctgtacagatccgtgtggacatttttaatttttgtaaaaacaaaacagtaatatattgatcttttttcatggaatgcgctacctgtggccttttaacattcaagagtatgcccacccagccccaaagccaccggcatgtgaagctgccggaaagtggacaggccagaccagggagatgtgtacctgaggggcacccttgggcctgggctttcccaggaaggagatgaaggtagaagcacctggctcgggcaaggctagaaagatgctacgttgggccttcagtcacctgatcagcagagagactctcagctgtggtactgccctgtaagaacctgctcccgcaaaactctggagtccctgggacacaccctatccaagaagacccaggggtggaacagcggctgctgttgctcctggcctcatcagcctccaaactcaaccacaaccagctgcctctgcagttggacaagacttggcccccggacaagactcgcccagcacttgcggctgggcccggggagcagtgagtggaaatcccccacgagggtctagctctaccacattcaggaggcctcaggaggccagcctgccatgagagcacatgtcctctggccaggagtagtggctgagctctgtgatcgctgtgatgtggacccagctccagggagcagagtgtcggggatggaggggcccagcctggactgactgctacttcctgtctctgtttccattatcacccagagagggacaagataggacatggcctggaccagggaggcaggcctcccactcagagtctgggtctcactggccccaagtctcccacccagaactctggccaaaaatggctctctaggtgggctgtgcaggcaaagcaaagctcagggctggttcccagctggcctgagcagggggcctgccaccagacccacccacgctctgacgagaggcttttccacctccagcaagtgttcccagcaaccagctccatcctggctgcttgccttccatttccgtgtagatggagatcactgtgtgtaataaaccacaagtgcgtgtcaaagtg

SEQ ID NO: 427914 - DNA, 2363 bp, Homo sapiens
tttgagaaccactgccttgaaaaaatttccaacttctacctttaagatcagcctgacttatcaaacgctagagaaaaactgaatctacccttgggcagatgacttgggattggattctatacagcagtcttgctcaatcttcccagtttccagttttattataccaacaattggtttttacaagctagaagacaatgaatgtataagttctatggaacagtgagataaatctaagcttcttgtctttgtatttagaaacattgattctatggatgatcatttgtatcatgttgaccctttgacttgtactgaaggtgattttaaatttaagtatgtagtgtttgaatttcttccatccatgtcgttttaatgagatgtttccatgtcagctcctttacagccttggctcctggcttacagatttttgaatagttgtttgcttgccagttgttttacatctttcattggccaccaaaatattagccatttgagatgagatgagactacttgttgtaccttcatctttcatttaattttctggcgtaaattaacattttaatttcatatatatctgtaaagagtctacccaaaggcttcacggaaatttgcaaaatgaactaattcccttttaagcagcaggtgtgcctgtttttgacttttcagtaaatatgttgtttgtgcacatatctacatggtggagaccatattcattatttcatcttccaaataatgggaaaaatataaaagtgaatcagtgtgctttgggaattcagtgaaatcatgttaactcatatagagggggccttagtttatctcttctttactgaattaattagttttggaaattcttttaccattaaaaaaaattaaggaccatacagagaatgatttaagaaaaaacaagtcacttaaaaatcatcacctatttataaactgtattaattacacataatgcttattgattcaatgaggtttctctaaagacttctgcttaataaatatgctgacttcatttaaattagtttagactattgtaggaatggaaggaaatgattatatttactagaattagtgagatcagaaagcatatcagaatgttgatgatatcaaggagacaatctacagagtttttgcctctgtggatggaaataagggtgtttttttttggttttttttttactttagtttcccataatttttggaaattatgtgtgcatttagttcttttagtaacactgattttaaaattaaatttcaaaagtcaatctctaagagtaatttatttttgttttaccaaccagtgccaaaaaggagaggagggaatccaaaagccaatcttttgaaccaatgtgtaaaagattatgttttttcttaaagttagggaggctcgggccctgacactgccagccccagtgagcatccctggctacctcgggattatgtgcaagctgctttgtcctacatttctttcatctggttcttattgggagtgcttctctctaataaaaattgatttcccacaaaataggcaaagctgaacaaagatgaatgcttttgataagttgggtttcacttcagttgaaacaatgtgatagaatatccaggtgtggcatgatggggcaggaggaggtgcctagagggaaaagttatttttgtttcttagtgttgtgttgtggggatgggacagataagaataagatgtttattgccctaatcatgctaagagactattattcaatatgcttttcccgcttttctaagaggaataaacttagacaaattacattataaacagttcccctactactatctcccactctagataaagccagtgggtggtatgggtccttttattccttatagtattatgccaaagaatcaacttattttcattgaagattataaataaatgaagcttgttatagccataatgatttgagtcagtataccattttacctataaaatgcaaaattcatccttgcaaccccattcaccaggagccttgaagcattttgtttactccaaaggccttgtcaaggaagcataattttttgttttgccttcttatttagtcagtttggtcatatttacttaaaaaaacaaactgaaaatcacactcctttatatgttgatataactgattttatagaatctgtctgttctttgtttaacaggtctctgtaagcaagcttgcaagtgtattttgtgtacattttatctgaggtggaaatgaaaattctaaagagaaaatattttaaaagatattgtatttatgttgcttgtgttgtagaataaagattcaaatgcattaaaaatctggtacatgaaacaattgtgtttactgaataaatatatataaata

SEQ ID NO: 427915 - DNA, 3479 bp, Homo sapiens
cctggaccctggggcgtgaggagggcgcggtgcgtcccgtggttgtgcttggaagccccccgagggtgcgcgcgcgtgggtatgagtgcgtgcgtgtgcctgggtgtgcgtgtgtgtaagtgtgcacgtgtgtgtgtgagagtgcgcgcggggaaggaggcacagagacagcccggacaggccactgcgcagccctggtggcccccgctccacctctcgctccgcagacccgcgccagggaggcctctgggccgcagcgggcaccggagcggagcgggcgcggcagcgggcgctgggaggtggggctgggggaggagagggggagggagagaggcgggcgggaggggaggatccgggaagctccggggtatttgacaggagcgagggcggacgcaaagaacgcggaggacctctgggtgcctgcaggggagctgctccagccgggccgccgggagcggtggggagagcatcgcggagccgcccctccacgcgcccgcccagccgcgctcgcccactgggctctcccggctgcagtgccagggcgcagggcgcggccgatctcccgctcccgccacctccgccaccatgctgctcccccagctctgctggctgccgctgctcgctgggctgctcccgccggtgcccgcgcagaagttctcggcgctcacgtttttgagagtggatcaagataaagacaaggattgtagcttggactgtgcgggttcgccccagaaacctctctgcgcatctgacggaaggaccttcctttcccgttgtgaatttcaacgtgccaagtgcaaagatccccagctagagattgcatatcgaggaaactgcaaagacgtgtccaggtgtgtggccgaaaggaagtatacccaggagcaagcccggaaggagtttcagcaagtgttcattcctgagtgcaatgacgacggcacctacagtcaggtccagtgtcacagctacacgggatactgctggtgcgtcacgcccaacgggaggcccatcagcggcactgccgtggcccacaagacgccccggtgcccgggttccgtaaatgaaaagttaccccaacgcgaaggcacaggaaaaacagatgatgccgcagctccagcgttggagactcagcctcaaggagatgaagaagatattgcatcacgttaccctaccctttggactgaacaggttaaaagtcggcagaacaaaaccaataagaattcagtgtcatcctgtgaccaagagcaccagtctgccctggaggaagccaagcagcccaagaacgacaatgtggtgatccctgagtgtgcgcacggcggcctctacaagccagtgcagtgccacccctccacggggtactgctggtgcgtcctggtggacacggggcgccccattcccggcacatccacaaggtacgagcagccgaaatgtgacaacacggccagggcccacccagccaaagcccgggacctgtacaagggccgccagctacaaggttgtccgggtgccaaaaagcatgagtttctgaccagcgttctggacgcgctgtccacggacatggtccacgccgcctccgacccctcctcctcgtcaggcaggctctcagaacccgaccccagccataccctagaggagcgggtggtgcactggtacttcaaactactggataaaaactccagtggagacatcggcaaaaaggaaatcaaacccttcaagaggttccttcgcaaaaaatcaaagcccaaaaaatgtgtgaagaagtttgttgaatactgtgacgtgaataatgacaaatccatctccgtacaagaactgatgggctgcctgggcgtggcgaaagaggacggcaaagcggacaccaagaaacgccacacccccagaggtcatgctgaaagtacgtctaatagacagccaaggaaacaaggataaatggctcataccccgaaggcagttcctagacacatgggaaatttccctcaccaaagagcaattaagaaaacaaaaacagaaacacatagtatttgcactttgtactttaaatgtaaattcactttgtagaaatgagctatttaaacagactgttttaatctgtgaaaatggagagctggcttcagaaaattaatcacatacaatgtatgtgtcctcttttgaccttggaaatctgtatgtggtggagaagtatttgaatgcatttaggcttaatttcttcgccttccacatgttaacagtagagctctatgcactccggctgcaatcgtatggctttctctaacccctgcagtcacttccagatgcctgtgcttacagcattgtggaatcatgttggaagctccacatgtccatggaagtttgtgatgtacggccgaccctacaggcagttaacatgcatgggctggtttgtttcttgggattttctgttagtttgtcttgttttgctttccagagatcttgctcatacaatgaatcacgcaaccactaaagctatccagttaagtgcaggtagttcccctggaggaaataatattttcaaactgtcgttggtgtgatactttggctcaaaggatctttgcttttccattttaagcttctgttttgagttttgccctggggcttgaatgagtcccagagagtcgttcggatggtgggaggctgcctaggaggcagtaaatccagtcacagtgcctgggaggggcccatccttccaaaatgtaaatccagtcgcggtgtgaccgagctggctaacaggcttgtctgcctggttttcctcctacacgtggacattattctcctgatcctcctacctggtccaccccagggctaccggaaggtaaaatcttcacctgaaccaattatgagcagtctccttactgaaggtacagccggatacgtggtgcccccggggctggtgttggcagccggggggaggtgcctgagggtccccacggttcctttctgcttttctgaatgcatcaagggtacgagaacttgccaatgggaaattcatccgagtggcactggcagagaaggataggagtggaatgcccacacagtgaccaacagaactggtctgcgtgcataaccagctgccaccctcaggcctgggccccagagctcagggcacccagtgtcttaaggaaccatttggaggacagtctgagagcaggaacttcaagctgtgattctatctcggctcagacttttggttggaaaaagatcttcatggccccaaatcccctgagacatgccttgtagaatgattttgtgatgttgtgatgcttgtggagcatcgcgtaaggcttcttgcttatttaaactgtgcaaggtaaaaatcaagcctttggagccacagaaccagctcaagtacatgccaatgttgtttaagaaacagttatgatcctaaactttttggataatcttttatatttctgacctttgaatttaatcattgttcttagattaaaataaaatatgctattgaaact

SEQ ID NO: 427916 - DNA, 268 bp, Homo sapiens
gcacgaggtctcaggggatttggggccatgccttgtagaatgattttgtgatgttgtgatgcttgtggagcatcgcgtaaggcttcttgcttatttaaactgtgcaaggtaaaaatcaagcctttggagccacagaaccagctcaagtacatgccaatgttgtttaagaaacagttatgatcctaaactttttggataatcttttatatttctgacctttgaatttaatcattgttcttagattaaaataaaatatgctattgaaact

SEQ ID NO: 427917 - DNA, 3574 bp, Homo sapiens
cctggaccctggggcgtgaggagggcgcggtgcgtcccgtggttgtgcttggaagccccccgagggtgcgcgcgcgtgggtatgagtgcgtgcgtgtgcctgggtgtgcgtgtgtgtaagtgtgcacgtgtgtgtgtgagagtgcgcgcggggaaggaggcacagagacagcccggacaggccactgcgcagccctggtggcccccgctccacctctcgctccgcagacccgcgccagggaggcctctgggccgcagcgggcaccggagcggagcgggcgcggcagcgggcgctgggaggtggggctgggggaggagagggggagggagagaggcgggcgggaggggaggatccgggaagctccggggtatttgacaggagcgagggcggacgcaaagaacgcggaggacctctgggtgcctgcaggggagctgctccagccgggccgccgggagcggtggggagagcatcgcggagccgcccctccacgcgcccgcccagccgcgctcgcccactgggctctcccggctgcagtgccagggcgcagggcgcggccgatctcccgctcccgccacctccgccaccatgctgctcccccagctctgctggctgccgctgctcgctgggctgctcccgccggtgcccgcgcagaagttctcggcgctcacgtttttgagagtggatcaagataaagacaaggattgtagcttggactgtgcgggttcgccccagaaacctctctgcgcatctgacggaaggaccttcctttcccgttgtgaatttcaacgtgccaagtgcaaagatccccagctagagattgcatatcgaggaaactgcaaagacgtgtccaggtgtgtggccgaaaggaagtatacccaggagcaagcccggaaggagtttcagcaagtgttcattcctgagtgcaatgacgacggcacctacagtcaggtccagtgtcacagctacacgggatactgctggtgcgtcacgcccaacgggaggcccatcagcggcactgccgtggcccacaagacgccccggtgcccgggttccgtaaatgaaaagttaccccaacgcgaaggcacaggaaaaacagatgatgccgcagctccagcgttggagactcagcctcaaggagatgaagaagatattgcatcacgttaccctaccctttggactgaacaggttaaaagtcggcagaacaaaaccaataagaattcagtgtcatcctgtgaccaagagcaccagtctgccctggaggaagccaagcagcccaagaacgacaatgtggtgatccctgagtgtgcgcacggcggcctctacaagccagtgcagtgccacccctccacggggtactgctggtgcgtcctggtggacacggggcgccccattcccggcacatccacaaggtacgagcagccgaaatgtgacaacacggccagggcccacccagccaaagcccgggacctgtacaagggccgccagctacaaggttgtccgggtgccaaaaagcatgagtttctgaccagcgttctggacgcgctgtccacggacatggtccacgccgcctccgacccctcctcctcgtcaggcaggctctcagaacccgaccccagccataccctagaggagcgggtggtgcactggtacttcaaactactggataaaaactccagtggagacatcggcaaaaaggaaatcaaacccttcaagaggttccttcgcaaaaaatcaaagcccaaaaaatgtgtgaagaagtttgttgaatactgtgacgtgaataatgacaaatccatctccgtacaagaactgatgggctgcctgggcgtggcgaaagaggacggcaaagcggacaccaagaaacgccacagaagtaagagaaacctgtgatggccagagcccagatgttcttaggaggcaagccaggagaagccgggtctgacttttcagctcagagacagcactcccccagaggtcatgctgaaagtacgtctaatagacagccaaggaaacaaggataaatggctcataccccgaaggcagttcctagacacatgggaaatttccctcaccaaagagcaattaagaaaacaaaaacagaaacacatagtatttgcactttgtactttaaatgtaaattcactttgtagaaatgagctatttaaacagactgttttaatctgtgaaaatggagagctggcttcagaaaattaatcacatacaatgtatgtgtcctcttttgaccttggaaatctgtatgtggtggagaagtatttgaatgcatttaggcttaatttcttcgccttccacatgttaacagtagagctctatgcactccggctgcaatcgtatggctttctctaacccctgcagtcacttccagatgcctgtgcttacagcattgtggaatcatgttggaagctccacatgtccatggaagtttgtgatgtacggccgaccctacaggcagttaacatgcatgggctggtttgtttcttgggattttctgttagtttgtcttgttttgctttccagagatcttgctcatacaatgaatcacgcaaccactaaagctatccagttaagtgcaggtagttcccctggaggaaataatattttcaaactgtcgttggtgtgatactttggctcaaaggatctttgcttttccattttaagcttctgttttgagttttgccctggggcttgaatgagtcccagagagtcgttcggatggtgggaggctgcctaggaggcagtaaatccagtcacagtgcctgggaggggcccatccttccaaaatgtaaatccagtcgcggtgtgaccgagctggctaacaggcttgtctgcctggttttcctcctacacgtggacattattctcctgatcctcctacctggtccaccccagggctaccggaaggtaaaatcttcacctgaaccaattatgagcagtctccttactgaaggtacagccggatacgtggtgcccccggggctggtgttggcagccggggggaggtgcctgagggtccccacggttcctttctgcttttctgaatgcatcaagggtacgagaacttgccaatgggaaattcatccgagtggcactggcagagaaggataggagtggaatgcccacacagtgaccaacagaactggtctgcgtgcataaccagctgccaccctcaggcctgggccccagagctcagggcacccagtgtcttaaggaaccatttggaggacagtctgagagcaggaacttcaagctgtgattctatctcggctcagacttttggttggaaaaagatcttcatggccccaaatcccctgagacatgccttgtagaatgattttgtgatgttgtgatgcttgtggagcatcgcgtaaggcttcttgcttatttaaactgtgcaaggtaaaaatcaagcctttggagccacagaaccagctcaagtacatgccaatgttgtttaagaaacagttatgatcctaaactttttggataatcttttatatttctgacctttgaatttaatcattgttcttagattaaaataaaatatgctattgaaact

SEQ ID NO: 427918 - DNA, 2066 bp, Homo sapiens
ggagtacacactcacaacattgttggaaggacagaaagtgatagcggtcaaagctgctgctgggctactgcagacaaaggttgtccgggtgccaaaaagcatgagtttctgaccagcgttctggacgcgctgtccacggacatggtccacgccgcctccgacccctcctcctcgtcaggcaggctctcagaacccgaccccagccataccctagaggagcgggtggtgcactggtacttcaaactactggataaaaactccagtggagacatcggcaaaaaggaaatcaaacccttcaagaggttccttcgcaaaaaatcaaagcccaaaaaatgtgtgaagaagtttgttgaatactgtgacgtgaataatgacaaatccatctccgtacaagaactgatgggctgcctgggcgtggcgaaagaggacggcaaagcggacaccaagaaacgccacacccccagaggtcatgctgaaagtacgtctaatagacagccaaggaaacaaggataaatggctcataccccgaaggcagttcctagacacatgggaaatttccctcaccaaagagcaattaagaaaacaaaaacagaaacacatagtatttgcactttgtactttaaatgtaaattcactttgtagaaatgagctatttaaacagactgttttaatctgtgaaaatggagagctggcttcagaaaattaatcacatacaatgtatgtgtcctcttttgaccttggaaatctgtatgtggtggagaagtatttgaatgcatttaggcttaatttcttcgccttccacatgttaacagtagagctctatgcactccggctgcaatcgtatggctttctctaacccctgcagtcacttccagatgcctgtgcttacagcattgtggaatcatgttggaagctccacatgtccatggaagtttgtgatgtacggccgaccctacaggcagttaacatgcatgggctggtttgtttcttgggattttctgttagtttgtcttgttttgctttccagagatcttgctcatacaatgaatcacgcaaccactaaagctatccagttaagtgcaggtagttcccctggaggaaataatattttcaaactgtcgttggtgtgatactttggctcaaaggatctttgcttttccattttaagcttctgttttgagttttgccctggggcttgaatgagtcccagagagtcgttcggatggtgggaggctgcctaggaggcagtaaatccagtcacagtgcctgggaggggcccatccttccaaaatgtaaatccagtcgcggtgtgaccgagctggctaacaggcttgtctgcctggttttcctcctacacgtggacattattctcctgatcctcctacctggtccaccccagggctaccggaaggtaaaatcttcacctgaaccaattatgagcagtctccttactgaaggtacagccggatacgtggtgcccccggggctggtgttggcagccggggggaggtgcctgagggtccccacggttcctttctgcttttctgaatgcatcaagggtacgagaacttgccaatgggaaattcatccgagtggcactggcagagaaggataggagtggaatgcccacacagtgaccaacagaactggtctgcgtgcataaccagctgccaccctcaggcctgggccccagagctcagggcacccagtgtcttaaggaaccatttggaggacagtctgagagcaggaacttcaagctgtgattctatctcggctcagacttttggttggaaaaagatcttcatggccccaaatcccctgagacatgccttgtagaatgattttgtgatgttgtgatgcttgtggagcatcgcgtaaggcttcttgcttatttaaactgtgcaaggtaaaaatcaagcctttggagccacagaaccagctcaagtacatgccaatgttgtttaagaaacagttatgatcctaaactttttggataatcttttatatttctgacctttgaatttaatcattgttcttagattaaaataaaatatgctattgaaact

SEQ ID NO: 427919 - DNA, 2129 bp, Homo sapiens
aattggcactcttggaaaactaagtctaggagatcatatattgctttttttttttcattctaaattacttttaattgaaagtcaagatgctgagttacagttgtttatcattataataagcaaactttttaagttggatttcttcttaaagaggtaaactagtgaacaaaaaagataaaaaggaaaattaagaatcaactatgcctttatcaaatttgaagcataagttatattattaaaattatttttgtataatcaaggtgataagacattctggaaaacatttaatgtatttagtacttagaatatttacagtggatgttacttttttgaaacgatatatttttcccaatttttctatcatgtcaaggaaggaaactgttaagaagttaccagtgtccaaaatgtcttcattgtttcttactcatacttacacctcacatgacctgcccagccctctttggttcagttcattcccagaagccaagccttagtcttcacagatgagcgacacacacctctgaatataatgtctcttttttgttttttccttttcagccaaggaaacaaggataaatggctcataccccgaaggcagttcctagacacatgggaaatttccctcaccaaagagcaattaagaaaacaaaaacagaaacacatagtatttgcactttgtactttaaatgtaaattcactttgtagaaatgagctatttaaacagactgttttaatctgtgaaaatggagagctggcttcagaaaattaatcacatacaatgtatgtgtcctcttttgaccttggaaatctgtatgtggtggagaagtatttgaatgcatttaggcttaatttcttcgccttccacatgttaacagtagagctctatgcactccggctgcaatcgtatggctttctctaacccctgcagtcacttccagatgcctgtgcttacagcattgtggaatcatgttggaagctccacatgtccatggaagtttgtgatgtacggccgaccctacaggcagttaacatgcatgggctggtttgtttcttgggattttctgttagtttgtcttgttttgctttccagagatcttgctcatacaatgaatcacgcaaccactaaagctatccagttaagtgcaggtagttcccctggaggaaataatattttcaaactgtcgttggtgtgatactttggctcaaaggatctttgcttttccattttaagcttctgttttgagttttgccctggggcttgaatgagtcccagagagtcgttcggatggtgggaggctgcctaggaggcagtaaatccagtcacagtgcctgggaggggcccatccttccaaaatgtaaatccagtcgcggtgtgaccgagctggctaacaggcttgtctgcctggttttcctcctacacgtggacattattctcctgatcctcctacctggtccaccccagggctaccggaaggtaaaatcttcacctgaaccaattatgagcagtctccttactgaaggtacagccggatacgtggtgcccccggggctggtgttggcagccggggggaggtgcctgagggtccccacggttcctttctgcttttctgaatgcatcaagggtacgagaacttgccaatgggaaattcatccgagtggcactggcagagaaggataggagtggaatgcccacacagtgaccaacagaactggtctgcgtgcataaccagctgccaccctcaggcctgggccccagagctcagggcacccagtgtcttaaggaaccatttggaggacagtctgagagcaggaacttcaagctgtgattctatctcggctcagacttttggttggaaaaagatcttcatggccccaaatcccctgagacatgccttgtagaatgattttgtgatgttgtgatgcttgtggagcatcgcgtaaggcttcttgcttatttaaactgtgcaaggtaaaaatcaagcctttggagccacagaaccagctcaagtacatgccaatgttgtttaagaaacagttatgatcctaaactttttggataatcttttatatttctgacctttgaatttaatcattgttcttagattaaaataaaatatgctattgaaact

SEQ ID NO: 427920 - DNA, 3881 bp, Homo sapiens
cctggaccctggggcgtgaggagggcgcggtgcgtcccgtggttgtgcttggaagccccccgagggtgcgcgcgcgtgggtatgagtgcgtgcgtgtgcctgggtgtgcgtgtgtgtaagtgtgcacgtgtgtgtgtgagagtgcgcgcggggaaggaggcacagagacagcccggacaggccactgcgcagccctggtggcccccgctccacctctcgctccgcagacccgcgccagggaggcctctgggccgcagcgggcaccggagcggagcgggcgcggcagcgggcgctgggaggtggggctgggggaggagagggggagggagagaggcgggcgggaggggaggatccgggaagctccggggtatttgacaggagcgagggcggacgcaaagaacgcggaggacctctgggtgcctgcaggggagctgctccagccgggccgccgggagcggtggggagagcatcgcggagccgcccctccacgcgcccgcccagccgcgctcgcccactgggctctcccggctgcagtgccagggcgcagggcgcggccgatctcccgctcccgccacctccgccaccatgctgctcccccagctctgctggctgccgctgctcgctgggctgctcccgccggtgcccgcgcagaagttctcggcgctcacgtttttgagagtggatcaagataaagacaaggattgtagcttggactgtgcgggttcgccccagaaacctctctgcgcatctgacggaaggaccttcctttcccgttgtgaatttcaacgtgccaagtgcaaagatccccagctagagattgcatatcgaggaaactgcaaagacgtgtccaggtgtgtggccgaaaggaagtatacccaggagcaagcccggaaggagtttcagcaagtgttcattcctgagtgcaatgacgacggcacctacagtcaggtccagtgtcacagctacacgggatactgctggtgcgtcacgcccaacgggaggcccatcagcggcactgccgtggcccacaagacgccccggtgcccgggttccgtaaatgaaaagttaccccaacgcgaaggcacaggaaaaacagatgatgccgcagctccagcgttggagactcagcctcaaggagatgaagaagatattgcatcacgttaccctaccctttggactgaacaggttaaaagtcggcagaacaaaaccaataagaattcagtgtcatcctgtgaccaagagcaccagtctgccctggaggaagccaagcagcccaagaacgacaatgtggtgatccctgagtgtgcgcacggcggcctctacaagccagtgcagtgccacccctccacggggtactgctggtgcgtcctggtggacacggggcgccccattcccggcacatccacaaggtacgagcagccgaaatgtgacaacacggccagggcccacccagccaaagcccgggacctgtacaagggccgccagctacaaggttgtccgggtgccaaaaagcatgagtttctgaccagcgttctggacgcgctgtccacggacatggtccacgccgcctccgacccctcctcctcgtcaggcaggctctcagaacccgaccccagccataccctagaggagcgggtggtgcactggtacttcaaactactggataaaaactccagtggagacatcggcaaaaaggaaatcaaacccttcaagaggttccttcgcaaaaaatcaaagcccaaaaaatgtgtgaagaagtttgttgaatactgtgacgtgaataatgacaaatccatctccgtacaagaactgatgggctgcctgggcgtggcgaaagaggacggcaaagcggacaccaagaaacgccacacccccagaggtcatgctgaaagtacgtctaatagacagccaaggaaacaaggataaatggctcataccccgaaggcagttcctagacacatgggaaatttccctcaccaaagagcaattaagaaaacaaaaacagaaacacatagtatttgcactttgtactttaaatgtaaattcactttgtagaaatgagctatttaaacagactgttttaatctgtgaaaatggagagctggcttcagaaaattaatcacatacaatgtatgtgtcctcttttgaccttggaaatctgtatgtggtggagaagtatttgaatgcatttaggcttaatttcttcgccttccacatgttaacagtagagctctatgcactccggctgcaatcgtatggctttctctaacccctgcagtcacttccagatgcctgtgcttacagcattgtggaatcatgttggaagctccacatgtccatggaagtttgtgatgtacggccgaccctacaggcagttaacatgcatgggctggtttgtttcttgggattttctgttagtttgtcttgttttgctttccagagatcttgctcatacaatgaatcacgcaaccactaaagctatccagttaagtgcaggtagttcccctggaggaaataatattttcaaactgtcgttggtgtgatactttggctcaaaggatctttgcttttccattttaagcttctgttttgagttttgccctggggcttgaatgagtcccagagagtcgttcggatggtgggaggctgcctaggaggcagtaaatccagtcacagtgcctgggaggggcccatccttccaaaatgtaaatccagtcgcggtgtgaccgagctggctaacaggcttgtctgcctggttttcctcctacacgtggacattattctcctgatcctcctacctggtccaccccagggctaccggaaggtaaaatcttcacctgaaccaattatgagcagtctccttactgaaggtacagccggatacgtggtgcccccggggctggtgttggcagccggggggaggtgcctgagggtccccacggttcctttctgcttttctgaatgcatcaagggtacgagaacttgccaatgggaaattcatccgagtggcactggcagagaaggataggagtggaatgcccacacagtgaccaacagaactggtctgcgtgcataaccagctgccaccctcaggcctgggccccagagctcagggcacccagtgtcttaaggaaccatttggaggacagtctgagagcaggaacttcaagctgtgattctatctcggctcagacttttggttggaaaaagatcttcatggccccaaatcccctgagacatgccttgtagaatgattttgtgatgttgtgatgcttgtggagcatcgcgtaaggcttcttgcttatttaaactgtgcaaggtaaaaatcaagcctttggagccacagaaccagctcaagtacatgccaatgttgtttaagaaacagttatgatcctaaactttttggataatcttttatatttctgacctttgaatttaatcattgttcttagattaaaataaaatatgctattgaaactaaaaaagccaaaaaaaaacacaaaaagaacaaacgaagaatagataaagaacacagaaatcaaatggtgaggggcgccggcaccacaagaaatagacctcccgagggaggccgccacaactgtagactccacaacgaactaacagccagagaagaaaagaaggaggcgcccagagaatgaggaacacagtatgccaatcagcagaggcaacgataccacgcagcggaaaacaaaccctactcgacgatgggaatacaaaccgagggtacaaggtaggaataccttcgggaacgcgaaaacaacctaccgcggaaggggggcaaacaccaggcacgcacacaagaccccacagaacaaaacaacgactataggtcggagacaaaacaaacagcacgatcccta

SEQ ID NO: 427921 - DNA, 204 bp, Homo sapiens
gtaagatgctgcctgatgtcactttgtaaggagtgatttaatagatctagaaaatgatggggtttttttttggagttaagtgtattgtacagttgacccttgaacaacatgggggtgaggggtgcagacctggcacaaacatctgaggataactttcaactccccccaaaataataacctcttgtagactggcagccttaccca

SEQ ID NO: 427922 - DNA, 3512 bp, Homo sapiens
cctggaccctggggcgtgaggagggcgcggtgcgtcccgtggttgtgcttggaagccccccgagggtgcgcgcgcgtgggtatgagtgcgtgcgtgtgcctgggtgtgcgtgtgtgtaagtgtgcacgtgtgtgtgtgagagtgcgcgcggggaaggaggcacagagacagcccggacaggccactgcgcagccctggtggcccccgctccacctctcgctccgcagacccgcgccagggaggcctctgggccgcagcgggcaccggagcggagcgggcgcggcagcgggcgctgggaggtggggctgggggaggagagggggagggagagaggcgggcgggaggggaggatccgggaagctccggggtatttgacaggagcgagggcggacgcaaagaacgcggaggacctctgggtgcctgcaggggagctgctccagccgggccgccgggagcggtggggagagcatcgcggagccgcccctccacgcgcccgcccagccgcgctcgcccactgggctctcccggctgcagtgccagggcgcagggcgcggccgatctcccgctcccgccacctccgccaccatgctgctcccccagctctgctggctgccgctgctcgctgggctgctcccgccggtgcccgcgcagaagttctcggcgctcacgtttttgagagtggatcaagataaagacaaggattgtagcttggactgtgcgggttcgccccagaaacctctctgcgcatctgacggaaggaccttcctttcccgttgtgaatttcaacgtgccaagtgcaaagatccccagctagagattgcatatcgaggaaactgcaaagacgtgtccaggtgtgtggccgaaaggaagtatacccaggagcaagcccggaaggagtttcagcaagtgttcattcctgagtgcaatgacgacggcacctacagtcaggtccagtgtcacagctacacgggatactgctggtgcgtcacgcccaacgggaggcccatcagcggcactgccgtggcccacaagacgccccggtgcccgggttccgtaaatgaaaagttaccccaacgcgaaggcacaggaaaaacagtctccttgcaaatcttttccgttctgaattcagatgatgccgcagctccagcgttggagactcagcctcaaggagatgaagaagatattgcatcacgttaccctaccctttggactgaacaggttaaaagtcggcagaacaaaaccaataagaattcagtgtcatcctgtgaccaagagcaccagtctgccctggaggaagccaagcagcccaagaacgacaatgtggtgatccctgagtgtgcgcacggcggcctctacaagccagtgcagtgccacccctccacggggtactgctggtgcgtcctggtggacacggggcgccccattcccggcacatccacaaggtacgagcagccgaaatgtgacaacacggccagggcccacccagccaaagcccgggacctgtacaagggccgccagctacaaggttgtccgggtgccaaaaagcatgagtttctgaccagcgttctggacgcgctgtccacggacatggtccacgccgcctccgacccctcctcctcgtcaggcaggctctcagaacccgaccccagccataccctagaggagcgggtggtgcactggtacttcaaactactggataaaaactccagtggagacatcggcaaaaaggaaatcaaacccttcaagaggttccttcgcaaaaaatcaaagcccaaaaaatgtgtgaagaagtttgttgaatactgtgacgtgaataatgacaaatccatctccgtacaagaactgatgggctgcctgggcgtggcgaaagaggacggcaaagcggacaccaagaaacgccacacccccagaggtcatgctgaaagtacgtctaatagacagccaaggaaacaaggataaatggctcataccccgaaggcagttcctagacacatgggaaatttccctcaccaaagagcaattaagaaaacaaaaacagaaacacatagtatttgcactttgtactttaaatgtaaattcactttgtagaaatgagctatttaaacagactgttttaatctgtgaaaatggagagctggcttcagaaaattaatcacatacaatgtatgtgtcctcttttgaccttggaaatctgtatgtggtggagaagtatttgaatgcatttaggcttaatttcttcgccttccacatgttaacagtagagctctatgcactccggctgcaatcgtatggctttctctaacccctgcagtcacttccagatgcctgtgcttacagcattgtggaatcatgttggaagctccacatgtccatggaagtttgtgatgtacggccgaccctacaggcagttaacatgcatgggctggtttgtttcttgggattttctgttagtttgtcttgttttgctttccagagatcttgctcatacaatgaatcacgcaaccactaaagctatccagttaagtgcaggtagttcccctggaggaaataatattttcaaactgtcgttggtgtgatactttggctcaaaggatctttgcttttccattttaagcttctgttttgagttttgccctggggcttgaatgagtcccagagagtcgttcggatggtgggaggctgcctaggaggcagtaaatccagtcacagtgcctgggaggggcccatccttccaaaatgtaaatccagtcgcggtgtgaccgagctggctaacaggcttgtctgcctggttttcctcctacacgtggacattattctcctgatcctcctacctggtccaccccagggctaccggaaggtaaaatcttcacctgaaccaattatgagcagtctccttactgaaggtacagccggatacgtggtgcccccggggctggtgttggcagccggggggaggtgcctgagggtccccacggttcctttctgcttttctgaatgcatcaagggtacgagaacttgccaatgggaaattcatccgagtggcactggcagagaaggataggagtggaatgcccacacagtgaccaacagaactggtctgcgtgcataaccagctgccaccctcaggcctgggccccagagctcagggcacccagtgtcttaaggaaccatttggaggacagtctgagagcaggaacttcaagctgtgattctatctcggctcagacttttggttggaaaaagatcttcatggccccaaatcccctgagacatgccttgtagaatgattttgtgatgttgtgatgcttgtggagcatcgcgtaaggcttcttgcttatttaaactgtgcaaggtaaaaatcaagcctttggagccacagaaccagctcaagtacatgccaatgttgtttaagaaacagttatgatcctaaactttttggataatcttttatatttctgacctttgaatttaatcattgttcttagattaaaataaaatatgctattgaaact

SEQ ID NO: 427923 - DNA, 3538 bp, Homo sapiens
cctggaccctggggcgtgaggagggcgcggtgcgtcccgtggttgtgcttggaagccccccgagggtgcgcgcgcgtgggtatgagtgcgtgcgtgtgcctgggtgtgcgtgtgtgtaagtgtgcacgtgtgtgtgtgagagtgcgcgcggggaaggaggcacagagacagcccggacaggccactgcgcagccctggtggcccccgctccacctctcgctccgcagacccgcgccagggaggcctctgggccgcagcgggcaccggagcggagcgggcgcggcagcgggcgctgggaggtggggctgggggaggagagggggagggagagaggcgggcgggaggggaggatccgggaagctccggggtatttgacaggagcgagggcggacgcaaagaacgcggaggacctctgggtgcctgcaggggagctgctccagccgggccgccgggagcggtggggagagcatcgcggagccgcccctccacgcgcccgcccagccgcgctcgcccactgggctctcccggctgcagtgccagggcgcagggcgcggccgatctcccgctcccgccacctccgccaccatgctgctcccccagctctgctggctgccgctgctcgctgggctgctcccgccggtgcccgcgcagaagttctcggcgctcacgtttttgagagtggatcaagataaagacaaggattgtagcttggactgtgcgggttcgccccagaaacctctctgcgcatctgacggaaggaccttcctttcccgttgtgaatttcaacgtgccaagtgcaaagatccccagctagagattgcatatcgaggaaactgcaaagacgtgtccaggtgtgtggccgaaaggaagtatacccaggagcaagcccggaaggagtttcagcaagtgttcattcctgagtgcaatgacgacggcacctacagtcaggtccagtgtcacagctacacgggatactgctggtgcgtcacgcccaacgggaggcccatcagcggcactgccgtggcccacaagacgccccggtgcccgggttccgtaaatgaaaagttaccccaacgcgaaggcacaggaaaaacagatgatgccgcagctccagcgttggagactcagcctcaaggagatgaagaagatattgcatcacgttaccctaccctttggactgaacaggttaaaagtcggcagaacaaaaccaataagaattcagtgtcatcctgtgaccaagagcaccagtctgccctggaggaagccaagcagcccaagaacgacaatgtggtgatccctgagtgtgcgcacggcggcctctacaagccagtgcagtgccacccctccacggggtactgctggtgcgtcctggtggacacggggcgccccattcccggcacatccacaaggtacgagcagccgaaatgtgacaacacggccagggcccacccagccaaagcccgggacctgtacaagggccgccagctacaaggttgtccgggtgccaaaaagcatgagtttctgaccagcgttctggacgcgctgtccacggacatggtccacgccgcctccgacccctcctcctcgtcaggcaggctctcagaacccgaccccagccataccctagaggagcgggtggtgcactggtacttcaaactactggataaaaactccagtggagacatcggcaaaaaggaaatcaaacccttcaagaggttccttcgcaaaaaatcaaagcccaaaaaatgtgtgaagaagtttgttgaatactgtgacgtgaataatgacaaatccatctccgtacaagaactgatgggctgcctgggcgtggcgaaagaggacggcaaagcggacaccaagaaacgccacacccccagaggtcatgctgaaagtacgtctaatagacagccaaggaaacaaggataaatggctcataccccgaaggcagttcctagacacatgggaaatttccctcaccaaagagcaattaagaaaacaaaaacagaaacacatagtatttgcactttgtactttaaatgtaaattcactttgtagaaatgagctatttaaacagactgttttaatctgtgaaaatggagagctggcttcagaaaattaatcacatacaatgtatgtgtcctcttttgaccttggaaatctgtatgtggtggagaagtatttgaatgcatttaggcttaatttcttcgccttccacatgttaacagtagagctctatgcactccggctgcaatcgtatggctttctctaacccctgcagtcacttccagatgcctgtgcttacagcattgtggaatcatgttggaagctccacatgtccatggaagtttgtgatgtacggccgaccctacaggcagttaacatgcatgggctggtttgtttcttgggattttctgttagtttgtcttgttttgctttccagagatcttgctcatacaatgaatcacgcaaccactaaagctatccagttaagtgcaggtagttcccctggaggaaataatattttcaaactgtcgttggtgtgatactttggctcaaaggatctttgcttttccattttaagcttctgttttgagttttgccctggggcttgaatgagtcccagagagtcgttcggatggtgggaggctgcctaggaggcagtaaatccagtcacagtgcctgggaggggcccatccttccaaaatgtaaatccagtcgcggtgtgaccgagctggctaacaggcttgtctgcctggttttcctcctacacgtggacattattctcctgatcctcctacctggtccaccccagggctaccggaaggtaaaatcttcacctgaaccaattatgagcagtctccttactgaaggtacagccggatacgtggtgcccccggggctggtgttggcagccggggggaggtgcctgagggtccccacggttcctttctgcttttctgaatgcatcaagggtacgagaacttgccaatgggaaattcatccgagtggcactggcagagaaggataggagtggaatgcccacacagtgaccaacagaactggtctgcgtgcataaccagctgccaccctcaggcctgggccccagagctcagggcacccagtgtcttaaggaaccatttggaggacagtctgagagcaggaacttcaagctgtgattctatctcggctcagacttttggttggaaaaagatcttcatggccccaaatcccctgagacatgccttgtagaatgattttgtgatgttgtgatgcttgtggagcatcgcgtaaggcttcttgcttatttaaactgtgcaaggtaaaaatcaagcctttggagccacagaaccagctcaagtacatgccaatgttgtttaagaaacagttatgatcctaaactttttggataatcttttatatttctgacctttgaatttaatcattgttcttagattaaaataaaatatgctattgaaactaaaaaaacgaaaacatcagacaaaatcacgaataaacacaaaaacgaaaaaaatcgaag

SEQ ID NO: 427924 - DNA, 340 bp, Homo sapiens
ccacgcgtccgcgttgctataaatacattgtgtatttggcattatgtataatttgcaaagatggactttaaaagatgctgtgtaactaaactgaaataattcaattacttattatttagaatgttaaagcttatgatagtcttttctaattcttaacactcatacttgaaatctttctgagtttccccagaagagaatatgggattttttttgacatttttgactcatttaataatgctcttgtgtttacctagtatatgtagactttgtcttatgtgtcaaaagtcctaggaaagtggttgatgtttcttatagcaattaaaaattatttttgaactga

SEQ ID NO: 427925 - DNA, 3077 bp, Homo sapiens
ccagtgtgtataggtgcggcctggtgtatattcgtgcgacgggggcgtgcgtgtgatttgaacgaagtactttcagtttcatattactctaaatccattacaaatctgcttagcttctaaatatttcatcaatgaggaaatcccagccctacaacttcggaacagtgaaatattagtccagggatccagtgagagacacagaagtgctagaagccagtgctcgtgaactaaggagaaaaagaacagacaagggaacagcctggacatggcatcagagatccacatgacaggcccaatgtgcctcattgagaacactaatgggcgactgatggcgaatccagaagctctgaagatcctttctgccattacacagcctatggtggtggtggcaattgtgggcctctaccgcacaggcaaatcctacctgatgaacaagctggctggaaagaaaaagggcttctctctgggctccacggtgcagtctcacactaaaggaatctggatgtggtgtgtgccccaccccaagaagccaggccacatcctagttctgctggacaccgagggtctgggagatgtagagaagggtgacaaccagaatgactcctggatcttcgccctggccgtcctcctgagcagcaccttcgtgtacaatagcataggaaccatcaaccagcaggctatggaccaactgtactatgtgacagagctgacacatagaatccgatcaaaatcctcacctgatgagaatgagaatgaggttgaggattcagctgactttgtgagcttcttcccagactttgtgtggacactgagagatttctccctggacttggaagcagatggacaacccctcacaccagatgagtacctgacatactccctgaagctgaagaaaggtaccagtcaaaaagatgaaacttttaacctgcccagactctgtatccggaaattcttcccaaagaaaaaatgctttgtctttgatcggcccgttcaccgcaggaagcttgcccagctcgagaaactacaagatgaagagctggaccccgaatttgtgcaacaagtagcagacttctgttcctacatctttagtaattccaaaactaaaactctttcaggaggcatccaggtcaacgggcctcgtctagagagcctggtgctgacctacgtcaatgccatcagcagtggggatctgccgtgcatggagaacgcagtcctggccttggcccagatagagaactcagctgcagtgcaaaaggctattgcccactatgaacagcagatgggccagaaggtgcagctgcccacagaaagcctccaggagctgctggacctgcacagggacagtgagagagaggccattgaagtcttcatcaggagttccttcaaagatgtggaccatctatttcaaaaggagttagcggcccagctagaaaaaaagcgggatgacttttgtaaacagaatcaggaagcatcatcagatcgttgctcaggtttacttcaggtcattttcagtcctctagaagaagaagtgaaggcgggaatttattcgaaaccagggggctatcgtctctttgttcagaagctacaagacctgaagaaaaagtactatgaggaaccgaggaaggggatacaggctgaagagattctgcagacatacttgaaatccaaggagtctatgactgatgcaattctccagacagaccagactctcacagaaaaagaaaaggagattgaagtggaacgtgtgaaagctgagtctgcacaggcttcagcaaaaatgttgcaggaaatgcaaagaaagaatgagcagatgatggaacagaaggagaggagttatcaggaacacttgaaacaactgactgagaagatggagaacgacagggtccagttgctgaaagagcaagagaggaccctcgctcttaaacttcaggaacaggagcaactactaaaagagggatttcaaaaagaaagcagaataatgaaaaatgagatacaggatctccagacgaaaatgagacgacgaaaggcatgtaccataagctaaagaccagagccttcctgtcacccctaaccaaggcataattgaaacaattttagaatttggaacaagcgtcactacatttgataataattagatcttgcatcataacaccaaaagtttataaaggcatgtggtacaatgatcaaaatcatgttttttcttaaaaaaaaaaaaagactgtaaattgtgcaacaaagatgcatttacctctgtatcaactcaggaaatctcataagctggtaccactcaggagaagtttattcttccagatgaccagcagtagacaaatggatactgagcagagtcttaggtaaaagtcttgggaaatatttgggcattggtctggccaagtctacaatgtcccaatatcaaggacaaccaccctagcttcttagtgaagacaatgtacagttatccattagatcaagactacacggtctatgagcaataatgtgatttctggacattgcccatgtataatcctcactgatgatttcaagctaaagcaaaccaccttatacagagatctagaatctctttatgttctccagaggaaggtggaagaaaccatgggcaggagtaggaattgagtgataaacaattgggctaatgaagaaaacttctcttattgttcagttcatccagattataacttcaatgggacactttagaccattagacaattgacactggattaaacaaattcacataatgccaaatacacaatgtatttatagcaacgtataatttgcaaagatggactttaaaagatgctgtgtaactaaactgaaataattcaattacttattatttagaatgttaaagcttatgatagtcttttctaattcttaacactcatacttgaaatctttctgagtttccccagaagagaatatgggattttttttgacatttttgactcatttaataatgctcttgtgtttacctagtatatgtagactttgtcttatgtgtcaaaagtcctaggaaagtggttgatgtttcttatagcaattaaaaattatttttgaactga

SEQ ID NO: 427926 - DNA, 3023 bp, Homo sapiens
ccagtgtgtataggtgcggcctggtgtatattcgtgcgacgggggcgtgcgtgtgatttgaacgaagtactttcagtttcatattactctaaatccattacaaatctgcttagcttctaaatatttcatcaatgaggaaatcccagccctacaacttcggaacagtgaaatattagtccagggatccagtgagagacacagaagtgctagaagccagtgctcgtgaactaaggagaaaaagaacagacaagggaacagcctggacatggcatcagagatccacatgacaggcccaatgtgcctcattgagaacactaatgggcgactgatggcgaatccagaagctctgaagatcctttctgccattacacagcctatggtggtggtggcaattgtgggcctctaccgcacaggcaaatcctacctgatgaacaagctggctggaaagaaaaagggcttctctctgggctccacggtgcagtctcacactaaaggaatctggatgtggtgtgtgccccaccccaagaagccaggccacatcctagttctgctggacaccgagggtctgggagatgtagagaagggtgacaaccagaatgactcctggatcttcgccctggccgtcctcctgagcagcaccttcgtgtacaatagcataggaaccatcaaccagcaggctatggaccaactgtactatgtgacagagctgacacatagaatccgatcaaaatcctcacctgatgagaatgagaatgaggttgaggattcagctgactttgtgagcttcttcccagactttgtgtggacactgagagatttctccctggacttggaagcagatggacaacccctcacaccagatgagtacctgacatactccctgaagctgaagaaaggtaccagtcaaaaagatgaaacttttaacctgcccagactctgtatccggaaattcttcccaaagaaaaaatgctttgtctttgatcggcccgttcaccgcaggaagcttgcccagctcgagaaactacaagatgaagagctggaccccgaatttgtgcaacaagtagcagacttctgttcctacatctttagtaattccaaaactaaaactctttcaggaggcatccaggtcaacgggcctcgtctagagagcctggtgctgacctacgtcaatgccatcagcagtggggatctgccgtgcatggagaacgcagtcctggccttggcccagatagagaactcagctgcagtgcaaaaggctattgcccactatgaacagcagatgggccagaaggtgcagctgcccacagaaagcctccaggagctgctggacctgcacagggacagtgagagagaggccattgaagtcttcatcaggagttccttcaaagatgtggaccatctatttcaaaaggagttagcggcccagctagaaaaaaagcgggatgacttttgtaaacagaatcaggaagcatcatcagatcgttgctcaggtttacttcaggtcattttcagtcctctagaagaagaagtgaaggcgggaatttattcgaaaccagggggctatcgtctctttgttcagaagctacaagacctgaagaaaaagtactatgaggaaccgaggaaggggatacaggctgaagagattctgcagacatacttgaaatccaaggagtctatgactgatgcaattctccagacagaccagactctcacagaaaaagaaaaggagattgaagtggaacgtgtgaaagctgagtctgcacaggcttcagcaaaaatgttgcaggaaatgcaaagaaagaatgagcagatgatggaacagaaggagaggagttatcaggaacacttgaaacaactgactgagaagatggagaacgacagggtccagttgctgaaagagcaagagaggaccctcgctcttaaacttcaggaacaggagcaactactaaaagagggatttcaaaaagaaagcagaataatgaaaaatgagatacaggatctccagacgaaaatgagacgacgaaaggcatgtaccataagctaaagaccagagccttcctgtcacccctaaccaaggcataattgaaacaattttagaatttggaacaagcgtcactacatttgataataattagatcttgcatcataacaccaaaagtttataaaggcatgtggtacaatgatcaaaatcatgttttttcttaaaaaaaaaaaaagactgtaaattgtgcaacaaagatgcatttacctctgtatcaactcaggaaatctcataagctggtaccactcaggagaagtttattcttccagatgaccagcagtagacaaatggatactgagcagagtcttaggttatcaaggacaaccaccctagcttcttagtgaagacaatgtacagttatccattagatcaagactacacggtctatgagcaataatgtgatttctggacattgcccatgtataatcctcactgatgatttcaagctaaagcaaaccaccttatacagagatctagaatctctttatgttctccagaggaaggtggaagaaaccatgggcaggagtaggaattgagtgataaacaattgggctaatgaagaaaacttctcttattgttcagttcatccagattataacttcaatgggacactttagaccattagacaattgacactggattaaacaaattcacataatgccaaatacacaatgtatttatagcaacgtataatttgcaaagatggactttaaaagatgctgtgtaactaaactgaaataattcaattacttattatttagaatgttaaagcttatgatagtcttttctaattcttaacactcatacttgaaatctttctgagtttccccagaagagaatatgggattttttttgacatttttgactcatttaataatgctcttgtgtttacctagtatatgtagactttgtcttatgtgtcaaaagtcctaggaaagtggttgatgtttcttatagcaattaaaaattatttttgaactga

SEQ ID NO: 427927 - DNA, 3350 bp, Homo sapiens
ccagtgtgtataggtgcggcctggtgtatattcgtgcgacgggggcgtgcgtgtgatttgaacgaagtactttcagtttcatattactctaaatccattacaaatctgcttagcttctaaatatttcatcaatgaggaaatcccagccctacaacttcggaacagtgaaatattagtccagggatccagtgagagacacagaagtgctagaagccagtgctcgtgaactaaggagaaaaagaacagacaagggaacagcctggacatggcatcagagatccacatgacaggcccaatgtgcctcattgagaacactaatgggcgactgatggcgaatccagaagctctgaagatcctttctgccattacacagcctatggtggtggtggcaattgtgggcctctaccgcacaggcaaatcctacctgatgaacaagctggctggaaagaaaaagggcttctctctgggctccacggtgcagtctcacactaaaggaatctggatgtggtgtgtgccccaccccaagaagccaggccacatcctagttctgctggacaccgagggtctgggagatgtagagaagggtgacaaccagaatgactcctggatcttcgccctggccgtcctcctgagcagcaccttcgtgtacaatagcataggaaccatcaaccagcaggctatggaccaactgtagtatccttttgtgacccagaacagcaccaaggtcagaggggacacctgtattcatacaccagctgcctgactgtgaatcctgatgaatcaagctcaaaaggagaaaacaaaaaataatgcaagtacagaggagagatcccatgtatccactttagaactgacactgacacttaggttaggagcaaaggaaaatggaaggtttgggtatgtgttgaactaacatgggatgaggtccctgttcattttgtcacatttccttagttagctactcagctatgtgacagagctgacacatagaatccgatcaaaatcctcacctgatgagaatgagaatgaggttgaggattcagctgactttgtgagcttcttcccagactttgtgtggacactgagagatttctccctggacttggaagcagatggacaacccctcacaccagatgagtacctgacatactccctgaagctgaagaaaggtaccagtcaaaaagatgaaacttttaacctgcccagactctgtatccggaaattcttcccaaagaaaaaatgctttgtctttgatcggcccgttcaccgcaggaagcttgcccagctcgagaaactacaagatgaagagctggaccccgaatttgtgcaacaagtagcagacttctgttcctacatctttagtaattccaaaactaaaactctttcaggaggcatccaggtcaacgggcctcgtctagagagcctggtgctgacctacgtcaatgccatcagcagtggggatctgccgtgcatggagaacgcagtcctggccttggcccagatagagaactcagctgcagtgcaaaaggctattgcccactatgaacagcagatgggccagaaggtgcagctgcccacagaaagcctccaggagctgctggacctgcacagggacagtgagagagaggccattgaagtcttcatcaggagttccttcaaagatgtggaccatctatttcaaaaggagttagcggcccagctagaaaaaaagcgggatgacttttgtaaacagaatcaggaagcatcatcagatcgttgctcaggtttacttcaggtcattttcagtcctctagaagaagaagtgaaggcgggaatttattcgaaaccagggggctatcgtctctttgttcagaagctacaagacctgaagaaaaagtactatgaggaaccgaggaaggggatacaggctgaagagattctgcagacatacttgaaatccaaggagtctatgactgatgcaattctccagacagaccagactctcacagaaaaagaaaaggagattgaagtggaacgtgtgaaagctgagtctgcacaggcttcagcaaaaatgttgcaggaaatgcaaagaaagaatgagcagatgatggaacagaaggagaggagttatcaggaacacttgaaacaactgactgagaagatggagaacgacagggtccagttgctgaaagagcaagagaggaccctcgctcttaaacttcaggaacaggagcaactactaaaagagggatttcaaaaagaaagcagaataatgaaaaatgagatacaggatctccagacgaaaatgagacgacgaaaggcatgtaccataagctaaagaccagagccttcctgtcacccctaaccaaggcataattgaaacaattttagaatttggaacaagcgtcactacatttgataataattagatcttgcatcataacaccaaaagtttataaaggcatgtggtacaatgatcaaaatcatgttttttcttaaaaaaaaaaaaagactgtaaattgtgcaacaaagatgcatttacctctgtatcaactcaggaaatctcataagctggtaccactcaggagaagtttattcttccagatgaccagcagtagacaaatggatactgagcagagtcttaggtaaaagtcttgggaaatatttgggcattggtctggccaagtctacaatgtcccaatatcaaggacaaccaccctagcttcttagtgaagacaatgtacagttatccattagatcaagactacacggtctatgagcaataatgtgatttctggacattgcccatgtataatcctcactgatgatttcaagctaaagcaaaccaccttatacagagatctagaatctctttatgttctccagaggaaggtggaagaaaccatgggcaggagtaggaattgagtgataaacaattgggctaatgaagaaaacttctcttattgttcagttcatccagattataacttcaatgggacactttagaccattagacaattgacactggattaaacaaattcacataatgccaaatacacaatgtatttatagcaacgtataatttgcaaagatggactttaaaagatgctgtgtaactaaactgaaataattcaattacttattatttagaatgttaaagcttatgatagtcttttctaattcttaacactcatacttgaaatctttctgagtttccccagaagagaatatgggattttttttgacatttttgactcatttaataatgctcttgtgtttacctagtatatgtagactttgtcttatgtgtcaaaagtcctaggaaagtggttgatgtttcttatagcaattaaaaattatttttgaactga

SEQ ID NO: 427928 - DNA, 3626 bp, Homo sapiens
ccagtgtgtataggtgcggcctggtgtatattcgtgcgacgggggcgtgcgtgtgatttgaacgaagtactttcagtttcatattactctaaatccattacaaatctgcttagcttctaaatatttcatcaatgaggaaatcccagccctacaacttcggaacagtgaaatattagtccagggatccagtgagagacacagaagtgctagaagccagtgctcgtgaactaaggagaaaaagaacagacaagggaacagcctggacatggcatcagagatccacatgacaggcccaatgtgcctcattgagaacactaatgggcgactgatggcgaatccagaagctctgaagatcctttctgccattacacagcctatggtggtggtggcaattgtgggcctctaccgcacaggcaaatcctacctgatgaacaagctggctggaaagaaaaagggcttctctctgggctccacggtgcagtctcacactaaaggaatctggatgtggtgtgtgccccaccccaagaagccaggccacatcctagttctgctggacaccgagggtctgggagatgtagagaagggtgacaaccagaatgactcctggatcttcgccctggccgtcctcctgagcagcaccttcgtgtacaatagcataggaaccatcaaccagcaggctatggaccaactgtactatgtgacagagctgacacatagaatccgatcaaaatcctcacctgatgagaatgagaatgaggttgaggattcagctgactttgtgagcttcttcccagactttgtgtggacactgagagatttctccctggacttggaagcagatggacaacccctcacaccagatgagtacctgacatactccctgaagctgaagaaaggtaacagagagcttcaactgataaatgaggatgagaaaacacaagaaattatcatttttcagtttactattgctagttttccagcatttgcagttttctatgtcttcagctggctattcctagaaattaatacttgctgaatatccaaattaatagatgttattttaaattacatttgtcattgttctagaacaagtttcttgttctttcacctttgtgtatgctgtgattaggttaattttatctccctgcctagggtttgtgatcttctacttagccatagagtatggagtacaatggatatttatttaaagaacatagactaaaacatgaaccgtgtgctagtccaagcattggcaaactacagcccaagacaaatcatggcaaatcctgcctgccagctgtctttgtaaataaggtttttttggaataatgctatgcccattcatttacatgttgtctaaagctgttgtcatgcttcaataacagagttgaatacttggaaaagagaccatccagcctgaagagcctaaaatatttactatttggccctttacagaaacacttatattaggcaattttataattttttaaatgtttttctaggtaccagtcaaaaagatgaaacttttaacctgcccagactctgtatccggaaattcttcccaaagaaaaaatgctttgtctttgatcggcccgttcaccgcaggaagcttgcccagctcgagaaactacaagatgaagagctggaccccgaatttgtgcaacaagtagcagacttctgttcctacatctttagtaattccaaaatgacctacgtcaatgccatcagcagtggggatctgccgtgcatggagaacgcagtcctggccttggcccagatagagaactcagctgcagtgcaaaaggctattgcccactatgaacagcagatgggccagaaggtgcagctgcccacagaaagcctccaggagctgctggacctgcacagggacagtgagagagaggccattgaagtcttcatcaggagttccttcaaagatgtggaccatctatttcaaaaggagttagcggcccagctagaaaaaaagcgggatgacttttgtaaacagaatcaggaagcatcatcagatcgttgctcaggtttacttcaggtcattttcagtcctctagaagaagaagtgaaggcgggaatttattcgaaaccagggggctatcgtctctttgttcagaagctacaagacctgaagaaaaagtactatgaggaaccgaggaaggggatacaggctgaagagattctgcagacatacttgaaatccaaggagtctatgactgatgcaattctccagacagaccagactctcacagaaaaagaaaaggagattgaagtggaacgtgtgaaagctgagtctgcacaggcttcagcaaaaatgttgcaggaaatgcaaagaaagaatgagcagatgatggaacagaaggagaggagttatcaggaacacttgaaacaactgactgagaagatggagaacgacagggtccagttgctgaaagagcaagagaggaccctcgctcttaaacttcaggaacaggagcaactactaaaagagggatttcaaaaagaaagcagaataatgaaaaatgagatacaggatctccagacgaaaatgagacgacgaaaggcatgtaccataagctaaagaccagagccttcctgtcacccctaaccaaggcataattgaaacaattttagaatttggaacaagcgtcactacatttgataataattagatcttgcatcataacaccaaaagtttataaaggcatgtggtacaatgatcaaaatcatgttttttcttaaaaaaaaaaaaagactgtaaattgtgcaacaaagatgcatttacctctgtatcaactcaggaaatctcataagctggtaccactcaggagaagtttattcttccagatgaccagcagtagacaaatggatactgagcagagtcttaggtaaaagtcttgggaaatatttgggcattggtctggccaagtctacaatgtcccaatatcaaggacaaccaccctagcttcttagtgaagacaatgtacagttatccattagatcaagactacacggtctatgagcaataatgtgatttctggacattgcccatgtataatcctcactgatgatttcaagctaaagcaaaccaccttatacagagatctagaatctctttatgttctccagaggaaggtggaagaaaccatgggcaggagtaggaattgagtgataaacaattgggctaatgaagaaaacttctcttattgttcagttcatccagattataacttcaatgggacactttagaccattagacaattgacactggattaaacaaattcacataatgccaaatacacaatgtatttatagcaacgtataatttgcaaagatggactttaaaagatgctgtgtaactaaactgaaataattcaattacttattatttagaatgttaaagcttatgatagtcttttctaattcttaacactcatacttgaaatctttctgagtttccccagaagagaatatgggattttttttgacatttttgactcatttaataatgctcttgtgtttacctagtatatgtagactttgtcttatgtgtcaaaagtcctaggaaagtggttgatgtttcttatagcaattaaaaattatttttgaactga

SEQ ID NO: 427929 - DNA, 3314 bp, Homo sapiens
ccagtgtgtataggtgcggcctggtgtatattcgtgcgacgggggcgtgcgtgtgatttgaacgaagtactttcagtttcatattactctaaatccattacaaatctgcttagcttctaaatatttcatcaatgaggaaatcccagccctacaacttcggaacagtgaaatattagtccagggatccagtgagagacacagaagtgctagaagccagtgctcgtgaactaaggagaaaaagaacagacaagggaacagcctggacatggcatcagagatccacatgacaggcccaatgtgcctcattgagaacactaatgggcgactgatggcgaatccagaagctctgaagatcctttctgccattacacagcctatggtggtggtggcaattgtgggcctctaccgcacaggcaaatcctacctgatgaacaagctggctggaaagaaaaagggcttctctctgggctccacggtgcagtctcacactaaaggaatctggatgtggtgtgtgccccaccccaagaagccaggccacatcctagttctgctggacaccgagggtctgggagatgtagagaagggtgacaaccagaatgactcctggatcttcgccctggccgtcctcctgagcagcaccttcgtgtacaatagcataggaaccatcaaccagcaggctatggaccaactgtactatgtgacagagctgacacatagaatccgatcaaaatcctcacctgatgagaatgagaatgaggttgaggattcagctgactttgtgagcttcttcccagactttgtgtggacactgagagatttctccctggacttggaagcagatggacaacccctcacaccagatgagtacctgacatactccctgaagctgaagaaaggtaccagtcaaaaagatgaaacttttaacctgcccagactctgtatccggaaattcttcccaaagaaaaaatgctttgtctttgatcggcccgttcaccgcaggaagcttgcccagctcgagaaactacaagatgaagagctggaccccgaatttgtgcaacaagtagcagacttctgttcctacatctttagtaattccaaaactaaaactctttcaggaggcatccaggtcaacgggcctcgtctagagagcctggtgctgacctacgtcaatgccatcagcagtggggatctgccgtgcatggagaacgcagtcctggccttggcccagatagagaactcagctgcagtgcaaaaggctattgcccactatgaacagcagatgggccagaaggtgcagctgcccacagaaagcctccaggagctgctggacctgcacagggacagtgagagagaggccattgaagtcttcatcaggagttccttcaaagatgtggaccatctatttcaaaaggagttagcggcccagctagaaaaaaagcgggatgacttttgtaaacagaatcaggaagcatcatcagatcgttgctcaggtttacttcaggtcattttcagtcctctagaagaagaagtgaaggcgggaatttattcgaaaccagggggctatcgtctctttgttcagaagctacaagacctgaagaaaaagtactatgaggaaccgaggaaggggatacaggctgaagagattctgcagacatacttgaaatccaaggagtctatgactgatgcaattctccagacagaccagactctcacagaaaaagaaaaggagattgaaggtgaggagtgagttaagagattagatggcctcaaaagctccaaaaattgaaataacttgactggataaacatgggaccctttaactagagcaagatccacaaaggtgtgtcttacttgccgaggtcatctctgagtagggcatatgcagtcaacaacaatgacaggtaagtgtataaggaagaatgaggcaacaagataaccccacacaaatttttcttcttccttttcctcctcagtggaacgtgtgaaagctgagtctgcacaggcttcagcaaaaatgttgcaggaaatgcaaagaaagaatgagcagatgatggaacagaaggagaggagttatcaggaacacttgaaacaactgactgagaagatggagaacgacagggtccagttgctgaaagagcaagagaggaccctcgctcttaaacttcaggaacaggagcaactactaaaagagggatttcaaaaagaaagcagaataatgaaaaatgagatacaggatctccagacgaaaatgagacgacgaaaggcatgtaccataagctaaagaccagagccttcctgtcacccctaaccaaggcataattgaaacaattttagaatttggaacaagcgtcactacatttgataataattagatcttgcatcataacaccaaaagtttataaaggcatgtggtacaatgatcaaaatcatgttttttcttaaaaaaaaaaaaagactgtaaattgtgcaacaaagatgcatttacctctgtatcaactcaggaaatctcataagctggtaccactcaggagaagtttattcttccagatgaccagcagtagacaaatggatactgagcagagtcttaggtaaaagtcttgggaaatatttgggcattggtctggccaagtctacaatgtcccaatatcaaggacaaccaccctagcttcttagtgaagacaatgtacagttatccattagatcaagactacacggtctatgagcaataatgtgatttctggacattgcccatgtataatcctcactgatgatttcaagctaaagcaaaccaccttatacagagatctagaatctctttatgttctccagaggaaggtggaagaaaccatgggcaggagtaggaattgagtgataaacaattgggctaatgaagaaaacttctcttattgttcagttcatccagattataacttcaatgggacactttagaccattagacaattgacactggattaaacaaattcacataatgccaaatacacaatgtatttatagcaacgtataatttgcaaagatggactttaaaagatgctgtgtaactaaactgaaataattcaattacttattatttagaatgttaaagcttatgatagtcttttctaattcttaacactcatacttgaaatctttctgagtttccccagaagagaatatgggattttttttgacatttttgactcatttaataatgctcttgtgtttacctagtatatgtagactttgtcttatgtgtcaaaagtcctaggaaagtggttgatgtttcttatagcaattaaaaattatttttgaactga

SEQ ID NO: 427930 - DNA, 1794 bp, Homo sapiens
gagtcactctgatatttgctttctcaatgatggcttcattccccagcaggctcagcccatatgggaccacagcattaacagttccaaacttagagcccttaatctaaacaggacagagactctccttttcccagtatctatattagcctactaaaaatgactgctaagtaggatgttctgatcggcttgccaggagcatgtgtctgtcgctccgacagggaatttgaccaccaaggacaatagggccaagagaaagaattcccagaggagaaaggatggcaggaagacaaacaggaacacctgcttacagccatttcctacttctcactctgtgttctctgggtcctaaggctgaagagattctgcagacatacttgaaatccaaggagtctatgactgatgcaattctccagacagaccagactctcacagaaaaagaaaaggagattgaagtggaacgtgtgaaagctgagtctgcacaggcttcagcaaaaatgttgcaggaaatgcaaagaaagaatgagcagatgatggaacagaaggagaggagttatcaggaacacttgaaacaactgactgagaagatggagaacgacagggtccagttgctgaaagagcaagagaggaccctcgctcttaaacttcaggaacaggagcaactactaaaagagggatttcaaaaagaaagcagaataatgaaaaatgagatacaggatctccagacgaaaatgagacgacgaaaggcatgtaccataagctaaagaccagagccttcctgtcacccctaaccaaggcataattgaaacaattttagaatttggaacaagcgtcactacatttgataataattagatcttgcatcataacaccaaaagtttataaaggcatgtggtacaatgatcaaaatcatgttttttcttaaaaaaaaaaaaagactgtaaattgtgcaacaaagatgcatttacctctgtatcaactcaggaaatctcataagctggtaccactcaggagaagtttattcttccagatgaccagcagtagacaaatggatactgagcagagtcttaggtaaaagtcttgggaaatatttgggcattggtctggccaagtctacaatgtcccaatatcaaggacaaccaccctagcttcttagtgaagacaatgtacagttatccattagatcaagactacacggtctatgagcaataatgtgatttctggacattgcccatgtataatcctcactgatgatttcaagctaaagcaaaccaccttatacagagatctagaatctctttatgttctccagaggaaggtggaagaaaccatgggcaggagtaggaattgagtgataaacaattgggctaatgaagaaaacttctcttattgttcagttcatccagattataacttcaatgggacactttagaccattagacaattgacactggattaaacaaattcacataatgccaaatacacaatgtatttatagcaacgtataatttgcaaagatggactttaaaagatgctgtgtaactaaactgaaataattcaattacttattatttagaatgttaaagcttatgatagtcttttctaattcttaacactcatacttgaaatctttctgagtttccccagaagagaatatgggattttttttgacatttttgactcatttaataatgctcttgtgtttacctagtatatgtagactttgtcttatgtgtcaaaagtcctaggaaagtggttgatgtttcttatagcaattaaaaattatttttgaactga

SEQ ID NO: 427931 - DNA, 2031 bp, Homo sapiens
gagtcactctgatatttgctttctcaatgatggcttcattccccagcaggctcagcccatatgggaccacagcattaacagttccaaacttagagcccttaatctaaacaggacagagactctccttttcccagtatctatattagcctactaaaaatgactgctaagtaggatgttctgatcggcttgccaggagcatgtgtctgtcgctccgacagggaatttgaccaccaaggacaatagggccaagagaaagaattcccagaggagaaaggatggcaggaagacaaacaggaacacctgcttacagccatttcctacttctcactctgtgttctctgggtcctaaggctgaagagattctgcagacatacttgaaatccaaggagtctatgactgatgcaattctccagacagaccagactctcacagaaaaagaaaaggagattgaaggtgaggagtgagttaagagattagatggcctcaaaagctccaaaaattgaaataacttgactggataaacatgggaccctttaactagagcaagatccacaaaggtgtgtcttacttgccgaggtcatctctgagtagggcatatgcagtcaacaacaatgacaggtaagtgtataaggaagaatgaggcaacaagataaccccacacaaatttttcttcttccttttcctcctcagtggaacgtgtgaaagctgagtctgcacaggcttcagcaaaaatgttgcaggaaatgcaaagaaagaatgagcagatgatggaacagaaggagaggagttatcaggaacacttgaaacaactgactgagaagatggagaacgacagggtccagttgctgaaagagcaagagaggaccctcgctcttaaacttcaggaacaggagcaactactaaaagagggatttcaaaaagaaagcagaataatgaaaaatgagatacaggatctccagacgaaaatgagacgacgaaaggcatgtaccataagctaaagaccagagccttcctgtcacccctaaccaaggcataattgaaacaattttagaatttggaacaagcgtcactacatttgataataattagatcttgcatcataacaccaaaagtttataaaggcatgtggtacaatgatcaaaatcatgttttttcttaaaaaaaaaaaaagactgtaaattgtgcaacaaagatgcatttacctctgtatcaactcaggaaatctcataagctggtaccactcaggagaagtttattcttccagatgaccagcagtagacaaatggatactgagcagagtcttaggtaaaagtcttgggaaatatttgggcattggtctggccaagtctacaatgtcccaatatcaaggacaaccaccctagcttcttagtgaagacaatgtacagttatccattagatcaagactacacggtctatgagcaataatgtgatttctggacattgcccatgtataatcctcactgatgatttcaagctaaagcaaaccaccttatacagagatctagaatctctttatgttctccagaggaaggtggaagaaaccatgggcaggagtaggaattgagtgataaacaattgggctaatgaagaaaacttctcttattgttcagttcatccagattataacttcaatgggacactttagaccattagacaattgacactggattaaacaaattcacataatgccaaatacacaatgtatttatagcaacgtataatttgcaaagatggactttaaaagatgctgtgtaactaaactgaaataattcaattacttattatttagaatgttaaagcttatgatagtcttttctaattcttaacactcatacttgaaatctttctgagtttccccagaagagaatatgggattttttttgacatttttgactcatttaataatgctcttgtgtttacctagtatatgtagactttgtcttatgtgtcaaaagtcctaggaaagtggttgatgtttcttatagcaattaaaaattatttttgaactga

SEQ ID NO: 427932 - DNA, 1408 bp, Homo sapiens
cttagaccaaatttcctaatccatgattcatacaccttatgagattttgaggatactttgcttatttcggtgttatgtcatatacataatagggtaaggaacatggctgtgctttggtcaatgataggccaaagtatgacatttacgtcttgcgtgactcagagaaaattaaataacaaatcatttaatgtggaaaccagatagaatgtttcaatttgcctgatgctacactttactcagccttcgtttgtccctttttaggaacaggagcaactactaaaagagggatttcaaaaagaaagcagaataatgaaaaatgagatacaggatctccagacgaaaatgagacgacgaaaggcatgtaccataagctaaagaccagagccttcctgtcacccctaaccaaggcataattgaaacaattttagaatttggaacaagcgtcactacatttgataataattagatcttgcatcataacaccaaaagtttataaaggcatgtggtacaatgatcaaaatcatgttttttcttaaaaaaaaaaaaagactgtaaattgtgcaacaaagatgcatttacctctgtatcaactcaggaaatctcataagctggtaccactcaggagaagtttattcttccagatgaccagcagtagacaaatggatactgagcagagtcttaggtaaaagtcttgggaaatatttgggcattggtctggccaagtctacaatgtcccaatatcaaggacaaccaccctagcttcttagtgaagacaatgtacagttatccattagatcaagactacacggtctatgagcaataatgtgatttctggacattgcccatgtataatcctcactgatgatttcaagctaaagcaaaccaccttatacagagatctagaatctctttatgttctccagaggaaggtggaagaaaccatgggcaggagtaggaattgagtgataaacaattgggctaatgaagaaaacttctcttattgttcagttcatccagattataacttcaatgggacactttagaccattagacaattgacactggattaaacaaattcacataatgccaaatacacaatgtatttatagcaacgtataatttgcaaagatggactttaaaagatgctgtgtaactaaactgaaataattcaattacttattatttagaatgttaaagcttatgatagtcttttctaattcttaacactcatacttgaaatctttctgagtttccccagaagagaatatgggattttttttgacatttttgactcatttaataatgctcttgtgtttacctagtatatgtagactttgtcttatgtgtcaaaagtcctaggaaagtggttgatgtttcttatagcaattaaaaattatttttgaactga

SEQ ID NO: 427933 - DNA, 778 bp, Homo sapiens
tagaggatccccttgaacattcggtccaaatggatactgagcagagtcttaggtaaaagtcttgggaaatatttgggcattggtctggccaagtctacaatgtcccaatatcaaggacaaccaccctagcttcttagtgaagacaatgtacagttatccattagatcaagactacacggtctatgagcaataatgtgatttctggacattgcccatgtataatcctcactgatgatttcaagctaaagcaaaccaccttatacagagatctagaatctctttatgttctccagaggaaggtggaagaaaccatgggcaggagtaggaattgagtgataaacaattgggctaatgaagaaaacttctcttattgttcagttcatccagattataacttcaatgggacactttagaccattagacaattgacactggattaaacaaattcacataatgccaaatacacaatgtatttatagcaacgtataatttgcaaagatggactttaaaagatgctgtgtaactaaactgaaataattcaattacttattatttagaatgttaaagcttatgatagtcttttctaattcttaacactcatacttgaaatctttctgagtttccccagaagagaatatgggattttttttgacatttttgactcatttaataatgctcttgtgtttacctagtatatgtagactttgtcttatgtgtcaaaagtcctaggaaagtggttgatgtttcttatagcaattaaaaattatttttgaactga

SEQ ID NO: 427934 - DNA, 1956 bp, Homo sapiens
ccagtgtgtataggtgcggcctggtgtatattcgtgcgacgggggcgtgcgtgtgatttgaacgaagtactttcagtttcatattactctaaatccattacaaatctgcttagcttctaaatatttcatcaatgaggaaatcccagccctacaacttcggaacagtgaaatattagtccagggatccagtgagagacacagaagtgctagaagccagtgctcgtgaactaaggagaaaaagaacagacaagggaacagcctggacatggcatcagagatccacatgacaggcccaatgtgcctcattgagaacactaatgggcgactgatggcgaatccagaagctctgaagatcctttctgccattacacagcctatggtggtggtggcaattgtgggcctctaccgcacaggcaaatcctacctgatgaacaagctggctggaaagaaaaagggcttctctctgggctccacggtgcagtctcacactaaaggaatctggatgtggtgtgtgccccaccccaagaagccaggccacatcctagttctgctggacaccgagggtctgggagatgtagagaagggtgacaaccagaatgactcctggatcttcgccctggccgtcctcctgagcagcaccttcgtgtacaatagcataggaaccatcaaccagcaggctatggaccaactgtactatgtgacagagctgacacatagaatccgatcaaaatcctcacctgatgagaatgagaatgaggttgaggattcagctgactttgtgagcttcttcccagactttgtgtggacactgagagatttctccctggacttggaagcagatggacaacccctcacaccagatgagtacctgacatactccctgaagctgaagaaaggtaccagtcaaaaagatgaaacttttaacctgcccagactctgtatccggaaattcttcccaaagaaaaaatgctttgtctttgatcggcccgttcaccgcaggaagcttgcccagctcgagaaactacaagatgaagagctggaccccgaatttgtgcaacaagtagcagacttctgttcctacatctttagtaattccaaaactaaaactctttcaggaggcatccaggtcaacgggcctcgtctagagagcctggtgctgacctacgtcaatgccatcagcagtggggatctgccgtgcatggagaacgcagtcctggccttggcccagatagagaactcagctgcagtgcaaaaggctattgcccactatgaacagcagatgggccagaaggtgcagctgcccacagaaagcctccaggagctgctggacctgcacagggacagtgagagagaggccattgaagtcttcatcaggagttccttcaaagatgtggaccatctatttcaaaaggagttagcggtaatttttgtctcaaatgtatacggtttagggtcatagaagctaaagtaccacaaggaaagaaaactattatttattttgacggaagtaattcctcctagcttccataatggtgaaaacaacagatttgtgatcacatcagtcagaaggaccaactgtattattacagacccaaagttctaaaacattttttcctgaataattttccctttacttatgcatacaactgacaaccagagcttctaataaaattacctgcccactcttctcagactgatttgatattctagccaaacacaaagaaaattttcatcctacttatcttgagcaggcttccgttcagccacatttattccatatgaaatcattagtccaatatgcaaaaacagagttttcctctaacagttgacataaagctatcaatctcagccctgaacctcacctccaaaaagaaagcgacttcagcagaaagtggggtcagaaggaagagtgtggtcctggtgaggaggctgtcagtttctccagcatcattgact

SEQ ID NO: 427935 - DNA, 445 bp, Homo sapiens
ccagtgtgtataggtgcggcctggtgtatattcgtgcgacgggggcgtgcgtgtgatttgaacgaagtactttcagtttcatattactctaaatccattacaaatctgcttagcttctaaatatttcatcaatgaggaaatcccagccctacaacttcggaacagtgaaatattagtccagggatccagtgagagacacagaagtgctagaagccagtgctcgtgaactaaggagaaaaagaacagacaagggaacagcctggacatggcatcagagatccacatgacaggcccaatgtgcctcattgagaacactaatgggcgactgatggcgaatccagaagctctgaagatcctttctgccattacacagcctatggtggtgggtgactatagtcccagctactcgggaggctgaggcaggagaatggcgtgaacccaggag

SEQ ID NO: 427936 - DNA, 600 bp, Homo sapiens
agcttgcccagctcgagaaactacaagatgaagagctggaccccgaatttgtgcaacaagtagcagacttctgttcctacatctttagtaattccaaaactaaaactctttcaggaggcatccaggtcaacgggcctcgtaagtccccttcctagtacttctgctcattgtttaagactagaggagcatagaataacttccacctagtttcagcattgaaaaatcccaatctactgctatatttgtgttaaattctagatggcaccaatgtttctaacatatattgttagtcacatttccagtctaggaaaaggccaaaggaaaaaagttctattgcttgaaattgccctagtgaactggacctgcactatgcaatagagtagcccctagacaagtgtgtctatgtaaacataaatgtaaataatttaaatagggaaaatttaaaagtcaattcacatgcctgtatttcaaggactaatatttacacgtacttagtgactagcacactgaaaagcacatatacaacattcccagcattacagaaagcgcttttgaacaatactgcaataaaataaactaaatggatgactcttttttatt

SEQ ID NO: 427937 - DNA, 3905 bp, Homo sapiens
ccagtgtgtataggtgcggcctggtgtatattcgtgcgacgggggcgtgcgtgtgatttgaacgaagtactttcagtttcatattactctaaatccattacaaatctgcttagcttctaaatatttcatcaatgaggaaatcccagccctacaacttcggaacagtgaaatattagtccagggatccagtgagagacacagaagtgctagaagccagtgctcgtgaactaaggagaaaaagaacagacaagggaacagcctggacatggcatcagagatccacatgacaggcccaatgtgcctcattgagaacactaatgggcgactgatggcgaatccagaagctctgaagatcctttctgccattacacagcctatggtggtggtggcaattgtgggcctctaccgcacaggcaaatcctacctgatgaacaagctggctggaaagaaaaagggcttctctctgggctccacggtgcagtctcacactaaaggaatctggatgtggtgtgtgccccaccccaagaagccaggccacatcctagttctgctggacaccgagggtctgggagatgtagagaagggtgacaaccagaatgactcctggatcttcgccctggccgtcctcctgagcagcaccttcgtgtacaatagcataggaaccatcaaccagcaggctatggaccaactgtactatgtgacagagctgacacatagaatccgatcaaaatcctcacctgatgagaatgagaatgaggttgaggattcagctgactttgtgagcttcttcccagactttgtgtggacactgagagatttctccctggacttggaagcagatggacaacccctcacaccagatgagtacctgacatactccctgaagctgaagaaaggtaccagtcaaaaagatgaaacttttaacctgcccagactctgtatccggaaattcttcccaaagaaaaaatgctttgtctttgatcggcccgttcaccgcaggaagcttgcccagctcgagaaactacaagatgaagagctggaccccgaatttgtgcaacaagtagcagacttctgttcctacatctttagtaattccaaaactaaaactctttcaggaggcatccaggtcaacgggcctcgtctagagagcctggtgctgacctacgtcaatgccatcagcagtggggatctgccgtgcatggagaacgcagtcctggccttggcccagatagagaactcagctgcagtgcaaaaggctattgcccactatgaacagcagatgggccagaaggtgcagctgcccacagaaagcctccaggagctgctggacctgcacagggacagtgagagagaggccattgaagtcttcatcaggagttccttcaaagatgtggaccatctatttcaaaaggagttagcggcccagctagaaaaaaagcgggatgacttttgtaaacagaatcaggaagcatcatcagatcgttgctcaggtttacttcaggtcattttcagtcctctagaagaagaagtgaaggcgggaatttattcgaaaccagggggctatcgtctctttgttcagaagctacaagacctgaagaaaaagtactatgaggaaccgaggaaggggatacaggctgaagagattctgcagacatacttgaaatccaaggagtctatgactgatgcaattctccagacagaccagactctcacagaaaaagaaaaggagattgaagtggaacgtgtgaaagctgagtctgcacaggcttcagcaaaaatgttgcaggaaatgcaaagaaagaatgagcagatgatggaacagaaggagaggagttatcaggaacacttgaaacaactgactgagaagatggagaacgacagggtccagttgctgaaagagcaagagaggaccctcgctcttaaacttcaggaacaggagcaactactaaaagagggatttcaaaaagaaagcagaataatgaaaaatgagatacaggatctccagacgaaaatgagacgacgaaaggcatgtaccataagctaaagaccagagccttcctgtcacccctaaccaaggcataattgaaacaattttagaatttggaacaagcgtcactacatttgataataattagatcttgcatcataacaccaaaagtttataaaggcatgtggtacaatgatcaaaatcatgttttttcttaaaaaaaaaaaaagactgtaaattgtgcaacaaagatgcatttacctctgtatcaactcaggaaatctcataagctggtaccactcaggagaagtttattcttccagatgaccagcagtagacaaatggatactgagcagagtcttaggtaaaagtcttgggaaatatttgggcattggtctggccaagtctacaatgtcccaatatcaaggacaaccaccctagcttcttagtgaagacaatgtacagttatccattagatcaagactacacggtctatgagcaataatgtgatttctggacattgcccatgtataatcctcactgatgatttcaagctaaagcaaaccaccttatacagagatctagaatctctttatgttctccagaggaaggtggaagaaaccatgggcaggagtaggaattgagtgataaacaattgggctaatgaagaaaacttctcttattgttcagttcatccagattataacttcaatgggacactttagaccattagacaattgacactggattaaacaaattcacataatgccaaatacacaatgtatttatagcaacgtataatttgcaaagatggactttaaaagatgctgtgtaactaaactgaaataattcaattacttattatttagaatgttaaagcttatgatagtcttttctaattcttaacactcatacttgaaatctttctgagtttccccagaagagaatatgggattttttttgacatttttgactcatttaataatgctcttgtgtttacctagtatatgtagactttgtcttatgtgtcaaaagtcctaggaaagtggttgatgtttcttatagcaattaaaaattatttttgaactgaaaatacaatgtatttcactaggcttcttatttctgattttcttttttgcagttatttttatcagaaaataaggttttactctttatagcaatggctggtaatcttttctgtaaaataccagatagtaacgatttatggctttgcaggtcatacagtctctgtctgaattactcagctctgcatgtagtgcaaacgcagccatagaaaatacataaaccaataggtgtggctatgttccaatcaatttttactttcaataacaggatggcacccataagccatagtttgcagaactctgttttacagaaacattggtcagagttttatatacctgcattgtgttactcacatgtataaaaatcatatggattagactatatatattacaatcttgaaaaaactatgcggttattcaaaataacacagtgagaaaaaagcaaggaagcagctaatgccattaaatccacattaataatcctgtctttcctaattgctttgaggccttttgttaccttgaactacctgtgatccaatcacacggcaaatgcctcctttcacaatagagcatggtgctgccaagcactgtttcttcacttgaactgaaactttatagaagaccaggtgagaacacagaatactagatgaaatgttcatgtagatatgctttatattttcttccaagctccattgctacaaaggtgtaaataaaatacatttttatgagttgaagtaacttcacagtagaaaagaataactctgccattaaaagcaaataatggtttctttgtaaaccaataaagtataagaaaatgaaaaatcagcaaaatt

SEQ ID NO: 427938 - DNA, 3683 bp, Homo sapiens
ccagtgtgtataggtgcggcctggtgtatattcgtgcgacgggggcgtgcgtgtgatttgaacgaagtactttcagtttcatattactctaaatccattacaaatctgcttagcttctaaatatttcatcaatgaggaaatcccagccctacaacttcggaacagtgaaatattagtccagggatccagtgagagacacagaagtgctagaagccagtgctcgtgaactaaggagaaaaagaacagacaagggaacagcctggacatggcatcagagatccacatgacaggcccaatgtgcctcattgagaacactaatgggcgactgatggcgaatccagaagctctgaagatcctttctgccattacacagcctatggtggtggtggcaattgtgggcctctaccgcacaggcaaatcctacctgatgaacaagctggctggaaagaaaaagggcttctctctgggctccacggtgcagtctcacactaaaggaatctggatgtggtgtgtgccccaccccaagaagccaggccacatcctagttctgctggacaccgagggtctgggagatgtagagaagggtgacaaccagaatgactcctggatcttcgccctggccgtcctcctgagcagcaccttcgtgtacaatagcataggaaccatcaaccagcaggctatggaccaactgtactatgtgacagagctgacacatagaatccgatcaaaatcctcacctgatgagaatgagaatgaggttgaggattcagctgactttgtgagcttcttcccagactttgtgtggacactgagagatttctccctggacttggaagcagatggacaacccctcacaccagatgagtacctgacatactccctgaagctgaagaaaggtaacagagagcttcaactgataaatgaggatgagaaaacacaagaaattatcatttttcagtttactattgctagttttccagcatttgcagttttctatgtcttcagctggctattcctagaaattaatacttgctgaatatccaaattaatagatgttattttaaattacatttgtcattgttctagaacaagtttcttgttctttcacctttgtgtatgctgtgattaggttaattttatctccctgcctagggtttgtgatcttctacttagccatagagtatggagtacaatggatatttatttaaagaacatagactaaaacatgaaccgtgtgctagtccaagcattggcaaactacagcccaagacaaatcatggcaaatcctgcctgccagctgtctttgtaaataaggtttttttggaataatgctatgcccattcatttacatgttgtctaaagctgttgtcatgcttcaataacagagttgaatacttggaaaagagaccatccagcctgaagagcctaaaatatttactatttggccctttacagaaacacttatattaggcaattttataattttttaaatgtttttctaggtaccagtcaaaaagatgaaacttttaacctgcccagactctgtatccggaaattcttcccaaagaaaaaatgctttgtctttgatcggcccgttcaccgcaggaagcttgcccagctcgagaaactacaagatgaagagctggaccccgaatttgtgcaacaagtagcagacttctgttcctacatctttagtaattccaaaactaaaactctttcaggaggcatccaggtcaacgggcctcgtctagagagcctggtgctgacctacgtcaatgccatcagcagtggggatctgccgtgcatggagaacgcagtcctggccttggcccagatagagaactcagctgcagtgcaaaaggctattgcccactatgaacagcagatgggccagaaggtgcagctgcccacagaaagcctccaggagctgctggacctgcacagggacagtgagagagaggccattgaagtcttcatcaggagttccttcaaagatgtggaccatctatttcaaaaggagttagcggcccagctagaaaaaaagcgggatgacttttgtaaacagaatcaggaagcatcatcagatcgttgctcaggtttacttcaggtcattttcagtcctctagaagaagaagtgaaggcgggaatttattcgaaaccagggggctatcgtctctttgttcagaagctacaagacctgaagaaaaagtactatgaggaaccgaggaaggggatacaggctgaagagattctgcagacatacttgaaatccaaggagtctatgactgatgcaattctccagacagaccagactctcacagaaaaagaaaaggagattgaagtggaacgtgtgaaagctgagtctgcacaggcttcagcaaaaatgttgcaggaaatgcaaagaaagaatgagcagatgatggaacagaaggagaggagttatcaggaacacttgaaacaactgactgagaagatggagaacgacagggtccagttgctgaaagagcaagagaggaccctcgctcttaaacttcaggaacaggagcaactactaaaagagggatttcaaaaagaaagcagaataatgaaaaatgagatacaggatctccagacgaaaatgagacgacgaaaggcatgtaccataagctaaagaccagagccttcctgtcacccctaaccaaggcataattgaaacaattttagaatttggaacaagcgtcactacatttgataataattagatcttgcatcataacaccaaaagtttataaaggcatgtggtacaatgatcaaaatcatgttttttcttaaaaaaaaaaaaagactgtaaattgtgcaacaaagatgcatttacctctgtatcaactcaggaaatctcataagctggtaccactcaggagaagtttattcttccagatgaccagcagtagacaaatggatactgagcagagtcttaggtaaaagtcttgggaaatatttgggcattggtctggccaagtctacaatgtcccaatatcaaggacaaccaccctagcttcttagtgaagacaatgtacagttatccattagatcaagactacacggtctatgagcaataatgtgatttctggacattgcccatgtataatcctcactgatgatttcaagctaaagcaaaccaccttatacagagatctagaatctctttatgttctccagaggaaggtggaagaaaccatgggcaggagtaggaattgagtgataaacaattgggctaatgaagaaaacttctcttattgttcagttcatccagattataacttcaatgggacactttagaccattagacaattgacactggattaaacaaattcacataatgccaaatacacaatgtatttatagcaacgtataatttgcaaagatggactttaaaagatgctgtgtaactaaactgaaataattcaattacttattatttagaatgttaaagcttatgatagtcttttctaattcttaacactcatacttgaaatctttctgagtttccccagaagagaatatgggattttttttgacatttttgactcatttaataatgctcttgtgtttacctagtatatgtagactttgtcttatgtgtcaaaagtcctaggaaagtggttgatgtttcttatagcaattaaaaattatttttgaactga

SEQ ID NO: 427939 - DNA, 3304 bp, Homo sapiens
ccagtgtgtataggtgcggcctggtgtatattcgtgcgacgggggcgtgcgtgtgatttgaacgaagtactttcagtttcatattactctaaatccattacaaatctgcttagcttctaaatatttcatcaatgaggaaatcccagccctacaacttcggaacagtgaaatattagtccagggatccagtgagagacacagaagtgctagaagccagtgctcgtgaactaaggagaaaaagaacagacaagggaacagcctggacatggcatcagagatccacatgacaggcccaatgtgcctcattgagaacactaatgggcgactgatggcgaatccagaagctctgaagatcctttctgccattacacagcctatggtggtggtggcaattgtgggcctctaccgcacaggcaaatcctacctgatgaacaagctggctggaaagaaaaagggatgtggtgtgtgccccaccccaagaagccaggccacatcctagttctgctggacaccgagggtctgggagatgtagagaagggtgacaaccagaatgactcctggatcttcgccctggccgtcctcctgagcagcaccttcgtgtacaatagcataggaaccatcaaccagcaggctatggaccaactgtagtatccttttgtgacccagaacagcaccaaggtcagaggggacacctgtattcatacaccagctgcctgactgtgaatcctgatgaatcaagctcaaaaggagaaaacaaaaaataatgcaagtacagaggagagatcccatgtatccactttagaactgacactgacacttaggttaggagcaaaggaaaatggaaggtttgggtatgtgttgaactaacatgggatgaggtccctgttcattttgtcacatttccttagttagctactcagctatgtgacagagctgacacatagaatccgatcaaaatcctcacctgatgagaatgagaatgaggttgaggattcagctgactttgtgagcttcttcccagactttgtgtggacactgagagatttctccctggacttggaagcagatggacaacccctcacaccagatgagtacctgacatactccctgaagctgaagaaaggtaccagtcaaaaagatgaaacttttaacctgcccagactctgtatccggaaattcttcccaaagaaaaaatgctttgtctttgatcggcccgttcaccgcaggaagcttgcccagctcgagaaactacaagatgaagagctggaccccgaatttgtgcaacaagtagcagacttctgttcctacatctttagtaattccaaaactaaaactctttcaggaggcatccaggtcaacgggcctcgtctagagagcctggtgctgacctacgtcaatgccatcagcagtggggatctgccgtgcatggagaacgcagtcctggccttggcccagatagagaactcagctgcagtgcaaaaggctattgcccactatgaacagcagatgggccagaaggtgcagctgcccacagaaagcctccaggagctgctggacctgcacagggacagtgagagagaggccattgaagtcttcatcaggagttccttcaaagatgtggaccatctatttcaaaaggagttagcggcccagctagaaaaaaagcgggatgacttttgtaaacagaatcaggaagcatcatcagatcgttgctcaggtttacttcaggtcattttcagtcctctagaagaagaagtgaaggcgggaatttattcgaaaccagggggctatcgtctctttgttcagaagctacaagacctgaagaaaaagtactatgaggaaccgaggaaggggatacaggctgaagagattctgcagacatacttgaaatccaaggagtctatgactgatgcaattctccagacagaccagactctcacagaaaaagaaaaggagattgaagtggaacgtgtgaaagctgagtctgcacaggcttcagcaaaaatgttgcaggaaatgcaaagaaagaatgagcagatgatggaacagaaggagaggagttatcaggaacacttgaaacaactgactgagaagatggagaacgacagggtccagttgctgaaagagcaagagaggaccctcgctcttaaacttcaggaacaggagcaactactaaaagagggatttcaaaaagaaagcagaataatgaaaaatgagatacaggatctccagacgaaaatgagacgacgaaaggcatgtaccataagctaaagaccagagccttcctgtcacccctaaccaaggcataattgaaacaattttagaatttggaacaagcgtcactacatttgataataattagatcttgcatcataacaccaaaagtttataaaggcatgtggtacaatgatcaaaatcatgttttttcttaaaaaaaaaaaaagactgtaaattgtgcaacaaagatgcatttacctctgtatcaactcaggaaatctcataagctggtaccactcaggagaagtttattcttccagatgaccagcagtagacaaatggatactgagcagagtcttaggtaaaagtcttgggaaatatttgggcattggtctggccaagtctacaatgtcccaatatcaaggacaaccaccctagcttcttagtgaagacaatgtacagttatccattagatcaagactacacggtctatgagcaataatgtgatttctggacattgcccatgtataatcctcactgatgatttcaagctaaagcaaaccaccttatacagagatctagaatctctttatgttctccagaggaaggtggaagaaaccatgggcaggagtaggaattgagtgataaacaattgggctaatgaagaaaacttctcttattgttcagttcatccagattataacttcaatgggacactttagaccattagacaattgacactggattaaacaaattcacataatgccaaatacacaatgtatttatagcaacgtataatttgcaaagatggactttaaaagatgctgtgtaactaaactgaaataattcaattacttattatttagaatgttaaagcttatgatagtcttttctaattcttaacactcatacttgaaatctttctgagtttccccagaagagaatatgggattttttttgacatttttgactcatttaataatgctcttgtgtttacctagtatatgtagactttgtcttatgtgtcaaaagtcctaggaaagtggttgatgtttcttatagcaattaaaaattatttttgaactga

SEQ ID NO: 427940 - DNA, 3028 bp, Homo sapiens
ccagtgtgtataggtgcggcctggtgtatattcgtgcgacgggggcgtgcgtgtgatttgaacgaagtactttcagtttcatattactctaaatccattacaaatctgcttagcttctaaatatttcatcaatgaggaaatcccagccctacaacttcggaacagtgaaatattagtccagggatccagtgagagacacagaagtgctagaagccagtgctcgtgaactaaggagaaaaagaacagacaagggaacagcctggacatggcatcagagatccacatgacaggcccaatgtgcctcattgagaacactaatgggcgactgatggcgaatccagaagctctgaagatcctttctgccattacacagcctatggtggtggtggcaattgtgggcctctaccgcacaggcaaatcctacctgatgaacaagctggctggaaagaaaaagggcttctctctgggctccacggtgcagtctcacactaaaggaatctggatgtggtgtgtgccccaccccaagaagccaggccacatcctagttctgctggacaccgagggtctgggagatgtagagaagggtgacaaccagaatgactcctggatcttcgccctggccgtcctcctgagcagcaccttcgtgtacaatagcataggaaccatcaaccagcaggctatggaccaactgtactatgtgacagagctgacacatagaatccgatcaaaatcctcacctgatgagaatgagaatgaggttgaggattcagctgactttgtgagcttcttcccagactttgtgtggacactgagagatttctccctggacttggaagcagatggacaacccctcacaccagatgagtacctgacatactccctgaagctgaagaaaggtaccagtcaaaaagatgaaacttttaacctgcccagactctgtatccggaaattcttcccaaagaaaaaatgctttgtctttgatcggcccgttcaccgcaggaagcttgcccagctcgagaaactacaagatgaagagctggaccccgaatttgtgcaacaagtagcagacttctgttcctacatctttagtaattccaaaactaaaactctttcaggaggcatccaggtcaacgggcctcgtctagagagcctggtgctgacctacgtcaatgccatcagcagtggggatctgccgtgcatggagaacgcagtcctggccttggcccagatagagaactcagctgcagtgcaaaaggctattgcccactatgaacagcagatgggccagaaggtgcagctgcccacagaaagcctccaggagctgctggacctgcacagggacagtgagagagaggccattgaagtcttcatcaggagttccttcaaagatgtggaccatctatttcaaaaggagttagcggcccagctagaaaaaaagcgggatgacttttgtaaacagaatcaggaagcatcatcagatcgttgctcaggtttacttcaggtcattttcagtcctctagaagaagaagtgaaggcgggaatttattcgaaaccagggggctatcgtctctttgttcagaagctacaagacctgaagaaaaagtactatgaggaaccgaggaaggggatacaggctgaagagattctgcagacatacttgaaatccaaggagtctatgactgatgcaattctccagacagaccagactctcacagaaaaagaaaaggagattgaagtggaacgtgtgaaagctgagtctgcacaggcttcagcaaaaataggagttatcaggaacacttgaaacaactgactgagaagatggagaacgacagggtccagttgctgaaagagcaagagaggaccctcgctcttaaacttcaggaacaggagcaactactaaaagagggatttcaaaaagaaagcagaataatgaaaaatgagatacaggatctccagacgaaaatgagacgacgaaaggcatgtaccataagctaaagaccagagccttcctgtcacccctaaccaaggcataattgaaacaattttagaatttggaacaagcgtcactacatttgataataattagatcttgcatcataacaccaaaagtttataaaggcatgtggtacaatgatcaaaatcatgttttttcttaaaaaaaaaaaaagactgtaaattgtgcaacaaagatgcatttacctctgtatcaactcaggaaatctcataagctggtaccactcaggagaagtttattcttccagatgaccagcagtagacaaatggatactgagcagagtcttaggtaaaagtcttgggaaatatttgggcattggtctggccaagtctacaatgtcccaatatcaaggacaaccaccctagcttcttagtgaagacaatgtacagttatccattagatcaagactacacggtctatgagcaataatgtgatttctggacattgcccatgtataatcctcactgatgatttcaagctaaagcaaaccaccttatacagagatctagaatctctttatgttctccagaggaaggtggaagaaaccatgggcaggagtaggaattgagtgataaacaattgggctaatgaagaaaacttctcttattgttcagttcatccagattataacttcaatgggacactttagaccattagacaattgacactggattaaacaaattcacataatgccaaatacacaatgtatttatagcaacgtataatttgcaaagatggactttaaaagatgctgtgtaactaaactgaaataattcaattacttattatttagaatgttaaagcttatgatagtcttttctaattcttaacactcatacttgaaatctttctgagtttccccagaagagaatatgggattttttttgacatttttgactcatttaataatgctcttgtgtttacctagtatatgtagactttgtcttatgtgtcaaaagtcctaggaaagtggttgatgtttcttatagcaattaaaaattatttttgaactga

SEQ ID NO: 427941 - DNA, 1325 bp, Homo sapiens
gattccggatcttcagttagcgggggagttgcaggaaatgcaaagaaagaatgagcagatgatggaacagaaggagaggagttatcaggaacacttgaaacaactgactgagaagatggagaacgacagggtccagttgctgaaagagcaagagaggaccctcgctcttaaacttcaggaacaggagcaactactaaaagagggatttcaaaaagaaagcagaataatgaaaaatgagatacaggatctccagacgaaaatgagacgacgaaaggcatgtaccataagctaaagaccagagccttcctgtcacccctaaccaaggcataattgaaacaattttagaatttggaacaagcgtcactacatttgataataattagatcttgcatcataacaccaaaagtttataaaggcatgtggtacaatgatcaaaatcatgttttttcttaaaaaaaaaaaaagactgtaaattgtgcaacaaagatgcatttacctctgtatcaactcaggaaatctcataagctggtaccactcaggagaagtttattcttccagatgaccagcagtagacaaatggatactgagcagagtcttaggtaaaagtcttgggaaatatttgggcattggtctggccaagtctacaatgtcccaatatcaaggacaaccaccctagcttcttagtgaagacaatgtacagttatccattagatcaagactacacggtctatgagcaataatgtgatttctggacattgcccatgtataatcctcactgatgatttcaagctaaagcaaaccaccttatacagagatctagaatctctttatgttctccagaggaaggtggaagaaaccatgggcaggagtaggaattgagtgataaacaattgggctaatgaagaaaacttctcttattgttcagttcatccagattataacttcaatgggacactttagaccattagacaattgacactggattaaacaaattcacataatgccaaatacacaatgtatttatagcaacgtataatttgcaaagatggactttaaaagatgctgtgtaactaaactgaaataattcaattacttattatttagaatgttaaagcttatgatagtcttttctaattcttaacactcatacttgaaatctttctgagtttccccagaagagaatatgggattttttttgacatttttgactcatttaataatgctcttgtgtttacctagtatatgtagactttgtcttatgtgtcaaaagtcctaggaaagtggttgatgtttcttatagcaattaaaaattatttttgaactga

SEQ ID NO: 427942 - DNA, 1151 bp, Homo sapiens
ccagtgtgtataggtgcggcctggtgtatattcgtgcgacgggggcgtgcgtgtgatttgaacgaagtactttcagtttcatattactctaaatccattacaaatctgcttagcttctaaatatttcatcaatgaggaaatcccagccctacaacttcggaacagtgaaatattagtccagggatccagtgagagacacagaagtgctagaagccagtgctcgtgaactaaggagaaaaagaacagacaagggaacagcctggacatggcatcagagatccacatgacaggcccaatgtgcctcattgagaacactaatgggcgactgatggcgaatccagaagctctgaagatcctttctgccattacacagcctatggtggtggtggcaattgtgggcctctaccgcacaggcaaatcctacctgatgaacaagctggctggaaagaaaaagggcttctctctgggctccacggtgcagtctcacactaaaggaatctggatgtggtgtgtgccccaccccaagaagccaggccacatcctagttctgctggacaccgagggtctgggagatgtagagaagggtgacaaccagaatgactcctggatcttcgccctggccgtcctcctgagcagcaccttcgtgtacaatagcataggaaccatcaaccagcaggctatggaccaactgtactatgtgacagagctgacacatagaatccgatcaaaatcctcacctgatgagaatgagaatgaggttgaggattcagctgactttgtgagcttcttcccagactttgtgtggacactgagagatttctccattacagaaagcgcttttgaacaatactgcaataaaataaactaaatggatgactcttttttattggaatagtgtcatttgtttcatacatattgatcaaatgcttactatgaatagactgaagatacagatataaatgaaatagatatggttcctgtcctaatgttggttggggttaaaatggatgcaaacattcaattaacacaagtctatgtaatctagtacaagaactctcaaatgttggtatgcatacatatcttctgaggatcttaccaaacacaaaagtctaattcaatagatctcggacagggtctgagagtctatttcc

SEQ ID NO: 427943 - DNA, 1841 bp, Homo sapiens
gccttacgctttgcggctgtcgtcggagaggcatctgggttcggactggggccgccatggggaaagtgaatgtggccaagttgcgttacatgagccgagatgacttcagggtcttgaccgcggttgaaatgggcatgaagaaccatgaaattgttcccggcagtttgattgcttctatagccagccttaaacatggtggctgtaataaagttttaagagaattagtgaaacataaactcatagcttgggagcgtaccaaaactgtccagggctatcggttgacaaatgcaggatatgattacctagctttgaaaacactttcttctaggcaagtagttgagtctgttggaaaccagatgggtgttggcaaagaatcagatatttacattgttgcaaatgaagaaggacaacaatttgcattaaagcttcacagactaggaagaacctcgtttcgaaatttgaaaaacaaacgcgattatcataaacataggcacaatgtgtcttggctttatttatctcgtctctctgccatgaaggaatttgcctatatgaaggcattgtatgagaggaaatttccagttccaaagccaattgattacaatcgtcatgcagtggtcatggaactcataaatggttatccactatgtcagatacaccatgttgaagatcctgcatcagtatatgatgaagctatggaactaattgtcaaacttgcaaatcatgggctgattcatggagattttaatgaatttaatctcattttggatgaaagtgaccatatcaccatgattgattttccacagatggtttcaacttctcatcccaatgctgagtggtattttgacagagatgttaaatgcattaaagatttctttatgaaacgtttcagctacgaaagtgagctttttccaacttttaaggatatcaggagagaagacactcttgatgtggaggtttctgccagtggctacacaaaggaaatgcaggcagatgatgaactgcttcatccattaggtccagatgataaaaatattgaaacaaaagagggatctgaattctcattttcagatggagaagtggcagaaaaagcagaggtttacaggtcagaaaatgaaagtgaacggaactgtctagaagaatcagagggctgctattgcagatcatctggagaccctgaacaaataaaggaagacagtttatcagaagagagtgctgatgcacggagttttgaaatgactgaattcaatcaagctttagaagaaataaaagggcaggttgttgaaaacaactctgtaactgaattttctgaggagaaaaacagaactgaaaattacaacaggcaagatggtcagagagttcaaggaggagtccctgctggctctgacgagtatgaagatgaatgccctcatctaattgccttgtcgtcattaaatagagaattcaggcctttcagagatgaagaaaatgtgggagctatgaatcagtatagaacaagaactctgagtatcacttcttcaggcagtgctgtaagctgttcaacaattcctccagaactggtgaaacagaaggtgaaacgtcagttgacaaaacagcaaaaatcagctgtcagacgtcgattgcagaaaggagaagcaaatatatttaccaagcaacgtagggaaaacatgcaaaatatcaaatcaagtttggaagcagctagcttttggggagaataatatatttaggatcttggatatgtttaatatattttttaaagttactgtaattcctttttgagccctcatttgtcttttttgagccaaggctatcatatattaataaataaaccctctttcatctat

SEQ ID NO: 427944 - DNA, 486 bp, Homo sapiens
gccttacgctttgcggctgtcgtcggagaggcatctgggttcggactggggccgccatggggaaagtgaatgtggccaagttgcgttacatgagccgagatgacttcagggtcttgaccgcggttgaaatgggcatgaagaaccatgaaattgttcccggcagtttgattgcttctatagccagccttaaacatggtggctgtaataaagttttaagagaattagtgaaacataaactcatagcttgggagcgtaccaaaagtaagtattttgaggcaccatttgtgatttttcaggtaattggtttccaccagagcaagtgttccaaaagtcaagaagtagaagttgccagactagtaaagcattagacgaagaactgacagaacacacttcggccatatcctattagtcaaaataatcacagggcacacccagatcaaaggaggtgaaaaaagaatagtagtaagaacatgtaggtactgcaga

SEQ ID NO: 427945 - DNA, 3142 bp, Homo sapiens
ggatacgatttgacgcgtctcccccacagatagtttcaacttctcatcccaatgctgagtggtattttgacagagatgttaaatgcattaaagatttctttatgaaacgtttcagctacgaaagtgagctttttccaacttttaaggatatcaggagagaagacactcttgatgtggaggtttctgccagtggctacacaaaggaaatgcaggcagatgatgaactgcttcatccattaggtccagatgataaaaatattgaaacaaaagagggatctgaattctcattttcagatggagaagtggcagaaaaagcagaggtttacaggtcagaaaatgaaagtgaacggaactgtctagaagaatcagagggctgctattgcagatcatctggagaccctgaacaaataaaggaagacagtttatcagaagagagtgctgatgcacggagttttgaaatgactgaattcaatcaagctttagaagaaataaaagggcaggttgttgaaaacaactctgtaactgaattttctgaggagaaaaacagaactgaaaattacaacaggcaagatggtcagagagttcaaggaggagtccctgctggctctgacgagtatgaagatgaatgccctcatctaattgccttgtcgtcattaaatagagaattcaggcctttcagagatgaagaaaatgtgggagctatgaatcagtatagaacaagaactctgagtatcacttcttcaggcagtgctgtaagctgttcaacaattcctccagaactggtgaaacagaaggtgaaacgtcagttgacaaaacagcaaaaatcagctgtcagacgtcgattgcagaaaggagaagcaaatatatttaccaagcaacgtagggaaaacatgcaaaatatcaaatcaagtttggaagcagctagcttttggggagaataatatatttaggatcttggatatgtttaatatattttttaaagttactgtaattcctttttgagccctcatttgtcttttttgagccaaggctatcatatattaataaataaaccctctttcatctataaatttggtcattcagtatgtgtcttgcaaagaataattacctgccaaagcagtccatttttttcaaagtaatttgggtaactacagttacgtaactttattagagacatttgcatatttttaaaaatctaaataacatttttgttgttttctgtttgttgaggatgatatgctacaatgcacataaagcaattagaacaatgtttagcacattcttaagcattcaataaaacatggctattagaatcataatgattctgaaattctgctgacaatttggttgcattttatttggcaactggaggacttcactgtcttatttttctttagaagtaaagataagcctttggaagtaaagataagccagtgatgcacaatttgcttaattaattgattaataatctgttttgtgccacttacattggtaatgtggtcatgagaatggaaacttacttgagatagtctaccacaatttttacagttggcagcttgtaagcaggcctgagtagcagaagagttaggggttggggaaggtggagtagaatgaggaatgaaatgttctttctcatatgcttattatataagtgggtccggaacatgttctcacctcaaggttaacaaatacctaatgcaggaaagaaaatacatagccatggtcccttcctcaaggactttataattcagtgagatgtaaagatgagtgcttaagtgtatgcacctgattattgtctcttcattgccgcataagtcggaaaaggggatcacttgcagcgaaaaatggccactagatggcaatatcaccccatagtcaccaaacaggattacttgcatccctaattatgttctaccagagggaatatagtacagacttttccaagattgataaagacagcagattccctttcacctttgccaaattaactctactagctatttgcaagacctgtaattatctaataaattggcttaaatatatagaagctagaaaatgccaattcctcttccctcaaaagttacctgacattcaaatatttaaatacccttgctttgcattttagatatatctttgaattcaggtattcattttgtataatctctcaacttttaagcatttttataatgtaaagttgaaaacagcttaatagaaccacagaatgtttattttggagtcattttcttatattcagagctatgaaagcaaattgggaataaagccttatcctgctcagctttacctagttgactcagttgacttttgagtatctactacataaaaagcccattactattaagaaactcaagacaaacatgatttttacctttaatagcctaagatttcttgtgggccaaggaattaattattccaatcagaaatggaggccttacctcatttgggcaaagattagtgctagttattgaagatttactaataaatgatctgttaaggaatttagttttttttggatatgttgttttggttgttgaaaactaaggtataattataatagttatttttgaagatatgtttggctagccatcaattagaagttagagagtttgtcctaacagataagctataaccctcacattttaaaacatgcatagtgaacaatgaacaaaaacaaattcaaaattttactaatgtaaagctgtatattgtgattgttaaaacacttttttttgcctaggagttccagatttaaatcctggttctacacttcccaaacctcaggtaccttctgtggcctctctaacctcaatttttttacttgtaaaatggggacatttaatagtatctacctcagtgtcgtgaagactaaatgaagtaccacttgtaaagagtttattacagtgcctgacatatactgtatggttagtactgctaaaatgacttcttaaggttaccaaaaggaaaattccacaagctgaccacctttcctattgtgatggtcactggtatttcagctatgatcctttgttgtgtatttatccagactgaaagatgtttttctagtaaccatcttgcatcgtcttagtctccccattaaataaacttttcctacaaaaaaaaaaaa

SEQ ID NO: 427946 - DNA, 3916 bp, Homo sapiens
gccttacgctttgcggctgtcgtcggagaggcatctgggttcggactggggccgccatggggaaagtgaatgtggccaagttgcgttacatgagccgagatgacttcagggtcttgaccgcggttgaaatgggcatgaagaaccatgaaattgttcccggcagtttgattgcttctatagccagccttaaacatggtggctgtaataaagttttaagagaattagtgaaacataaactcatagcttgggagcgtaccaaaactgtccagggctatcggttgacaaatgcaggatatgattacctagctttgaaaacactttcttctaggcaagtagttgagtctgttggaaaccagatgggtgttggcaaagaatcagatatttacattgttgcaaatgaagaaggacaacaatttgcattaaagcttcacagactaggaagaacctcgtttcgaaatttgaaaaacaaacgcgattatcataaacataggcacaatgtgtcttggctttatttatctcgtctctctgccatgaaggaatttgcctatatgaaggcattgtatgagaggaaatttccagttccaaagccaattgattacaatcgtcatgcagtggtcatggaactcataaatggttatccactatgtcagatacaccatgttgaagatcctgcatcagtatatgatgaagctatggaactaattgtcaaacttgcaaatcatgggctgattcatggagattttaatgaatttaatctcattttggatgaaagtgaccatatcaccatgattgattttccacagatggtttcaacttctcatcccaatgctgagtggtattttgacagagatgttaaatgcattaaagatttctttatgaaacgtttcagctacgaaagtgagctttttccaacttttaaggatatcaggagagaagacactcttgatgtggaggtttctgccagtggctacacaaaggaaatgcaggcagatgatgaactgcttcatccattaggtccagatgataaaaatattgaaacaaaagagggatctgaattctcattttcagatggagaagtggcagaaaaagcagaggtttacaggtcagaaaatgaaagtgaacggaactgtctagaagaatcagagggctgctattgcagatcatctggagaccctgaacaaataaaggaagacagtttatcagaagagagtgctgatgcacggagttttgaaatgactgaattcaatcaagctttagaagaaataaaagggcaggttgttgaaaacaactctgtaactgaattttctgaggagaaaaacagaactgaaaattacaacaggcaagatggtcagagagttcaaggaggagtccctgctggctctgacgagtatgaagatgaatgccctcatctaattgccttgtcgtcattaaatagagaattcaggcctttcagagatgaagaaaatgtgggagctatgaatcagtatagaacaagaactctgagtatcacttcttcaggcagtgctgtaagctgttcaacaattcctccagaactggtgaaacagaaggtgaaacgtcagttgacaaaacagcaaaaatcagctgtcagacgtcgattgcagaaaggagaagcaaatatatttaccaagcaacgtagggaaaacatgcaaaatatcaaatcaagtttggaagcagctagcttttggggagaataatatatttaggatcttggatatgtttaatatattttttaaagttactgtaattcctttttgagccctcatttgtcttttttgagccaaggctatcatatattaataaataaaccctctttcatctataaatttggtcattcagtatgtgtcttgcaaagaataattacctgccaaagcagtccatttttttcaaagtaatttgggtaactacagttacgtaactttattagagacatttgcatatttttaaaaatctaaataacatttttgttgttttctgtttgttgaggatgatatgctacaatgcacataaagcaattagaacaatgtttagcacattcttaagcattcaataaaacatggctattagaatcataatgattctgaaattctgctgacaatttggttgcattttatttggcaactggaggacttcactgtcttatttttctttagaagtaaagataagcctttggaagtaaagataagccagtgatgcacaatttgcttaattaattgattaataatctgttttgtgccacttacattggtaatgtggtcatgagaatggaaacttacttgagatagtctaccacaatttttacagttggcagcttgtaagcaggcctgagtagcagaagagttaggggttggggaaggtggagtagaatgaggaatgaaatgttctttctcatatgcttattatataagtgggtccggaacatgttctcacctcaaggttaacaaatacctaatgcaggaaagaaaatacatagccatggtcccttcctcaaggactttataattcagtgagatgtaaagatgagtgcttaagtgtatgcacctgattattgtctcttcattgccgcataagtcggaaaaggggatcacttgcagcgaaaaatggccactagatggcaatatcaccccatagtcaccaaacaggattacttgcatccctaattatgttctaccagagggaatatagtacagacttttccaagattgataaagacagcagattccctttcacctttgccaaattaactctactagctatttgcaagacctgtaattatctaataaattggcttaaatatatagaagctagaaaatgccaattcctcttccctcaaaagttacctgacattcaaatatttaaatacccttgctttgcattttagatatatctttgaattcaggtattcattttgtataatctctcaacttttaagcatttttataatgtaaagttgaaaacagcttaatagaaccacagaatgtttattttggagtcattttcttatattcagagctatgaaagcaaattgggaataaagccttatcctgctcagctttacctagttgactcagttgacttttgagtatctactacataaaaagcccattactattaagaaactcaagacaaacatgatttttacctttaatagcctaagatttcttgtgggccaaggaattaattattccaatcagaaatggaggccttacctcatttgggcaaagattagtgctagttattgaagatttactaataaatgatctgttaaggaatttagttttttttggatatgttgttttggttgttgaaaactaaggtataattataatagttatttttgaagatatgtttggctagccatcaattagaagttagagagtttgtcctaacagataagctataaccctcacattttaaaacatgcatagtgaacaatgaacaaaaacaaattcaaaattttactaatgtaaagctgtatattgtgattgttaaaacacttttttttgcctaggagttccagatttaaatcctggttctacacttcccaaacctcaggtaccttctgtggcctctctaacctcaatttttttacttgtaaaatggggacatttaatagtatctacctcagtgtcgtgaagactaaatgaagtaccacttgtaaagagtttattacagtgcctgacatatactgtatggttagtactgctaaaatgacttcttaaggttaccaaaaggaaaattccacaagctgaccacctttcctattgtgatggtcactggtatttcagctatgatcctttgttgtgtatttatccagactgaaagatgtttttctagtaaccatcttgcatcgtcttagtctccccattaaataaacttttcctacaaaaaaaaaaaa

SEQ ID NO: 427947 - DNA, 908 bp, Homo sapiens
agcagctgcctctgggtggtggcagagatgcccatgtctaggacctccaggccttaactaatcaggggcactgatgaagccagcggggctccactggggaccacaggcaagactgggccaggacgaggcggtcacgcagagaaagaagataaaagggaacagaagagaaaattcaaaaggagcacgggcctccccgggagtgggcttcagcctccctagactcctgtctccttccaagggctaggcctgggggaccagaagcaagagtccctagagcgtccaagatttttggtttcaaaccaatttcctgctgaccagaatgaaatggagccacattccagcacgatgcacctgctgacctcctgcaagtcagggaccttctctgcccctcttttgctctgctgcaggagggagaagctgggaatgtgttcctctggggtcccatcacctccagccagccactgtccctgtctccccaaaacctcctcgttgtccctcctctgtcctcctcctcctccatctgccttcgccctgctctcctctttttcgcctgaggttcgtgctgcctcctcacctcttgtcctgtttctcccttctctctgctccctcctttgatcttgctattttgcttctctttcccttcctctcttctcctccctccccttcctccctgctccctgcctcagcttctcagtctctctccgttcttcctctagcttccttccctccccagaagacccagcccttcctagagccccagaagccagggttcatgccccagctctctacccacacatgctgtgcaaccctgggccagtcactggtctcttgggcctcagttcaacagatggctgtcttggtgatgtgagatcatagggtggaagcacccagaatggtgccaggcactc

SEQ ID NO: 427948 - DNA, 1377 bp, Homo sapiens
ggctggtacggtccggagtgttaggacaatgtcaagggagggggctcacccagggctcctgtagctcagggggcaggcctgagccctgcacccgccccacgaccgtccagcccctgacggggcaccccatcctgaggggctctgcattggcccccaccgaggcaggggatctgaccgactcggagcccggctggatgttacaggcgtgcaaaatggaagggtttcccctcgtcccccctcagccatcagaagacctggtgccctatgacacggatctataccaacgccaaacgcacgagtattacccctatctcagcagtgatggggagagccatagcgaccattactgggacttccacccccaccacgtgcacagcgagttcgagagcttcgccgagaacaacttcacggagctccagagcgtgcagcccccgcagctgcagcagctctaccgccacatggagctggagcagatgcacgtcctcgatacccccatggtgccaccccatcccagtcttggccaccaggtctcctacctgccccggatgtgcctccagtacccatccctgtccccagcccagcccagctcagatgaggaggagggcgagcggcagagccccccactggaggtgtctgacggcgaggcggatggcctggagcccgggcctgggctcctgcctggggagacaggcagcaagaagaagatccgcctgtaccagttcctgttggacctgctccgcagcggcgacatgaaggacagcatctggtgggtggacaaggacaagggcaccttccagttctcgtccaagcacaaggaggcgctggcgcaccgctggggcatccagaagggcaaccgcaagaagatgacctaccagaagatggcgcgcgcgctgcgcaactacggcaagacgggcgaggtcaagaaggtgaagaagaagctcacctaccagttcagcggcgaagtgctgggccgcgggggcctggccgagcggcgccacccgccccactgagcccgcagcccccgccgggccccgccaggcctccccgctggccatagcattaagccctcgcccggcccggacacagggaggacgctcccggggcccagaggcaggactgtggcgggccgggcctcgcctcacccgccccctccccccactccaggccccctccacatcccgcttcgcctccctccaggactccaccccggctcccggacgccagctgggcgtcagaccccaccggggcaaccttgcagaggacgacccggggtactgccttgggagtctcaagtccgtatgtaaatcagatctcccctctcacccctcccacccattaacctcctcccaaaaaacaagtaaagttattctcaatcca

SEQ ID NO: 427949 - DNA, 1421 bp, Homo sapiens
aaaatcaggaacttgtgctggccctgcaatgtcaagggagggggctcacccagggctcctgtagctcagggggcaggcctgagccctgcacccgccccacgaccgtccagcccctgacggggcaccccatcctgaggggctctgcattggcccccaccgaggcaggggatctgaccgactcggagcccggctggatgttacaggcgtgcaaaatggaagggtttcccctcgtcccccctcagccatcagaagacctggtgccctatgacacggatctataccaacgccaaacgcacgagtattacccctatctcagcagtgatggggagagccatagcgaccattactgggacttccacccccaccacgtgcacagcgagttcgagagcttcgccgagaacaacttcacggagctccagagcgtgcagcccccgcagctgcagcagctctaccgccacatggagctggagcagatgcacgtcctcgatacccccatggtgccaccccatcccagtcttggccaccaggtctcctacctgccccggatgtgcctccagtacccatccctgtccccagcccagcccagctcagatgaggaggagggcgagcggcagagccccccactggaggtgtctgacggcgaggcggatggcctggagcccgggcctgggctcctgcctggggagacaggcagcaagaagaagatccgcctgtaccagttcctgttggacctgctccgcagcggcgacatgaaggacagcatctggtgggtggacaaggacaagggcaccttccagttctcgtccaagcacaaggaggcgctggcgcaccgctggggcatccagaagggcaaccgcaagaagatgacctaccagaagatggcgcgcgcgctgcgcaactacggcaagacgggcgaggtcaagaaggtgaagaagaagctcacctaccagttcagcggcgaagtgctgggccgcgggggcctggccgagcggcgccacccgccccactgagcccgcagcccccgccgggccccgccaggcctccccgctggccatagcattaagccctcgcccggcccggacacagggaggacgctcccggggcccagaggcaggactgtggcgggccgggcctcgcctcacccgccccctccccccactccaggccccctccacatcccgcttcgcctccctccaggactccaccccggctcccggacgccagctgggcgtcagaccccaccggggcaaccttgcagaggacgacccggggtactgccttgggagtctcaagtccgtatgtaaatcagatctcccctctcacccctcccacccattaacctcctcccaaaaaacaagtaaagttattctcaatccatcctcttgcagcacagagtctcttttaaaatttgttgtgtatct

SEQ ID NO: 427950 - DNA, 1757 bp, Homo sapiens
agcagctgcctctgggtggtggcagagatgcccatgtctaggacctccaggccttaactaatcaggggcactgatgaagccagcggggctccactggggaccacaggcaagactgggccaggacgaggcggtcacgcagagaaagaagataaaagggaacagaagagaaaattcaaaaggagcacgggcctccccgggagtgggcttcagcctccctagactcctgtctccttccaagggctaggcctgggggaccagaagcaagagtccctagagcgtccaagatttttggtttcaaaccaatttcctgctgaccagaatgaaatggagccacattccagcacgatgcacctgctgacctcctgcccagaccatggaagacactcaataaaaacagaggggactcaccagagatcactgggccagaaaaacaacaacaacaacaacaacaacaaaacaaaaatgcctctactcatccctccaccccccagaaaagatcaggaactctctgaagcaacatggatggaattggaggacattatcatatgcgaaacaacgcagaaacagaaagtcaaatactgcctgttctcatggggctcctggaaaccgaagctgatagcagccatcagaagacctggtgccctatgacacggatctataccaacgccaaacgcacgagtattacccctatctcagcagtgatggggagagccatagcgaccattactgggacttccacccccaccacgtgcacagcgagttcgagagcttcgccgagaacaacttcacggagctccagagcgtgcagcccccgcagctgcagcagctctaccgccacatggagctggagcagatgcacgtcctcgatacccccatggtgccaccccatcccagtcttggccaccaggtctcctacctgccccggatgtgcctccagtacccatccctgtccccagcccagcccagctcagatgaggaggagggcgagcggcagagccccccactggaggtgtctgacggcgaggcggatggcctggagcccgggcctgggctcctgcctggggagacaggcagcaagaagaagatccgcctgtaccagttcctgttggacctgctccgcagcggcgacatgaaggacagcatctggtgggtggacaaggacaagggcaccttccagttctcgtccaagcacaaggaggcgctggcgcaccgctggggcatccagaagggcaaccgcaagaagatgacctaccagaagatggcgcgcgcgctgcgcaactacggcaagacgggcgaggtcaagaaggtgaagaagaagctcacctaccagttcagcggcgaagtgctgggccgcgggggcctggccgagcggcgccacccgccccactgagcccgcagcccccgccgggccccgccaggcctccccgctggccatagcattaagccctcgcccggcccggacacagggaggacgctcccggggcccagaggcaggactgtggcgggccgggcctcgcctcacccgccccctccccccactccaggccccctccacatcccgcttcgcctccctccaggactccaccccggctcccggacgccagctgggcgtcagaccccaccggggcaaccttgcagaggacgacccggggtactgccttgggagtctcaagtccgtatgtaaatcagatctcccctctcacccctcccacccattaacctcctcccaaaaaacaagtaaagttattctcaatcca

SEQ ID NO: 427951 - DNA, 1704 bp, Homo sapiens
aaaatcaggaacttgtgctggccctgcaatgtcaagggagggggctcacccagggctcctgtagctcagggggcaggcctgagccctgcacccgccccacgaccgtccagcccctgacggggcaccccatcctgaggggctctgcattggcccccaccgaggcaggggatctgaccgactcggagcccggctggatgttacaggcgtgcaaaatggaagggtttcccctcgtcccccctcagccatcagaagacctggtgccctatgacacggatctataccaacgccaaacgcacgagtattacccctatctcagcagtgatggggagagccatagcgaccattactgggacttccacccccaccacgtgcacagcgagttcgagagcttcgccgagaacaacttcacggagctccagagcgtgcagcccccgcagctgcagcagctctaccgccacatggagctggagcagatgcacgtcctcgatacccccatggtgccaccccatcccagtcttggccaccaggtctcctacctgccccggatgtgcctccagtacccatccctgtccccagcccagcccagctcagatgaggaggagggcgagcggcagagccccccactggaggtgtctgacggcgaggcggatggcctggagcccgggcctgggctcctgcctggggagacaggtggggcacctggccctccaccctggccccgaccctggccgtgtctgtgccctgaccccacccagccaggccaactgacccagcagccacgccaccgagtcgcgtgtgtgtgtgtgtgcatgtttgccagtgtgtgtgttttgtggggctgtctgtggctgtctctgtgtgtgtgtatctgctgtgtagtgcatacgggcatctccatgaagtgtgccaggtgtgtgtgtctctctgtgccatgagtgtgtgtacatctgggtgtgtgtgagcaagtgtgcagagggtgcgtgtgcacaggtacgggcaggtgcatgtgtgcgagtggctgtgtgagtgggtgtgtgagaaggtgaatgtgagagctggtgtggctgagagtgggtgtggccatgtttgtgtgtctgtcaacacatgaatgtatttcagtgcgtgtgagcagctgtgcacgtatgatgtcagtgggtgtcagcagtgtgtgggtgtgcctgtgtgagcagggatgtgagcatggtatatgtgagtggctgtaagcaggcatgtgtgagtgatatgtgtgagtgggggtgtgacagcaggtgtgtgagcaagtgtatatgtgtgaatgtgtatgtaagcagggatgtgtgtgatataagtgtgtgtgaatgggcataggtgtgtgtcagtggatgtgtgagtgggtgtgaacatgtttgagggtgtatgtaagcaggtgtgtgtgagcaggaaggtgtgagctggggtgtgtgagcatgtatgtgtatatgtgagcaggtttgtgcatgtatgtgagtggatatgtgttttaacatgtgtaagcatgtgtgtgttcccatgtgtgagcaggtgtgtgtggggggtgaggacgtgcttaagcacctgcgtgtgtgagcaggtgtgcatgtgtgtgaacaggtatgtgtatgtgtgaaagcaggtgtgtgaatgagtgtgtgagcatgaatgggtgtgagtgggccgggcgtggtggctcacgcctgtatcccagca

SEQ ID NO: 427952 - DNA, 664 bp, Homo sapiens
aaaatcaggaacttgtgctggccctgcaatgtcaagggagggggctcacccagggctcctgtagctcagggggcaggcctgagccctgcacccgccccacgaccgtccagcccctgacggggcaccccatcctgaggggctctgcattggcccccaccgaggcaggggatctgaccgactcggagcccggctggatgttacaggcgtgcaaaatggaagggtttcccctcgtcccccctcagccatcagaagacctggtgccctatgacacggatctataccaacgccaaacgcacgagtattacccctatctcagcagtgatggggagagccatagcgaccattactgggacttccacccccaccacgtgcacagcgagttcgagagcttcgccgagaacaacttcacggagctccagagcgtgcagcccccgcagctgcagcagctctaccgccacatggagctggagcagatgcacgtcctcgatacccccatggtgccaccccatcccagtcttggccaccaggtctcctacctgccccggatgtgcctccagtacccatccctgtccccagcccagcccagtctctacaaaatgccttgcagccgaggtgtggtggaaagaatattgtatttggaataaaaaatttttgattttgcaaa

SEQ ID NO: 427953 - DNA, 577 bp, Homo sapiens
catggaagacactcaataaaaagtaagtgattaaatgacaacctctacggaaaagagtatggagatttctcaaagaactaaaaacagaactaccttttggccagatgcagtggctcacacctataatcccaacatttgggaaggctgaggcaggtggattgcttgagcccaggagttcaagatcagcctgggcaacatggtgaaaccctatctctacaaaaaatacagaaaattagatgagactacaggtggcacacatccatagtaccagctactccagaggctgaggcgggaggatcgcttgagcccaggaggtccaggctacagtgggccaagatcacgccattgcactccagcctcagtgataaagtggcattctgtctcaaaagaaaaagaactggccaagcatggtggctcacgtctgtaatcccagcactttgggaggccgaggcaggtggatcacatgagatcaggagtttgagactagcctggccaacaatgatgaaaccccatctctactaaaaatacaataattagctgggcgtggtggcgggcgcctgtaatcccagctactcag

SEQ ID NO: 427954 - DNA, 1377 bp, Homo sapiens
aaaatcaggaacttgtgctggccctgcaatgtcaagggagggggctcacccagggctcctgtagctcagggggcaggcctgagccctgcacccgccccacgaccgtccagcccctgacggggcaccccatcctgaggggctctgcattggcccccaccgaggcaggggatctgaccgactcggagcccggctggatgttacaggcgtgcaaaatggaagggtttcccctcgtcccccctcagccatcagaagacctggtgccctatgacacggatctataccaacgccaaacgcacgagtattacccctatctcagcagtgatggggagagccatagcgaccattactgggacttccacccccaccacgtgcacagcgagttcgagagcttcgccgagaacaacttcacggagctccagagcgtgcagcccccgcagctgcagcagctctaccgccacatggagctggagcagatgcacgtcctcgatacccccatggtgccaccccatcccagtcttggccaccaggtctcctacctgccccggatgtgcctccagtacccatccctgtccccagcccagcccagctcagatgaggaggagggcgagcggcagagccccccactggaggtgtctgacggcgaggcggatggcctggagcccgggcctgggctcctgcctggggagacaggcagcaagaagaagatccgcctgtaccagttcctgttggacctgctccgcagcggcgacatgaaggacagcatctggtgggtggacaaggacaagggcaccttccagttctcgtccaagcacaaggaggcgctggcgcaccgctggggcatccagaagggcaaccgcaagaagatgacctaccagaagatggcgcgcgcgctgcgcaactacggcaagacgggcgaggtcaagaaggtgaagaagaagctcacctaccagttcagcggcgaagtgctgggccgcgggggcctggccgagcggcgccacccgccccactgagcccgcagcccccgccgggccccgccaggcctccccgctggccatagcattaagccctcgcccggcccggacacagggaggacgctcccggggcccagaggcaggactgtggcgggccgggcctcgcctcacccgccccctccccccactccaggccccctccacatcccgcttcgcctccctccaggactccaccccggctcccggacgccagctgggcgtcagaccccaccggggcaaccttgcagaggacgacccggggtactgccttgggagtctcaagtccgtatgtaaatcagatctcccctctcacccctcccacccattaacctcctcccaaaaaacaagtaaagttattctcaatcca

SEQ ID NO: 427955 - DNA, 1542 bp, Homo sapiens
cacggagctccagagcgtgcagcccccgcagctgcagcagctctaccgccacatggagctggagcagatgcacgtcctcgatacccccatggtgccaccccatcccagtcttggccaccaggtctcctacctgccccggatgtgcctccagtacccatccctgtcctcatctgagctgggctgggctggggcaatgtcaagggagggggctcacccagggctcctgtagctcagggggcaggcctgagccctgcacccgccccacgaccgtccagcccctgacggggcaccccatcctgaggggctctgcattggcccccaccgaggcaggggatctgaccgactcggagcccggctggatgttacaggcgtgcaaaatggaagggtttcccctcgtcccccctcagccatcagaagacctggtgccctatgacacggatctataccaacgccaaacgcacgagtattacccctatctcagcagtgatggggagagccatagcgaccattactgggacttccacccccaccacgtgcacagcgagttcgagagcttcgccgagaacaacttcacggagctccagagcgtgcagcccccgcagctgcagcagctctaccgccacatggagctggagcagatgcacgtcctcgatacccccatggtgccaccccatcccagtcttggccaccaggtctcctacctgccccggatgtgcctccagtacccatccctgtccccagcccagcccagctcagatgaggaggagggcgagcggcagagccccccactggaggtgtctgacggcgaggcggatggcctggagcccgggcctgggctcctgcctggggagacaggcagcaagaagaagatccgcctgtaccagttcctgttggacctgctccgcagcggcgacatgaaggacagcatctggtgggtggacaaggacaagggcaccttccagttctcgtccaagcacaaggaggcgctggcgcaccgctggggcatccagaagggcaaccgcaagaagatgacctaccagaagatggcgcgcgcgctgcgcaactacggcaagacgggcgaggtcaagaaggtgaagaagaagctcacctaccagttcagcggcgaagtgctgggccgcgggggcctggccgagcggcgccacccgccccactgagcccgcagcccccgccgggccccgccaggcctccccgctggccatagcattaagccctcgcccggcccggacacagggaggacgctcccggggcccagaggcaggactgtggcgggccgggcctcgcctcacccgccccctccccccactccaggccccctccacatcccgcttcgcctccctccaggactccaccccggctcccggacgccagctgggcgtcagaccccaccggggcaaccttgcagaggacgacccggggtactgccttgggagtctcaagtccgtatgtaaatcagatctcccctctcacccctcccacccattaacctcctcccaaaaaacaagtaaagttattctcaatcca

SEQ ID NO: 427956 - DNA, 1056 bp, Homo sapiens
caagggagggggctcacccagggctcctgtagctcagggggcaggcctgagccctgcacccgccccacgaccgtccagcccctgacgggcaccccatcctgaggggctctgcattggcccccaccgaggcaggggatctgaccgactcggagcccggctggatgttacaggcgtgcaaaatggaagggtttcccctcgtcccccctgtctcctacctgccccggatgtgcctccagtacccatccctgtccccagcccagcccagctcagatgaggaggagggcgagcggcagagccccccactggaggtgtctgacggcgaggcggatggcctggagcccgggcctgggctcctgcctggggagacaggcagcaagaagaagatccgcctgtaccagttcctgttggacctgctccgcagcggcgacatgaaggacagcatctggtgggtggacaaggacaagggcaccttccagttctcgtccaagcacaaggaggcgctggcgcaccgctggggcatccagaagggcaaccgcaagaagatgacctaccagaagatggcgcgcgcgctgcgcaactacggcaagacgggcgaggtcaagaaggtgaagaagaagctcacctaccagttcagcggcgaagtgctgggccgcgggggcctggccgagcggcgccacccgccccactgagcccgcagcccccgccgggccccgccaggcctccccgctggccatagcattaagccctcgcccggcccggacacagggaggacgctcccggggcccagaggcaggactgtggcgggccgggcctcgcctcacccgccccctccccccactccaggccccctccacatcccgcttcgcctccctccaggactccaccccggctcccggacgccagctgggcgtcagaccccaccggggcaaccttgcagaggacgacccggggtactgccttgggagtctcaagtccgtatgtaaatcagatctcccctctcacccctcccacccattaacctcctcccaaaaaacaagtaaagttattctcaatcca

SEQ ID NO: 427957 - DNA, 897 bp, Homo sapiens
aaaatcaggaacttgtgctggccctgcaatgtcaagggagggggctcacccagggctcctgtagctcagggggcaggcctgagccctgcacccgccccacgaccgtccagcccctgacggggcaccccatcctgaggggctctgcattggcccccaccgaggcaggggatctgaccgactcggagcccggctggatgttacaggcgtgcaaaatggaagggtttcccctcgtcccccctcagccatcagaagacctggtgccctatgacacggatctataccaacgccaaacgcacgagtattacccctatctcagcagtgatggggagagccatagcgaccattactgggacttccacccccaccacgtgcacagcgagttcgagagcttcgccgagaacaacttcacggagctccagagcgtgcagcccccgcagctgcagcagctctaccgccacatggagctggagcagatgcacgtcctcgatacccccatggtgccaccccatcccagtcttggccaccaggtctcctacctgccccggatgtgcctccagtacccatccctgtccccagcccagcccagaaggacaagggcaccttccagttctcgtccaagcacaaggaggcgctggcgcaccgctggggcatccagaagggcaaccgcaagaagatgacctaccagaagatggcgcatcccgcttcgcctccctccaggactccaccccggctcccggacgccagctgggcgtcagaccccaccggggcaaccttgcagaggacgacccggggtactgccttgggagtctcaagtccgtatgtaaatcagatctcccctctcacccctcccacccattaacctcctcccaaaaaacaagtaaagttattctcaatcca

SEQ ID NO: 427958 - DNA, 557 bp, Homo sapiens
ggctggtacggtccggagtgttaggacaatgtcaagggagggggctcacccagggctcctgtagctcagggggcaggcctgagccctgcacccgccccacgaccgtccagcccctgacggggcaccccatcctgaggggctctgcattggcccccaccgaggcaggggatctgaccgactcggagcccggctggatgttacaggcgtgcaaaatggaagggtttcccctcgtcccccctcagccatcagaagacctggtgccctatgacacggatctataccaacgccaaacgcacgagtattacccctatctcagcagtgatggggagagccatagcggtgagtacggggcctgccacgcccccatcccccagcccagcctgggctcctggggtctggagagagaaaaagaataaatgattcccaggacttctttggaattctgagaatcagatcaagtttgctctcaaaggcagtgaactgcagcatcatcgctgcacccccacacctgagcctccattatggagcctctgcagtgtgtcaaggtgcggggttca

SEQ ID NO: 427959 - DNA, 1659 bp, Homo sapiens
ggcccgcgcgtcccggccgggctgcggcggagcgagcggggccagcgctgcagaaggcggcggctggctctccgggacggtcacatcccgctgcaggggcgggcggaggccgccgcactgcctcccgcaccggggacccaggccagcgtccgggcaacgccccctgctcccggacagactccgtggcccgctcgagccctgggggctccgcagacccgcgcccgctccgcccgcagctcggccccgcgctgcccgcgtcgccgggcccgcgccgggatggggtaggggcagcgccaccgagtcgggcgatgggccgccctctgggcaccgagcagccccccgaggcctgaccaaccgcgaggaccggcggaggagccccgcctggatgtcaagcggatgccaagcggatgccacagttccccccccagcggactccgtggggacatggcttcgctggtgcccctttccccatatctaagccccacggtcctcctgctggtcagctgtgacctgggcttcgtgcgagcagaccggcctccctctcctgtgaatgtgacggtcactcacctcagagccaactcggccactgtgtcctgggacgtcccagaaggcaacatcgtcattggctactccatttcccagcaacggcagaatggccccgggcagcgtgtgattcgggaggtgaacaccaccacccgggcctgtgccctctggggcctggctgaagacagtgactacacagtgcaggtcaggagcatcggccttcggggagagagtcccccagggccccgggtgcacttccgaactctcaagggttctgaccggctaccttcaaacagttcaagcccaggtgacatcacagtggaaggtctggatggagagcggccactgcagactggggaagtggtcatcattgtggtggtgttgctcatgtgggctgctgtaattgggctgttctgccgtcagtatgacatcatcaaggacaatgactccaacaacaatcccaaggagaagggaaaggggccggaacagagtcctcagggaaggccagtggggacaagacagaaaaagtcaccatctatcaacaccatcgacgtttgagtgaagaaacacacccagaagagagatgcactaacaactggggatagggatggggtcagggggagcccaagatggtgatctgcccgagactcccagagggtaatgccactcccacaatctcaggcctggtacccatcctctttccactgtgagcagagccagaaggtaggtctgttcagagtctgtgcccctggacctggggagtggatatcagatgggatatctccttccattccccggtccaggggagagtcactagttgtaccctactccattaggtcccaaatgggggccccatttcacctgtatcaggactctgagcatccccagctgccccacatcttgcctctggccctcagagaggggtgtttctgtgggtactcctcttaccccagcaaataaaaggaattgtctgaccctagaggcagatgctgcactgcactactccaatgtcttccatggagcctcaggtgctccccctctcacctggcagccccttcagctgctagtgatatcacttgttggacatttttccaataaaggttcttggacaaactg

SEQ ID NO: 427960 - DNA, 2205 bp, Homo sapiens
  misc_feature (2205)..(2205): n is a, c, g, or t
ggcccgcgcgtcccggccgggctgcggcggagcgagcggggccagcgctgcagaaggcggcggctggctctccgggacggtcacatcccgctgcaggggcgggcggaggccgccgcactgcctcccgcaccggggacccaggccagcgtccgggcaacgccccctgctcccggacagactccgtggcccgctcgagccctgggggctccgcagacccgcgcccgctccgcccgcagctcggccccgcgctgcccgcgtcgccgggcccgcgccgggatggggtaggggcagcgccaccgagtcgggcgatgggccgccctctgggcaccgagcagccccccgaggcctgaccaaccgcgaggaccggcggaggagccccgcctggatgtcaagcggatgccaagcggatgccacagttccccccccagcggactccgtggggacatggcttcgctggtgcccctttccccatatctaagccccacggtcctcctgctggtcagctgtgacctgggcttcgtgcgagcagaccggcctccctctcctgtgaatgtgacggtcactcacctcagagccaactcggccactgtgtcctgggacgtcccagaaggcaacatcgtcattggctactccatttcccagcaacggcagaatggccccgggcagcgtgtgattcgggaggtgaacaccaccacccgggcctgtgccctctggggcctggctgaagacagtgactacacagtgcaggtcaggagcatcggccttcggggagagagtcccccagggccccgggtgcacttccgaactctcaagggttctgaccggctaccttcaaacagttcaagcccaggtgacatcacagtggaaggtctggatggagagcggccactgcagactggggaagtggtcatcattgtggtggtgttgctcatgtgggctgctgtaattgggctgttctgccgtcagtatgacatcatcaaggacaatgactccaacaacaatcccaaggagaagggaaaggggccggaacagagtcctcagggaaggccagtggggacaagacagaaaaagtcaccatctatcaacaccatcgacgtttgagtgaagaaacacacccagaagagagatgcactaacaactggggatagggatggggtcagggggagcccaagatggtgatctgcccgagactcccagagggtaatgccactcccacaatctcaggcctggtacccatcctctttccactgtgagcagagccagaaggtaggtctgttcagagtctgtgcccctggacctggggagtggatatcagatgggatatctccttccattccccggtccaggggagagtcactagttgtaccctactccattaggtcccaaatgggggccccatttcacctgtatcaggactctgagcatccccagctgccccacatcttgcctctggccctcagagaggggtgtttctgtgggtactcctcttaccccagcaaataaaaggaattgtctgaccctagaggcagatgctgcactgcactactccaatgtcttccatggagcctcaggtgctccccctctcacctggcagccccttcagctgctagtgatatcacttgttggacatttttccaataaaggttcttggacaaactgaaaaaaaaaaaaaaaaaaaaaaaaaaaaaaaaaaaaaaaaaaaaggggggcggcgcgcgcctccaagaatttccccccgccgaggggcgccccagatctttcgcgctgctcccccgcgttttttttgtacaaaggggcgcccccaaatagggagggggtccgatattataaaaggcccggagggccgggcgggcgccgcccgtttaaaacaaccgctctctcgcggcgcgggcgagcaacactggcgtaccgcggggagactcttggggagagggagacccccttcaacttcgcgggggggcgcgccactatatgtgtggggacacaccctccctaccagagaagattattaaagccgccctctaagggggagacatatatctaacactttttacacggcgtattatacgtgttggtcaacacaccaacgccgcggaaataaatcgttgccccgggctaagaaaagttgtgggcaccacggacagttattactattcaccggacacattttttcatccccgggggccttcttttcataaataaggn

SEQ ID NO: 427961 - DNA, 1875 bp, Homo sapiens
ggcccgcgcgtcccggccgggctgcggcggagcgagcggggccagcgctgcagaaggcggcggctggctctccgggacggtcacatcccgctgcaggggcgggcggaggccgccgcactgcctcccgcaccggggacccaggccagcgtccgggcaacgccccctgctcccggacagactccgtggcccgctcgagccctgggggctccgcagacccgcgcccgctccgcccgcagctcggccccgcgctgcccgcgtcgccgggcccgcgccgggatggggtaggggcagcgccaccgagtcgggcgatgggccgccctctgggcaccgagcagccccccgaggcctgaccaaccgcgaggaccggcggaggagccccgcctggatgtcaagcggatgccaagcggatgccacagttccccccccagcggactccgtggggacatggcttcgctggtgcccctttccccatatctaagccccacggtcctcctgctggtcagctgtgacctgggcttcgtgcgagcagaccggcctccctctcctgtgaatgtgacggtcactcacctcagagccaactcggccactgtgtcctgggacgtcccagaaggcaacatcgtcattggctactccatttcccagcaagtatgaatcacccttctgctcccccaacctgtgtccttggatttcggcacatttcttcacttaagtgggggggatctggaagctggcgtatcctggctcaggctgcccttttcacgctactcccccggagtgcttggatgttgaagagtctctggttgagccttgtggcctggcactggggtgaggctgtcctcctctcccctcatctccctgcagcggcagaatggccccgggcagcgtgtgattcgggaggtgaacaccaccacccgggcctgtgccctctggggcctggctgaagacagtgactacacagtgcaggtcaggagcatcggccttcggggagagagtcccccagggccccgggtgcacttccgaactctcaagggttctgaccggctaccttcaaacagttcaagcccaggtgacatcacagtggaaggtctggatggagagcggccactgcagactggggaagtggtcatcattgtggtggtgttgctcatgtgggctgctgtaattgggctgttctgccgtcagtatgacatcatcaaggacaatgactccaacaacaatcccaaggagaagggaaaggggccggaacagagtcctcagggaaggccagtggggacaagacagaaaaagtcaccatctatcaacaccatcgacgtttgagtgaagaaacacacccagaagagagatgcactaacaactggggatagggatggggtcagggggagcccaagatggtgatctgcccgagactcccagagggtaatgccactcccacaatctcaggcctggtacccatcctctttccactgtgagcagagccagaaggtaggtctgttcagagtctgtgcccctggacctggggagtggatatcagatgggatatctccttccattccccggtccaggggagagtcactagttgtaccctactccattaggtcccaaatgggggccccatttcacctgtatcaggactctgagcatccccagctgccccacatcttgcctctggccctcagagaggggtgtttctgtgggtactcctcttaccccagcaaataaaaggaattgtctgaccctagaggcagatgctgcactgcactactccaatgtcttccatggagcctcaggtgctccccctctcacctggcagccccttcagctgctagtgatatcacttgttggacatttttccaataaaggttcttggacaaactg

SEQ ID NO: 427962 - DNA, 1731 bp, Homo sapiens
ggcccgcgcgtcccggccgggctgcggcggagcgagcggggccagcgctgcagaaggcggcggctggctctccgggacggtcacatcccgctgcaggggcgggcggaggccgccgcactgcctcccgcaccggggacccaggccagcgtccgggcaacgccccctgctcccggacagactccgtggcccgctcgagccctgggggctccgcagacccgcgcccgctccgcccgcagctcggccccgcgctgcccgcgtcgccgggcccgcgccgggatggggtaggggcagcgccaccgagtcgggcgatgggccgccctctgggcaccgagcagccccccgaggcctgaccaaccgcgaggaccggcggaggagccccgcctggatgtcaagcggatgccaagcggatgccacagttccccccccagcggactccgtggggacatggcttcgctggtgcccctttccccatatctaagccccacggtcctcctgctggtcagctgtgacctgggcttcgtgcgagcagaccggcctccctctcctgtgaatgtgacggtcactcacctcagagccaactcggccactgtgtcctgggacgtcccagaaggcaacatcgtcattggctactccatttcccagcaacggcagaatggccccgggcagcgtgtgattcgggaggtgaacaccaccacccgggcctgtgccctctggggcctggctgaagacagtgactacacagtgcaggtcaggagcatcggccttcggggagagagtcccccagggccccgggtgcacttccgaactctcaagggttctgaccggctaccttcaaacagttcaagcccaggtgacatcacagtggaaggtctggatggagagcggccactgcagactggggaagtggtcatcattgtggtggtgttgctcatgtgggctgctgtaattgggctgttctgccgtcagtatgacatcatcaaggacaatgactccaacaacaatcccaaggagaagggaaaggggccggaacagagtcctcagggaaggccagtggggacaagacagaaaaagtcaccatctatcaacaccatcgacgtttgagtgaagaaacacacccagaagagagatgcactaacaactggggatagggatggggtcagggggagcccaagatggtgatctgcccgagactcccagagggtaatgccactcccacaatctcaggcctggtacccatcctctttccactgtgagcagagccagaaggtaggtctgttcagagtctgtgcccctggacctggggagtggatatcagatgggatatctccttccattccccggtccaggggagagtcactagttgtaccctactccattaggtcccaaatgggggccccatttcacctgtatcaggactctgagcatccccagctgccccacatcttgcctctggccctcagagaggggtgtttctgtgggtactcctcttaccccagcaaataaaaggaattgtctgaccctagaggcagatgctgcactgcactactccaatgtcttccatggagcctcaggtgctccccctctcacctggcagccccttcagctgctagtgatatcacttgttggacatttttccaataaaggttcttggacaaactggatacaatacaaggcgactgtagggggatactctaagagacggccaacaggcattccaggtgcactgccgca

SEQ ID NO: 427963 - DNA, 1528 bp, Homo sapiens
ggcccgcgcgtcccggccgggctgcggcggagcgagcggggccagcgctgcagaaggcggcggctggctctccgggacggtcacatcccgctgcaggggcgggcggaggccgccgcactgcctcccgcaccggggacccaggccagcgtccgggcaacgccccctgctcccggacagactccgtggcccgctcgagccctgggggctccgcagacccgcgcccgctccgcccgcagctcggccccgcgctgcccgcgtcgccgggcccgcgccgggatggggtaggggcagcgccaccgagtcgggcgatgggccgccctctgggcaccgagcagccccccgaggcctgaccaaccgcgaggaccggcggaggagccccgcctggatgtcaagcggatgccaagcggatgccacagttccccccccagcggactccgtggggacatggcttcgctggtgcccctttccccatatctaagccccacggtcctcctgctggtcagctgtgacctgggcttcgtgcgagcagaccggcctccctctcctgtgaatgtgacggtcactcacctcagagccaactcggccactgtgtcctgggacgtcccagaaggcaacatcgtcattggctactccatttcccagcaagtatgaatcacccttctgctcccccaacctgtgtccttggatttcggcacatttcttcacttaagtgggggggatctggaagctggcgtatcctggctcaggctgcccttttcacgctactcccccggagtgcttggatgttgaagagtctctggttgagccttctgtaattgggctgttctgccgtcagtatgacatcatcaaggacaatgactccaacaacaatcccaaggagaagggaaaggggccggaacagagtcctcagggaaggccagtggggacaagacagaaaaagtcaccatctatcaacaccatcgacgtttgagtgaagaaacacacccagaagagagatgcactaacaactggggatagggatggggtcagggggagcccaagatggtgatctgcccgagactcccagagggtaatgccactcccacaatctcaggcctggtacccatcctctttccactgtgagcagagccagaaggtaggtctgttcagagtctgtgcccctggacctggggagtggatatcagatgggatatctccttccattccccggtccaggggagagtcactagttgtaccctactccattaggtcccaaatgggggccccatttcacctgtatcaggactctgagcatccccagctgccccacatcttgcctctggccctcagagaggggtgtttctgtgggtactcctcttaccccagcaaataaaaggaattgtctgaccctagaggcagatgctgcactgcactactccaatgtcttccatggagcctcaggtgctccccctctcacctggcagccccttcagctgctagtgatatcacttgttggacatttttccaataaaggttcttggacaaactg

SEQ ID NO: 427964 - DNA, 1331 bp, Homo sapiens
ggcccgcgcgtcccggccgggctgcggcggagcgagcggggccagcgctgcagaaggcggcggctggctctccgggacggtcacatcccgctgcaggggcgggcggaggccgccgcactgcctcccgcaccggggacccaggccagcgtccgggcaacgccccctgctcccggacagactccgtggcccgctcgagccctgggggctccgcagacccgcgcccgctccgcccgcagctcggccccgcgctgcccgcgtcgccgggcccgcgccgggatggggtaggggcagcgccaccgagtcgggcgatgggccgccctctgggcaccgagcagccccccgaggcctgaccaaccgcgaggaccggcggaggagccccgcctggatgtcaagcggatgccaagcggatgccacagttccccccccagcggactccgtggggacatggcttcgctggtgcccctttccccatatctaagccccacggtcctcctgctggtcagctgtgacctgggcttcgtgcgagcagaccggcctccctctcctgtgaatgtgacggtcactcacctcagagccaactcggccactgtgtcctgggacgtcccagaaggcaacatcgtcattggctactccatttcccagcaacggcagaatggccccgggcagcgtgtgattcgggaggtgaacaccaccacccgggcctgtgccctctggggcctggctgaagacagtgactacacagtgcaggtcaggagcatcggccttcggggagagagtcccccagggccccgggtgcacttccgaactctcaagggttctgaccggctaccttcaaacagttcaagcccaggtgacatcacagtggaaggtctggatggagagcggccaaatctcaggcctggtacccatcctctttccactgtgagcagagccagaaggtaggtctgttcagagtctgtgcccctggacctggggagtggatatcagatgggatatctccttccattccccggtccaggggagagtcactagttgtaccctactccattaggtcccaaatgggggccccatttcacctgtatcaggactctgagcatccccagctgccccacatcttgcctctggccctcagagaggggtgtttctgtgggtactcctcttaccccagcaaataaaaggaattgtctgaccctagaggcagatgctgcactgcactactccaatgtcttccatggagcctcaggtgctccccctctcacctggcagccccttcagctgctagtgatatcacttgttggacatttttccaataaaggttcttggacaaactg

SEQ ID NO: 427965 - DNA, 1396 bp, Homo sapiens
ggcccgcgcgtcccggccgggctgcggcggagcgagcggggccagcgctgcagaaggcggcggctggctctccgggacggtcacatcccgctgcaggggcgggcggaggccgccgcactgcctcccgcaccggggacccaggccagcgtccgggcaacgccccctgctcccggacagactccgtggcccgctcgagccctgggggctccgcagacccgcgcccgctccgcccgcagctcggccccgcgctgcccgcgtcgccgggcccgcgccgggatggggtaggggcagcgccaccgagtcgggcgatgggccgccctctgggcaccgagcagccccccgaggcctgaccaaccgcgaggaccggcggaggagccccgcctggatgtcaagcggatgccaagcggatgccacagttccccccccagcggactccgtggggacatggcttcgctggtgcccctttccccatatctaagccccacggtcctcctgctggtcagctgtgacctgggcttcgtgcgagcagaccggcctccctctcctgtgaatgtgacggtcactcacctcagagccaactcggccactgtgtcctgggacgtcccagaaggcaacatcgtcattggctactccatttcccagcaacggcagaatggccccgggcagcgtgtgattcgggaggtgaacaccaccacccgggcctgtgccctctggggcctggctgaagacagtgactacacagtgcaggtcaggagcatcggccttcggggagagagtcccccagggccccgggtgcacttccgaactctcaagggttctgaccggctaccttcaaacagttcaagcccaggtgacatcacagtggaaggtctggatggagagcggccactgcagactggggaagtggtcatcattgtggtggtgttgctcatgtgggctgctgtaattgggctgttctgccgtcagtatgacatcatcaaggacaatgactccaacaacaatcccaaggagaagggaaaggggccggaacagagtcctcagggaaggccagtggggacaagacagaaaaagtcaccatctatcaacaccatcgacgtttgagtgaagaaacacacccagaagagagatgcactaacaactggggatagggatggggtcagggggagcccaagatggtgatctgcccgagactcccagagggtaatgccactcccacaatctcaggcctggtacccatcctctttcctaagttcacctggctctgaacttagggacagactattagaaacaagagaacaagataatttctgatggttaaaaataatgagaggggccgggcgcagtggctcacgcctgtaatcccagcactttgggaggccgaagcaggtggatcacc

SEQ ID NO: 427966 - DNA, 316 bp, Homo sapiens
ccctactccattaggtcccaaatgggggccccatttcacctgtatcaggactctgagcatccccagctgccccacatcttgcctctggccctcagagaggggtgtttctgtgggtactcctcttaccccagcaaataaaaggaattgtctgaccctagaggcagatgctgcactgcactactccaatgtcttccatggagcctcaggtgctccccctctcacctggcagccccttcagctgctagtgatatcacttgttggacatttttccaataaaggttcttggacaaactgtcttggacaaactggagctgac

SEQ ID NO: 427967 - DNA, 1603 bp, Homo sapiens
ggcccgcgcgtcccggccgggctgcggcggagcgagcggggccagcgctgcagaaggcggcggctggctctccgggacggtcacatcccgctgcaggggcgggcggaggccgccgcactgcctcccgcaccggggacccaggccagcgtccgggcaacgccccctgctcccggacagactccgtggcccgctcgagccctgggggctccgcagacccgcgcccgctccgcccgcacgccaccgagtcgggcgatgggccgccctctgggcaccgagcagccccccgaggcctgaccaaccgcgaggaccggcggaggagccccgcctggatgtcaagcggatgccaagcggatgccacagttccccccccagcggactccgtggggacatggcttcgctggtgcccctttccccatatctaagccccacggtcctcctgctggtcagctgtgacctgggcttcgtgcgagcagaccggcctccctctcctgtgaatgtgacggtcactcacctcagagccaactcggccactgtgtcctgggacgtcccagaaggcaacatcgtcattggctactccatttcccagcaacggcagaatggccccgggcagcgtgtgattcgggaggtgaacaccaccacccgggcctgtgccctctggggcctggctgaagacagtgactacacagtgcaggtcaggagcatcggccttcggggagagagtcccccagggccccgggtgcacttccgaactctcaagggttctgaccggctaccttcaaacagttcaagcccaggtgacatcacagtggaaggtctggatggagagcggccactgcagactggggaagtggtcatcattgtggtggtgttgctcatgtgggctgctgtaattgggctgttctgccgtcagtatgacatcatcaaggacaatgactccaacaacaatcccaaggagaagggaaaggggccggaacagagtcctcagggaaggccagtggggacaagacagaaaaagtcaccatctatcaacaccatcgacgtttgagtgaagaaacacacccagaagagagatgcactaacaactggggatagggatggggtcagggggagcccaagatggtgatctgcccgagactcccagagggtaatgccactcccacaatctcaggcctggtacccatcctctttccactgtgagcagagccagaaggtaggtctgttcagagtctgtgcccctggacctggggagtggatatcagatgggatatctccttccattccccggtccaggggagagtcactagttgtaccctactccattaggtcccaaatgggggccccatttcacctgtatcaggactctgagcatccccagctgccccacatcttgcctctggccctcagagaggggtgtttctgtgggtactcctcttaccccagcaaataaaaggaattgtctgaccctagaggcagatgctgcactgcactactccaatgtcttccatggagcctcaggtgctccccctctcacctggcagccccttcagctgctagtgatatcacttgttggacatttttccaataaaggttcttggacaaactg

SEQ ID NO: 427968 - DNA, 1535 bp, Homo sapiens
ggcccgcgcgtcccggccgggctgcggcggagcgagcggggccagcgctgcagaaggcggcggctggctctccgggacggtcacatcccgctgcaggggcgggcggaggccgccgcactgcctcccgcaccggggacccaggccagcgtccgggcaacgccccctgctcccggacagactccgtggcccgctcgagccctgggggctccgcagacccgcgcccgctccgcccgcagctcggccccgcgctgcccgcgtcgccgggcccgcgccgggatggggtaggggcagcgccaccgagtcgggcgatgggccgccctctgggcaccgagcagccccccgaggcctgaccaaccgcgaggaccggcggaggagccccgcctggatgtcaagcggatgccaagcggatgccacagttccccccccagcggactccgtggggacatggcttcgctggtgcccctttccccatatctaagccccacggtcctcctgctggtcagctgtgacctgggcttcgtgcgagcagaccggcctccctctcctgtgaatgtgacggtcactcacctcagagccaactcggccactgtgtcctggctgaagacagtgactacacagtgcaggtcaggagcatcggccttcggggagagagtcccccagggccccgggtgcacttccgaactctcaagggttctgaccggctaccttcaaacagttcaagcccaggtgacatcacagtggaaggtctggatggagagcggccactgcagactggggaagtggtcatcattgtggtggtgttgctcatgtgggctgctgtaattgggctgttctgccgtcagtatgacatcatcaaggacaatgactccaacaacaatcccaaggagaagggaaaggggccggaacagagtcctcagggaaggccagtggggacaagacagaaaaagtcaccatctatcaacaccatcgacgtttgagtgaagaaacacacccagaagagagatgcactaacaactggggatagggatggggtcagggggagcccaagatggtgatctgcccgagactcccagagggtaatgccactcccacaatctcaggcctggtacccatcctctttccactgtgagcagagccagaaggtaggtctgttcagagtctgtgcccctggacctggggagtggatatcagatgggatatctccttccattccccggtccaggggagagtcactagttgtaccctactccattaggtcccaaatgggggccccatttcacctgtatcaggactctgagcatccccagctgccccacatcttgcctctggccctcagagaggggtgtttctgtgggtactcctcttaccccagcaaataaaaggaattgtctgaccctagaggcagatgctgcactgcactactccaatgtcttccatggagcctcaggtgctccccctctcacctggcagccccttcagctgctagtgatatcacttgttggacatttttccaataaaggttcttggacaaactg

SEQ ID NO: 427969 - DNA, 1750 bp, Homo sapiens
ggcccgcgcgtcccggccgggctgcggcggagcgagcggggccagcgctgcagaaggcggcggctggctctccgggacggtcacatcccgctgcaggggcgggcggaggccgccgcactgcctcccgcaccggggacccaggccagcgtccgggcaacgccccctgctcccggacagactccgtggcccgctcgagccctgggggctccgcagacccgcgcccgctccgcccgcagctcggccccgcgctgcccgcgtcgccgggcccgcgccgggatggggtaggggcagcgccaccgagtcgggcgatgggccgccctctgggcaccgagcagccccccgaggcctgaccaaccgcgaggaccggcggaggagccccgcctggatgtcaagcggatgccaagcggatgccacagttccccccccagcggactccgtggggacatggcttcgctggtgcccctttccccatatctaagccccacggtcctcctgctggtcagctgtgacctgggcttcgtgcgagcagaccggcctccctctcctgtgaatgtgacggtcactcacctcagagccaactcggccactgtgtcctgggacgtcccagaaggcaacatcgtcattggctactccatttcccagcaagtatgaatcacccttctgctcccccaacctgtgtccttggatttcggcacatttcttcacttaagtgggggggatctggaagctggcgtatcctggctcaggctgcccttttcacgctactcccccggagtgcttggatgttgaagagtctctggttgagccttgtggcctggcactggggtgaggctgtcctcctctcccctcatctccctgcagcggcagaatggccccgggcagcgtgtgattcgggaggtgaacaccaccacccgggcctgtgccctctggggcctggctgaagacagtgactacacagtgcaggtcaggagcatcggccttcggggagagagtcccccagggccccgggtgcacttccgaactctcaagggttctgaccggctaccttcaaacagttcaagcccaggtgacatcacagtggaaggtctggatggagagcggccactgcagactggggaagtggtcatcattgtggtggtgttgctcatgtgggctgaaaaagtcaccatctatcaacaccatcgacgtttgagtgaagaaacacacccagaagagagatgcactaacaactggggatagggatggggtcagggggagcccaagatggtgatctgcccgagactcccagagggtaatgccactcccacaatctcaggcctggtacccatcctctttccactgtgagcagagccagaaggtaggtctgttcagagtctgtgcccctggacctggggagtggatatcagatgggatatctccttccattccccggtccaggggagagtcactagttgtaccctactccattaggtcccaaatgggggccccatttcacctgtatcaggactctgagcatccccagctgccccacatcttgcctctggccctcagagaggggtgtttctgtgggtactcctcttaccccagcaaataaaaggaattgtctgaccctagaggcagatgctgcactgcactactccaatgtcttccatggagcctcaggtgctccccctctcacctggcagccccttcagctgctagtgatatcacttgttggacatttttccaataaaggttcttggacaaactg

SEQ ID NO: 427970 - DNA, 1547 bp, Homo sapiens
ggcccgcgcgtcccggccgggctgcggcggagcgagcggggccagcgctgcagaaggcggcggctggctctccgggacggtcacatcccgctgcaggggcgggcggaggccgccgcactgcctcccgcaccggggacccaggccagcgtccgggcaacgccccctgctcccggacagactccgtggcccgctcgagccctgggggctccgcagacccgcgcccgctccgcccgcagctcggccccgcgctgcccgcgtcgccgggcccgcgccgggatggggtaggggcagcgccaccgagtcgggcgatgggccgccctctgggcaccgagcagccccccgaggcctgaccaaccgcgaggaccggcggaggagccccgcctggatgtcaagcggatgccaagcggatgccacagttccccccccagcggactccgtggggacatggcttcgctggtgcccctttccccatatctaagccccacggtcctcctgctggtcagctgtgacctgggcttcgtgcgagcagaccggcctccctctcctgtgaatgtgacggtcactcacctcagagccaactcggccactgtgtcctgggacgtcccagaaggcaacatcgtcattggctactccatttcccagcaacggcagaatggccccgggcagcgtgtgattcgggaggtgaacaccaccacccgggcctgtgccctctggggcctggctgaagacagtgactacacagtgcaggtcaggagcatcggccttcggggagagagtcccccagggccccgggtgcacttccgaactctcaagggttctgaccggctaccttcaaacagttcaagcccaggtgacatcacagtggaaggtctggatggagagcggccactgcagactggggaagtggtcatcattgtggtggtgttgctcatgtgggctgctgtaattgggctgttctgccgtcagtatgacatcatcaaggacaatgactccaacaacaatcccaaggagaagggaaaggggccggaacagagtcctcagggaaggccagtggggacaagacagaaaaagtcaccatctatcaacaccatcgacgtttgagtgaagaaacacacccagaagagagatgcactaacaactggggatagggatggggtcagggggagcccaagatggtgatctgcccgagactcccagagggtaatgccactcccacaatctcaggcctggtacccatcctctttccactgtgagcagagccagaaggtaggtctgttcagagtctgtgcccctggacctggggagtggatatcagatgggatatctccttccattccccggtccaggggagagtcactagttgtaccctatcctcttaccccagcaaataaaaggaattgtctgaccctagaggcagatgctgcactgcactactccaatgtcttccatggagcctcaggtgctccccctctcacctggcagccccttcagctgctagtgatatcacttgttggacatttttccaataaaggttcttggacaaactg

SEQ ID NO: 427971 - DNA, 1245 bp, Homo sapiens
ggcccgcgcgtcccggccgggctgcggcggagcgagcggggccagcgctgcagaaggcggcggctggctctccgggacggtcacatcccgctgcaggggcgggcggaggccgccgcactgcctcccgcaccggggacccaggccagcgtccgggcaacgccccctgctcccggacagactccgtggcccgctcgagccctgggggctccgcagacccgcgcccgctccgcccgcagctcggccccgcgctgcccgcgtcgccgggcccgcgccgggatggggtaggggcagcgccaccgagtcgggcgatgggccgccctctgggcaccgagcagccccccgaggcctgaccaaccgcgaggaccggcggaggagccccgcctggatgtcaagcggatgccaagcggatgccacagttccccccccagcggactccgtggggacatggcttcgctggtgcccctttccccatatctaagccccacggtcctcctgctggtcagctgtgacctgggcttcgtgcgagcagaccggcctccctctcctgtgaatgtgacggtcactcacctcagagccaactcggccactgtgtcctgggacgtcccagaaggcaacatcgtcattggctactccatttcccagcaacggcagaatggccccgggcagcgtgtgattcgggaggtgaacaccaccacccgggcctgtgccctctggggcctggctgaagacagtgactacacagtgcaggtcaggagcatcggccttcggggagagagtcccccagggccccgggtgcacttccgaactctcaagggttctgaccggctaccttcaaacagttcaagcccaggtgacatcacagtggaaggtctggatggagagcggccactgcagactggggaagtggtcatcattgtggtggtgttgctcatgtgggctgctgtaattgggctgttctgccgtcagtatgacatcatcaaggacaatgactccaacaacaatcccaaggagaagggaaaggggccggaacagagtcctcagggaaggccagtggggacaagacaggtgatgtgggggccagtgagggcggaaagggtgattctgcccctgaggggcagccagggaaaggaagaaggtcaaagaggggcagaaaaagatggagaatggaagatctgggatggggggagcttggcaaacaccgtgtagggcgtatatatagggacttacaatcttattgtgtaagag

SEQ ID NO: 427972 - DNA, 1235 bp, Homo sapiens
agcggttcaagaccagcctgggcaacaaagctagaccctgtctctaaaaaaaaaaaaaaaagtacagaaattagctgggcatggtggtgcacacctgtagttccagctactcggaaaactgaggtgggaggattgcttgagcccaggagcccaggagctcaaggctttagtgaactgtgatcgagtcatgcactccagcctgggcaacagagcaaggccccctctcttaaaaaaaaaagtggagaaattgttagaaagctattaaattgggcttgtattttctttggctttcagatctaaagcatgtattccttatttgaaaaagagcaaagttgctcatatcctcaatatcagtccaccactgaacctaaatccagtttggttcaaacagcactgtggtaggtggtaggtggtagggtgaggggatggtttgtgcttaatttgttttgaattaaatctgtgtatgtctgatgtaatcacaatctgcacataacattcatcattgaattttctatgccaagtcattaagtggcatttggaaagtagattcttcatcttttatctgtaatttaaaaaattgaggcataattgacattcaataaaatgcacagctcttaatggttcagtttgatgagttttgagaaatgtatataaccaacacccaaatcaagatacagatttttaccatttcagaaagctctttcatttcccaatgagtgtgttttactgtgtgtaatttattcatctataaagttggttaaaaactatctatgagatactttatttttcttagacaggtatgcacctgtagtcctagctacttgaaaggctgaggtgggaggatcgcttgagcccaggagtttgaggctgcagtgagctaggatcatggcactgcactcctgcctgggtgacagagcgagaccctgactctaaaaaaaaaaaaaaaaacgacaaaaaaaccctattacctttcatagcaaactaatggtttaaggtaaatatgctaagcaacaagatttacatatagatgcctcctttaaaatagttgtatcaaacacttagtttttatttcagcacagttcactaacatttggaaaggcacttggaatgggaacccacagagcaaaactgaaagaagttccactttaattgactaggttaaatacatttgcagcctttttttattattgttttactagcagtagtttccctttaaataaacactttcattctta

SEQ ID NO: 427973 - DNA, 583 bp, Homo sapiens
ttgttgttatgttagtatgagagcagaggaaaaatggtttagagttttttcccaaaacagtcatgtaatgctatcatagtatacctcagtgcatagatgttttattttttctgccactcattctagagtgcagtggcatgctcatagctcactgcagccttgaattcctgggctcaaggtcttagctttccaagtctcagctttcctgggctcctgcctcagctttccaagtagctgggattacaggcacataccaccatgcctggctttgtttgttttttgtgtggacaaggtctcactttgttgcccaggctggtctcaaactcctggcttcacgcaatcctcccacctcagcctcccaaagtgctgggattataggtgtgagccaccatgcccagcctaaataattttttaaattccagtttttaattattctttgttaggatacagaaatgctttgtgtcctgcaatactgttaaatctccttattagttttagcagctttttttgtaaatcccttaggattttctatgtatgtgattgttatctgcaaataaaggcagttttatttcttcttttccac

SEQ ID NO: 427974 - DNA, 829 bp, Homo sapiens
aaaggaaggaggaggtaacttgtggaatgctgagaacgatctaaagcatgtattccttatttgaaaaagagcaaagttgctcatatcctcaatatcagtccaccactgaacctaaatccagtttggttcaaacagcactgtgcttataccattgctaagtatggtatgtctatgtatgtgcttggaatggcagaagaatttaaaggtgaaattgcagtcaatgcattatggcctaaaacagccatacacactgctgctatggatatgctgggaggacctggtatcgaaagccagtgtagaaaagttgatatcattgcagatgcagcatattccattttccaaaagccaaaaagttttactggcaactttgtcattgatgaaaatatcttaaaagaagaaggaatagaaaattttgacgtttatgcaattaaaccagctgtcttcccaatgaaggaagaaaacccataccaacacaacttaaaaaaaaagatgaatgaaaaatagaggtcatcctttgcaaccagatttcttcttagatgaatacccagaagcagttagcaagaaagtggaatcaactggacgacttagtataaatcctagcaggattggtgctatggcgaaattttgggccaatataacgacgtgcgcgggcaacgaactgcggcagtccaattgggcagccacacagcaattgactaaattggtccgctcccgaagaccttgaaagggcttgaatttttcctgggttccctcaacctggggtctgaacgtttggcacgggccaaaccgtcgcattgggggccgccaaggcgggaatctacgggaaaag

SEQ ID NO: 427975 - DNA, 213 bp, Homo sapiens
ctatatgtttatctctctaggtgaagatggtggcacgtggtttcttgatctgaaaagcaagggtgggaatgtcggatatggagagccttctgatcagggaaactaaaaccaacaatggcattcatgtcagggaaattgaagattaaaggtaacatggccctagcaatcaaattggagaagctaatgaatcagatgaatgccagactgtgaagg

SEQ ID NO: 427976 - DNA, 3730 bp, Homo sapiens
aggcgcactcggcgatcccggcttttccgcgcgcagttcccgcacaggcatcggggggggcaggggcggggcaggggcggggataaatgcggagggacggtccagctttagctctctgctcgccgccgccgctgtcgccgccacctcctctgatctacgaaagtcatgttacccaacaccgggaggctggcaggatgtacagtttttatcacaggtgcaagccgtggcattggcaaagctattgcattgaaagcagcaaaggatggagcaaatattgttattgctgcaaagaccgcccagccacatccaaaacttctaggcacaatctatactgctgctgaagaaattgaagcagttggaggaaaggccttgccatgtattgttgatgtgagagatgaacagcagatcagtgctgcagtggagaaagccatcaagaaatttggaggaattgatattctggtaaataatgccagtgccattagtttgaccaatacattggacacacctaccaagagattggatctgatgatgaacgtgaacaccagaggcacctaccttgcatctaaagcatgtattccttatttgaaaaagagcaaagttgctcatatcctcaatatcagtccaccactgaacctaaatccagtttggttcaaacagcactgtgcttataccattgctaagtatggtatgtctatgtatgtgcttggaatggcagaagaatttaaaggtgaaattgcagtcaatgcattatggcctaaaacagccatacacactgctgctatggatatgctgggaggacctggtatcgaaagccagtgtagaaaagttgatatcattgcagatgcagcatattccattttccaaaagccaaaaagttttactggcaactttgtcattgatgaaaatatcttaaaagaagaaggaatagaaaattttgacgtttatgcaattaaaccaggtcatcctttgcaaccagatttcttcttagatgaatacccagaagcagttagcaagaaagtggaatcaactggtgctgttccagaattcaaagaagagaaactgcagctgcaaccaaaaccacgttctggagctgtggaagaaacatttagaattgttaaggactctctcagtgatgatgttgttaaagccactcaagcaatctatctgtttgaactctccggtgaagatggtggcacgtggtttcttgatctgaaaagcaagggtgggaatgtcggatatggagagccttctgatcaggcagatgtggtgatgagtatgactactgatgactttgtaaaaatgttttcagggaaactaaaaccaacaatggcattcatgtcagggaaattgaagattaaaggtaacatggccctagcaatcaaattggagaagctaatgaatcagatgaatgccagactgtgaaggaaaatataaaaaaaaagtcgactgctatgctcaaaaagtaaaaaaagctcaacagttaaaatctaatgtttgttttctttcctgttatattataaggatatgcacgtttgttctggaaaagatagaatttgtctctaaaagacttgaaattgtaattaaaatggcaagctaatcaaacataagcttcattaagtgggattctaagacagtctgtgtttttatatttcaagggtttaaccctttgagccttacatctcattcactgtctttctccaagaaaagtattttgggcggacagtcagatcaagcagtaaaattagctctttcaaatcttcttgtcatgtaaaatgaagctagtctgttttaaaatttttagttttggattgtatactaatgaaaatcttaatgatgtttttgatttttatatacttattttaaagaaaatcttatatagtacattttacaaaaattataaaaaatgaattagtactggcgaggactaaatgaaacaataatttttcattttgataactagctttccaggtggacttagccataggaaaatattactaatgtaatttaacaaattgctgcatgtattccatttaaaaatatgtttaaattgtcctaaaacaaaataattttctccctaggagtatgcatttggctacagtgttttgaaacagaaaccttagaataggtcattggtatgggctgaactgtgtatcccccaattcatttgttgaggtcctaactcccatttcttttgaatgtgactgttcggagatgaggcctttaaagaggtgacttaagttcaaaggaggctgttagtctaatccaacatggtgtcctttggacataagagataccagcaatgtgtgcacagaacaaagaccaggagaggacacagtgagaaggcagttatctgcaagcaaagagagaggcttcagaagaaacaaaatcaccagcaccttgatctttgacttctaatctccagaatagtgagaaataaatttctgttgttaagccgtccactgtgggaggccgacgcaggaggattgcttgaggccaggagttcaaggccagcctggacaacatagtaagaccctatctctacccccctaataaattaatttaaaaagccccccaatctgtggtattttattatggcagccctagcaagctaatacagtggtttgagaggctgggagggttgaggggaagataaacttttaaaaagctcttatctttcatttcaatcagttaaaaatacttgctcagtgtaacaattttgcttctcagcttccactctaatattgttgtgccattaagcaatttagctaatcctgacatttcttagattcataatgttaggagcatttaatctgtattttacaagttaggaagcagaggatcagagatgggaaaggactagcccaaggccaacattaacaagccctctaacaaaaactttacaatacatttatgttgaatggaactccaagatctcacctctccatccaggaatggagtccatgtaatcaaagtgaacttaaaaataggacagtttcaacaagtcaggagattcacagcaactgatcaaagggagtccagtcaacgtgagcaagcgtgattatgatgaggaagccccctctgctttaatccacacaaggaacgtaacctgaagtaacctgatgttaaccaatctgctgtgtctactatgctgtttccttgttcctgctagtgctgctttacaaatgcagaccattctatcatacctggcagggcttctgttttattttgtaggctggatgctacccagttcatgaatcgctaataaaagccaattagatctttaaaaaaaaaaaaaaaaaaaaaaaaaaatttgtgggccggccgggcccggaaaaggtttttaaaaccttcgtttggggccggggcccctggtgtgggaacctgggccaaggggtccaaggaaaaccggcgcggctgggggtggggttgcccccataaaaaggccggggaccggcggttcggacaacccagaggcttcgttcgcaggggagagccccgctcaaaacgcggcgacccgtgttgctaaccgccggctcgggggggggggggcaacagcaacacaaacacacaaaaaaaagaaaacacagacaaaaacagataaagaaaacaaaagacaaagcagcactatacagcacacacaaggacacaaaaactcaagagtaaaagacaaatagacaacacatcaaaagacgaaacacacataactaccacatcaacccagacacagaag

SEQ ID NO: 427977 - DNA, 3229 bp, Homo sapiens
aggcgcactcggcgatcccggcttttccgcgcgcagttcccgcacaggcatcggggggggcaggggcggggcaggggcggggataaatgcggagggacggtccagctttagctctctgctcgccgccgccgctgtcgccgccacctcctctgatctacgaaagtcatgttacccaacaccgggaggctggcaggatgtacagtttttatcacaggtgcaagccgtggcattggcaaagctattgcattgaaagcagcaaaggatggagcaaatattgttattgctgcaaagaccgcccagccacatccaaaacttctaggcacaatctatactgctgctgaagaaattgaagcagttggaggaaaggccttgccatgtattgttgatgtgagagatgaacagcagatcagtgctgcagtggagaaagccatcaagaaatttggaggaattgatattctggtaaataatgccagtgccattagtttgaccaatacattggacacacctaccaagagattggatctgatgatgaacgtgaacaccagaggcacctaccttgcatctaaagcatgtattccttatttgaaaaagagcaaagttgctcatatcctcaatatcagtccaccactgaacctaaatccagtttggttcaaacagcactgtgcttataccattgctaagtatggtatgtctatgtatgtgcttggaatggcagaagaatttaaaggtgaaattgcagtcaatgcattatggcctaaaacagccatacacactgctgctatggatatgctgggaggacctggtatcgaaagccagtgtagaaaagttgatatcattgcagatgcagcatattccattttccaaaagccaaaaagttttactggcaactttgtcattgatgaaaatatcttaaaagaagaaggaatagaaaattttgacgtttatgcaattaaaccaggtcatcctttgcaaccagatttcttcttagatgaatacccagaagcagttagcaagaaagtggaatcaactggtgctgttccagaattcaaagaagagaaactgcagctgcaaccaaaaccacgttctggagctgtggaagaaacatttagaattgttaaggactctctcagtgatgatgttgttaaagccactcaagcaatctatctgtttgaactctccggtgaagatggtggcacgtggtttcttgatctgaaaagcaagggtgggaatgtcggatatggagagccttctgatcaggcagatgtggtgatgagtatgactactgatgactttgtaaaaatgttttcagggaaactaaaaccaacaatggcattcatgtcagggaaattgaagattaaaggtaacatggccctagcaatcaaattggagaagctaatgaatcagatgaatgccagactgtgaaggaaaatataaaaaaaaagtcgactgctatgctcaaaaagtaaaaaaagctcaacagttaaaatctaatgtttgttttctttcctgttatattataaggatatgcacgtttgttctggaaaagatagaatttgtctctaaaagacttgaaattgtaattaaaatggcaagctaatcaaacataagcttcattaagtgggattctaagacagtctgtgtttttatatttcaagggtttaaccctttgagccttacatctcattcactgtctttctccaagaaaagtattttgggcggacagtcagatcaagcagtaaaattagctctttcaaatcttcttgtcatgtaaaatgaagctagtctgttttaaaatttttagttttggattgtatactaatgaaaatcttaatgatgtttttgatttttatatacttattttaaagaaaatcttatatagtacattttacaaaaattataaaaaatgaattagtactggcgaggactaaatgaaacaataatttttcattttgataactagctttccaggtggacttagccataggaaaatattactaatgtaatttaacaaattgctgcatgtattccatttaaaaatatgtttaaattgtcctaaaaaaccttagaataggtcattggtatgggctgaactgtgtatcccccaattcatttgttgaggtcctaactcccatttcttttgaatgtgactgttcggagatgaggcctttaaagaggtgacttaagttcaaaggaggctgttagtctaatccaacatggtgtcctttggacataagagataccagcaatgtgtgcacagaacaaagaccaggagaggacacagtgagaaggcagttatctgcaagcaaagagagaggcttcagaagaaacaaaatcaccagcaccttgatctttgacttctaatctccagaatagtgagaaataaatttctgttgttaagccgtccactgtgggaggccgacgcaggaggattgcttgaggccaggagttcaaggccagcctggacaacatagtaagaccctatctctacccccctaataaattaatttaaaaagccccccaatctgtggtattttattatggcagccctagcaagctaatacagtggtttgagaggctgggagggttgaggggaagataaacttttaaaaagctcttatctttcatttcaatcagttaaaaatacttgctcagtgtaacaattttgcttctcagcttccactctaatattgttgtgccattaagcaatttagctaatcctgacatttcttagattcataatgttaggagcatttaatctgtattttacaagttaggaagcagaggatcagagatgggaaaggactagcccaaggccaacattaacaagccctctaacaaaaactttacaatacatttatgttgaatggaactccaagatctcacctctccatccaggaatggagtccatgtaatcaaagtgaacttaaaaataggacagtttcaacaagtcaggagattcacagcaactgatcaaagggagtccagtcaacgtgagcaagcgtgattatgatgaggaagccccctctgctttaatccacacaaggaacgtaacctgaagtaacctgatgttaaccaatctgctgtgtctactatgctgtttccttgttcctgctagtgctgctttacaaatgcagaccattctatcatacctggcagggcttctgttttattttgtaggctggatgctacccagttcatgaatcgctaataaaagccaattagatcttta

SEQ ID NO: 427978 - DNA, 4865 bp, Homo sapiens
  misc_feature (4183)..(4183): n is a, c, g, or t
aggcgcactcggcgatcccggcttttccgcgcgcagttcccgcacaggcatcggggggggcaggggcggggcaggggcggggataaatgcggagggacggtccagctttagctctctgctcgccgccgccgctgtcgccgccacctcctctgatctacgaaagtcatgttacccaacaccgggaggctggcaggatgtacagtttttatcacaggtgcaagccgtggcattggcaaagctattgcattgaaagcagcaaaggatggagcaaatattgttattgctgcaaagaccgcccagccacatccaaaacttctaggcacaatctatactgctgctgaagaaattgaagcagttggaggaaaggccttgccatgtattgttgatgtgagagatgaacagcagatcagtgctgcagtggagaaagccatcaagaaatttggaggaattgatattctggtaaataatgccagtgccattagtttgaccaatacattggacacacctaccaagagattggatctgatgatgaacgtgaacaccagaggcacctaccttgcatctaaagcatgtattccttatttgaaaaagagcaaagttgctcatatcctcaatatcagtccaccactgaacctaaatccagtttggttcaaacagcactgtgcttataccattgctaagtatggtatgtctatgtatgtgcttggaatggcagaagaatttaaaggtgaaattgcagtcaatgcattatggcctaaaacagccatacacactgctgctatggatatgctgggaggacctggtatcgaaagccagtgtagaaaagttgatatcattgcagatgcagcatattccattttccaaaagccaaaaagttttactggcaactttgtcattgatgaaaatatcttaaaagaagaaggaatagaaaattttgacgtttatgcaattaaaccaggtcatcctttgcaaccagatttcttcttagatgaatacccagaagcagttagcaagaaagtggaatcaactggtgctgttccagaattcaaagaagagaaactgcagctgcaaccaaaaccacgttctggagctgtggaagaaacatttagaattgttaaggactctctcagtgatgatgttgttaaagccactcaagcaatctatctgtttgaactctccggtgaagatggtggcacgtggtttcttgatctgaaaagcaagggtgggaatgtcggatatggagagccttctgatcaggcagatgtggtgatgagtatgactactgatgactttgtaaaaatgttttcagggaaactaaaaccaacaatggcattcatgtcagggaaattgaagattaaaggtaacatggccctagcaatcaaattggagaagctaatgaatcagatgaatgccagactgtgaaggaaaatataaaaaaaaagtcgactgctatgctcaaaaagtaaaaaaagctcaacagttaaaatctaatgtttgttttctttcctgttatattataaggatatgcacgtttgttctggaaaagatagaatttgtctctaaaagacttgaaattgtaattaaaatggcaagctaatcaaacataagcttcattaagtgggattctaagacagtctgtgtttttatatttcaagggtttaaccctttgagccttacatctcattcactgtctttctccaagaaaagtattttgggcggacagtcagatcaagcagtaaaattagctctttcaaatcttcttgtcatgtaaaatgaagctagtctgttttaaaatttttagttttggattgtatactaatgaaaatcttaatgatgtttttgatttttatatacttattttaaagaaaatcttatatagtacattttacaaaaattataaaaaatgaattagtactggcgaggactaaatgaaacaataatttttcattttgataactagctttccaggtggacttagccataggaaaatattactaatgtaatttaacaaattgctgcatgtattccatttaaaaatatgtttaaattgtcctaaaacaaaataattttctccctaggagtatgcatttggctacagtgttttgaaacagaaaccttagaataggtcattggtatgggctgaactgtgtatcccccaattcatttgttgaggtcctaactcccatttcttttgaatgtgactgttcggagatgaggcctttaaagaggtgacttaagttcaaaggaggctgttagtctaatccaacatggtgtcctttggacataagagataccagcaatgtgtgcacagaacaaagaccaggagaggacacagtgagaaggcagttatctgcaagcaaagagagaggcttcagaagaaacaaaatcaccagcaccttgatctttgacttctaatctccagaatagtgagaaataaatttctgttgttaagccgtccactgtgggaggccgacgcaggaggattgcttgaggccaggagttcaaggccagcctggacaacatagtaagaccctatctctacccccctaataaattaatttaaaaagccccccaatctgtggtattttattatggcagccctagcaagctaatacagtggtttgagaggctgggagggttgaggggaagataaacttttaaaaagctcttatctttcatttcaatcagttaaaaatacttgctcagtgtaacaattttgcttctcagcttccactctaatattgttgtgccattaagcaatttagctaatcctgacatttcttagattcataatgttaggagcatttaatctgtattttacaagttaggaagcagaggatcagagatgggaaaggactagcccaaggccaacattaacaagccctctaacaaaaactttacaatacatttatgttgaatggaactccaagatctcacctctccatccaggaatggagtccatgtaatcaaagtgaacttaaaaataggacagtttcaacaagtcaggagattcacagcaactgatcaaagggagtccagtcaacgtgagcaagcgtgattatgatgaggaagccccctctgctttaatccacacaaggaacgtaacctgaagtaacctgatgttaaccaatctgctgtgtctactatgctgtttccttgttcctgctagtgctgctttacaaatgcagaccattctatcatacctggcagggcttctgttttattttgtaggctggatgctacccagttcatgaatcgctaataaaagccaattagatctttacataatttgttgagattttattctttgacattcttaaaggtttgggaaaattagaggtagaacataccgtgaggcagcaatctctgggttctggtcattaaaatatgaatttgctaattatacctatcccaacagggggattgagtcaagggaccttgcccttttctggactgacctgcttgattattgccctaagtgattgttagttaggttgcccattggaatctctgccttctggctttaaaaatttttccagattggagtaaattgagctgactggttttgagctttgtaatgttaggggaccagcaatgagttcctctgatccatccaatcattagtagattaaatctttgttttaaacccatcacagtccactattcatccctttttaaaataaccatttaaaaattttctaccctgaattgcattttgaaagggatggttcctaggtaacacaaggtagaaaatttacatctcaaaggcagagaacttacatttcaggcctaaatattgttatttgccaagacagaaagttgatgctaagaagcccagttcagacaaaatggttgaaggtgagtttatttggactaatgctctcacctattgtaagaatttctactgattttcctttatagatacacgtttttacaaagagtttcaaaataactggctaaataccagaaacgcaaattttggagactgatttaattcaataggcggtcttttcaacttagcttctgtttcttaactagattactgagttcagggcagagcccattagcaaatagagcagacaaagggtttcctatttctggatgcagatggatagttctgaaaatgcaaatctgcttcacccaagggcctaatttttataaatattacctagctttctttttncctttggagtaaaacagtaactaagtgaaaagattggcagattcaattttcttataaactagttgcttaaacttttcatttgccttctacgtgagctcttttaaagagacaaacatttttgaaatctttttagaagcttttgcacatcaataggtatccctaggagggcctgattcagaagccctcatttttaaactcaattcttagatgaacagtcttattcatctggaatgttccacataatggtcatcataattctaatttatctttagtaagatttcaccatttttgtaagtatttgcagcttctaggccctaacacatgtaaaaggtaaacatagccagaaggtgaaatacacagttctttaaaaatttaaggatgctggccaggcgaggtggctcacacctgtaatcccagcactttgggaggctgagggctgaggtgcgagaattgtttgagcccaggaggtggaggttgcattgagctgagactgcgccactgcactccagcctggacaacagagtgagatgctgtcttaaaaataaaaaaaaagaattaaggatgccatttttaagttgaatcttgagtctctcagagtcaagataaaagtctgagtgaaacgccatgaggttgggtcactgtgtttgctatctatctacctatctatctatctatctatcta

SEQ ID NO: 427979 - DNA, 4955 bp, Homo sapiens
  misc_feature (4183)..(4183): n is a, c, g, or t
aggcgcactcggcgatcccggcttttccgcgcgcagttcccgcacaggcatcggggggggcaggggcggggcaggggcggggataaatgcggagggacggtccagctttagctctctgctcgccgccgccgctgtcgccgccacctcctctgatctacgaaagtcatgttacccaacaccgggaggctggcaggatgtacagtttttatcacaggtgcaagccgtggcattggcaaagctattgcattgaaagcagcaaaggatggagcaaatattgttattgctgcaaagaccgcccagccacatccaaaacttctaggcacaatctatactgctgctgaagaaattgaagcagttggaggaaaggccttgccatgtattgttgatgtgagagatgaacagcagatcagtgctgcagtggagaaagccatcaagaaatttggaggaattgatattctggtaaataatgccagtgccattagtttgaccaatacattggacacacctaccaagagattggatctgatgatgaacgtgaacaccagaggcacctaccttgcatctaaagcatgtattccttatttgaaaaagagcaaagttgctcatatcctcaatatcagtccaccactgaacctaaatccagtttggttcaaacagcactgtgcttataccattgctaagtatggtatgtctatgtatgtgcttggaatggcagaagaatttaaaggtgaaattgcagtcaatgcattatggcctaaaacagccatacacactgctgctatggatatgctgggaggacctggtatcgaaagccagtgtagaaaagttgatatcattgcagatgcagcatattccattttccaaaagccaaaaagttttactggcaactttgtcattgatgaaaatatcttaaaagaagaaggaatagaaaattttgacgtttatgcaattaaaccaggtcatcctttgcaaccagatttcttcttagatgaatacccagaagcagttagcaagaaagtggaatcaactggtgctgttccagaattcaaagaagagaaactgcagctgcaaccaaaaccacgttctggagctgtggaagaaacatttagaattgttaaggactctctcagtgatgatgttgttaaagccactcaagcaatctatctgtttgaactctccggtgaagatggtggcacgtggtttcttgatctgaaaagcaagggtgggaatgtcggatatggagagccttctgatcaggcagatgtggtgatgagtatgactactgatgactttgtaaaaatgttttcagggaaactaaaaccaacaatggcattcatgtcagggaaattgaagattaaaggtaacatggccctagcaatcaaattggagaagctaatgaatcagatgaatgccagactgtgaaggaaaatataaaaaaaaagtcgactgctatgctcaaaaagtaaaaaaagctcaacagttaaaatctaatgtttgttttctttcctgttatattataaggatatgcacgtttgttctggaaaagatagaatttgtctctaaaagacttgaaattgtaattaaaatggcaagctaatcaaacataagcttcattaagtgggattctaagacagtctgtgtttttatatttcaagggtttaaccctttgagccttacatctcattcactgtctttctccaagaaaagtattttgggcggacagtcagatcaagcagtaaaattagctctttcaaatcttcttgtcatgtaaaatgaagctagtctgttttaaaatttttagttttggattgtatactaatgaaaatcttaatgatgtttttgatttttatatacttattttaaagaaaatcttatatagtacattttacaaaaattataaaaaatgaattagtactggcgaggactaaatgaaacaataatttttcattttgataactagctttccaggtggacttagccataggaaaatattactaatgtaatttaacaaattgctgcatgtattccatttaaaaatatgtttaaattgtcctaaaacaaaataattttctccctaggagtatgcatttggctacagtgttttgaaacagaaaccttagaataggtcattggtatgggctgaactgtgtatcccccaattcatttgttgaggtcctaactcccatttcttttgaatgtgactgttcggagatgaggcctttaaagaggtgacttaagttcaaaggaggctgttagtctaatccaacatggtgtcctttggacataagagataccagcaatgtgtgcacagaacaaagaccaggagaggacacagtgagaaggcagttatctgcaagcaaagagagaggcttcagaagaaacaaaatcaccagcaccttgatctttgacttctaatctccagaatagtgagaaataaatttctgttgttaagccgtccactgtgggaggccgacgcaggaggattgcttgaggccaggagttcaaggccagcctggacaacatagtaagaccctatctctacccccctaataaattaatttaaaaagccccccaatctgtggtattttattatggcagccctagcaagctaatacagtggtttgagaggctgggagggttgaggggaagataaacttttaaaaagctcttatctttcatttcaatcagttaaaaatacttgctcagtgtaacaattttgcttctcagcttccactctaatattgttgtgccattaagcaatttagctaatcctgacatttcttagattcataatgttaggagcatttaatctgtattttacaagttaggaagcagaggatcagagatgggaaaggactagcccaaggccaacattaacaagccctctaacaaaaactttacaatacatttatgttgaatggaactccaagatctcacctctccatccaggaatggagtccatgtaatcaaagtgaacttaaaaataggacagtttcaacaagtcaggagattcacagcaactgatcaaagggagtccagtcaacgtgagcaagcgtgattatgatgaggaagccccctctgctttaatccacacaaggaacgtaacctgaagtaacctgatgttaaccaatctgctgtgtctactatgctgtttccttgttcctgctagtgctgctttacaaatgcagaccattctatcatacctggcagggcttctgttttattttgtaggctggatgctacccagttcatgaatcgctaataaaagccaattagatctttacataatttgttgagattttattctttgacattcttaaaggtttgggaaaattagaggtagaacataccgtgaggcagcaatctctgggttctggtcattaaaatatgaatttgctaattatacctatcccaacagggggattgagtcaagggaccttgcccttttctggactgacctgcttgattattgccctaagtgattgttagttaggttgcccattggaatctctgccttctggctttaaaaatttttccagattggagtaaattgagctgactggttttgagctttgtaatgttaggggaccagcaatgagttcctctgatccatccaatcattagtagattaaatctttgttttaaacccatcacagtccactattcatccctttttaaaataaccatttaaaaattttctaccctgaattgcattttgaaagggatggttcctaggtaacacaaggtagaaaatttacatctcaaaggcagagaacttacatttcaggcctaaatattgttatttgccaagacagaaagttgatgctaagaagcccagttcagacaaaatggttgaaggtgagtttatttggactaatgctctcacctattgtaagaatttctactgattttcctttatagatacacgtttttacaaagagtttcaaaataactggctaaataccagaaacgcaaattttggagactgatttaattcaataggcggtcttttcaacttagcttctgtttcttaactagattactgagttcagggcagagcccattagcaaatagagcagacaaagggtttcctatttctggatgcagatggatagttctgaaaatgcaaatctgcttcacccaagggcctaatttttataaatattacctagctttctttttncctttggagtaaaacagtaactaagtgaaaagattggcagattcaattttcttataaactagttgcttaaacttttcatttgccttctacgtgagctcttttaaagagacaaacatttttgaaatctttttagaagcttttgcacatcaataggtatccctaggagggcctgattcagaagccctcatttttaaactcaattcttagatgaacagtcttattcatctggaatgttccacataatggtcatcataattctaatttatctttagtaagatttcaccatttttgtaagtatttgcagcttctaggccctaacacatgtaaaaggtaaacatagccagaaggtgaaatacacagttctttaaaaatttaaggatgctggccaggcgaggtggctcacacctgtaatcccagcactttgggaggctgaggtcggaggccaggagtttgagaccagcctagccaacatggtgaaaccccgtctctactaaaaatacaaaaattagatgggtgtggcagtgtggcctttaatccagctacccaggaaaagtgctgggattataggtgtgagccaccatgcccagcctaaataattttttaaattccagtttttaattattctttgttaggatacagaaatgctttgtgtcctgcaatactgttaaatctccttattagttttagcagctttttttgtaaatcccttaggattttctatgtatgtgattgttatctgcaaataaaggcagttttatttcttcttttccac

SEQ ID NO: 427980 - DNA, 4835 bp, Homo sapiens
  misc_feature (4183)..(4183): n is a, c, g, or t
aggcgcactcggcgatcccggcttttccgcgcgcagttcccgcacaggcatcggggggggcaggggcggggcaggggcggggataaatgcggagggacggtccagctttagctctctgctcgccgccgccgctgtcgccgccacctcctctgatctacgaaagtcatgttacccaacaccgggaggctggcaggatgtacagtttttatcacaggtgcaagccgtggcattggcaaagctattgcattgaaagcagcaaaggatggagcaaatattgttattgctgcaaagaccgcccagccacatccaaaacttctaggcacaatctatactgctgctgaagaaattgaagcagttggaggaaaggccttgccatgtattgttgatgtgagagatgaacagcagatcagtgctgcagtggagaaagccatcaagaaatttggaggaattgatattctggtaaataatgccagtgccattagtttgaccaatacattggacacacctaccaagagattggatctgatgatgaacgtgaacaccagaggcacctaccttgcatctaaagcatgtattccttatttgaaaaagagcaaagttgctcatatcctcaatatcagtccaccactgaacctaaatccagtttggttcaaacagcactgtgcttataccattgctaagtatggtatgtctatgtatgtgcttggaatggcagaagaatttaaaggtgaaattgcagtcaatgcattatggcctaaaacagccatacacactgctgctatggatatgctgggaggacctggtatcgaaagccagtgtagaaaagttgatatcattgcagatgcagcatattccattttccaaaagccaaaaagttttactggcaactttgtcattgatgaaaatatcttaaaagaagaaggaatagaaaattttgacgtttatgcaattaaaccaggtcatcctttgcaaccagatttcttcttagatgaatacccagaagcagttagcaagaaagtggaatcaactggtgctgttccagaattcaaagaagagaaactgcagctgcaaccaaaaccacgttctggagctgtggaagaaacatttagaattgttaaggactctctcagtgatgatgttgttaaagccactcaagcaatctatctgtttgaactctccggtgaagatggtggcacgtggtttcttgatctgaaaagcaagggtgggaatgtcggatatggagagccttctgatcaggcagatgtggtgatgagtatgactactgatgactttgtaaaaatgttttcagggaaactaaaaccaacaatggcattcatgtcagggaaattgaagattaaaggtaacatggccctagcaatcaaattggagaagctaatgaatcagatgaatgccagactgtgaaggaaaatataaaaaaaaagtcgactgctatgctcaaaaagtaaaaaaagctcaacagttaaaatctaatgtttgttttctttcctgttatattataaggatatgcacgtttgttctggaaaagatagaatttgtctctaaaagacttgaaattgtaattaaaatggcaagctaatcaaacataagcttcattaagtgggattctaagacagtctgtgtttttatatttcaagggtttaaccctttgagccttacatctcattcactgtctttctccaagaaaagtattttgggcggacagtcagatcaagcagtaaaattagctctttcaaatcttcttgtcatgtaaaatgaagctagtctgttttaaaatttttagttttggattgtatactaatgaaaatcttaatgatgtttttgatttttatatacttattttaaagaaaatcttatatagtacattttacaaaaattataaaaaatgaattagtactggcgaggactaaatgaaacaataatttttcattttgataactagctttccaggtggacttagccataggaaaatattactaatgtaatttaacaaattgctgcatgtattccatttaaaaatatgtttaaattgtcctaaaacaaaataattttctccctaggagtatgcatttggctacagtgttttgaaacagaaaccttagaataggtcattggtatgggctgaactgtgtatcccccaattcatttgttgaggtcctaactcccatttcttttgaatgtgactgttcggagatgaggcctttaaagaggtgacttaagttcaaaggaggctgttagtctaatccaacatggtgtcctttggacataagagataccagcaatgtgtgcacagaacaaagaccaggagaggacacagtgagaaggcagttatctgcaagcaaagagagaggcttcagaagaaacaaaatcaccagcaccttgatctttgacttctaatctccagaatagtgagaaataaatttctgttgttaagccgtccactgtgggaggccgacgcaggaggattgcttgaggccaggagttcaaggccagcctggacaacatagtaagaccctatctctacccccctaataaattaatttaaaaagccccccaatctgtggtattttattatggcagccctagcaagctaatacagtggtttgagaggctgggagggttgaggggaagataaacttttaaaaagctcttatctttcatttcaatcagttaaaaatacttgctcagtgtaacaattttgcttctcagcttccactctaatattgttgtgccattaagcaatttagctaatcctgacatttcttagattcataatgttaggagcatttaatctgtattttacaagttaggaagcagaggatcagagatgggaaaggactagcccaaggccaacattaacaagccctctaacaaaaactttacaatacatttatgttgaatggaactccaagatctcacctctccatccaggaatggagtccatgtaatcaaagtgaacttaaaaataggacagtttcaacaagtcaggagattcacagcaactgatcaaagggagtccagtcaacgtgagcaagcgtgattatgatgaggaagccccctctgctttaatccacacaaggaacgtaacctgaagtaacctgatgttaaccaatctgctgtgtctactatgctgtttccttgttcctgctagtgctgctttacaaatgcagaccattctatcatacctggcagggcttctgttttattttgtaggctggatgctacccagttcatgaatcgctaataaaagccaattagatctttacataatttgttgagattttattctttgacattcttaaaggtttgggaaaattagaggtagaacataccgtgaggcagcaatctctgggttctggtcattaaaatatgaatttgctaattatacctatcccaacagggggattgagtcaagggaccttgcccttttctggactgacctgcttgattattgccctaagtgattgttagttaggttgcccattggaatctctgccttctggctttaaaaatttttccagattggagtaaattgagctgactggttttgagctttgtaatgttaggggaccagcaatgagttcctctgatccatccaatcattagtagattaaatctttgttttaaacccatcacagtccactattcatccctttttaaaataaccatttaaaaattttctaccctgaattgcattttgaaagggatggttcctaggtaacacaaggtagaaaatttacatctcaaaggcagagaacttacatttcaggcctaaatattgttatttgccaagacagaaagttgatgctaagaagcccagttcagacaaaatggttgaaggtgagtttatttggactaatgctctcacctattgtaagaatttctactgattttcctttatagatacacgtttttacaaagagtttcaaaataactggctaaataccagaaacgcaaattttggagactgatttaattcaataggcggtcttttcaacttagcttctgtttcttaactagattactgagttcagggcagagcccattagcaaatagagcagacaaagggtttcctatttctggatgcagatggatagttctgaaaatgcaaatctgcttcacccaagggcctaatttttataaatattacctagctttctttttncctttggagtaaaacagtaactaagtgaaaagattggcagattcaattttcttataaactagttgcttaaacttttcatttgccttctacgtgagctcttttaaagagacaaacatttttgaaatctttttagaagcttttgcacatcaataggtatccctaggagggcctgattcagaagccctcatttttaaactcaattcttagatgaacagtcttattcatctggaatgttccacataatggtcatcataattctaatttatctttagtaagatttcaccatttttgtaagtatttgcagcttctaggccctaacacatgtaaaaggtaaacatagccagaaggtgaaatacacagttctttaaaaatttaaggatgctggtctcaaactcctggcttcacgcaatcctcccacctcagcctcccaaagtgctgggattataggtgtgagccaccatgcccagcctaaataattttttaaattccagtttttaattattctttgttaggatacagaaatgctttgtgtcctgcaatactgttaaatctccttattagttttagcagctttttttgtaaatcccttaggattttctatgtatgtgattgttatctgcaaataaaggcagttttatttcttcttttccac

SEQ ID NO: 427981 - DNA, 1425 bp, Homo sapiens
aggcgcactcggcgatcccggcttttccgcgcgcagttcccgcacaggcatcggggggggcaggggcggggcaggggcggggataaatgcggagggacggtccagctttagctctctgctcgccgccgccgctgtcgccgccacctcctctgatctacgaaagtcatgttacccaacaccgggaggctggcaggatgtacagtttttatcacaggtgcaagccgtggcattggcaaagctattgcattgaaagcagcaaaggatggagcaaatattgttattgctgcaaagaccgcccagccacatccaaaacttctaggcacaatctatactgctgctgaagaaattgaagcagttggaggaaaggccttgccatgtattgttgatgtgagagatgaacagcagatcagtgctgcagtggagaaagccatcaagaaatttggaggaattgatattctggtaaataatgccagtgccattagtttgaccaatacattggacacacctaccaagagattggatctgatgatgaacgtgaacaccagaggcacctaccttgcatctaaagcatgtattccttatttgaaaaagagcaaagttgctcatatcctcaatatcagtccaccactgaacctaaatccagtttggttcaaacagcactgtgcttataccattgctaagtatggtatgtctatgtatgtgcttggaatggcagaagaatttaaaggtgaaattgcagtcaatgcattatggcctaaaacagccatacacactgctgctatggatatgctgggaggacctggtatcgaaagccagtgtagaaaagttgatatcattgcagatgcagcatattccattttccaaaagccaaaaagttttactggcaactttgtcattgatgaaaatatcttaaaagaagaaggaatagaaaattttgacgtttatgcaattaaaccaggtcatcctttgcaaccagatttcttcttagatgaatacccagaagcagttagcaagaaagtggaatcaactggtgctgttccagaattcaaagaagagaaactgcagctgcaaccaaaaccacgttctggagctgtggaagaaacatttagaattgttaaggactctctcagtgatgatgttgttaaagccactcaagcaatctatctgtttgaactctccggtgaagatggtggcacgtggtttcttgatctgaaaagcaagggtgggaatgtcggatatggagagccttctgatcaggcagatgtggtgatgagtatgactactgatgactttgtaaaaatgttttcagggaaactaaaaccaacaatggcattcatgtcagggaaattgaagattaaaggtaacatggccctagcaatcaaattggagaagctaatgaatcagatgaatgccagactgtgaagg

SEQ ID NO: 427982 - DNA, 385 bp, Homo sapiens
taggatgagaagggcagaggttcctgggagagcaggtaaaggctttacagaacaggtgatcttttggggattaaatcttgaagataaaatttatcagaggagagaaagataactgaattatgagaaaattaatttaatgaagatcaggtcattcgacagttctcacagaggccttttcttttgcaccagaaagatttttaataaaatagatatgtttattaaacagatgttaaaatcttactatgttgtagttacattaacctaatggtttggggtcaatttttcaggtcatcctttgcaaccagatttcttcttagatgaatacccagaagcagttagcaagaaagtggaatcaactggtaagatctagactatattttatgtt

SEQ ID NO: 427983 - DNA, 3064 bp, Homo sapiens
aggcgcactcggcgatcccggcttttccgcgcgcagttcccgcacaggcatcggggggggcaggggcggggcaggggcggggataaatgcggagggacggtccagctttagctctctgctcgccgccgccgctgtcgccgccacctcctctgatctacgaaagtcatgttacccaacaccgggaggctggcaggatgtacagtttttatcacaggtgcaagccgtggcattggcaaagctattgcattgaaagcagcaaaggatggagcaaatattgttattgctgcaaagaccgcccagccacatccaaaacttctaggcacaatctatactgctgctgaagaaattgaagcagttggaggaaaggccttgccatgtattgttgatgtgagagatgaacagcagatcagtgctgcagtggagaaagccatcaagaaatttggagcttataccattgctaagtatggtatgtctatgtatgtgcttggaatggcagaagaatttaaaggtgaaattgcagtcaatgcattatggcctaaaacagccatacacactgctgctatggatatgctgggaggacctggtatcgaaagccagtgtagaaaagttgatatcattgcagatgcagcatattccattttccaaaagccaaaaagttttactggcaactttgtcattgatgaaaatatcttaaaagaagaaggaatagaaaattttgacgtttatgcaattaaaccaggtcatcctttgcaaccagatttcttcttagatgaatacccagaagcagttagcaagaaagtggaatcaactggtgctgttccagaattcaaagaagagaaactgcagctgcaaccaaaaccacgttctggagctgtggaagaaacatttagaattgttaaggactctctcagtgatgatgttgttaaagccactcaagcaatctatctgtttgaactctccggtgaagatggtggcacgtggtttcttgatctgaaaagcaagggtgggaatgtcggatatggagagccttctgatcaggcagatgtggtgatgagtatgactactgatgactttgtaaaaatgttttcagggaaactaaaaccaacaatggcattcatgtcagggaaattgaagattaaaggtaacatggccctagcaatcaaattggagaagctaatgaatcagatgaatgccagactgtgaaggaaaatataaaaaaaaagtcgactgctatgctcaaaaagtaaaaaaagctcaacagttaaaatctaatgtttgttttctttcctgttatattataaggatatgcacgtttgttctggaaaagatagaatttgtctctaaaagacttgaaattgtaattaaaatggcaagctaatcaaacataagcttcattaagtgggattctaagacagtctgtgtttttatatttcaagggtttaaccctttgagccttacatctcattcactgtctttctccaagaaaagtattttgggcggacagtcagatcaagcagtaaaattagctctttcaaatcttcttgtcatgtaaaatgaagctagtctgttttaaaatttttagttttggattgtatactaatgaaaatcttaatgatgtttttgatttttatatacttattttaaagaaaatcttatatagtacattttacaaaaattataaaaaatgaattagtactggcgaggactaaatgaaacaataatttttcattttgataactagctttccaggtggacttagccataggaaaatattactaatgtaatttaacaaattgctgcatgtattccatttaaaaatatgtttaaattgtcctaaaacaaaataattttctccctaggagtatgcatttggctacagtgttttgaaacagaaaccttagaataggtcattggtatgggctgaactgtgtatcccccaattcatttgttgaggtcctaactcccatttcttttgaatgtgactgttcggagatgaggcctttaaagaggtgacttaagttcaaaggaggctgttagtctaatccaacatggtgtcctttggacataagagataccagcaatgtgtgcacagaacaaagaccaggagaggacacagtgagaaggcagttatctgcaagcaaagagagaggcttcagaagaaacaaaatcaccagcaccttgatctttgacttctaatctccagaatagtgagaaataaatttctgttgttaagccgtccactgtgggaggccgacgcaggaggattgcttgaggccaggagttcaaggccagcctggacaacatagtaagaccctatctctacccccctaataaattaatttaaaaagccccccaatctgtggtattttattatggcagccctagcaagctaatacagtggtttgagaggctgggagggttgaggggaagataaacttttaaaaagctcttatctttcatttcaatcagttaaaaatacttgctcagtgtaacaattttgcttctcagcttccactctaatattgttgtgccattaagcaatttagctaatcctgacatttcttagattcataatgttaggagcatttaatctgtattttacaagttaggaagcagaggatcagagatgggaaaggactagcccaaggccaacattaacaagccctctaacaaaaactttacaatacatttatgttgaatggaactccaagatctcacctctccatccaggaatggagtccatgtaatcaaagtgaacttaaaaataggacagtttcaacaagtcaggagattcacagcaactgatcaaagggagtccagtcaacgtgagcaagcgtgattatgatgaggaagccccctctgctttaatccacacaaggaacgtaacctgaagtaacctgatgttaaccaatctgctgtgtctactatgctgtttccttgttcctgctagtgctgctttacaaatgcagaccattctatcatacctggcagggcttctgttttattttgtaggctggatgctacccagttcatgaatcgctaataaaagccaattagatcttta

SEQ ID NO: 427984 - DNA, 3283 bp, Homo sapiens
aggcgcactcggcgatcccggcttttccgcgcgcagttcccgcacaggcatcggggggggcaggggcggggcaggggcggggataaatgcggagggacggtccagctttagctctctgctcgccgccgccgctgtcgccgccacctcctctgatctacgaaagtcatgttacccaacaccgggaggctggcaggatgtacagtttttatcacaggtgcaagccgtggcattggcaaagctattgcattgaaagcagcaaaggatggagcaaatattgttattgctgcaaagaccgcccagccacatccaaaacttctaggcacaatctatactgctgctgaagaaattgaagcagttggaggaaaggccttgccatgtattgttgatgtgagagatgaacagcagatcagtgctgcagtggagaaagccatcaagaaatttggaggaattgatattctggtaaataatgccagtgccattagtttgaccaatacattggacacacctaccaagagattggatctgatgatgaacgtgaacaccagaggcacctaccttgcatctaaagcatgtattccttatttgaaaaagagcaaagttgctcatatcctcaatatcagtccaccactgaacctaaatccagtttggttcaaacagcactgtgcttataccattgctaagtatggtatgtctatgtatgtgcttggaatggcagaagaatttaaaggtgaaattgcagtcaatgcattatggcctaaaacagccatacacactgctgctatggatatgctgggaggacctggtatcgaaagccagtgtagaaaagttgatatcattgcagatgcagcatattccattttccaaaagccaaaaagttttactggcaactttgtcattgatgaaaatatcttaaaagaagaaggaatagaaaattttgacgtttatgcaattaaaccaggtcatcctttgcaaccagatttcttcttagatgaatacccagaagcagttagcaagaaagtggaatcaactggtgctgttccagaattcaaagaagagaaactgcagctgcaaccaaaaccacgttctggagctgtggaagaaacatttagaattgttaaggactctctcagtgatgatgttgttaaagccactcaagcaatctatctgtttgaactctccggtgaagatggtggcacgtggtttcttgatctgaaaagcaagggtgggaatgtcggatatggagagccttctgatcaggcagatgtggtgatgagtatgactactgatgactttgtaaaaatgttttcagggaaactaaaaccaacaatggcattcatgtcagggaaattgaagattaaaggtaacatggccctagcaatcaaattggagaagctaatgaatcagatgaatgccagactgtgaaggaaaatataaaaaaaaagtcgactgctatgctcaaaaagtaaaaaaagctcaacagttaaaatctaatgtttgttttctttcctgttatattataaggatatgcacgtttgttctggaaaagatagaatttgtctctaaaagacttgaaattgtaattaaaatggcaagctaatcaaacataagcttcattaagtgggattctaagacagtctgtgtttttatatttcaagggtttaaccctttgagccttacatctcattcactgtctttctccaagaaaagtattttgggcggacagtcagatcaagcagtaaaattagctctttcaaatcttcttgtcatgtaaaatgaagctagtctgttttaaaatttttagttttggattgtatactaatgaaaatcttaatgatgtttttgatttttatatacttattttaaagaaaatcttatatagtacattttacaaaaattataaaaaatgaattagtactggcgaggactaaatgaaacaataatttttcattttgataactagctttccaggtggacttagccataggaaaatattactaatgtaatttaacaaattgctgcatgtattccatttaaaaatatgtttaaattgtcctaaaacaaaataattttctccctaggagtatgcatttggctacagtgttttgaaacagaaaccttagaataggtcattggtatgggctgaactgtgtatcccccaattcatttgttgaggtcctaactcccatttcttttgaatgtgactgttcggagatgaggcctttaaagaggtgacttaagttcaaaggaggctgttagtctaatccaacatggtgtcctttggacataagagataccagcaatgtgtgcacagaacaaagaccaggagaggacacagtgagaaggcagttatctgcaagcaaagagagaggcttcagaagaaacaaaatcaccagcaccttgatctttgacttctaatctccagaatagtgagaaataaatttctgttgttaagccgtccactgtgggaggccgacgcaggaggattgcttgaggccaggagttcaaggccagcctggacaacatagtaagaccctatctctacccccctaataaattaatttaaaaagccccccaatctgtggtattttattatggcagccctagcaagctaatacagtggtttgagaggctgggagggttgaggggaagataaacttttaaaaagctcttatctttcatttcaatcagttaaaaatacttgctcagtgtaacaattttgcttctcagcttccactctaatattgttgtgccattaagcaatttagctaatcctgacatttcttagattcataatgttaggagcatttaatctgtattttacaagttaggaagcagaggatcagagatgggaaaggactagcccaaggccaacattaacaagccctctaacaaaaactttacaatacatttatgttgaatggaactccaagatctcacctctccatccaggaatggagtccatgtaatcaaagtgaacttaaaaataggacagtttcaacaagtcaggagattcacagcaactgatcaaagggagtccagtcaacgtgagcaagcgtgattatgatgaggaagccccctctgctttaatccacacaaggaacgtaacctgaagtaacctgatgttaaccaatctgctgtgtctactatgctgtttccttgttcctgctagtgctgctttacaaatgcagaccattctatcatacctggcagggcttctgttttattttgtaggctggatgctacccagttcatgaatcgctaataaaagccaattagatcttta

SEQ ID NO: 427985 - DNA, 4980 bp, Homo sapiens
  misc_feature (4183)..(4183): n is a, c, g, or t
aggcgcactcggcgatcccggcttttccgcgcgcagttcccgcacaggcatcggggggggcaggggcggggcaggggcggggataaatgcggagggacggtccagctttagctctctgctcgccgccgccgctgtcgccgccacctcctctgatctacgaaagtcatgttacccaacaccgggaggctggcaggatgtacagtttttatcacaggtgcaagccgtggcattggcaaagctattgcattgaaagcagcaaaggatggagcaaatattgttattgctgcaaagaccgcccagccacatccaaaacttctaggcacaatctatactgctgctgaagaaattgaagcagttggaggaaaggccttgccatgtattgttgatgtgagagatgaacagcagatcagtgctgcagtggagaaagccatcaagaaatttggaggaattgatattctggtaaataatgccagtgccattagtttgaccaatacattggacacacctaccaagagattggatctgatgatgaacgtgaacaccagaggcacctaccttgcatctaaagcatgtattccttatttgaaaaagagcaaagttgctcatatcctcaatatcagtccaccactgaacctaaatccagtttggttcaaacagcactgtgcttataccattgctaagtatggtatgtctatgtatgtgcttggaatggcagaagaatttaaaggtgaaattgcagtcaatgcattatggcctaaaacagccatacacactgctgctatggatatgctgggaggacctggtatcgaaagccagtgtagaaaagttgatatcattgcagatgcagcatattccattttccaaaagccaaaaagttttactggcaactttgtcattgatgaaaatatcttaaaagaagaaggaatagaaaattttgacgtttatgcaattaaaccaggtcatcctttgcaaccagatttcttcttagatgaatacccagaagcagttagcaagaaagtggaatcaactggtgctgttccagaattcaaagaagagaaactgcagctgcaaccaaaaccacgttctggagctgtggaagaaacatttagaattgttaaggactctctcagtgatgatgttgttaaagccactcaagcaatctatctgtttgaactctccggtgaagatggtggcacgtggtttcttgatctgaaaagcaagggtgggaatgtcggatatggagagccttctgatcaggcagatgtggtgatgagtatgactactgatgactttgtaaaaatgttttcagggaaactaaaaccaacaatggcattcatgtcagggaaattgaagattaaaggtaacatggccctagcaatcaaattggagaagctaatgaatcagatgaatgccagactgtgaaggaaaatataaaaaaaaagtcgactgctatgctcaaaaagtaaaaaaagctcaacagttaaaatctaatgtttgttttctttcctgttatattataaggatatgcacgtttgttctggaaaagatagaatttgtctctaaaagacttgaaattgtaattaaaatggcaagctaatcaaacataagcttcattaagtgggattctaagacagtctgtgtttttatatttcaagggtttaaccctttgagccttacatctcattcactgtctttctccaagaaaagtattttgggcggacagtcagatcaagcagtaaaattagctctttcaaatcttcttgtcatgtaaaatgaagctagtctgttttaaaatttttagttttggattgtatactaatgaaaatcttaatgatgtttttgatttttatatacttattttaaagaaaatcttatatagtacattttacaaaaattataaaaaatgaattagtactggcgaggactaaatgaaacaataatttttcattttgataactagctttccaggtggacttagccataggaaaatattactaatgtaatttaacaaattgctgcatgtattccatttaaaaatatgtttaaattgtcctaaaacaaaataattttctccctaggagtatgcatttggctacagtgttttgaaacagaaaccttagaataggtcattggtatgggctgaactgtgtatcccccaattcatttgttgaggtcctaactcccatttcttttgaatgtgactgttcggagatgaggcctttaaagaggtgacttaagttcaaaggaggctgttagtctaatccaacatggtgtcctttggacataagagataccagcaatgtgtgcacagaacaaagaccaggagaggacacagtgagaaggcagttatctgcaagcaaagagagaggcttcagaagaaacaaaatcaccagcaccttgatctttgacttctaatctccagaatagtgagaaataaatttctgttgttaagccgtccactgtgggaggccgacgcaggaggattgcttgaggccaggagttcaaggccagcctggacaacatagtaagaccctatctctacccccctaataaattaatttaaaaagccccccaatctgtggtattttattatggcagccctagcaagctaatacagtggtttgagaggctgggagggttgaggggaagataaacttttaaaaagctcttatctttcatttcaatcagttaaaaatacttgctcagtgtaacaattttgcttctcagcttccactctaatattgttgtgccattaagcaatttagctaatcctgacatttcttagattcataatgttaggagcatttaatctgtattttacaagttaggaagcagaggatcagagatgggaaaggactagcccaaggccaacattaacaagccctctaacaaaaactttacaatacatttatgttgaatggaactccaagatctcacctctccatccaggaatggagtccatgtaatcaaagtgaacttaaaaataggacagtttcaacaagtcaggagattcacagcaactgatcaaagggagtccagtcaacgtgagcaagcgtgattatgatgaggaagccccctctgctttaatccacacaaggaacgtaacctgaagtaacctgatgttaaccaatctgctgtgtctactatgctgtttccttgttcctgctagtgctgctttacaaatgcagaccattctatcatacctggcagggcttctgttttattttgtaggctggatgctacccagttcatgaatcgctaataaaagccaattagatctttacataatttgttgagattttattctttgacattcttaaaggtttgggaaaattagaggtagaacataccgtgaggcagcaatctctgggttctggtcattaaaatatgaatttgctaattatacctatcccaacagggggattgagtcaagggaccttgcccttttctggactgacctgcttgattattgccctaagtgattgttagttaggttgcccattggaatctctgccttctggctttaaaaatttttccagattggagtaaattgagctgactggttttgagctttgtaatgttaggggaccagcaatgagttcctctgatccatccaatcattagtagattaaatctttgttttaaacccatcacagtccactattcatccctttttaaaataaccatttaaaaattttctaccctgaattgcattttgaaagggatggttcctaggtaacacaaggtagaaaatttacatctcaaaggcagagaacttacatttcaggcctaaatattgttatttgccaagacagaaagttgatgctaagaagcccagttcagacaaaatggttgaaggtgagtttatttggactaatgctctcacctattgtaagaatttctactgattttcctttatagatacacgtttttacaaagagtttcaaaataactggctaaataccagaaacgcaaattttggagactgatttaattcaataggcggtcttttcaacttagcttctgtttcttaactagattactgagttcagggcagagcccattagcaaatagagcagacaaagggtttcctatttctggatgcagatggatagttctgaaaatgcaaatctgcttcacccaagggcctaatttttataaatattacctagctttctttttncctttggagtaaaacagtaactaagtgaaaagattggcagattcaattttcttataaactagttgcttaaacttttcatttgccttctacgtgagctcttttaaagagacaaacatttttgaaatctttttagaagcttttgcacatcaataggtatccctaggagggcctgattcagaagccctcatttttaaactcaattcttagatgaacagtcttattcatctggaatgttccacataatggtcatcataattctaatttatctttagtaagatttcaccatttttgtaagtatttgcagcttctaggccctaacacatgtaaaaggtaaacatagccagaaggtgaaatacacagttctttaaaaatttaaggatgctggccaggcgaggtggctcacacctgtaatcccagcactttgggaggctgaggtcggaggccaggagtttgagaccagcctagccaacatggtgaaaccccgtctctactaaaaatacaaaaattagatgggtgtggcagtgtggcctttaatccagctacccaggaggctgaggtgcgagaattgtttgagcccaggaggtggaggttgcattgagctgagactgcgccactgcactccagcctggacaacagagtgagatgctgtcttaaaaataaaaaaaaagaattaaggatgccatttttaagttgaatcttgagtctctcagagtcaagataaaagtctgagtgaaacgccatgaggttgggtcactgtgtttgctatctatctacctatctatctatctatctatcta

SEQ ID NO: 427986 - DNA, 4786 bp, Homo sapiens
  misc_feature (4183)..(4183): n is a, c, g, or t
aggcgcactcggcgatcccggcttttccgcgcgcagttcccgcacaggcatcggggggggcaggggcggggcaggggcggggataaatgcggagggacggtccagctttagctctctgctcgccgccgccgctgtcgccgccacctcctctgatctacgaaagtcatgttacccaacaccgggaggctggcaggatgtacagtttttatcacaggtgcaagccgtggcattggcaaagctattgcattgaaagcagcaaaggatggagcaaatattgttattgctgcaaagaccgcccagccacatccaaaacttctaggcacaatctatactgctgctgaagaaattgaagcagttggaggaaaggccttgccatgtattgttgatgtgagagatgaacagcagatcagtgctgcagtggagaaagccatcaagaaatttggaggaattgatattctggtaaataatgccagtgccattagtttgaccaatacattggacacacctaccaagagattggatctgatgatgaacgtgaacaccagaggcacctaccttgcatctaaagcatgtattccttatttgaaaaagagcaaagttgctcatatcctcaatatcagtccaccactgaacctaaatccagtttggttcaaacagcactgtgcttataccattgctaagtatggtatgtctatgtatgtgcttggaatggcagaagaatttaaaggtgaaattgcagtcaatgcattatggcctaaaacagccatacacactgctgctatggatatgctgggaggacctggtatcgaaagccagtgtagaaaagttgatatcattgcagatgcagcatattccattttccaaaagccaaaaagttttactggcaactttgtcattgatgaaaatatcttaaaagaagaaggaatagaaaattttgacgtttatgcaattaaaccaggtcatcctttgcaaccagatttcttcttagatgaatacccagaagcagttagcaagaaagtggaatcaactggtgctgttccagaattcaaagaagagaaactgcagctgcaaccaaaaccacgttctggagctgtggaagaaacatttagaattgttaaggactctctcagtgatgatgttgttaaagccactcaagcaatctatctgtttgaactctccggtgaagatggtggcacgtggtttcttgatctgaaaagcaagggtgggaatgtcggatatggagagccttctgatcaggcagatgtggtgatgagtatgactactgatgactttgtaaaaatgttttcagggaaactaaaaccaacaatggcattcatgtcagggaaattgaagattaaaggtaacatggccctagcaatcaaattggagaagctaatgaatcagatgaatgccagactgtgaaggaaaatataaaaaaaaagtcgactgctatgctcaaaaagtaaaaaaagctcaacagttaaaatctaatgtttgttttctttcctgttatattataaggatatgcacgtttgttctggaaaagatagaatttgtctctaaaagacttgaaattgtaattaaaatggcaagctaatcaaacataagcttcattaagtgggattctaagacagtctgtgtttttatatttcaagggtttaaccctttgagccttacatctcattcactgtctttctccaagaaaagtattttgggcggacagtcagatcaagcagtaaaattagctctttcaaatcttcttgtcatgtaaaatgaagctagtctgttttaaaatttttagttttggattgtatactaatgaaaatcttaatgatgtttttgatttttatatacttattttaaagaaaatcttatatagtacattttacaaaaattataaaaaatgaattagtactggcgaggactaaatgaaacaataatttttcattttgataactagctttccaggtggacttagccataggaaaatattactaatgtaatttaacaaattgctgcatgtattccatttaaaaatatgtttaaattgtcctaaaacaaaataattttctccctaggagtatgcatttggctacagtgttttgaaacagaaaccttagaataggtcattggtatgggctgaactgtgtatcccccaattcatttgttgaggtcctaactcccatttcttttgaatgtgactgttcggagatgaggcctttaaagaggtgacttaagttcaaaggaggctgttagtctaatccaacatggtgtcctttggacataagagataccagcaatgtgtgcacagaacaaagaccaggagaggacacagtgagaaggcagttatctgcaagcaaagagagaggcttcagaagaaacaaaatcaccagcaccttgatctttgacttctaatctccagaatagtgagaaataaatttctgttgttaagccgtccactgtgggaggccgacgcaggaggattgcttgaggccaggagttcaaggccagcctggacaacatagtaagaccctatctctacccccctaataaattaatttaaaaagccccccaatctgtggtattttattatggcagccctagcaagctaatacagtggtttgagaggctgggagggttgaggggaagataaacttttaaaaagctcttatctttcatttcaatcagttaaaaatacttgctcagtgtaacaattttgcttctcagcttccactctaatattgttgtgccattaagcaatttagctaatcctgacatttcttagattcataatgttaggagcatttaatctgtattttacaagttaggaagcagaggatcagagatgggaaaggactagcccaaggccaacattaacaagccctctaacaaaaactttacaatacatttatgttgaatggaactccaagatctcacctctccatccaggaatggagtccatgtaatcaaagtgaacttaaaaataggacagtttcaacaagtcaggagattcacagcaactgatcaaagggagtccagtcaacgtgagcaagcgtgattatgatgaggaagccccctctgctttaatccacacaaggaacgtaacctgaagtaacctgatgttaaccaatctgctgtgtctactatgctgtttccttgttcctgctagtgctgctttacaaatgcagaccattctatcatacctggcagggcttctgttttattttgtaggctggatgctacccagttcatgaatcgctaataaaagccaattagatctttacataatttgttgagattttattctttgacattcttaaaggtttgggaaaattagaggtagaacataccgtgaggcagcaatctctgggttctggtcattaaaatatgaatttgctaattatacctatcccaacagggggattgagtcaagggaccttgcccttttctggactgacctgcttgattattgccctaagtgattgttagttaggttgcccattggaatctctgccttctggctttaaaaatttttccagattggagtaaattgagctgactggttttgagctttgtaatgttaggggaccagcaatgagttcctctgatccatccaatcattagtagattaaatctttgttttaaacccatcacagtccactattcatccctttttaaaataaccatttaaaaattttctaccctgaattgcattttgaaagggatggttcctaggtaacacaaggtagaaaatttacatctcaaaggcagagaacttacatttcaggcctaaatattgttatttgccaagacagaaagttgatgctaagaagcccagttcagacaaaatggttgaaggtgagtttatttggactaatgctctcacctattgtaagaatttctactgattttcctttatagatacacgtttttacaaagagtttcaaaataactggctaaataccagaaacgcaaattttggagactgatttaattcaataggcggtcttttcaacttagcttctgtttcttaactagattactgagttcagggcagagcccattagcaaatagagcagacaaagggtttcctatttctggatgcagatggatagttctgaaaatgcaaatctgcttcacccaagggcctaatttttataaatattacctagctttctttttncctttggagtaaaacagtaactaagtgaaaagattggcagattcaattttcttataaactagttgcttaaacttttcatttgccttctacgtgagctcttttaaagagacaaacatttttgaaatctttttagaagcttttgcacatcaataggtatccctaggagggcctgattcagaagccctcatttttaaactcaattcttagatgaacagtcttattcatctggaatgttccacataatggtcatcataattctaatttatctttagtaagatttcaccatttttgtaagtatttgcagcttctaggccctaacacatgtaaaaggtaaacatagccagaaggtgaaatacacagttctttaaaaatttaaggataaagtgctgggattataggtgtgagccaccatgcccagcctaaataattttttaaattccagtttttaattattctttgttaggatacagaaatgctttgtgtcctgcaatactgttaaatctccttattagttttagcagctttttttgtaaatcccttaggattttctatgtatgtgattgttatctgcaaataaaggcagttttatttcttcttttccac

SEQ ID NO: 427987 - DNA, 2569 bp, Homo sapiens
aggcgcactcggcgatcccggcttttccgcgcgcagttcccgcacaggcatcggggggggcaggggcggggcaggggcggggataaatgcggagggacggtccagctttagctctctgctcgccgccgccgctgtcgccgccacctcctctgatctacgaaagtcatgttacccaacaccgggaggctggcaggatgtacagtttttatcacaggtgcaagccgtggcattggcaaagctattgcattgaaagcagcaaaggatggagcaaatattgttattgctgcaaagaccgcccagccacatccaaaacttctaggcacaatctatactgctgctgaagaaattgaagcagttggaggaaaggccttgccatgtattgttgatgtgagagatgaacagcagatcagtgctgcagtggagaaagccatcaagaaatttggaggaattgatattctggtaaataatgccagtgccattagtttgaccaatacattggacacacctaccaagagattggatctgatgatgaacgtgaacaccagaggcacctaccttgcatctaaagcatgtattccttatttgaaaaagagcaaagttgctcatatcctcaatatcagtccaccactgaacctaaatccagtttggttcaaacagcactgtgcttataccattgctaagtatggtatgtctatgtatgtgcttggaatggcagaagaatttaaaggtgaaattgcagtcaatgcattatggcctaaaacagccatacacactgctgctatggatatgctgggaggacctggtatcgaaagccagtgtagaaaagttgatatcattgcagatgcagcatattccattttccaaaagccaaaaagttttactggcaactttgtcattgatgaaaatatcttaaaagaagaaggaatagaaaattttgacgtttatgcaattaaaccaggtcatcctttgcaaccagatttcttcttagatgaatacccagaagcagttagcaagaaagtggaatcaactggtgctgttccagaattcaaagaagagaaactgcagctgcaaccaaaaccacgttctggagctgtggaagaaacatttagaattgttaaggactctctcagtgatgatgttgttaaagccactcaagcaatctatctgtttgaactctccggtgaagatggtggcacgtggtttcttgatctgaaaagcaagggtgggaatgtcggatatggagagccttctgatcaggcagatgtggtgatgagtatgactactgatgactttgtaaaaatgttttcagggaaactaaaaccaacaatggcattcatgtcagggaaattgaagattaaaggtaacatggccctagcaatcaaattggagaagctaatgaatcagatgaatgccagactgtgaaggaaaatataaaaaaaaagtcgactgctatgctcaaaaagtaaaaaaagctcaacagttaaaatctaatgtttgttttctttcctgttatattataaggatatgcacgtttgttctggaaaagatagaatttgtctctaaaagacttgaaattgtaattaaaatggcaagctaatcaaacataagcttcattaagtgggattctaagacagtctgtgtttttatatttcaagggtttaaccctttgagccttacatctcattcactgtctttctccaagaaaagtattttgggcggacagtcagatcaagcagtaaaattagctctttcaaatcttcttgtcatgtaaaatgaagctagtctgttttaaaatttttagttttggattgtatactaatgaaaatcttaatgatgtttttgatttttatatacttattttaaagaaaatcttatatagtacattttacaaaaattataaaaaatgaattagtactggcgaggactaaatgaaacaataatttttcattttgataactagctttccaggtggacttagccataggaaaatattactaatgtaatttaacaaattgctgcatgtattccatttaaaaatatgtttaaattgtcctaaaacaaaataattttctccctaggagtatgcatttggctacagtgttttgaaacagaaaccttagaataggtcattggtatgggctgaactgtgtatcccccaattcatttgttgaggtcctaactcccatttcttttgaatgtgactgttcggagatgaggcctttaaagaggtgacttaagttcaaaggaggctgttagtctaatccaacatggtgtcctttggacataagagataccagcaatgtgtgcacagaacaaagaccaggagaggacacagtgagaaggcagttatctgcaagcaaagagagaggcttcagaagaaacaaaatcaccagcaccttgatctttgacttctaatctccagaatagtgagaaataaatttctgttgttaagccgtccactgtgggaggccgacgcaggaggattgcttgaggccaggagttcaaggccagcctggacaacatagtaagaccctatctctacccccctaataaattaatttaaaaagcc

SEQ ID NO: 427988 - DNA, 1501 bp, Homo sapiens
aggcgcactcggcgatcccggcttttccgcgcgcagttcccgcacaggcatcggggggggcaggggcggggcaggggcggggataaatgcggagggacggtccagctttagctctctgctcgccgccgccgctgtcgccgccacctcctctgatctacgaaagtcatgttacccaacaccgggaggctggcaggatgtacagtttttatcacaggtgcaagccgtggcattggcaaagctattgcattgaaagcagcaaaggatggagcaaatattgttattgctgcaaagaccgcccagccacatccaaaacttctaggcacaatctatactgctgctgaagaaattgaagcagttggaggaaaggccttgccatgtattgttgatgtgagagatgaacagcagatcagtgctgcagtggagaaagccatcaagaaatttggaggaattgatattctggtaaataatgccagtgccattagtttgaccaatacattggacacacctaccaagagattggatctgatgatgaacgtgaacaccagaggcacctaccttgcatctaaagcatgtattccttatttgaaaaagagcaaagttgctcatatcctcaatatcagtccaccactgaacctaaatccagtttggttcaaacagcactgtggtaggtggtaggtggtagggtgaggggatggtttgtgcttaatttgttttgaattaaatctgtgtatgtctgatgtaatcacaatctgcacataacattcatcattgaattttctatgccaagtcattaagtggcatttggaaagtagattcttcatcttttatctgtaatttaaaaaattgaggcataattgacattcaataaaatgcacagctcttaatggttcagtttgatgagttttgagaaatgtatataaccaacacccaaatcaagatacagatttttaccatttcagaaagctctttcatttcccaatgagtgtgttttactgtgtgtaatttattcatctataaagttggttaaaaactatctatgagatactttatttttcttagacaggtatgcacctgtagtcctagctacttgaaaggctgaggtgggaggatcgcttgagcccaggagtttgaggctgcagtgagctaggatcatggcactgcactcctgcctgggtgacagagcgagaccctgactctaaaaaaaaaaaaaaaaacgacaaaaaaaccctattacctttcatagcaaactaatggtttaaggtaaatatgctaagcaacaagatttacatatagatgcctcctttaaaatagttgtatcaaacacttagtttttatttcagcacagttcactaacatttggaaaggcacttggaatgggaacccacagagcaaaactgaaagaagttccactttaattgactaggttaaatacatttgcagcctttttttattattgttttactagcagtagtttccctttaaataaacactttcattctta

SEQ ID NO: 427989 - DNA, 512 bp, Homo sapiens
agtactgtatacctgtgtgtttgcttttatatgtatacttttatttccagtattatcacttaattgctatgtagatatataactgacatttataaataacactttcctatttatagtatgttattaataggtcataattatactaatggagtaaatctcactaaagctgacgtacatagaagaaattttggattgatcataatctgcttaagtgagaccttcctgtgacttagttaattttatgtgtcttttatcatggtacagtatagcattctgattgtgggtgaagtgatacaccctctaaatactgcatctaaaaacaacctcaccttaattgcaggctgaacagaattttggaagggtttcattcacaaacctgcatgtatgcctttaagaaagttcctatattcttctgagggtcatagtttggtgtcttacctcttgttcaatacagcaaggacacaaactgaccaaaaacgatgataaagggtcaagagtcactgacattgtca

SEQ ID NO: 427990 - DNA, 920 bp, Homo sapiens
  misc_feature (704)..(704): n is a, c, g, or t
  misc_feature (717)..(718): n is a, c, g, or t
  misc_feature (722)..(722): n is a, c, g, or t
  misc_feature (724)..(724): n is a, c, g, or t
  misc_feature (726)..(726): n is a, c, g, or t
  misc_feature (728)..(728): n is a, c, g, or t
  misc_feature (733)..(733): n is a, c, g, or t
  misc_feature (742)..(744): n is a, c, g, or t
  misc_feature (753)..(753): n is a, c, g, or t
  misc_feature (765)..(766): n is a, c, g, or t
  misc_feature (773)..(773): n is a, c, g, or t
  misc_feature (776)..(777): n is a, c, g, or t
ctggagtgcagtggcatgatctcagctcactgcaacttccaactccctggttcaagcgattctcctgcctcagcctcccgagtagctgggattataggcacacaccagcacaccaggctaatttttgtatttttagtaaagacagggtttcaccatgttagccaggatggtctcgatctcctgacctcgtgatccacctgcctctgcctcccaaagtgctgggattacaggtgtgagccacctcgcccggcccatttttccccatttcatttcctgtctccatgccctcttcttgaccccagtgatggccacgtcttgtttctagaatcccttcctttgcacaagccatattctgaactcttaattccttcccttaacttcaatccctatgtctcctgtcctacctcatggttttcctggccccacacctgatgctcagagcccactgtgaacccctggtgcctctttttggactcggttctcccttctctcccacagaccttcccctcctccaatgagtcccgccaatgccccaatgcccgttgccagttcgccttctacggtggtgagtcgggctaccaccgggccctgctgggcctgcagatcttcaatgccttcatgttcttctggttggccaacttcgtgctggcgctgggccaggtcacgctgtatggcctggcagcggagactgcggctccgtcttntgcttggcggggnnaggncnanangtccnggctggggnnnctggcaggnacaccgggaacnnaccgaanggnngaccgcacaaagtcgcgggccaggcgtccaggggtcggggaaacacatccaaaaagacacaggcagaatagggcggagtgccgagaaagagggggcagccgggaacagggaggaacaggaccctgtgcacgtggtcgcgcgcc

SEQ ID NO: 427991 - DNA, 240 bp, Homo sapiens
ggaactgcaagtgtaaagtccctgaggcagaagcctcgatgtttgcttctgttaaatgggggcagttgtagctgctttgcaaagttgcaggatcctggagagggagaacccctggccccaggggaaagaggggggggtctcccgtttcctgtgcctgcaccagccctgcccccattgcgtctgcacacccctgcgtgtaactgcattccaaccactaataaagtgcctattgtacaggtc

SEQ ID NO: 427992 - DNA, 226 bp, Homo sapiens
tcacacctgcccctcgtgtcctcatcagagtggctgtcctggataaagttactgacttcctcttcctgttgggcaaacttctgatcgttggtagtgtgggtgagtgccgcccacctagcctctcggggtgtgggagcctgatttctgtcttctgtgatgagtgtcatcttcttaggaggctgtttcctatatccagaacccttcgccatcttgctttcttctcctt

SEQ ID NO: 427993 - DNA, 3509 bp, Homo sapiens
gggagcagctgcagccccgcccgcgccctcccgggtcccttagtctgggcagctgcccagctcgggccggtctgaccggtttgggccgccccgcctggcgctgtgctgggaggagccgccgccagtcgcgcggtcagtgcctccctccagactcgggagggtcgagggggcgcgggagagagcgcgggcggccgccggggctggtcgcctgcagggatgggggacgagcggccccactactacgggaaacacggaacgccacagaagtatgatcccactttcaaaggacccatttacaataggggctgcacggatatcatatgctgtgtgttcctgctcctggccattgtgggctacgtggctgtaggcatcatagcctggactcatggagaccctcgaaaggtgatctaccccactgatagccggggcgagttctgcgggcagaagggcacaaaaaacgagaacaaaccctatctgttttatttcaacattgtgaaatgtgccagccccctggttctgctggaattccaatgtcccactccccagatctgcgtggaaaaatgccccgaccgctacctcacgtacctgaatgctcgcagctcccgggactttgagtactataagcagttctgtgttcctggcttcaagaacaataaaggagtggctgaggtgcttcgagatggtgactgccctgctgtcctcatccccagcaaacccttggcccggagatgcttccccgctatccacgcctacaagggtgtcctgatggtgggcaatgagacgacctatgaggatgggcatggctcccggaaaaacatcacagacctggtggagggcgccaagaaagccaatggagtcctagaggcgcggcaactcgccatgcgcatatttgaagattacaccgtctcttggtactggattatcataggcctggtcattgccatggcgatgagcctcctgttcatcatcctgcttcgcttcctggctggtattatggtctgggtgatgatcatcatggtgattctggtgctgggctacggaatatttcactgctacatggagtactcccgactgcgtggtgaggccggctctgatgtctctttggtggacctcggctttcagacggatttccgggtgtacctgcacttacggcagacctggttggcctttatgatcattctgagtatccttgaagtcattatcatcttgctgctcatctttctccggaagagaattctcatcgcgattgcactcatcaaagaagccagcagggctgtgggatacgtcatgtgctccttgctctacccactggtcaccttcttcttgctgtgcctctgcatcgcctactgggccagcactgctgtcttcctgtccacttccaacgaagcggtctataagatctttgatgacagcccctgcccatttactgcgaaaacctgcaacccagagaccttcccctcctccaatgagtcccgccaatgccccaatgcccgttgccagttcgccttctacggtggtgagtcgggctaccaccgggccctgctgggcctgcagatcttcaatgccttcatgttcttctggttggccaacttcgtgctggcgctgggccaggtcacgctggccggggcctttgcctcctactactgggccctgcgcaagccggacgacctgccggccttcccgctcttctctgcctttggccgggcgctcaggtaccacacaggctccctggcctttggcgcgctcatcctggccattgtgcagatcatccgtgtgatactcgagtacctggatcagcggctgaaagctgcagagaacaagtttgccaagtgcctcatgacctgtctcaaatgctgcttctggtgcctggagaagttcatcaaattccttaataggaatgcctacatcatgattgccatctacggcaccaatttctgcacctcggccaggaatgccttcttcctgctcatgagaaacatcatcagagtggctgtcctggataaagttactgacttcctcttcctgttgggcaaacttctgatcgttggtagtgtggggatcctggctttcttcttcttcacccaccgtatcaggatcgtgcaggatacagcaccacccctcaattattactgggttcctatactgacggtgatcgttggctcctacttgattgcacacggtttcttcagcgtctatggcatgtgtgtggacacgctgttcctctgcttcttggaggacctggagaggaatgacggctcggccgagaggccttacttcatgtcttccaccctcaagaaactcttgaacaagaccaacaagaaggcagcggagtcctgaaggccccgtgctccccacctctcaaggagtctcatgccgcagggtgctcagtagctgggtctgttcccccagccccttgggctcacctgaagtcctatcactgccgctctgcccctccccatgagccagatcccaccagtttctggacgtggagagtctggggcatctccttcttatgccaaggggcgcttggagttttcatggctgcccctccagactgcgagaaacaagtaaaaacccattggggcctcttgatgtctgggatggcacgtggcccgacctccacaagctccctcatgcttcctgtcccccgcttacacgacaacgggccagaccacgggaaggacggtgtttgtgtctgagggagctgctggccacagtgaacacccacgtttattcctgcctgctccggccaggactgaaccccttctccacacctgaacagttggctcaagggccaccagaagcatttctttattattattattttttaacctggacatgcattaaagggtctattagctttctttccgtctgtctcaacagctgagatggggccgccaaggagtgccttccttttgctccctcctagctgggagtgacgggtgggagtgtgtgtgcccaggtgggggtgtctcctggctgggaaggagggaaagggagggagagttttgcgggggttggcagtggagagcaggctggagaggagatggctaatagctgtttaatggaaacctgctgggctggagggagttaggctgaatttcccgacttcctctgccagttattgacacagctctctttgtaagagaggaaagaaactaaacccacccaagggatgatttcagggggagaggtggagggcagatgtcctgggcaaaccgggcccctctgcccacacacctcacttgatccttttgccaaacttgtcaaactcaggggaactggcttcccagttgcccctttgccatattccaagtccccctcagacttcatgtctctgctcatcagcactgtcccaggatcctggagagggagaacccctggccccaggggaaagaggggggggtctcccgtttcctgtgcctgcaccagccctgcccccattgcgtctgcacacccctgcgtgtaactgcattccaaccactaataaagtgcctattgtacaggtc

SEQ ID NO: 427994 - DNA, 3412 bp, Homo sapiens
tgcaataggtaactaatgaacaccgcttgctagttatacgtgtccgtcgatcgggatagctcgcgcggctgggtgcgctggctcggactcgctcccgccccgcgcggcgggccccaagtggggatgggacgaagcgggaaaaaaacggagcctacggaacgccacagaagtatgatcccactttcaaaggacccatttacaataggggctgcacggatatcatatgctgtgtgttcctgctcctggccattgtgggctacgtggctgtaggcatcatagcctggactcatggagaccctcgaaaggtgatctaccccactgatagccggggcgagttctgcgggcagaagggcacaaaaaacgagaacaaaccctatctgttttatttcaacattgtgaaatgtgccagccccctggttctgctggaattccaatgtcccactccccagatctgcgtggaaaaatgccccgaccgctacctcacgtacctgaatgctcgcagctcccgggactttgagtactataagcagttctgtgttcctggcttcaagaacaataaaggagtggctgaggtgcttcgagatggtgactgccctgctgtcctcatccccagcaaacccttggcccggagatgcttccccgctatccacgcctacaagggtgtcctgatggtgggcaatgagacgacctatgaggatgggcatggctcccggaaaaacatcacagacctggtggagggcgccaagaaagccaatggagtcctagaggcgcggcaactcgccatgcgcatatttgaagattacaccgtctcttggtactggattatcataggcctggtcattgccatggcgatgagcctcctgttcatcatcctgcttcgcttcctggctggtattatggtctgggtgatgatcatcatggtgattctggtgctgggctacggaatatttcactgctacatggagtactcccgactgcgtggtgaggccggctctgatgtctctttggtggacctcggctttcagacggatttccgggtgtacctgcacttacggcagacctggttggcctttatgatcattctgagtatccttgaagtcattatcatcttgctgctcatctttctccggaagagaattctcatcgcgattgcactcatcaaagaagccagcagggctgtgggatacgtcatgtgctccttgctctacccactggtcaccttcttcttgctgtgcctctgcatcgcctactgggccagcactgctgtcttcctgtccacttccaacgaagcggtctataagatctttgatgacagcccctgcccatttactgcgaaaacctgcaacccagagaccttcccctcctccaatgagtcccgccaatgccccaatgcccgttgccagttcgccttctacggtggtgagtcgggctaccaccgggccctgctgggcctgcagatcttcaatgccttcatgttcttctggttggccaacttcgtgctggcgctgggccaggtcacgctggccggggcctttgcctcctactactgggccctgcgcaagccggacgacctgccggccttcccgctcttctctgcctttggccgggcgctcaggtaccacacaggctccctggcctttggcgcgctcatcctggccattgtgcagatcatccgtgtgatactcgagtacctggatcagcggctgaaagctgcagagaacaagtttgccaagtgcctcatgacctgtctcaaatgctgcttctggtgcctggagaagttcatcaaattccttaataggaatgcctacatcatgattgccatctacggcaccaatttctgcacctcggccaggaatgccttcttcctgctcatgagaaacatcatcagagtggctgtcctggataaagttactgacttcctcttcctgttgggcaaacttctgatcgttggtagtgtggggatcctggctttcttcttcttcacccaccgtatcaggatcgtgcaggatacagcaccacccctcaattattactgggttcctatactgacggtgatcgttggctcctacttgattgcacacggtttcttcagcgtctatggcatgtgtgtggacacgctgttcctctgcttcttggaggacctggagaggaatgacggctcggccgagaggccttacttcatgtcttccaccctcaagaaactcttgaacaagaccaacaagaaggcagcggagtcctgaaggccccgtgctccccacctctcaaggagtctcatgccgcagggtgctcagtagctgggtctgttcccccagccccttgggctcacctgaagtcctatcactgccgctctgcccctccccatgagccagatcccaccagtttctggacgtggagagtctggggcatctccttcttatgccaaggggcgcttggagttttcatggctgcccctccagactgcgagaaacaagtaaaaacccattggggcctcttgatgtctgggatggcacgtggcccgacctccacaagctccctcatgcttcctgtcccccgcttacacgacaacgggccagaccacgggaaggacggtgtttgtgtctgagggagctgctggccacagtgaacacccacgtttattcctgcctgctccggccaggactgaaccccttctccacacctgaacagttggctcaagggccaccagaagcatttctttattattattattttttaacctggacatgcattaaagggtctattagctttctttccgtctgtctcaacagctgagatggggccgccaaggagtgccttccttttgctccctcctagctgggagtgacgggtgggagtgtgtgtgcccaggtgggggtgtctcctggctgggaaggagggaaagggagggagagttttgcgggggttggcagtggagagcaggctggagaggagatggctaatagctgtttaatggaaacctgctgggctggagggagttaggctgaatttcccgacttcctctgccagttattgacacagctctctttgtaagagaggaaagaaactaaacccacccaagggatgatttcagggggagaggtggagggcagatgtcctgggcaaaccgggcccctctgcccacacacctcacttgatccttttgccaaacttgtcaaactcaggggaactggcttcccagttgcccctttgccatattccaagtccccctcagacttcatgtctctgctcatcagcactgtcccaggatcctggagagggagaacccctggccccaggggaaagaggggggggtctcccgtttcctgtgcctgcaccagccctgcccccattgcgtctgcacacccctgcgtgtaactgcattccaaccactaataaagtgcctattgtacaggtc

SEQ ID NO: 427995 - DNA, 3462 bp, Homo sapiens
cggggcggggcgtgcagcccgcggagcctcccgcccgcccgggctggggtcgcgctggctcggactccgctccccgccccgccgcggccatggaggacgagcggaaaaacggagcctacggaacgccacagaagtatgatcccactttcaaaggacccatttacaataggggctgcacggatatcatatgctgtgtgttcctgctcctggccattgtgggctacgtggctgtaggcatcatagcctggactcatggagaccctcgaaaggtgatctaccccactgatagccggggcgagttctgcgggcagaagggcacaaaaaacgagaacaaaccctatctgttttatttcaacattgtgaaatgtgccagccccctggttctgctggaattccaatgtcccactccccagatctgcgtggaaaaatgccccgaccgctacctcacgtacctgaatgctcgcagctcccgggactttgagtactataagcagttctgtgttcctggcttcaagaacaataaaggagtggctgaggtgcttcgagatggtgactgccctgctgtcctcatccccagcaaacccttggcccggagatgcttccccgctatccacgcctacaagggtgtcctgatggtgggcaatgagacgacctatgaggatgggcatggctcccggaaaaacatcacagacctggtggagggcgccaagaaagccaatggagtcctagaggcgcggcaactcgccatgcgcatatttgaagattacaccgtctcttggtactggattatcataggcctggtcattgccatggcgatgagcctcctgttcatcatcctgcttcgcttcctggctggtattatggtctgggtgatgatcatcatggtgattctggtgctgggctacggaatatttcactgctacatggagtactcccgactgcgtggtgaggccggctctgatgtctctttggtggacctcggctttcagacggatttccgggtgtacctgcacttacggcagacctggttggcctttagtgagtcacagtctcccattcctgcccccacatgaggccttggagggagtggggagcccagccggctcagcctttgccctttgcagtgatcattctgagtatccttgaagtcattatcatcttgctgctcatctttctccggaagagaattctcatcgcgattgcactcatcaaagaagccagcagggctgtgggatacgtcatgtgctccttgctctacccactggtcaccttcttcttgctgtgcctctgcatcgcctactgggccagcactgctgtcttcctgtccacttccaacgaagcggtctataagatctttgatgacagcccctgcccatttactgcgaaaacctgcaacccagagaccttcccctcctccaatgagtcccgccaatgccccaatgcccgttgccagttcgccttctacggtggtgagtcgggctaccaccgggccctgctgggcctgcagatcttcaatgccttcatgttcttctggttggccaacttcgtgctggcgctgggccaggtcacgctggccggggcctttgcctcctactactgggccctgcgcaagccggacgacctgccggccttcccgctcttctctgcctttggccgggcgctcaggtaccacacaggctccctggcctttggcgcgctcatcctggccattgtgcagatcatccgtgtgatactcgagtacctggatcagcggctgaaagctgcagagaacaagtttgccaagtgcctcatgacctgtctcaaatgctgcttctggtgcctggagaagttcatcaaattccttaataggaatgcctacatcatgattgccatctacggcaccaatttctgcacctcggccaggaatgccttcttcctgctcatgagaaacatcatcagagtggctgtcctggataaagttactgacttcctcttcctgttgggcaaacttctgatcgttggtagtgtggggatcctggctttcttcttcttcacccaccgtatcaggatcgtgcaggatacagcaccacccctcaattattactgggttcctatactgacggtgatcgttggctcctacttgattgcacacggtttcttcagcgtctatggcatgtgtgtggacacgctgttcctctgcttcttggaggacctggagaggaatgacggctcggccgagaggccttacttcatgtcttccaccctcaagaaactcttgaacaagaccaacaagaaggcagcggagtcctgaaggccccgtgctccccacctctcaaggagtctcatgccgcagggtgctcagtagctgggtctgttcccccagccccttgggctcacctgaagtcctatcactgccgctctgcccctccccatgagccagatcccaccagtttctggacgtggagagtctggggcatctccttcttatgccaaggggcgcttggagttttcatggctgcccctccagactgcgagaaacaagtaaaaacccattggggcctcttgatgtctgggatggcacgtggcccgacctccacaagctccctcatgcttcctgtcccccgcttacacgacaacgggccagaccacgggaaggacggtgtttgtgtctgagggagctgctggccacagtgaacacccacgtttattcctgcctgctccggccaggactgaaccccttctccacacctgaacagttggctcaagggccaccagaagcatttctttattattattattttttaacctggacatgcattaaagggtctattagctttctttccgtctgtctcaacagctgagatggggccgccaaggagtgccttccttttgctccctcctagctgggagtgacgggtgggagtgtgtgtgcccaggtgggggtgtctcctggctgggaaggagggaaagggagggagagttttgcgggggttggcagtggagagcaggctggagaggagatggctaatagctgtttaatggaaacctgctgggctggagggagttaggctgaatttcccgacttcctctgccagttattgacacagctctctttgtaagagaggaaagaaactaaacccacccaagggatgatttcagggggagaggtggagggcagatgtcctgggcaaaccgggcccctctgcccacacacctcacttgatccttttgccaaacttgtcaaactcaggggaactggcttcccagttgcccctttgccatattccaagtccccctcagacttcatgtctctgctcatcagcactgtcccaggatcctggagagggagaacccctggccccaggggaaagaggggggggtctcccgtttcctgtgcctgcaccagccctgcccccattgcgtctgcacacccctgcgtgtaactgcattccaaccactaataaagtgcctattgtacaggtc

SEQ ID NO: 427996 - DNA, 3899 bp, Homo sapiens
gggagcagctgcagccccgcccgcgccctcccgggtcccttagtctgggcagctgcccagctcgggccggtctgaccggtttgggccgccccgcctggcgctgtgctgggaggagccgccgccagtcgcgcggtcagtgcctccctccagactcgggagggtcgagggggcgcgggagagagcgcgggcggccgccggggctggtcgcctgcagggatgggggacgagcggccccactactacgggaaacacggaacgccacagaagtatgatcccactttcaaaggacccatttacaataggggctgcacggatatcatatgctgtgtgttcctgctcctggccattgtgggctacgtggctgtaggcatcatagcctggactcatggagaccctcgaaaggtgatctaccccactgatagccggggcgagttctgcgggcagaagggcacaaaaaacgagaacaaaccctatctgttttatttcaacattgtgaaatgtgccagccccctggttctgctggaattccaatgtcccactccccagatctgcgtggaaaaatgccccgaccgctacctcacgtacctgaatgctcgcagctcccgggactttgagtactataagcagttctgtgttcctggcttcaagaacaataaaggagtggctgaggtgcttcgagatggtgactgccctgctgtcctcatccccagcaaacccttggcccggagatgcttccccgctatccacgcctacaagggtgtcctgatggtgggcaatgagacgacctatgaggatgggcatggctcccggaaaaacatcacagacctggtggagggcgccaagaaagccaatggagtcctagaggcgcggcaactcgccatgcgcatatttgaagattacaccgtctcttggtactggattatcataggcctggtcattgccatggcgatgagcctcctgttcatcatcctgcttcgcttcctggctggtattatggtctgggtgatgatcatcatggtgattctggtgctgggctacggaatatttcactgctacatggagtactcccgactgcgtggtgaggccggctctgatgtctctttggtggacctcggctttcagacggatttccgggtgtacctgcacttacggcagacctggttggcctttatgatcattctgagtatccttgaagtcattatcatcttgctgctcatctttctccggaagagaattctcatcgcgattgcactcatcaaagaagccagcagggctgtgggatacgtcatgtgctccttgctctacccactggtcaccttcttcttgctgtgcctctgcatcgcctactgggccagcactgctgtcttcctgtccacttccaacgaagcggtctataagatctttgatgacagcccctgcccatttactgcgaaaacctgcaacccagagaccttcccctcctccaatgagtcccgccaatgccccaatgcccgttgccagttcgccttctacggtggtgagtcgggctaccaccgggccctgctgggcctgcagatcttcaatgccttcatgttcttctggttggccaacttcgtgctggcgctgggccaggtcacgctggccggggcctttgcctcctactactgggccctgcgcaagccggacgacctgccggccttcccgctcttctctgcctttggccgggcgctcaggtaccacacaggctccctggcctttggcgcgctcatcctggccattgtgcagatcatccgtgtgatactcgagtacctggatcagcggctgaaagctgcagagaacaagtttgccaagtgcctcatgacctgtctcaaatgctgcttctggtgcctggagaagttcatcaaattccttaataggaatgcctacatcatgattgccatctacggcaccaatttctgcacctcggccaggaatgccttcttcctgctcatgagaaacatcatcagagtggctgtcctggataaagttactgacttcctcttcctgttgggcaaacttctgatcgttggtagtgtggggatcctggctttcttcttcttcacccaccgtatcaggatcgtgcaggatacagcaccacccctcaattattactgggttcctatactgacggtgatcgttggctcctacttgattgcacacggtttcttcagcgtctatggcatgtgtgtggacacgctgttcctctgcttcttggaggacctggagaggaatgacggctcggccgagaggccttacttcatgtcttccaccctcaagaaactcttgaacaagaccaacaagaaggcagcggagtcctgaaggccccgtgctccccacctctcaaggagtctcatgccgcagggtgctcagtagctgggtctgttcccccagccccttgggctcacctgaagtcctatcactgccgctctgcccctccccatgagccagatcccaccagtttctggacgtggagagtctggggcatctccttcttatgccaaggggcgcttggagttttcatggctgcccctccagactgcgagaaacaagtaaaaacccattggggcctcttgatgtctgggatggcacgtggcccgacctccacaagctccctcatgcttcctgtcccccgcttacacgacaacgggccagaccacgggaaggacggtgtttgtgtctgagggagctgctggccacagtgaacacccacgtttattcctgcctgctccggccaggactgaaccccttctccacacctgaacagttggctcaagggccaccagaagcatttctttattattattattttttaacctggacatgcattaaagggtctattagctttctttccgtctgtctcaacagctgagatggggccgccaaggagtgccttccttttgctccctcctagctgggagtgacgggtgggagtgtgtgtgcccaggtgggggtgtctcctggctgggaaggagggaaagggagggagagttttgcgggggttggcagtggagagcaggctggagaggagatggctaatagctgtttaatggaaacctgctgggctggagggagttaggctgaatttcccgacttcctctgccagttattgacacagctctctttgtaagagaggaaagaaactaaacccacccaagggatgatttcagggggagaggtggagggcagatgtcctgggcaaaccgggcccctctgcccacacacctcacttgatccttttgccaaacttgtcaaactcaggggaactggcttcccagttgcccctttgccatattccaagtccccctcagacttcatgtctctgctcatcagcactgtcccaggatcctggagagggagaacccctggccccaggggaaagaggggggggtctcccgtttcctgtgcctgcaccagccctgcccccattgcgtctgcacacccctgcgtgtaactgcattccaaccactaataaagtgcctattgtacaggtcaaaaaaaaaaaaaaaaaaaaaaaagaaaaaaaaaaaaaaaaaaaaaaaaaaaaaaaaaaaaaaaaaaaaaaaggggggggggggcgtaaaaaatattccccggggggggcaccatgtatgatgtcgagcaccattttgttttataaagggggggctacctagagagagggatagttatttataacgacgaagaacgggggggggttatcaaaaagattggtagaggagaaaaagcagtatgagggagtattggaaagggacaccatcatctggtgggggaaactatgggaacccacccgagggaaattaacgcggggggaaataaaagagggtatgggtaaacccgattgtggggaaaatgttggttgatttaataggggtagttatatg

SEQ ID NO: 427997 - DNA, 3423 bp, Homo sapiens
gggagcagctgcagccccgcccgcgccctcccgggtcccttagtctgggcagctgcccagctcgggccggtctgaccggtttgggccgccccgcctggcgctgtgctgggaggagccgccgccagtcgcgcggtcagtgcctccctccagactcgggagggtcgagggggcgcgggagagagcgcgggcggccgccggggctggtcgcctgcagggatgggggacgagcggccccactactacgggaaacacggaacgccacagaagtatgatcccactttcaaaggacccatttacaataggggctgcacggatatcatatgctgtgtgttcctgctcctggccattgtgggctacgtggctgtaggcatcatagcctggactcatggagaccctcgaaaggtgatctaccccactgatagccggggcgagttctgcgggcagaagggcacaaaaaacgagaacaaaccctatctgttttatttcaacattgtgaaatgtgccagccccctggttctgctggaattccaatgtcccactccccagatctgcgtggaaaaatgccccgaccgctacctcacgtacctgaatgctcgcagctcccgggactttgagtactataagcagttctgtgttcctggcttcaagaacaataaaggagtggctgaggtgcttcgagatggtgactgccctgctgtcctcatccccagcaaacccttggcccggagatgcttccccgctatccacgcctacaagggtgtcctgatggtgggcaatgagacgacctatgaggatgggcatggctcccggaaaaacatcacagacctggtggagggcgccaagaaagccaatggagtcctagaggcgcggcaactcgccatgcgcatatttgaagattacaccgtctcttggtactggattatcataggcctggtcattgccatggcgatgagcctcctgttcatcatcctgcttcgcttcctggctggtattatggtctgggtgatgatcatcatggtgattctggtgctgggctacggaatatttcactgctacatggagtactcccgactgcgtggtgaggccggctctgatgtctctttggtggacctcggctttcagacggatttccgggtgtacctgcacttacggcagacctggttggcctttatgatcattctgagtatccttgaagtcattatcatcttgctgctcatctttctccggaagagaattctcatcgcgattgcactcatcaaagaagccagcagggctgtgggatacgtcatgtgctccttgctctacccactggtcaccttcttcttgctgtgcctctgcatcgcctactgggccagcactgctgtcttcctgtccacttccaacgaagcggtctataagatctttgatgacagcccctgcccatttactgcgaaaacctgcaacccagagaccttcccctcctccaatgagtcccgccaatgccccaatgcccgttgccagttcgccttctacggtggtgagtcgggctaccaccgggccctgctgggcctgcagatcttcaatgccttcatgttcttctggttggccaacttcgtgctggcgctgggccaggtcacgctggccggggcctttgcctcctactactgggccctgcgcaagccggacgacctgccggccttcccgctcttctctgcctttggccgggcgctcaggtaccacacaggctccctggcctttggcgcgctcatcctggccattgtgcagatcatccgtgtgatactcgagtacctggatcagcggctgaaagctgcagagaacaagtttgccaagtgcctcatgacctgtctcaaatgctgcttctggtgcctggagaagttcatcaaattccttaataggaatgcctacatcatgattgccatctacggcaccaatttctgcacctcggccaggaatgccttcttcctgctcatgagaaacatcatcagagtggctgtcctggataaagttactgacttcctcttcctgttgggcaaacttctgatcgttggtagtgtggggatcctggctttcttcttcttcacccaccgtatcaggatcgtgcaggatacagcaccacccctcaattattactgggttcctatactgacggtgatcgttggctcctacttgattgcacacggtttcttcagcgtctatggcatgtgtgtggacacgctgttcctctgcttcttggaggacctggagaggaatgacggctcggccgagaggccttacttcatgtcttccaccctcaagaaactcttgaacaagaccaacaagaaggcagcggagtcctgaaggccccgtgctccccacctctcaaggagtctcatgccgcagggtgctcagtagctgggtctgttcccccagccccttgggctcacctgaagtcctatcactgccgctctgcccctccccatgagccagatcccaccagtttctggacgtggagagtctggggcatctccttcttatgccaaggggcgcttggagttttcatggctgcccctccagactgcgagaaacaagtaaaaacccattggggcctcttgatgtctgggatggcacgtggcccgacctccacaagctccctcatgcttcctgtcccccgcttacacgacaacgggccagaccacgggaaggacggtgtttgtgtctgagggagctgctggccacagtgaacacccacgtttattcctgcctgctccggccaggactgaaccccttctccacacctgaacagttggctcaagggccaccagaagcatttctttattattattattttttaacctggacatgcattaaagggtctattagctttctttccgtctgtctcaacagctgagatggggccgccaaggaggaaagggagggagagttttgcgggggttggcagtggagagcaggctggagaggagatggctaatagctgtttaatggaaacctgctgggctggagggagttaggctgaatttcccgacttcctctgccagttattgacacagctctctttgtaagagaggaaagaaactaaacccacccaagggatgatttcagggggagaggtggagggcagatgtcctgggcaaaccgggcccctctgcccacacacctcacttgatccttttgccaaacttgtcaaactcaggggaactggcttcccagttgcccctttgccatattccaagtccccctcagacttcatgtctctgctcatcagcactgtcccaggatcctggagagggagaacccctggccccaggggaaagaggggggggtctcccgtttcctgtgcctgcaccagccctgcccccattgcgtctgcacacccctgcgtgtaactgcattccaaccactaataaagtgcctattgtacaggtc

SEQ ID NO: 427998 - DNA, 2818 bp, Homo sapiens
cggggcggggcgtgcagcccgcggagcctcccgcccgcccgggctggggtcgcgctggctcggactccgctccccgccccgccgcggccatggaggacgagcggaaaaacggagcctacggaacgccacagaagtatgatcccactttcaaaggacccatttacaataggggctgcacggatatcatatgctgtgtgttcctgctcctggccattgtgggctacgtggctgtaggcatcatagcctggactcatggagaccctcgaaaggtgatctaccccactgatagccggggcgagttctgcgggcagaagggcacaaaaaacgagaacaaaccctatctgttttatttcaacattgtgaaatgtgccagccccctggttctgctggaattccaatgtcccactccccagatctgcgtggaaaaatgccccgaccgctacctcacgtacctgaatgctcgcagctcccgggactttgagtactataagcagttctgtgttcctggcttcaagaacaataaaggagtggctgaggtgcttcgagatggtgactgccctgctgtcctcatccccagcaaacccttggcccggagatgcttccccgctatccacgcctacaagggtgtcctgatggtgggcaatgagacgacctatgaggatgggcatggctcccggaaaaacatcacagacctggtggagggcgccaagaaagccaatggagtcctagaggcgcggcaactcgccatgcgcatatttgaagattacaccgtctcttggtactggattatcataggcctggtcattgccatggcgatgagcctcctgttcatcatcctgcttcgcttcctggctggtattatggtctgggtgatgatcatcatggtgattctggtgctgggctacggaatatttcactgctacatggagtactcccgactgcgtggtgaggccggctctgatgtctctttggtggacctcggctttcagacggatttccgggtgtacctgcacttacggcagacctggttggcctttatgatcattctgagtatccttgaagtcattatcatcttgctgctcatctttctccggaagagaattctcatcgcgattgcactcatcaaagaagccagcagggctgtgggatacgtcatgtgctccttgctctacccactggagaagttcatcaaattccttaataggaatgcctacatcatgattgccatctacggcaccaatttctgcacctcggccaggaatgccttcttcctgctcatgagaaacatcatcagagtggctgtcctggataaagttactgacttcctcttcctgttgggcaaacttctgatcgttggtagtgtggggatcctggctttcttcttcttcacccaccgtatcaggatcgtgcaggatacagcaccacccctcaattattactgggttcctatactgacggtgatcgttggctcctacttgattgcacacggtttcttcagcgtctatggcatgtgtgtggacacgctgttcctctgcttcttggaggacctggagaggaatgacggctcggccgagaggccttacttcatgtcttccaccctcaagaaactcttgaacaagaccaacaagaaggcagcggagtcctgaaggccccgtgctccccacctctcaaggagtctcatgccgcagggtgctcagtagctgggtctgttcccccagccccttgggctcacctgaagtcctatcactgccgctctgcccctccccatgagccagatcccaccagtttctggacgtggagagtctggggcatctccttcttatgccaaggggcgcttggagttttcatggctgcccctccagactgcgagaaacaagtaaaaacccattggggcctcttgatgtctgggatggcacgtggcccgacctccacaagctccctcatgcttcctgtcccccgcttacacgacaacgggccagaccacgggaaggacggtgtttgtgtctgagggagctgctggccacagtgaacacccacgtttattcctgcctgctccggccaggactgaaccccttctccacacctgaacagttggctcaagggccaccagaagcatttctttattattattattttttaacctggacatgcattaaagggtctattagctttctttccgtctgtctcaacagctgagatggggccgccaaggagtgccttccttttgctccctcctagctgggagtgacgggtgggagtgtgtgtgcccaggtgggggtgtctcctggctgggaaggagggaaagggagggagagttttgcgggggttggcagtggagagcaggctggagaggagatggctaatagctgtttaatggaaacctgctgggctggagggagttaggctgaatttcccgacttcctctgccagttattgacacagctctctttgtaagagaggaaagaaactaaacccacccaagggatgatttcagggggagaggtggagggcagatgtcctgggcaaaccgggcccctctgcccacacacctcacttgatccttttgccaaacttgtcaaactcaggggaactggcttcccagttgcccctttgccatattccaagtccccctcagacttcatgtctctgctcatcagcactgtcccaggatcctggagagggagaacccctggccccaggggaaagaggggggggtctcccgtttcctgtgcctgcaccagccctgcccccattgcgtctgcacacccctgcgtgtaactgcattccaaccactaataaagtgcctattgtacaggtc

SEQ ID NO: 427999 - DNA, 3758 bp, Homo sapiens
cggggcggggcgtgcagcccgcggagcctcccgcccgcccgggctggggtcgcgctggctcggactccgctccccgccccgccgcggccatggaggacgagcggaaaaacggagcctacggaacgccacagaagtatgatcccactttcaaaggacccatttacaataggggctgcacggatatcatatgctgtgtgttcctgctcctggccattgtgggctacgtggctgtaggcatcatagcctggactcatggagaccctcgaaaggtgatctaccccactgatagccggggcgagttctgcgggcagaagggcacaaaaaacgagaacaaaccctatctgttttatttcaacattgtgaaatgtgccagccccctggttctgctggaattccaatgtcccactccccagatctgcgtggaaaaatgccccgaccgctacctcacgtacctgaatgctcgcagctcccgggactttgagtactataagcagttctgtgttcctggcttcaagaacaataaaggagtggctgaggtgcttcgagatggtgactgccctgctgtcctcatccccagcaaacccttggcccggagatgcttccccgctatccacgcctacaagggtgtcctgatggtgggcaatgagacgacctatgaggatgggcatggctcccggaaaaacatcacagacctggtggagggcgccaagaaagccaatggagtcctagaggcgcggcaactcgccatgcgcatatttgaagattacaccgtctcttggtactggattatcataggcctggtcattgccatggcgatgagcctcctgttcatcatcctgcttcgcttcctggctggtattatggtctgggtgatgatcatcatggtgattctggtgctgggctacggaatatttcactgctacatggagtactcccgactgcgtggtgaggccggctctgatgtctctttggtggacctcggctttcagacggatttccgggtgtacctgcacttacggcagacctggttggcctttatgatcattctgagtatccttgaagtcattatcatcttgctgctcatctttctccggaagagaattctcatcgcgattgcactcatcaaagaagccagcagggctgtgggatacgtcatgtgctccttgctctacccactggtcaccttcttcttgctgtgcctctgcatcgcctactgggccagcactgctgtcttcctgtccacttccaacgaagcggtctataagatctttgatgacagcccctgcccatttactgcgaaaacctgcaacccagagaccttcccctcctccaatgagtcccgccaatgccccaatgcccgttgccagttcgccttctacggtggtgagtcgggctaccaccgggccctgctgggcctgcagatcttcaatgccttcatgttcttctggttggccaacttcgtgctggcgctgggccaggtcacgctggccggggcctttgcctcctactactgggccctgcgcaagccggacgacctgccggccttcccgctcttctctgcctttggccgggcgctcaggtaccacacaggctccctggcctttggcgcgctcatcctggccattgtgcagatcatccgtgtgatactcgagtacctggatcagcggctgaaagctgcagagaacaagtttgccaagtgcctcatgacctgtctcaaatgctgcttctggtgcctggagaagttcatcaaattccttaataggaatgcctacatcatgattgccatctacggcaccaatttctgcacctcggccaggaatgccttcttcctgctcatgagaaacatcatcagagtggctgtcctggataaagttactgacttcctcttcctgttgggcaaacttctgatcgttggtagtgtggggatcctggctttcttcttcttcacccaccgtatcaggatcgtgcaggatacagcaccacccctcaattattactgggttcctatactgacggtgatcgttggctcctacttgattgcacacggtttcttcagcgtctatggcatgtgtgtggacacgctgttcctctgcttctgtgaggacctggaaaggaatgacggctctcaggagcgaccctacttcatgtcgcccgagctgagagacatcctgttgaaggggagtgcggaggaggggaagcgggcagaagccgaggagtagagagtgagggagactggcgtgggggccaggtttcctccatgtagactgggggtgcatgaagcgggggggttcctggcctgcgagtgtggggatcctgtgtgtccctcggagcccactacagtctgcccctctctggtcccagtgtgtctgctttctaaccctctgaggcttctctgtgaccctcatccacctaccctgtccttgaggcccctgcccgtgggctcccctcatgcctcctgctctgggacctctctccacagtggaggacctggagaggaatgacggctcggccgagaggccttacttcatgtcttccaccctcaagaaactcttgaacaagaccaacaagaaggcagcggagtcctgaaggccccgtgctccccacctctcaaggagtctcatgccgcagggtgctcagtagctgggtctgttcccccagccccttgggctcacctgaagtcctatcactgccgctctgcccctccccatgagccagatcccaccagtttctggacgtggagagtctggggcatctccttcttatgccaaggggcgcttggagttttcatggctgcccctccagactgcgagaaacaagtaaaaacccattggggcctcttgatgtctgggatggcacgtggcccgacctccacaagctccctcatgcttcctgtcccccgcttacacgacaacgggccagaccacgggaaggacggtgtttgtgtctgagggagctgctggccacagtgaacacccacgtttattcctgcctgctccggccaggactgaaccccttctccacacctgaacagttggctcaagggccaccagaagcatttctttattattattattttttaacctggacatgcattaaagggtctattagctttctttccgtctgtctcaacagctgagatggggccgccaaggagtgccttccttttgctccctcctagctgggagtgacgggtgggagtgtgtgtgcccaggtgggggtgtctcctggctgggaaggagggaaagggagggagagttttgcgggggttggcagtggagagcaggctggagaggagatggctaatagctgtttaatggaaacctgctgggctggagggagttaggctgaatttcccgacttcctctgccagttattgacacagctctctttgtaagagaggaaagaaactaaacccacccaagggatgatttcagggggagaggtggagggcagatgtcctgggcaaaccgggcccctctgcccacacacctcacttgatccttttgccaaacttgtcaaactcaggggaactggcttcccagttgcccctttgccatattccaagtccccctcagacttcatgtctctgctcatcagcactgtcccaggatcctggagagggagaacccctggccccaggggaaagaggggggggtctcccgtttcctgtgcctgcaccagccctgcccccattgcgtctgcacacccctgcgtgtaactgcattccaaccactaataaagtgcctattgtacaggtc

SEQ ID NO: 428000 - DNA, 3501 bp, Homo sapiens
cggggcggggcgtgcagcccgcggagcctcccgcccgcccgggctggggtcgcgctggctcggactccgctccccgccccgccgcggccatggaggacgagcggaaaaacggagcctacggaacgccacagaagtatgatcccactttcaaaggacccatttacaataggggctgcacggatatcatatgctgtgtgttcctgctcctggccattgtgggctacgtggctgtaggcatcatagcctggactcatggagaccctcgaaaggtgatctaccccactgatagccggggcgagttctgcgggcagaagggcacaaaaaacgagaacaaaccctatctgttttatttcaacattgtgaaatgtgccagccccctggttctgctggaattccaatgtcccactccccagatctgcgtggaaaaatgccccgaccgctacctcacgtacctgaatgctcgcagctcccgggactttgagtactataagcagttctgtgttcctggcttcaagaacaataaaggagtggctgaggtgcttcgagatggtgactgccctgctgtcctcatccccagcaaacccttggcccggagatgcttccccgctatccacgcctacaagggtgtcctgatggtgggcaatgagacgacctatgaggatgggcatggctcccggaaaaacatcacagacctggtggagggcgccaagaaagccaatggagtcctagaggcgcggcaactcgccatgcgcatatttgaagattacaccgtctcttggtactggattatcataggcctggtcattgccatggcgatgagcctcctgttcatcatcctgcttcgcttcctggctggtattatggtctgggtgatgatcatcatggtgattctggtgctgggctacggaatatttcactgctacatggagtactcccgactgcgtggtgaggccggctctgatgtctctttggtggacctcggctttcagacggatttccgggtgtacctgcacttacggcagacctggttggcctttatgatcattctgagtatccttgaagtcattatcatcttgctgctcatctttctccggaagagaattctcatcgcgattgcactcatcaaagaagccagcagggctgtgggatacgtcatgtgctccttgctctacccactggtcaccttcttcttgctgtgcctctgcatcgcctactgggccagcactgctgtcttcctgtccacttccaacgaagcggtctataagatctttgatgacagcccctgcccatttactgcgaaaacctgcaacccagagaccttcccctcctccaatgagtcccgccaatgccccaatgcccgttgccagttcgccttctacggtggtgagtcgggctaccaccgggccctgctgggcctgcagatcttcaatgccttcatgttcttctggttggccaacttcgtgctggcgctgggccaggtcacgctggccggggcctttgcctcctactactgggccctgcgcaagccggacgacctgccggccttcccgctcttctctgcctttggccgggcgctcaggtaccacacaggctccctggcctttggcgcgctcatcctggccattgtgcagatcatccgtgtgatactcgagtacctggatcagcggctgaaagctgcagagaacaagtttgccaagtgcctcatgacctgtctcaaatgctgcttctggtgcctggagaagttcatcaaattccttaataggaatgcctacatcatgattgccatctacggcaccaatttctgcacctcggccaggaatgccttcttcctgctcatgagaaacatcatcagagtggctgtcctggataaagttactgacttcctcttcctgttgggcaaacttctgatcgttggtagtgtggggatcctggctttcttcttcttcacccaccgtatcaggatcgtgcaggatacagcaccacccctcaattattactgggttcctatactgacggtgatcgttggctcctacttgattgcacacggtttcttcagcgtctatggcatgtgtgtggacacgctgttcctctgcttctgtgaggacctggaaaggaatgacggctctcaggagcgaccctacttcatgtcgcccgagctgagagacatcctgttgaaggggagtgcggaggaggggaagcgggcagaagccgaggagtagagatggaggacctggagaggaatgacggctcggccgagaggccttacttcatgtcttccaccctcaagaaactcttgaacaagaccaacaagaaggcagcggagtcctgaaggccccgtgctccccacctctcaaggagtctcatgccgcagggtgctcagtagctgggtctgttcccccagccccttgggctcacctgaagtcctatcactgccgctctgcccctccccatgagccagatcccaccagtttctggacgtggagagtctggggcatctccttcttatgccaaggggcgcttggagttttcatggctgcccctccagactgcgagaaacaagtaaaaacccattggggcctcttgatgtctgggatggcacgtggcccgacctccacaagctccctcatgcttcctgtcccccgcttacacgacaacgggccagaccacgggaaggacggtgtttgtgtctgagggagctgctggccacagtgaacacccacgtttattcctgcctgctccggccaggactgaaccccttctccacacctgaacagttggctcaagggccaccagaagcatttctttattattattattttttaacctggacatgcattaaagggtctattagctttctttccgtctgtctcaacagctgagatggggccgccaaggagtgccttccttttgctccctcctagctgggagtgacgggtgggagtgtgtgtgcccaggtgggggtgtctcctggctgggaaggagggaaagggagggagagttttgcgggggttggcagtggagagcaggctggagaggagatggctaatagctgtttaatggaaacctgctgggctggagggagttaggctgaatttcccgacttcctctgccagttattgacacagctctctttgtaagagaggaaagaaactaaacccacccaagggatgatttcagggggagaggtggagggcagatgtcctgggcaaaccgggcccctctgcccacacacctcacttgatccttttgccaaacttgtcaaactcaggggaactggcttcccagttgcccctttgccatattccaagtccccctcagacttcatgtctctgctcatcagcactgtcccaggatcctggagagggagaacccctggccccaggggaaagaggggggggtctcccgtttcctgtgcctgcaccagccctgcccccattgcgtctgcacacccctgcgtgtaactgcattccaaccactaataaagtgcctattgtacaggtc

SEQ ID NO: 428001 - DNA, 1717 bp, Homo sapiens
gatttgagacaggtcatgaggcacttggcaccagaagctgcctcatgacctgtctccaggcaccagaagcagcactggagaagttcatcaaattccttaataggaatgcctacatcatgattgccatctacggcaccaatttctgcacctcggccaggaatgccttcttcctgctcatgagaaacatcatcagagtggctgtcctggataaagttactgacttcctcttcctgttgggcaaacttctgatcgttggtagtgtggggatcctggctttcttcttcttcacccaccgtatcaggatcgtgcaggatacagcaccacccctcaattattactgggttcctatactgacggtgatcgttggctcctacttgattgcacacggtttcttcagcgtctatggcatgtgtgtggacacgctgttcctctgcttcttggaggacctggagaggaatgacggctcggccgagaggccttacttcatgtcttccaccctcaagaaactcttgaacaagaccaacaagaaggcagcggagtcctgaaggccccgtgctccccacctctcaaggagtctcatgccgcagggtgctcagtagctgggtctgttcccccagccccttgggctcacctgaagtcctatcactgccgctctgcccctccccatgagccagatcccaccagtttctggacgtggagagtctggggcatctccttcttatgccaaggggcgcttggagttttcatggctgcccctccagactgcgagaaacaagtaaaaacccattggggcctcttgatgtctgggatggcacgtggcccgacctccacaagctccctcatgcttcctgtcccccgcttacacgacaacgggccagaccacgggaaggacggtgtttgtgtctgagggagctgctggccacagtgaacacccacgtttattcctgcctgctccggccaggactgaaccccttctccacacctgaacagttggctcaagggccaccagaagcatttctttattattattattttttaacctggacatgcattaaagggtctattagctttctttccgtctgtctcaacagctgagatggggccgccaaggagtgccttccttttgctccctcctagctgggagtgacgggtgggagtgtgtgtgcccaggtgggggtgtctcctggctgggaaggagggaaagggagggagagttttgcgggggttggcagtggagagcaggctggagaggagatggctaatagctgtttaatggaaacctgctgggctggagggagttaggctgaatttcccgacttcctctgccagttattgacacagctctctttgtaagagaggaaagaaactaaacccacccaagggatgatttcagggggagaggtggagggcagatgtcctgggcaaaccgggcccctctgcccacacacctcacttgatccttttgccaaacttgtcaaactcaggggaactggcttcccagttgcccctttgccatattccaagtccccctcagacttcatgtctctgctcatcagcactgtcccaggatcctggagagggagaacccctggccccaggggaaagaggggggggtctcccgtttcctgtgcctgcaccagccctgcccccattgcgtctgcacacccctgcgtgtaactgcattccaaccactaataaagtgcctattgtacaggtc

SEQ ID NO: 428002 - DNA, 2862 bp, Homo sapiens
gggagcagctgcagccccgcccgcgccctcccgggtcccttagtctgggcagctgcccagctcgggccggtctgaccggtttgggccgccccgcctggcgctgtgctgggaggagccgccgccagtcgcgcggtcagtgcctccctccagactcgggagggtcgagggggcgcgggagagagcgcgggcggccgccggggctggtcgcctgcagggatgggggacgagcggccccactactacgggaaacacggaacgccacagaagtatgatcccactttcaaaggacccatttacaataggggctgcacggatatcatatgctgtgtgttcctgctcctggccattgtgggctacgtggctgtaggcatcatagcctggactcatggagaccctcgaaaggtgatctaccccactgatagccggggcgagttctgcgggcagaagggcacaaaaaacgagaacaaaccctatctgttttatttcaacattgtgaaatgtgccagccccctggttctgctggaattccaatgtcccactccccagatctgcgtggaaaaatgccccgaccgctacctcacgtacctgaatgctcgcagctcccgggactttgagtactataagcagttctgtgttcctggcttcaagaacaataaaggagtggctgaggtgcttcgagatggtgactgccctgctgtcctcatccccagcaaacccttggcccggagatgcttccccgctatccacgcctacaagggtgtcctgatggtgggcaatgagacgacctatgaggatgggcatggctcccggaaaaacatcacagacctggtggagggcgccaagaaagccaatggagtcctagaggcgcggcaactcgccatgcgcatatttgaagattacaccgtctcttggtactggattatcataggcctggtcattgccatggcgatgagcctcctgttcatcatcctgcttcgcttcctggctggtattatggtctgggtgatgatcatcatggtgattctggtgctgggctacggaatatttcactgctacatggagtactcccgactgcgtggtgaggccggctctgatgtctctttggtggacctcggctttcagacggatttccgggtgtacctgcacttacggcagacctggttggcctttatgatcattctgagtatccttgaagtcattatcatcttgctgctcatctttctccggaagagaattctcatcgcgattgcactcatcaaagaagccagcagggctgtgggatacgtcatgtgctccttgctctacccactggtcaccttcttcttgctgtgcctctgcatcgcctactgggccagcactgctgtcttcctgtccacttccaacgaagcggtctataagatctttgatgacagcccctgcccatttactgcgaaaacctgcaacccagagaccttcccctcctccaatgagtcccgccaatgccccaatgcccgttgccagttcgccttctacggtggtgagtcgggctaccaccgggccctgctgggcctgcagatcttcaatgccttcatgttcttctggttggccaacttcgtgctggcgctgggccaggtcacgctggccggggcctttgcctcctactactgggccctgcgcaagccggacgacctgccggccttcccgctcttctctgcctttggccgggcgctcaggtaccacacaggctccctggcctttggcgcgctcatcctggccattgtgcagatcatccgtgtgatactcgagtacctggatcagcggctgaaagctgcagagaacaagtttgccaagtgcctcatgacctgtctcaaatgctgcttctggtgcctggagaagttcatcaaattccttaataggaatgcctacatcatgattgccatctacggcaccaatttctgcacctcggccaggaatgccttcttcctgctcatgagaaacatcatcagagtggctgtcctggataaagttactgacttcctcttcctgttgggcaaacttctgatcgttggtagtgtggggatcctggctttcttcttcttcacccaccgtatcaggatcgtgcaggatacagcaccacccctcaattattactgggttcctatactgacggtgatcgttggctcctacttgattgcacacggtttcttcagcgtctatggcatgtgtgtggacacgctgttcctctgcttcttggaggacctggagaggaatgacggctcggccgagaggccttacttcatgtcttccaccctcaagaaactcttgaacaagaccaacaagaaggcagcggagtcctgaaggccccgtgctccccacctctcaaggagtctcatgccgcagggtgctcagtagctgggtctgttcccccagccccttgggctcacctgaagtcctatcactgccgctctgcccctccccatgagccagatcccaccagtttctggacgtggagagtctggggcatctccttcttatgccaaggggcgcttggagttttcatggctgcccctccagactgcgagaaacaagtaaaaacccattggggcctcttgatgtctgggatggcacgtggcccgacctccacaagctccctcatgcttcctgtcccccgcttacacgacaacgggccagaccacgggaaggacggtgtttgtgtctgagggagctgctggccacagtgaacacccacgtttattcctgcctgctccggccaggactgaaccccttctccacacctgaacagttggctcaagggccaccagaagcatttctttattattattattttttaacctggacatgcattaaagggtctattagctt

SEQ ID NO: 428003 - DNA, 3454 bp, Homo sapiens
gggagcagctgcagccccgcccgcgccctcccgggtcccttagtctgggcagctgcccagctcgggccggtctgaccggtttgggccgccccgcctggcgctgtgctgggaggagccgccgccagtcgcgcggtcagtgcctccctccagactcgggagggtcgagggggcgcgggagagagcgcgggcggccgccggggctggtcgcctgcagggatgggggacgagcggccccactactacgggaaacacggaacgccacagaagtatgatcccactttcaaaggacccatttacaataggggctgcacggatatcatatgctgtgtgttcctgctcctggccattgtgggctacgtggctgtaggcatcatagcctggactcatggagaccctcgaaaggtgatctaccccactgatagccggggcgagttctgcgggcagaagggcacaaaaaacgagaacaaaccctatctgttttatttcaacattgtgaaatgtgccagccccctggttctgctggaattccaatgtcccactccccagatctgcgtggaaaaatgccccgaccgctacctcacgtacctgaatgctcgcagctcccgggactttgagtactataagcagttctgtgttcctggcttcaagaacaataaaggagtggctgaggtgcttcgagatggtgactgccctgctgtcctcatccccagcaaacccttggcccggagatgcttccccgctatccacgcctacaagggtgtcctgatggtgggcaatgagacgacctatgaggatgggcatggctcccggaaaaacatcacagacctggtggagggcgccaagaaagccaatggagtcctagaggcgcggcaactcgccatgcgcatatttgaagattacaccgtctcttggtactggattatcataggcctggtcattgccatggcgatgagcctcctgttcatcatcctgcttcgcttcctggctggtattatggtctgggtgatgatcatcatggtgattctggtgctgggctacggaatatttcactgctacatggagtactcccgactgcgtggtgaggccggctctgatgtctctttggtggacctcggctttcagacggatttccgggtgtacctgcacttacggcagacctggttggcctttatgatcattctgagtatccttgaagtcattatcatcttgctgctcatctttctccggaagagaattctcatcgcgattgcactcatcaaagaagccagcagggctgtgggatacgtcatgtgctccttgctctacccactggtcaccttcttcttgctgtgcctctgcatcgcctactgggccagcactgctgtcttcctgtccacttccaacgaagcggtctataagatctttgatgacagcccctgcccatttactgcgaaaacctgcaacccagagaccttcccctcctccaatgagtcccgccaatgccccaatgcccgttgccagttcgccttctacggtggtgagtcgggctaccaccgggccctgctgggcctgcagatcttcaatgccttcatgttcttctggttggccaacttcgtgctggcgctgggccaggtcacgctggccggggcctttgcctcctactactgggccctgcgcaagccggacgacctgccggccttcccgctcttctctgcctttggccgggcgctcaggtaccacacaggctccctggcctttggcgcgctcatcctggccattgtgcagatcatccgtgtgatactcgagtacctggatcagcggctgaaagctgcagagaacaagtttgccaagtgcctcatgacctgtctcaaatgctgcttctggtgcctggagaagttcatcaaattccttaataggaatgcctacatcatgattgccatctacggcaccaatttctgcacctcggccaggaatgccttcttcctgctcatgagaaacatcatcagagtggctgtcctggataaagttactgacttcctcttcctgttgggcaaacttctgatcgttggtagtgtggggatcctggctttcttcttcttcacccaccgtatcaggatcgtgcaggatacagcaccacccctcaattattactgggttcctatactgacggtgatcgttggctcctacttgattgcacacggtttcttcagcgtctatggcatgtgtgtggacacgctgttcctctgcttcttggaggacctggagaggaatgacggctcggccgagaggccttacttcatgtcttccaccctcaagaaactcttgaacaagaccaacaagaaggcagcggagtcctgaaggccccgtgctccccacctctcaaggagtctcatgccgcagggtgctcagtagctgggtctgttcccccagccccttgggctcacctgaagtcctatcactgccgctctgcccctccccatgagccagatcccaccagtttctggacgtggagagtctggggcatctccttcttatgccaaggggcgcttggagttttcatggctgcccctccagactgcgagaaaccacaagctccctcatgcttcctgtcccccgcttacacgacaacgggccagaccacgggaaggacggtgtttgtgtctgagggagctgctggccacagtgaacacccacgtttattcctgcctgctccggccaggactgaaccccttctccacacctgaacagttggctcaagggccaccagaagcatttctttattattattattttttaacctggacatgcattaaagggtctattagctttctttccgtctgtctcaacagctgagatggggccgccaaggagtgccttccttttgctccctcctagctgggagtgacgggtgggagtgtgtgtgcccaggtgggggtgtctcctggctgggaaggagggaaagggagggagagttttgcgggggttggcagtggagagcaggctggagaggagatggctaatagctgtttaatggaaacctgctgggctggagggagttaggctgaatttcccgacttcctctgccagttattgacacagctctctttgtaagagaggaaagaaactaaacccacccaagggatgatttcagggggagaggtggagggcagatgtcctgggcaaaccgggcccctctgcccacacacctcacttgatccttttgccaaacttgtcaaactcaggggaactggcttcccagttgcccctttgccatattccaagtccccctcagacttcatgtctctgctcatcagcactgtcccaggatcctggagagggagaacccctggccccaggggaaagaggggggggtctcccgtttcctgtgcctgcaccagccctgcccccattgcgtctgcacacccctgcgtgtaactgcattccaaccactaataaagtgcctattgtacaggtc

SEQ ID NO: 428004 - DNA, 2797 bp, Homo sapiens
gggagcagctgcagccccgcccgcgccctcccgggtcccttagtctgggcagctgcccagctcgggccggtctgaccggtttgggccgccccgcctggcgctgtgctgggaggagccgccgccagtcgcgcggtcagtgcctccctccagactcgggagggtcgagggggcgcgggagagagcgcgggcggccgccggggctggtcgcctgcagggatgggggacgagcggccccactactacgggaaacacggaacgccacagaagtatgatcccactttcaaaggacccatttacaataggggctgcacggatatcatatgctgtgtgttcctgctcctggccattgtgggctacgtggctgtaggcatcatagcctggactcatggagaccctcgaaaggtgatctaccccactgatagccggggcgagttctgcgggcagaagggcacaaaaaacgagaacaaaccctatctgttttatttcaacattgtgaaatgtgccagccccctggttctgctggaattccaatgtcccactccccagatctgcgtggaaaaatgccccgaccgctacctcacgtacctgaatgctcgcagctcccgggactttgagtactataagcagttctgtgttcctggcttcaagaacaataaaggagtggctgaggtgcttcgagatggtgactgccctgctgtcctcatccccagcaaacccttggcccggagatgcttccccgctatccacgcctacaagggtgtcctgatggtgggcaatgagacgacctatgaggatgggcatggctcccggaaaaacatcacagacctggtggagggcgccaagaaagccaatggagtcctagaggcgcggcaactcgccatgcgcatatttgaagattacaccgtctcttggtactggattatcataggcctggtcattgccatggcgatgagcctcctgttcatcatcctgcttcgcttcctggctggtattatggtctgggtgatgatcatcatggtgattctggtgctgggctacggaatatttcactgctacatggagtactcccgactgcgtggtgaggccggctctgatgtctctttggtggacctcggctttcagacggatttccgggtgtacctgcacttacggcagacctggttggcctttatgatcattctgagtatccttgaagtcattatcatcttgctgctcatctttctccggaagagaattctcatcgcgattgcactcatcaaagaagccagcagggctgtgggatacgtcatgtgctccttgctctacccactggtcaccttcttcttgctgtgcctctgcatcgcctactgggccagcactgctgtcttcctgtccacttccaacgaagcggtctataagatctttgatgacagcccctgcccatttactgcgaaaacctgcaacccagagaccttcccctcctccaatgagtcccgccaatgccccaatgcccgttgccagttcgccttctacggtggtgagtcgggctaccaccgggccctgctgggcctgcagatcttcaatgccttcatgttcttctggttggccaacttcgtgctggcgctgggccaggtcacgctggccggggcctttgcctcctactactgggccctgcgcaagccggacgacctgccggccttcccgctcttctctgcctttggccgggcgctcaggtaccacacaggctccctggcctttggcgcgctcatcctggccattgtgcagatcatccgtgtgatactcgagtacctggatcagcggctgaaagctgcagagaacaagtttgccaagtgcctcatgacctgtctcaaatgctgcttctggtgcctggagaagttcatcaaattccttaataggaatgcctacatcatgattgccatctacggcaccaatttctgcacctcggccaggaatgccttcttcctgctcatgagaaacatcatcagagtggctgtcctggataaagttactgacttcctcttcctgttgggcaaacttctgatcgttggtagtgtggggatcctggctttcttcttcttcacccaccgtatcaggatcgtgcaggatacagcaccacccctcaattattactgggttcctatactgacggtgatcgttggctcctacttgattgcacacggtttcttcagcgtctatggcatgtgtgtggacacgctgttcctctgcttcttggaggacctggagaggaatgacggctcggccgagaggccttacttcatgtcttccaccctcaagaaactcttgaacaagaccaacaagaaggcagcggagtcctgaaggccccgtgctccccacctctcaaggagtctcatgccgcagggtgctcagtagctgggtctgttcccccagccccttgggctcacctgaagtcctatcactgccgctctgcccctccccatgagccagatcccaccagtttctggacgtggagagtctggggcatctccttcttatgccaaggggcgcttggagttttcatggctgcccctccagactgcgagaaacaagtaaaaacccattggggcctcttgatgtctgggatggcacgtggcccgacctccacaagctccctcatgcttcctgtcccccgcttacacgacaacgggccagaccacgggaaggacggtgtttgtgtctgagggagctgctggccacagtgaacacccacgtttattcctgcctgctccggccaggactgaaccccttcgccgcgatcctatctctgggtaccgagctt

SEQ ID NO: 428005 - DNA, 3395 bp, Homo sapiens
gggagcagctgcagccccgcccgcgccctcccgggtcccttagtctgggcagctgcccagctcgggccggtctgaccggtttgggccgccccgcctggcgctgtgctgggaggagccgccgccagtcgcgcggtcagtgcctccctccagactcgggagggtcgagggggcgcgggagagagcgcgggcggccgccggggctggtcgcctgcagggatgggggacgagcggccccactactacgggaaacacggaacgccacagaagtatgatcccactttcaaaggacccatttacaataggggctgcacggatatcatatgctgtgtgttcctgctcctggccattgtgggctacgtggctgtaggcatcatagcctggactcatggagaccctcgaaaggtgatctaccccactgatagccggggcgagttctgcgggcagaagggcacaaaaaacgagaacaaaccctatctgttttatttcaacattgtgaaatgtgccagccccctggttctgctggaattccaatgtcccactccccagatctgcgtggaaaaatgccccgaccgctacctcacgtacctgaatgctcgcagctcccgggactttgagtactataagcagttctgtgttcctggcttcaagaacaataaaggagtggctgaggtgcttcgagatggtgactgccctgctgtcctcatccccagcaaacccttggcccggagatgcttccccgctatccacgcctacaagggtgtcctgatggtgggcaatgagacgacctatgaggatgggcatggctcccggaaaaacatcacagacctggtggagggcgccaagaaagccaatggagtcctagaggcgcggcaactcgccatgcgcatatttgaagattacaccgtctcttggtactggattatcataggcctggtcattgccatggcgatgagcctcctgttcatcatcctgcttcgcttcctggctggtattatggtctgggtgatgatcatcatggtgattctggtgctgggctacggaatatttcactgctacatggagtactcccgactgcgtggtgaggccggctctgatgtctctttggtggacctcggctttcagacggatttccgggtgtacctgcacttacggcagacctggttggcctttatgatcattctgagtatccttgaagtcattatcatcttgctgctcatctttctccggaagagaattctcatcgcgattgcactcatcaaagaagccagcagggctgtgggatacgtcatgtgctccttgctctacccactggtcaccttcttcttgctgtgcctctgcatcgcctactgggccagcactgctgtcttcctgtccacttccaacgaagcggtctataagatctttgatgacagcccctgcccatttactgcgaaaacctgcaacccagagaccttcccctcctccaatgagtcccgccaatgccccaatgcccgttgccagttcgccttctacggtggtgagtcgggctaccaccgggccctgctgggcctgcagatcttcaatgccttcatgttcttctggttggccaacttcgtgctggcgctgggccaggtcacgctggccggggcctttgcctcctactactgggccctgcgcaagccggacgacctgccggccttcccgctcttctctgcctttggccgggcgctcaggtaccacacaggctccctggcctttggcgcgctcatcctggccattgtgcagatcatccgtgtgatactcgagtacctggatcagcggctgaaagctgcagagaacaagtttgccaagtgcctcatgacctgtctcaaatgctgcttctggtgcctggagaagttcatcaaattccttaataggaatgcctacatcatgattgccatctacggcaccaatttctgcacctcggccaggaatgccttcttcctgctcatgagaaacatcatcagagtggctgtcctggataaagttactgacttcctcttcctgttgggcaaacttctgatcgttggtagtgtggggatcctggctttcttcttcttcacccaccgtatcaggatcgtgcaggatacagcaccacccctcaattattactgggttcctatactgacggtgatcgttggctcctacttgattgcacacggtttcttcagcgtctatggcatgtgtgtggacacgctgttcctctgcttcttggaggacctggagaggaatgacggctcggccgagaggccttacttcatgtcttccaccctcaagaaactcttgaacaagaccaacaagaaggcagcggagtcctgaaggccccgtgctccccacctctcaaggagtctcatgccgcagggtgctcagtagctgggtctgttcccccagccccttgggctcacctgaagtcctatcactgccgctctgcccctccccatgagccagatcccaccagtttctggacgtggagagtctggggcatctccacaagctccctcatgcttcctgtcccccgcttacacgacaacgggccagaccacgggaaggacggtgtttgtgtctgagggagctgctggccacagtgaacacccacgtttattcctgcctgctccggccaggactgaaccccttctccacacctgaacagttggctcaagggccaccagaagcatttctttattattattattttttaacctggacatgcattaaagggtctattagctttctttccgtctgtctcaacagctgagatggggccgccaaggagtgccttccttttgctccctcctagctgggagtgacgggtgggagtgtgtgtgcccaggtgggggtgtctcctggctgggaaggagggaaagggagggagagttttgcgggggttggcagtggagagcaggctggagaggagatggctaatagctgtttaatggaaacctgctgggctggagggagttaggctgaatttcccgacttcctctgccagttattgacacagctctctttgtaagagaggaaagaaactaaacccacccaagggatgatttcagggggagaggtggagggcagatgtcctgggcaaaccgggcccctctgcccacacacctcacttgatccttttgccaaacttgtcaaactcaggggaactggcttcccagttgcccctttgccatattccaagtccccctcagacttcatgtctctgctcatcagcactgtcccaggatcctggagagggagaacccctggccccaggggaaagaggggggggtctcccgtttcctgtgcctgcaccagccctgcccccattgcgtctgcacacccctgcgtgtaactgcattccaaccactaataaagtgcctattgtacaggtc

SEQ ID NO: 428006 - DNA, 2629 bp, Homo sapiens
gggagcagctgcagccccgcccgcgccctcccgggtcccttagtctgggcagctgcccagctcgggccggtctgaccggtttgggccgccccgcctggcgctgtgctgggaggagccgccgccagtcgcgcggtcagtgcctccctccagactcgggagggtcgagggggcgcgggagagagcgcgggcggccgccggggctggtcgcctgcagggatgggggacgagcggccccactactacgggaaacacggaacgccacagaagtatgatcccactttcaaaggacccatttacaataggggctgcacggatatcatatgctgtgtgttcctgctcctggccattgtgggctacgtggctgtaggcatcatagcctggactcatggagaccctcgaaaggtgatctaccccactgatagccggggcgagttctgcgggcagaagggcacaaaaaacgagaacaaaccctatctgttttatttcaacattgtgaaatgtgccagccccctggttctgctggaattccaatgtcccactccccagatctgcgtggaaaaatgccccgaccgctacctcacgtacctgaatgctcgcagctcccgggactttgagtactataagcagttctgtgttcctggcttcaagaacaataaaggagtggctgaggtgcttcgagatggtgactgccctgctgtcctcatccccagcaaacccttggcccggagatgcttccccgctatccacgcctacaagggtgtcctgatggtgggcaatgagacgacctatgaggatgggcatggctcccggaaaaacatcacagacctggtggagggcgccaagaaagccaatggagtcctagaggcgcggcaactcgccatgcgcatatttgaagattacaccgtctcttggtactggattatcataggcctggtcattgccatggcgatgagcctcctgttcatcatcctgcttcgcttcctggctggtattatggtctgggtgatgatcatcatggtgattctggtgctgggctacggaatatttcactgctacatggagtactcccgactgcgtggtgaggccggctctgatgtctctttggtggacctcggctttcagacggatttccgggtgtacctgcacttacggcagacctggttggcctttatgatcattctgagtatccttgaagtcattatcatcttgctgctcatctttctccggaagagaattctcatcgcgattgcactcatcaaagaagccagcagggctgtgggatacgtcatgtgctccttgctctacccactggtcaccttcttcttgctgtgcctctgcatcgcctactgggccagcactgctgtcttcctgtccacttccaacgaagcggtctataagatctttgatgacagcccctgcccatttactgcgaaaacctgcaacccagagaccttcccctcctccaatgagtcccgccaatgccccaatgcccgttgccagttcgccttctacggtggtgagtcgggctaccaccgggccctgctgggcctgcagatcttcaatgccttcatgttcttctggttggccaacttcgtgctggcgctgggccaggtcacgctggccggggcctttgcctcctactactgggccctgcgcaagccggacgacctgccggccttcccgctcttctctgcctttggccgggcgctcaggtaccacacaggctccctggcctttggcgcgctcatcctggccattgtgcagatcatccgtgtgatactcgagtacctggatcagcggctgaaagctgcagagaacaagtttgccaagtgcctcatgacctgtctcaaatgctgcttctggtgcctggagaagttcatcaaattccttaataggaatgcctacatcatgattgccatctacggcaccaatttctgcacctcggccaggaatgccttcttcctgctcatgagaaacatcatcagagtggctgtcctggataaagttactgacttcctcttcctgttgggcaaacttctgatcgttggtagtgtggggatcctggctttcttcttcttcacccaccgtatcaggatcgtgcaggatacagcaccacccctcaattattactgggttcctatactgacggtgatcgttggctcctacttgattgcacacggtttcttcagcgtctatggcatgtgtgtggacacgctgttcctctgcttcttggaggacctggagaggaatgacggctcggccgagaggccttacttcatgtcttccaccctcaagaaactcttgaacaagaccaacaagaaggcagcggagtcctgaaggccccgtgctccccacctctcaaggagtctcatgccgcagggtgctcagtagctgggtctgttcccccagccccttgggctcacctgaagtcctatcactgccgctctgcccctccccatgagccagatcccaccagtttctggacgtggagagtctggggcatctccttcttatgccaaggggcgcttggagttttcatggctgcccctccagactgcgagaaacggtggtttaaccccagtagggagtaatgaccacgatgatggattcgggggcggtctttttaagt

SEQ ID NO: 428007 - DNA, 3035 bp, Homo sapiens
gggagcagctgcagccccgcccgcgccctcccgggtcccttagtctgggcagctgcccagctcgggccggtctgaccggtttgggccgccccgcctggcgctgtgctgggaggagccgccgccagtcgcgcggtcagtgcctccctccagactcgggagggtcgagggggcgcgggagagagcgcgggcggccgccggggctggtcgcctgcagggatgggggacgagcggccccactactacgggaaacacggaacgccacagaagtatgatcccactttcaaaggacccatttacaataggggctgcacggatatcatatgctgtgtgttcctgctcctggccattgtgggctacgtggctgtaggcatcatagcctggactcatggagaccctcgaaaggtgatctaccccactgatagccggggcgagttctgcgggcagaagggcacaaaaaacgagaacaaaccctatctgttttatttcaacattgtgaaatgtgccagccccctggttctgctggaattccaatgtcccactccccagatctgcgtggaaaaatgccccgaccgctacctcacgtacctgaatgctcgcagctcccgggactttgagtactataagcagttctgtgttcctggcttcaagaacaataaaggagtggctgaggtgcttcgagatggtgactgccctgctgtcctcatccccagcaaacccttggcccggagatgcttccccgctatccacgcctacaagggtgtcctgatggtgggcaatgagacgacctatgaggatgggcatggctcccggaaaaacatcacagacctggtggagggcgccaagaaagccaatggagtcctagaggcgcggcaactcgccatgcgcatatttgaagattacaccgtctcttggtactggattatcataggcctggtcattgccatggcgatgagcctcctgttcatcatcctgcttcgcttcctggctggtattatggtctgggtgatgatcatcatggtgattctggtgctgggctacggaatatttcactgctacatggagtactcccgactgcgtggtgaggccggctctgatgtctctttggtggacctcggctttcagacggatttccgggtgtacctgcacttacggcagacctggttggcctttatgatcattctgagtatccttgaagtcattatcatcttgctgctcatctttctccggaagagaattctcatcgcgattgcactcatcaaagaagccagcagggctgtgggatacgtcatgtgctccttgctctacccactggtcaccttcttcttgctgtgcctctgcatcgcctactgggccagcactgctgtcttcctgtccacttccaacgaagcggtctataagatctttgatgacagcccctgcccatttactgcgaaaacctgcaacccagagaccttcccctcctccaatgagtcccgccaatgccccaatgcccgttgccagttcgccttctacggtggtgagtcgggctaccaccgggccctgctgggcctgcagatcttcaatgccttcatgttcttctggttggccaacttcgtgctggcgctgggccaggtcacgctggccggggcctttgcctcctactactgggccctgcgcaagccggacgacctgccggccttcccgctcttctctgcctttggccgggcgctcaggtaccacacaggctccctggcctttggcgcgctcatcctggccattgtgcagatcatccgtgtgatactcgagtacctggatcagcggctgaaagctgcagagaacaagtttgccaagtgcctcatgacctgtctcaaatgctgcttctggtgcctggagaagttcatcaaattccttaataggaatgcctacatcatgattgccatctacggcaccaatttctgcacctcggccaggaatgccttcttcctgctcatgagaaacatcatcagagtggctgtcctggataaagttactgacttcctcttcctgttgggcaaacttctgatcgttggtagtgtggggatcctggctttcttcttcttcacccaccgtatcaggatcgtgcaggatacagcaccacccctcaattattactgggttcctatactgacggtgatcgttggctcctacttgattgcacacggtttcttcagcgtctatggcatgtgtgtggacacgctgttcctctgcttcttggaggacctggagaggaatgacggctcggccgagaggccttacttcatgtcttccaccctcaagaaactcttgaacaagaccaacaagaaggcagcggagtcctgaaggccccgtgctccccacctctcaaggagtctcatgccgcagggtgctcagtagctgggtctgttcccccagccccttgggctcacctgaagtcctatcactgccgctctgcccctccccatgagccagatcccaccagtttctggacgtggagagtctggggcatctccacaagctccctcatgcttcctgtcccccgcttacacgacaacgggccagaccacgggaaggacggtgtttgtgtctgagggagctgctggccacagtgaacacccacgtttattcctgcctgctccggccaggactgaaccccttctccacacctgaacagttggctcaagggccaccagaagcatttctttattattattattttttaacctggacatgcattaaagggtctattagcttaaaaaaacaacaacacaaaacaaaaacacaacatgtgtgacacgcgatggagcccgcaaaaaagctctcccaaacccactggttgggcgcgccggggcccagaaggcaacggcacacgggggcaaacagacgggttcccccagaggaacaccgcggcacagacacaaggctggggaatccacccaagtaaaaaaaccgcgcggagacacacgagttgtggacacaaccccaaaggagatccggaagacacaaggggaccaccaacgggacccagggaccgaaacaag

SEQ ID NO: 428008 - DNA, 2495 bp, Homo sapiens
gggagcagctgcagccccgcccgcgccctcccgggtcccttagtctgggcagctgcccagctcgggccggtctgaccggtttgggccgccccgcctggcgctgtgctgggaggagccgccgccagtcgcgcggtcagtgcctccctccagactcgggagggtcgagggggcgcgggagagagcgcgggcggccgccggggctggtcgcctgcagggatgggggacgagcggccccactactacgggaaacacggaacgccacagaagtatgatcccactttcaaaggacccatttacaataggggctgcacggatatcatatgctgtgtgttcctgctcctggccattgtgggctacgtggctgtaggcatcatagcctggactcatggagaccctcgaaaggtgatctaccccactgatagccggggcgagttctgcgggcagaagggcacaaaaaacgagaacaaaccctatctgttttatttcaacattgtgaaatgtgccagccccctggttctgctggaattccaatgtcccactccccagatctgcgtggaaaaatgccccgaccgctacctcacgtacctgaatgctcgcagctcccgggactttgagtactataagcagttctgtgttcctggcttcaagaacaataaaggagtggctgaggtgcttcgagatggtgactgccctgctgtcctcatccccagcaaacccttggcccggagatgcttccccgctatccacgcctacaagggtgtcctgatggtgggcaatgagacgacctatgaggatgggcatggctcccggaaaaacatcacagacctggtggagggcgccaagaaagccaatggagtcctagaggcgcggcaactcgccatgcgcatatttgaagattacaccgtctcttggtactggattatcataggcctggtcattgccatggcgatgagcctcctgttcatcatcctgcttcgcttcctggctggtattatggtctgggtgatgatcatcatggtgattctggtgctgggctacggaatatttcactgctacatggagtactcccgactgcgtggtgaggccggctctgatgtctctttggtggacctcggctttcagacggatttccgggtgtacctgcacttacggcagacctggttggcctttatgatcattctgagtatccttgaagtcattatcatcttgctgctcatctttctccggaagagaattctcatcgcgattgcactcatcaaagaagccagcagggctgtgggatacgtcatgtgctccttgctctacccactggtcaccttcttcttgctgtgcctctgcatcgcctactgggccagcactgctgtcttcctgtccacttccaacgaagcggtctataagatctttgatgacagcccctgcccatttactgcgaaaacctgcaacccagagaccttcccctcctccaatgagtcccgccaatgccccaatgcccgttgccagttcgccttctacggtggtgagtcgggctaccaccgggccctgctgggcctgcagatcttcaatgccttcatgttcttctggttggccaacttcgtgctggcgctgggccaggtcacgctggccggggcctttgcctcctactactgggccctgcgcaagccggacgacctgccggccttcccgctcttctctgcctttggccgggcgctcaggtaccacacaggctccctggcctttggcgcgctcatcctggccattgtgcagatcatccgtgtgatactcgagtacctggatcagcggctgaaagctgcagagaacaagtttgccaagtgcctcatgacctgtctcaaatgctgcttctggtgcctggagaagttcatcaaattccttaataggaatgcctacatcatgattgccatctacggcaccaatttctgcacctcggccaggaatgccttcttcctgctcatgagaaacatcatcagagtggctgtcctggataaagttactgacttcctcttcctgttgggcaaacttctgatcgttggtagtgtggggatcctggctttcttcttcttcacccaccgtatcaggatcgtgcaggatacagcaccacccctcaattattactgggttcctatactgacggtgatcgttggctcctacttgattgcacacggtttcttcagcgtctatggcatgtgtgtggacacgctgttcctctgcttcttggaggacctggagaggaatgacggctcggccgagaggccttacttcatgtcttccaccctcaagaaactcttgaacaagaccaacaagaaggcagcggagtcctgaaggccccgtgctccccacctctcaaggagtctcatgccgcagggtgctcagtagctggggttaaagctgatactactggcggaagcatgtctgcttcccatggtggtacgtgctggcattgatcctgtttgtggcttgaccaatggactctatcacag

SEQ ID NO: 428009 - DNA, 2050 bp, Homo sapiens
cggggcggggcgtgcagcccgcggagcctcccgcccgcccgggctggggtcgcgctggctcggactccgctccccgccccgccgcggccatggaggacgagcggaaaaacggagcctacggaacgccacagaagtatgatcccactttcaaaggacccatttacaataggggctgcacggatatcatatgctgtgtgttcctgctcctggccattgtgggctacgtggctgtaggcatcatagcctggactcatggagaccctcgaaaggtgatctaccccactgatagccggggcgagttctgcgggcagaagggcacaaaaaacgagaacaaaccctatctgttttatttcaacattgtgaaatgtgccagccccctggttctgctggaattccaatgtcccactccccagatctgcgtggaaaaatgccccgaccgctacctcacgtacctgaatgctcgcagctcccgggactttgagtactataagcagttctgtgttcctggcttcaagaacaataaaggagtggctgaggtgcttcgagatggtgactgccctgctgtcctcatccccagcaaacccttggcccggagatgcttccccgctatccacgcctacaagggtgtcctgatggtgggcaatgagacgacctatgaggatgggcatggctcccggaaaaacatcacagacctggtggagggcgccaagaaagccaatggagtcctagaggcgcggcaactcgccatgcgcatatttgaagattacaccgtctcttggtactggattatcataggcctggtcattgccatggcgatgagcctcctgttcatcatcctgcttcgcttcctggctggtattatggtctgggtgatgatcatcatggtgattctggtgctgggctacggaatatttcactgctacatggagtactcccgactgcgtggtgaggccggctctgatgtctctttggtggacctcggctttcagacggatttccgggtgtacctgcacttacggcagacctggttggcctttatgatcattctgagtatccttgaagtcattatcatcttgctgctcatctttctccggaagagaattctcatcgcgattgcactcatcaaagaagccagcagggctgtgggatacgtcatgtgctccttgctctacccactggtcaccttcttcttgctgtgcctctgcatcgcctactgggccagcactgctgtcttcctgtccacttccaacgaagcggtctataagatctttgatgacagcccctgcccatttactgcgaaaacctgcaacccagagaccttcccctcctccaatgagtcccgccaatgccccaatgcccgttgccagttcgccttctacggtggtgagtcgggctaccaccgggccctgctgggcctgcagatcttcaatgccttcatgttcttctggttggccaacttcgtgctggcgctgggccaggtcacgctggccggggcctttgcctcctactactgggccctgcgcaagccggacgacctgccggccttcccgctcttctctgcctttggccgggcgctcaggtaccacacaggctccctggcctttggcgcgctcatcctggccattgtgcagatcatccgtgtgatactcgagtacctggatcagcggctgaaagctgcagagaacaagtttgccaagtgcctcatgacctgtctcaaatgctgcttctggtgcctggagaagttcatcaaattccttaataggaatgcctacatcatgattgccatctacggcaccaatttctgcacctcggccaggaatgccttcttcctgctcatgagaaacatcatcagagtggctgtcctggataaagttactgacttcctcttcctgttgggcaaacttctgatcgttggtagtgtgggtgagtgccgcccacctagcctctcggggtgtgggagcctgatttctgtcttctgtgatgagtgtcatcttcttaggaggctgtttcctatatccagaacccttcgccatcttgctttcttctcctt

SEQ ID NO: 428010 - DNA, 1758 bp, Homo sapiens
  misc_feature (1542)..(1542): n is a, c, g, or t
  misc_feature (1555)..(1556): n is a, c, g, or t
  misc_feature (1560)..(1560): n is a, c, g, or t
  misc_feature (1562)..(1562): n is a, c, g, or t
  misc_feature (1564)..(1564): n is a, c, g, or t
  misc_feature (1566)..(1566): n is a, c, g, or t
  misc_feature (1571)..(1571): n is a, c, g, or t
  misc_feature (1580)..(1582): n is a, c, g, or t
  misc_feature (1591)..(1591): n is a, c, g, or t
  misc_feature (1603)..(1604): n is a, c, g, or t
  misc_feature (1611)..(1611): n is a, c, g, or t
  misc_feature (1614)..(1615): n is a, c, g, or t
cggggcggggcgtgcagcccgcggagcctcccgcccgcccgggctggggtcgcgctggctcggactccgctccccgccccgccgcggccatggaggacgagcggaaaaacggagcctacggaacgccacagaagtatgatcccactttcaaaggacccatttacaataggggctgcacggatatcatatgctgtgtgttcctgctcctggccattgtgggctacgtggctgtaggcatcatagcctggactcatggagaccctcgaaaggtgatctaccccactgatagccggggcgagttctgcgggcagaagggcacaaaaaacgagaacaaaccctatctgttttatttcaacattgtgaaatgtgccagccccctggttctgctggaattccaatgtcccactccccagatctgcgtggaaaaatgccccgaccgctacctcacgtacctgaatgctcgcagctcccgggactttgagtactataagcagttctgtgttcctggcttcaagaacaataaaggagtggctgaggtgcttcgagatggtgactgccctgctgtcctcatccccagcaaacccttggcccggagatgcttccccgctatccacgcctacaagggtgtcctgatggtgggcaatgagacgacctatgaggatgggcatggctcccggaaaaacatcacagacctggtggagggcgccaagaaagccaatggagtcctagaggcgcggcaactcgccatgcgcatatttgaagattacaccgtctcttggtactggattatcataggcctggtcattgccatggcgatgagcctcctgttcatcatcctgcttcgcttcctggctggtattatggtctgggtgatgatcatcatggtgattctggtgctgggctacggaatatttcactgctacatggagtactcccgactgcgtggtgaggccggctctgatgtctctttggtggacctcggctttcagacggatttccgggtgtacctgcacttacggcagacctggttggcctttatgatcattctgagtatccttgaagtcattatcatcttgctgctcatctttctccggaagagaattctcatcgcgattgcactcatcaaagaagccagcagggctgtgggatacgtcatgtgctccttgctctacccactggtcaccttcttcttgctgtgcctctgcatcgcctactgggccagcactgctgtcttcctgtccacttccaacgaagcggtctataagatctttgatgacagcccctgcccatttactgcgaaaacctgcaacccagagaccttcccctcctccaatgagtcccgccaatgccccaatgcccgttgccagttcgccttctacggtggtgagtcgggctaccaccgggccctgctgggcctgcagatcttcaatgccttcatgttcttctggttggccaacttcgtgctggcgctgggccaggtcacgctggccggggcctttgcctcctatatggcctggcagcggagactgcggctccgtcttntgcttggcggggnnaggncnanangtccnggctggggnnnctggcaggnacaccgggaacnnaccgaanggnngaccgcacaaagtcgcgggccaggcgtccaggggtcggggaaacacatccaaaaagacacaggcagaatagggcggagtgccgagaaagagggggcagccgggaacagggaggaacaggaccctgtgcacgtggtcgcgcgcc

SEQ ID NO: 428011 - DNA, 461 bp, Homo sapiens
ccatggcctctggagtgggaacagggctggatctgaggagtggcagtgtctcagtatccctggatctttccacagcctggactcatggagaccctcgaaaggtgatctaccccactgatagccggggcgagttctgcgggcagaagggcacaaaaaacgagtgagttgactccttgcggcctggtggggctggggaagagggggcagaagattctaggcattccccatctctctaagtccagttaacaagtgcttataggctgggcgcggtgactcacgcccgaaattccaacactttgggaggccgaggcaggaatattgctttaggctaggagttcgagaccagcctggccaacatggcaaaaccccgtctccactaaaaatacacaaattagccaggcatggtggcacatgcctgtaatcccagctactcaggaggctgaggcaggagaatcacttga

SEQ ID NO: 428012 - DNA, 462 bp, Homo sapiens
agcatatgattatgattccaagtagggggaaagggttctggaagttctcttctgaaggtgacacttgagcagagacctaaggatgtgtgggatccagccatggggagagaatgcaccgggcggtgggaactgcaagtgtaaagtccctgaggcagaagcctcgatgtttgcttctgttaaatgggggcagttgtagctgctttgcaaagttgcaggaggcactgctggactgagcttgtggttcccccatgcaggaatatttcactgctacatggagtactcccgactgcgtggtgaggccggctctgatgtctctttggtggacctcggctttcagacggatttccgggtgtacctgcacttacggcagacctggttggcctttagtgagtcacagtctcccattcctgcccccacatgaggccttggagggagtggggagcccagccggctcagcctttg

SEQ ID NO: 428013 - DNA, 340 bp, Homo sapiens
gtggtgaggccggctctgatgtctctttggtggacctcggctttcagacggatttccgggtgtacctgcacttacggcagacctggttggcctttagtgagtcacagtctcccattcctgcccccacatgaggccttggagggagtggggagcccagccggctcagcctttgccctttgcagtgatcattctgagtatccttgaagtcattatcatcttgctgctcatctttctccggaagagaattctcatcgcgattgcactcatcaaagaagccagcaggtggggggccagggtgccaggggccaggatggagctgtccctagagttgtgtcttttg

SEQ ID NO: 428014 - DNA, 3376 bp, Homo sapiens
cggggcggggcgtgcagcccgcggagcctcccgcccgcccgggctggggtcgcgctggctcggactccgctccccgccccgccgcggccatggaggacgagcggaaaaacggagcctacggaacgccacagaagtatgatcccactttcaaaggacccatttacaataggggctgcacggatatcatatgctgtgtgttcctgctcctggccattgtgggctacgtggctgtaggcatcatagcctggactcatggagaccctcgaaaggtgatctaccccactgatagccggggcgagttctgcgggcagaagggcacaaaaaacgagaacaaaccctatctgttttatttcaacattgtgaaatgtgccagccccctggttctgctggaattccaatgtcccactccccagatctgcgtggaaaaatgccccgaccgctacctcacgtacctgaatgctcgcagctcccgggactttgagtactataagcagttctgtgttcctggcttcaagaacaataaaggagtggctgaggtgcttcgagatggtgactgccctgctgtcctcatccccagcaaacccttggcccggagatgcttccccgctatccacgcctacaagggtgtcctgatggtgggcaatgagacgacctatgaggatgggcatggctcccggaaaaacatcacagacctggtggagggcgccaagaaagccaatggagtcctagaggcgcggcaactcgccatgcgcatatttgaagattacaccgtctcttggtactggattatcataggcctggtcattgccatggcgatgagcctcctgttcatcatcctgcttcgcttcctggctggtattatggtctgggtgatgatcatcatggtgattctggtgctgggctacggaatatttcactgctacatggagtactcccgactgcgtggtgaggccggctctgatgtctctttggtggacctcggctttcagacggatttccgggtgtacctgcacttacggcagacctggttggcctttatgatcattctgagtatccttgaagtcattatcatcttgctgctcatctttctccggaagagaattctcatcgcgattgcactcatcaaagaagccagcagggctgtgggatacgtcatgtgctccttgctctacccactggtcaccttcttcttgctgtgcctctgcatcgcctactgggccagcactgctgtcttcctgtccacttccaacgaagcggtctataagatctttgatgacagcccctgcccatttactgcgaaaacctgcaacccagagaccttcccctcctccaatgagtcccgccaatgccccaatgcccgttgccagttcgccttctacggtggtgagtcgggctaccaccgggccctgctgggcctgcagatcttcaatgccttcatgttcttctggttggccaacttcgtgctggcgctgggccaggtcacgctggccggggcctttgcctcctactactgggccctgcgcaagccggacgacctgccggccttcccgctcttctctgcctttggccgggcgctcaggtaccacacaggctccctggcctttggcgcgctcatcctggccattgtgcagatcatccgtgtgatactcgagtacctggatcagcggctgaaagctgcagagaacaagtttgccaagtgcctcatgacctgtctcaaatgctgcttctggtgcctggagaagttcatcaaattccttaataggaatgcctacatcatgattgccatctacggcaccaatttctgcacctcggccaggaatgccttcttcctgctcatgagaaacatcatcagagtggctgtcctggataaagttactgacttcctcttcctgttgggcaaacttctgatcgttggtagtgtggggatcctggctttcttcttcttcacccaccgtatcaggatcgtgcaggatacagcaccacccctcaattattactgggttcctatactgacggtgatcgttggctcctacttgattgcacacggtttcttcagcgtctatggcatgtgtgtggacacgctgttcctctgcttcttggaggacctggagaggaatgacggctcggccgagaggccttacttcatgtcttccaccctcaagaaactcttgaacaagaccaacaagaaggcagcggagtcctgaaggccccgtgctccccacctctcaaggagtctcatgccgcagggtgctcagtagctgggtctgttcccccagccccttgggctcacctgaagtcctatcactgccgctctgcccctccccatgagccagatcccaccagtttctggacgtggagagtctggggcatctccttcttatgccaaggggcgcttggagttttcatggctgcccctccagactgcgagaaacaagtaaaaacccattggggcctcttgatgtctgggatggcacgtggcccgacctccacaagctccctcatgcttcctgtcccccgcttacacgacaacgggccagaccacgggaaggacggtgtttgtgtctgagggagctgctggccacagtgaacacccacgtttattcctgcctgctccggccaggactgaaccccttctccacacctgaacagttggctcaagggccaccagaagcatttctttattattattattttttaacctggacatgcattaaagggtctattagctttctttccgtctgtctcaacagctgagatggggccgccaaggagtgccttccttttgctccctcctagctgggagtgacgggtgggagtgtgtgtgcccaggtgggggtgtctcctggctgggaaggagggaaagggagggagagttttgcgggggttggcagtggagagcaggctggagaggagatggctaatagctgtttaatggaaacctgctgggctggagggagttaggctgaatttcccgacttcctctgccagttattgacacagctctctttgtaagagaggaaagaaactaaacccacccaagggatgatttcagggggagaggtggagggcagatgtcctgggcaaaccgggcccctctgcccacacacctcacttgatccttttgccaaacttgtcaaactcaggggaactggcttcccagttgcccctttgccatattccaagtccccctcagacttcatgtctctgctcatcagcactgtcccaggatcctggagagggagaacccctggccccaggggaaagaggggggggtctcccgtttcctgtgcctgcaccagccctgcccccattgcgtctgcacacccctgcgtgtaactgcattccaaccactaataaagtgcctattgtacaggtc

SEQ ID NO: 428015 - DNA, 3843 bp, Homo sapiens
gggagcagctgcagccccgcccgcgccctcccgggtcccttagtctgggcagctgcccagctcgggccggtctgaccggtttgggccgccccgcctggcgctgtgctgggaggagccgccgccagtcgcgcggtcagtgcctccctccagactcgggagggtcgagggggcgcgggagagagcgcgggcggccgccggggctggtcgcctgcagggatgggggacgagcggccccactactacgggaaacacggaacgccacagaagtatgatcccactttcaaaggacccatttacaataggggctgcacggatatcatatgctgtgtgttcctgctcctggccattgtgggctacgtggctgtaggcatcatagcctggactcatggagaccctcgaaaggtgatctaccccactgatagccggggcgagttctgcgggcagaagggcacaaaaaacgagaacaaaccctatctgttttatttcaacattgtgaaatgtgccagccccctggttctgctggaattccaatgtcccactccccagatctgcgtggaaaaatgccccgaccgctacctcacgtacctgaatgctcgcagctcccgggactttgagtactataagcagttctgtgttcctggcttcaagaacaataaaggagtggctgaggtgcttcgagatggtgactgccctgctgtcctcatccccagcaaacccttggcccggagatgcttccccgctatccacgcctacaagggtgtcctgatggtgggcaatgagacgacctatgaggatgggcatggctcccggaaaaacatcacagacctggtggagggcgccaagaaagccaatggagtcctagaggcgcggcaactcgccatgcgcatatttgaagattacaccgtctcttggtactggattatcataggcctggtcattgccatggcgatgagcctcctgttcatcatcctgcttcgcttcctggctggtattatggtctgggtgatgatcatcatggtgattctggtgctgggctacggaatatttcactgctacatggagtactcccgactgcgtggtgaggccggctctgatgtctctttggtggacctcggctttcagacggatttccgggtgtacctgcacttacggcagacctggttggcctttatgatcattctgagtatccttgaagtcattatcatcttgctgctcatctttctccggaagagaattctcatcgcgattgcactcatcaaagaagccagcagggctgtgggatacgtcatgtgctccttgctctacccactggtcaccttcttcttgctgtgcctctgcatcgcctactgggccagcactgctgtcttcctgtccacttccaacgaagcggtctataagatctttgatgacagcccctgcccatttactgcgaaaacctgcaacccagagaccttcccctcctccaatgagtcccgccaatgccccaatgcccgttgccagttcgccttctacggtggtgagtcgggctaccaccgggccctgctgggcctgcagatcttcaatgccttcatgttcttctggttggccaacttcgtgctggcgctgggccaggtcacgctggccggggcctttgcctcctactactgggccctgcgcaagccggacgacctgccggccttcccgctcttctctgcctttggccgggcgctcaggtaccacacaggctccctggcctttggcgcgctcatcctggccattgtgcagatcatccgtgtgatactcgagtacctggatcagcggctgaaagctgcagagaacaagtttgccaagtgcctcatgacctgtctcaaatgctgcttctggtgcctggagaagttcatcaaattccttaataggaatgcctacatcatgattgccatctacggcaccaatttctgcacctcggccaggaatgccttcttcctgctcatgagaaacatcatcagagtggctgtcctggataaagttactgacttcctcttcctgttgggcaaacttctgatcgttggtagtgtggggatcctggctttcttcttcttcacccaccgtatcaggatcgtgcaggatacagcaccacccctcaattattactgggttcctatactgacggtgatcgttggctcctacttgattgcacacggtttcttcagcgtctatggcatgtgtgtggacacgctgttcctctgcttcttggaggacctggagaggaatgacggctcggccgagaggccttacttcatgtcttccaccctcaagaaactcttgaacaagaccaacaagaaggcagcggagtcctgaaggccccgtgctccccacctctcaaggagtctcatgccgcagggtgctcagtagctgggtctgttcccccagccccttgggctcacctgaagtcctatcactgccgctctgcccctccccatgagccagatcccaccagtttctggacgtggagagtctggggcatctccttcttatgccaaggggcgcttggagttttcatggctgcccctccagactgcgagaaacaagtaaaaacccattggggcctcttgatgtctgggatggcacgtggcccgacctccacaagctccctcatgcttcctgtcccccgcttacacgacaacgggccagaccacgggaaggacggtgtttgtgtctgagggagctgctggccacagtgaacacccacgtttattcctgcctgctccggccaggactgaaccccttctccacacctgaacagttggctcaagggccaccagaagcatttctttattattattattttttaacctggacatgcattaaagggtctattagctttctttccgtctgtctcaacagctgagatggggccgccaaggagtgccttccttttgctccctcctagctgggagtgacgggtgggagtgtgtgtgcccaggtgggggtgtctcctggctgggaaggagggaaagggagggagagttttgcgggggttggcagtggagagcaggctggagaggagatggctaatagctgtttaatggaaacctgctgggctggagggagttaggctgaatttcccgacttcctctgccagttattgacacagctctctttgtaagagaggaaagaaactaaacccacccaagggatgatttcagggggagaggtggagggcagatgtcctgggcaaaccgggcccctctgcccacacacctcacttgatccttttgccaaacttgtcaaactcaggggaactggcttcccagttgcccctttgccatattccaagtccccctcagacttcatgtctctgctcatcagcactgtcccaggatcctggagagggagaacccctggccccaggggaaagaggggggggtctcccgtttcctgtgcctgcaccagccctgcccccattgcgtctgcacacccctgcgtgtaactgcattccaaccactaataaagtgcctattgtacaggtcaaaaaaaaacaaaacaaaaacgacaacaaaacaaacggggaacacgaaaagaagaactgccacagggggccaaagtagaagaacacagaaatagagtaagacgaggggccacacagcgcagcaatataaacagcgcacgacaagccacgcgcgaggacaaggcagacaaggtggaaaacagcaccacgcgccaccatggaagcgcacacccacaccgcggcgtagaaaacatcgcacacacaacaaagaacaacgaccaaggcgcaaaaagacacgcgacaacgccgacagcacgcaaacgccgcgcgaagacgcggacaagcagaaactacgg

SEQ ID NO: 428016 - DNA, 3435 bp, Homo sapiens
gggagcagctgcagccccgcccgcgccctcccgggtcccttagtctgggcagctgcccagctcgggccggtctgaccggtttgggccgccccgcctggcgctgtgctgggaggagccgccgccagtcgcgcggtcagtgcctccctccagactcgggagggtcgagggggcgcgggagagagcgcgggcggccgccggggctggtcgcctgcagggatgggggacgagcggccccactactacgggaaacacggaacgccacagaagtatgatcccactttcaaaggacccatttacaatagcctggactcatggagaccctcgaaaggtgatctaccccactgatagccggggcgagttctgcgggcagaagggcacaaaaaacgagaacaaaccctatctgttttatttcaacattgtgaaatgtgccagccccctggttctgctggaattccaatgtcccactccccagatctgcgtggaaaaatgccccgaccgctacctcacgtacctgaatgctcgcagctcccgggactttgagtactataagcagttctgtgttcctggcttcaagaacaataaaggagtggctgaggtgcttcgagatggtgactgccctgctgtcctcatccccagcaaacccttggcccggagatgcttccccgctatccacgcctacaagggtgtcctgatggtgggcaatgagacgacctatgaggatgggcatggctcccggaaaaacatcacagacctggtggagggcgccaagaaagccaatggagtcctagaggcgcggcaactcgccatgcgcatatttgaagattacaccgtctcttggtactggattatcataggcctggtcattgccatggcgatgagcctcctgttcatcatcctgcttcgcttcctggctggtattatggtctgggtgatgatcatcatggtgattctggtgctgggctacggaatatttcactgctacatggagtactcccgactgcgtggtgaggccggctctgatgtctctttggtggacctcggctttcagacggatttccgggtgtacctgcacttacggcagacctggttggcctttatgatcattctgagtatccttgaagtcattatcatcttgctgctcatctttctccggaagagaattctcatcgcgattgcactcatcaaagaagccagcagggctgtgggatacgtcatgtgctccttgctctacccactggtcaccttcttcttgctgtgcctctgcatcgcctactgggccagcactgctgtcttcctgtccacttccaacgaagcggtctataagatctttgatgacagcccctgcccatttactgcgaaaacctgcaacccagagaccttcccctcctccaatgagtcccgccaatgccccaatgcccgttgccagttcgccttctacggtggtgagtcgggctaccaccgggccctgctgggcctgcagatcttcaatgccttcatgttcttctggttggccaacttcgtgctggcgctgggccaggtcacgctggccggggcctttgcctcctactactgggccctgcgcaagccggacgacctgccggccttcccgctcttctctgcctttggccgggcgctcaggtaccacacaggctccctggcctttggcgcgctcatcctggccattgtgcagatcatccgtgtgatactcgagtacctggatcagcggctgaaagctgcagagaacaagtttgccaagtgcctcatgacctgtctcaaatgctgcttctggtgcctggagaagttcatcaaattccttaataggaatgcctacatcatgattgccatctacggcaccaatttctgcacctcggccaggaatgccttcttcctgctcatgagaaacatcatcagagtggctgtcctggataaagttactgacttcctcttcctgttgggcaaacttctgatcgttggtagtgtggggatcctggctttcttcttcttcacccaccgtatcaggatcgtgcaggatacagcaccacccctcaattattactgggttcctatactgacggtgatcgttggctcctacttgattgcacacggtttcttcagcgtctatggcatgtgtgtggacacgctgttcctctgcttcttggaggacctggagaggaatgacggctcggccgagaggccttacttcatgtcttccaccctcaagaaactcttgaacaagaccaacaagaaggcagcggagtcctgaaggccccgtgctccccacctctcaaggagtctcatgccgcagggtgctcagtagctgggtctgttcccccagccccttgggctcacctgaagtcctatcactgccgctctgcccctccccatgagccagatcccaccagtttctggacgtggagagtctggggcatctccttcttatgccaaggggcgcttggagttttcatggctgcccctccagactgcgagaaacaagtaaaaacccattggggcctcttgatgtctgggatggcacgtggcccgacctccacaagctccctcatgcttcctgtcccccgcttacacgacaacgggccagaccacgggaaggacggtgtttgtgtctgagggagctgctggccacagtgaacacccacgtttattcctgcctgctccggccaggactgaaccccttctccacacctgaacagttggctcaagggccaccagaagcatttctttattattattattttttaacctggacatgcattaaagggtctattagctttctttccgtctgtctcaacagctgagatggggccgccaaggagtgccttccttttgctccctcctagctgggagtgacgggtgggagtgtgtgtgcccaggtgggggtgtctcctggctgggaaggagggaaagggagggagagttttgcgggggttggcagtggagagcaggctggagaggagatggctaatagctgtttaatggaaacctgctgggctggagggagttaggctgaatttcccgacttcctctgccagttattgacacagctctctttgtaagagaggaaagaaactaaacccacccaagggatgatttcagggggagaggtggagggcagatgtcctgggcaaaccgggcccctctgcccacacacctcacttgatccttttgccaaacttgtcaaactcaggggaactggcttcccagttgcccctttgccatattccaagtccccctcagacttcatgtctctgctcatcagcactgtcccaggatcctggagagggagaacccctggccccaggggaaagaggggggggtctcccgtttcctgtgcctgcaccagccctgcccccattgcgtctgcacacccctgcgtgtaactgcattccaaccactaataaagtgcctattgtacaggtc

SEQ ID NO: 428017 - DNA, 3551 bp, Homo sapiens
cggggcggggcgtgcagcccgcggagcctcccgcccgcccgggctggggtcgcgctggctcggactccgctccccgccccgccgcggccatggaggacgagcggaaaaacggagcctacggaacgccacagaagtatgatcccactttcaaaggacccatttacaataggggctgcacggatatcatatgctgtgtgttcctgctcctggccattgtgggctacgtggctgtaggcatcatagcctggactcatggagaccctcgaaaggtgatctaccccactgatagccggggcgagttctgcgggcagaagggcacaaaaaacgagaacaaaccctatctgttttatttcaacattgtgaaatgtgccagccccctggttctgctggaattccaatgtcccactccccagatctgcgtggaaaaatgccccgaccgctacctcacgtacctgaatgctcgcagctcccgggactttgagtactataagcagttctgtgttcctggcttcaagaacaataaaggagtggctgaggtgcttcgagatggtgactgccctgctgtcctcatccccagcaaacccttggcccggagatgcttccccgctatccacgcctacaagggtgtcctgatggtgggcaatgagacgacctatgaggatgggcatggctcccggaaaaacatcacagacctggtggagggcgccaagaaagccaatggagtcctagaggcgcggcaactcgccatgcgcatatttgaagattacaccgtctcttggtactggattatcataggcctggtcattgccatggcgatgagcctcctgttcatcatcctgcttcgcttcctggctggtattatggtctgggtgatgatcatcatggtgattctggtgctgggctacggaatatttcactgctacatggagtactcccgactgcgtggtgaggccggctctgatgtctctttggtggacctcggctttcagacggatttccgggtgtacctgcacttacggcagacctggttggcctttatgatcattctgagtatccttgaagtcattatcatcttgctgctcatctttctccggaagagaattctcatcgcgattgcactcatcaaagaagccagcagggctgtgggatacgtcatgtgctccttgctctacccactggtcaccttcttcttgctgtgcctctgcatcgcctactgggccagcactgctgtgtatctgcccccagacactgatctctgaccccagggatggctaaagaccaactttgcctagaagtgacctgcagcttagggatagggctggaaactggtgggagaatggattctttcccacaaaagtccctggggtcctcagtcctagacctctgcttccttaacgaacctccagcttcctgtccacttccaacgaagcggtctataagatctttgatgacagcccctgcccatttactgcgaaaacctgcaacccagagaccttcccctcctccaatgagtcccgccaatgccccaatgcccgttgccagttcgccttctacggtggtgagtcgggctaccaccgggccctgctgggcctgcagatcttcaatgccttcatgttcttctggttggccaacttcgtgctggcgctgggccaggtcacgctggccggggcctttgcctcctactactgggccctgcgcaagccggacgacctgccggccttcccgctcttctctgcctttggccgggcgctcaggtaccacacaggctccctggcctttggcgcgctcatcctggccattgtgcagatcatccgtgtgatactcgagtacctggatcagcggctgaaagctgcagagaacaagtttgccaagtgcctcatgacctgtctcaaatgctgcttctggtgcctggagaagttcatcaaattccttaataggaatgcctacatcatgattgccatctacggcaccaatttctgcacctcggccaggaatgccttcttcctgctcatgagaaacatcatcagagtggctgtcctggataaagttactgacttcctcttcctgttgggcaaacttctgatcgttggtagtgtggggatcctggctttcttcttcttcacccaccgtatcaggatcgtgcaggatacagcaccacccctcaattattactgggttcctatactgacggtgatcgttggctcctacttgattgcacacggtttcttcagcgtctatggcatgtgtgtggacacgctgttcctctgcttcttggaggacctggagaggaatgacggctcggccgagaggccttacttcatgtcttccaccctcaagaaactcttgaacaagaccaacaagaaggcagcggagtcctgaaggccccgtgctccccacctctcaaggagtctcatgccgcagggtgctcagtagctgggtctgttcccccagccccttgggctcacctgaagtcctatcactgccgctctgcccctccccatgagccagatcccaccagtttctggacgtggagagtctggggcatctccttcttatgccaaggggcgcttggagttttcatggctgcccctccagactgcgagaaacaagtaaaaacccattggggcctcttgatgtctgggatggcacgtggcccgacctccacaagctccctcatgcttcctgtcccccgcttacacgacaacgggccagaccacgggaaggacggtgtttgtgtctgagggagctgctggccacagtgaacacccacgtttattcctgcctgctccggccaggactgaaccccttctccacacctgaacagttggctcaagggccaccagaagcatttctttattattattattttttaacctggacatgcattaaagggtctattagctttctttccgtctgtctcaacagctgagatggggccgccaaggagtgccttccttttgctccctcctagctgggagtgacgggtgggagtgtgtgtgcccaggtgggggtgtctcctggctgggaaggagggaaagggagggagagttttgcgggggttggcagtggagagcaggctggagaggagatggctaatagctgtttaatggaaacctgctgggctggagggagttaggctgaatttcccgacttcctctgccagttattgacacagctctctttgtaagagaggaaagaaactaaacccacccaagggatgatttcagggggagaggtggagggcagatgtcctgggcaaaccgggcccctctgcccacacacctcacttgatccttttgccaaacttgtcaaactcaggggaactggcttcccagttgcccctttgccatattccaagtccccctcagacttcatgtctctgctcatcagcactgtcccaggatcctggagagggagaacccctggccccaggggaaagaggggggggtctcccgtttcctgtgcctgcaccagccctgcccccattgcgtctgcacacccctgcgtgtaactgcattccaaccactaataaagtgcctattgtacaggtc

SEQ ID NO: 428018 - DNA, 3332 bp, Homo sapiens
cggggcggggcgtgcagcccgcggagcctcccgcccgcccgggctggggtcgcgctggctcggactccgctccccgccccgccgcggccatggaggacgagcggaaaaacggagcctacggaacgccacagaagtatgatcccactttcaaaggacccatttacaataggggctgcacggatatcatatgctgtgtgttcctgctcctggccattgtgggctacgtggctgtaggcatcatagcctggactcatggagaccctcgaaaggtgatctaccccactgatagccggggcgagttctgcgggcagaagggcacaaaaaacgagaacaaaccctatctgttttatttcaacattgtgaaatgtgccagccccctggttctgctggaattccaatgtcccactccccagatctgcgtggaaaaatgccccgaccgctacctcacgtacctgaatgctcgcagctcccgggactttgagtactataagcagttctgtgttcctggcttcaagaacaataaaggagtggctgaggtgcttcgagatggtgactgccctgctgtcctcatccccagcaaacccttggcccggagatgcttccccgctatccacgcctacaagggtgtcctgatggtgggcaatgagacgacctatgaggatgggcatggctcccggaaaaacatcacagacctggtggagggcgccaagaaagccaatggagtcctagaggcgcggcaactcgccatgcgcatatttgaagattacaccgtctcttggtactggattatcataggcctggtcattgccatggcgatgagcctcctgttcatcatcctgcttcgcttcctggctggtattatggtctgggtgatgatcatcatggtgattctggtgctgggctacggaatatttcactgctacatggagtactcccgactgcgtggtgaggccggctctgatgtctctttggtggacctcggctttcagacggatttccgggtgtacctgcacttacggcagacctggttggcctttatgatcattctgagtatccttgaagtcattatcatcttgctgctcatctttctccggaagagaattctcatcgcgattgcactcatcaaagaagccagcagggctgtgggatacgtcatgtgctccttgctctacccactggtcaccttcttcttgctgtgcctctgcatcgcctactgggccagcactgctgtcttcctgtccacttccaacgaagcggtctataagatctttgatgacagcccctgcccatttactgcgaaaacctgcaacccagagaccttcccctcctccaatgagtcccgccaatgccccaatgcccgttgccagttcgccttctacggtggtgagtcgggctaccaccgggccctgctgggcctgcagatcttcaatgccttcatgttcttctggttggccaacttcgtgctggcgctgggccaggtcacgctggccggggcctttgcctcctactactgggccctgcgcaagccggacgacctgccggccttcccgctcttctctgcctttggccgggcgctcaggtaccacacaggctccctggcctttggcgcgctcatcctggccattgtgcagatcatccgtgtgatactcgagtacctggatcagcggctgaaagctgcagagaacaagtttgccaagtgcctcatgacctgtctcaaatgctgcttctggtgcctggagaagttcatcaaattccttaataggaatgcctacatcatgcttcttcctgctcatgagaaacatcatcagagtggctgtcctggataaagttactgacttcctcttcctgttgggcaaacttctgatcgttggtagtgtggggatcctggctttcttcttcttcacccaccgtatcaggatcgtgcaggatacagcaccacccctcaattattactgggttcctatactgacggtgatcgttggctcctacttgattgcacacggtttcttcagcgtctatggcatgtgtgtggacacgctgttcctctgcttcttggaggacctggagaggaatgacggctcggccgagaggccttacttcatgtcttccaccctcaagaaactcttgaacaagaccaacaagaaggcagcggagtcctgaaggccccgtgctccccacctctcaaggagtctcatgccgcagggtgctcagtagctgggtctgttcccccagccccttgggctcacctgaagtcctatcactgccgctctgcccctccccatgagccagatcccaccagtttctggacgtggagagtctggggcatctccttcttatgccaaggggcgcttggagttttcatggctgcccctccagactgcgagaaacaagtaaaaacccattggggcctcttgatgtctgggatggcacgtggcccgacctccacaagctccctcatgcttcctgtcccccgcttacacgacaacgggccagaccacgggaaggacggtgtttgtgtctgagggagctgctggccacagtgaacacccacgtttattcctgcctgctccggccaggactgaaccccttctccacacctgaacagttggctcaagggccaccagaagcatttctttattattattattttttaacctggacatgcattaaagggtctattagctttctttccgtctgtctcaacagctgagatggggccgccaaggagtgccttccttttgctccctcctagctgggagtgacgggtgggagtgtgtgtgcccaggtgggggtgtctcctggctgggaaggagggaaagggagggagagttttgcgggggttggcagtggagagcaggctggagaggagatggctaatagctgtttaatggaaacctgctgggctggagggagttaggctgaatttcccgacttcctctgccagttattgacacagctctctttgtaagagaggaaagaaactaaacccacccaagggatgatttcagggggagaggtggagggcagatgtcctgggcaaaccgggcccctctgcccacacacctcacttgatccttttgccaaacttgtcaaactcaggggaactggcttcccagttgcccctttgccatattccaagtccccctcagacttcatgtctctgctcatcagcactgtcccaggatcctggagagggagaacccctggccccaggggaaagaggggggggtctcccgtttcctgtgcctgcaccagccctgcccccattgcgtctgcacacccctgcgtgtaactgcattccaaccactaataaagtgcctattgtacaggtc

SEQ ID NO: 428019 - DNA, 2610 bp, Homo sapiens
ccttcatacttctgactacatacttccgcatggtgattctggtgctgggctacggaatatttcactgctacatggagtactcccgactgcgtggtgaggccggctctgatgtctctttggtggacctcggctttcagacggatttccgggtgtacctgcacttacggcagacctggttggcctttagtgagtcacagtctcccattcctgcccccacatgaggccttggagggagtggggagcccagccggctcagcctttgccctttgcagtgatcattctgagtatccttgaagtcattatcatcttgctgctcatctttctccggaagagaattctcatcgcgattgcactcatcaaagaagccagcagggctgtgggatacgtcatgtgctccttgctctacccactggtcaccttcttcttgctgtgcctctgcatcgcctactgggccagcactgctgtcttcctgtccacttccaacgaagcggtctataagatctttgatgacagcccctgcccatttactgcgaaaacctgcaacccagagaccttcccctcctccaatgagtcccgccaatgccccaatgcccgttgccagttcgccttctacggtggtgagtcgggctaccaccgggccctgctgggcctgcagatcttcaatgccttcatgttcttctggttggccaacttcgtgctggcgctgggccaggtcacgctggccggggcctttgcctcctactactgggccctgcgcaagccggacgacctgccggccttcccgctcttctctgcctttggccgggcgctcaggtaccacacaggctccctggcctttggcgcgctcatcctggccattgtgcagatcatccgtgtgatactcgagtacctggatcagcggctgaaagctgcagagaacaagtttgccaagtgcctcatgacctgtctcaaatgctgcttctggtgcctggagaagttcatcaaattccttaataggaatgcctacatcatgattgccatctacggcaccaatttctgcacctcggccaggaatgccttcttcctgctcatgagaaacatcatcagagtggctgtcctggataaagttactgacttcctcttcctgttgggcaaacttctgatcgttggtagtgtggggatcctggctttcttcttcttcacccaccgtatcaggatcgtgcaggatacagcaccacccctcaattattactgggttcctatactgacggtgatcgttggctcctacttgattgcacacggtttcttcagcgtctatggcatgtgtgtggacacgctgttcctctgcttcttggaggacctggagaggaatgacggctcggccgagaggccttacttcatgtcttccaccctcaagaaactcttgaacaagaccaacaagaaggcagcggagtcctgaaggccccgtgctccccacctctcaaggagtctcatgccgcagggtgctcagtagctgggtctgttcccccagccccttgggctcacctgaagtcctatcactgccgctctgcccctccccatgagccagatcccaccagtttctggacgtggagagtctggggcatctccttcttatgccaaggggcgcttggagttttcatggctgcccctccagactgcgagaaacaagtaaaaacccattggggcctcttgatgtctgggatggcacgtggcccgacctccacaagctccctcatgcttcctgtcccccgcttacacgacaacgggccagaccacgggaaggacggtgtttgtgtctgagggagctgctggccacagtgaacacccacgtttattcctgcctgctccggccaggactgaaccccttctccacacctgaacagttggctcaagggccaccagaagcatttctttattattattattttttaacctggacatgcattaaagggtctattagctttctttccgtctgtctcaacagctgagatggggccgccaaggagtgccttccttttgctccctcctagctgggagtgacgggtgggagtgtgtgtgcccaggtgggggtgtctcctggctgggaaggagggaaagggagggagagttttgcgggggttggcagtggagagcaggctggagaggagatggctaatagctgtttaatggaaacctgctgggctggagggagttaggctgaatttcccgacttcctctgccagttattgacacagctctctttgtaagagaggaaagaaactaaacccacccaagggatgatttcagggggagaggtggagggcagatgtcctgggcaaaccgggcccctctgcccacacacctcacttgatccttttgccaaacttgtcaaactcaggggaactggcttcccagttgcccctttgccatattccaagtccccctcagacttcatgtctctgctcatcagcactgtcccaggatcctggagagggagaacccctggccccaggggaaagaggggggggtctcccgtttcctgtgcctgcaccagccctgcccccattgcgtctgcacacccctgcgtgtaactgcattccaaccactaataaagtgcctattgtacaggtc

SEQ ID NO: 428020 - DNA, 1956 bp, Homo sapiens
agtcctgcgatggaggagcaaaccagagaacctactgggtggaattcttgctgttgaggggacaggcccaagaggcctggcccaccattggttattaccagagtgaattggagtggtatatatttgcgctgaagagagcaggaataagactggtttattagccgggcgccgtgactcacgcctgtaatcccagcactttgggaggctgaggcgagcggatcacctgagcgtggactcaggagacctggacattgctgcagagaacaagtttgccaagtgcctcatgacctgtctcaaatgctgcttctggtgcctggagaagttcatcaaattccttaataggaatgcctacatcatgattgccatctacggcaccaatttctgcacctcggccaggaatgccttcttcctgctcatgagaaacatcatcagagtggctgtcctggataaagttactgacttcctcttcctgttgggcaaacttctgatcgttggtagtgtggggatcctggctttcttcttcttcacccaccgtatcaggatcgtgcaggatacagcaccacccctcaattattactgggttcctatactgacggtgatcgttggctcctacttgattgcacacggtttcttcagcgtctatggcatgtgtgtggacacgctgttcctctgcttcttggaggacctggagaggaatgacggctcggccgagaggccttacttcatgtcttccaccctcaagaaactcttgaacaagaccaacaagaaggcagcggagtcctgaaggccccgtgctccccacctctcaaggagtctcatgccgcagggtgctcagtagctgggtctgttcccccagccccttgggctcacctgaagtcctatcactgccgctctgcccctccccatgagccagatcccaccagtttctggacgtggagagtctggggcatctccttcttatgccaaggggcgcttggagttttcatggctgcccctccagactgcgagaaacaagtaaaaacccattggggcctcttgatgtctgggatggcacgtggcccgacctccacaagctccctcatgcttcctgtcccccgcttacacgacaacgggccagaccacgggaaggacggtgtttgtgtctgagggagctgctggccacagtgaacacccacgtttattcctgcctgctccggccaggactgaaccccttctccacacctgaacagttggctcaagggccaccagaagcatttctttattattattattttttaacctggacatgcattaaagggtctattagctttctttccgtctgtctcaacagctgagatggggccgccaaggagtgccttccttttgctccctcctagctgggagtgacgggtgggagtgtgtgtgcccaggtgggggtgtctcctggctgggaaggagggaaagggagggagagttttgcgggggttggcagtggagagcaggctggagaggagatggctaatagctgtttaatggaaacctgctgggctggagggagttaggctgaatttcccgacttcctctgccagttattgacacagctctctttgtaagagaggaaagaaactaaacccacccaagggatgatttcagggggagaggtggagggcagatgtcctgggcaaaccgggcccctctgcccacacacctcacttgatccttttgccaaacttgtcaaactcaggggaactggcttcccagttgcccctttgccatattccaagtccccctcagacttcatgtctctgctcatcagcactgtcccaggatcctggagagggagaacccctggccccaggggaaagaggggggggtctcccgtttcctgtgcctgcaccagccctgcccccattgcgtctgcacacccctgcgtgtaactgcattccaaccactaataaagtgcctattgtacaggtc

SEQ ID NO: 428021 - DNA, 1615 bp, Homo sapiens
ctcccactctcctccagattgccatctacggcaccaatttctgcacctcggccaggaatgccttcttcctgctcatgagaaacatcatcagagtggctgtcctggataaagttactgacttcctcttcctgttgggcaaacttctgatcgttggtagtgtggggatcctggctttcttcttcttcacccaccgtatcaggatcgtgcaggatacagcaccacccctcaattattactgggttcctatactgacggtgatcgttggctcctacttgattgcacacggtttcttcagcgtctatggcatgtgtgtggacacgctgttcctctgcttcttggaggacctggagaggaatgacggctcggccgagaggccttacttcatgtcttccaccctcaagaaactcttgaacaagaccaacaagaaggcagcggagtcctgaaggccccgtgctccccacctctcaaggagtctcatgccgcagggtgctcagtagctgggtctgttcccccagccccttgggctcacctgaagtcctatcactgccgctctgcccctccccatgagccagatcccaccagtttctggacgtggagagtctggggcatctccttcttatgccaaggggcgcttggagttttcatggctgcccctccagactgcgagaaacaagtaaaaacccattggggcctcttgatgtctgggatggcacgtggcccgacctccacaagctccctcatgcttcctgtcccccgcttacacgacaacgggccagaccacgggaaggacggtgtttgtgtctgagggagctgctggccacagtgaacacccacgtttattcctgcctgctccggccaggactgaaccccttctccacacctgaacagttggctcaagggccaccagaagcatttctttattattattattttttaacctggacatgcattaaagggtctattagctttctttccgtctgtctcaacagctgagatggggccgccaaggagtgccttccttttgctccctcctagctgggagtgacgggtgggagtgtgtgtgcccaggtgggggtgtctcctggctgggaaggagggaaagggagggagagttttgcgggggttggcagtggagagcaggctggagaggagatggctaatagctgtttaatggaaacctgctgggctggagggagttaggctgaatttcccgacttcctctgccagttattgacacagctctctttgtaagagaggaaagaaactaaacccacccaagggatgatttcagggggagaggtggagggcagatgtcctgggcaaaccgggcccctctgcccacacacctcacttgatccttttgccaaacttgtcaaactcaggggaactggcttcccagttgcccctttgccatattccaagtccccctcagacttcatgtctctgctcatcagcactgtcccaggatcctggagagggagaacccctggccccaggggaaagaggggggggtctcccgtttcctgtgcctgcaccagccctgcccccattgcgtctgcacacccctgcgtgtaactgcattccaaccactaataaagtgcctattgtacaggtc

SEQ ID NO: 428022 - DNA, 1552 bp, Homo sapiens
tcacacctgcccctcgtgtcctcatcagagtggctgtcctggataaagttactgacttcctcttcctgttgggcaaacttctgatcgttggtagtgtggggatcctggctttcttcttcttcacccaccgtatcaggatcgtgcaggatacagcaccacccctcaattattactgggttcctatactgacggtgatcgttggctcctacttgattgcacacggtttcttcagcgtctatggcatgtgtgtggacacgctgttcctctgcttcttggaggacctggagaggaatgacggctcggccgagaggccttacttcatgtcttccaccctcaagaaactcttgaacaagaccaacaagaaggcagcggagtcctgaaggccccgtgctccccacctctcaaggagtctcatgccgcagggtgctcagtagctgggtctgttcccccagccccttgggctcacctgaagtcctatcactgccgctctgcccctccccatgagccagatcccaccagtttctggacgtggagagtctggggcatctccttcttatgccaaggggcgcttggagttttcatggctgcccctccagactgcgagaaacaagtaaaaacccattggggcctcttgatgtctgggatggcacgtggcccgacctccacaagctccctcatgcttcctgtcccccgcttacacgacaacgggccagaccacgggaaggacggtgtttgtgtctgagggagctgctggccacagtgaacacccacgtttattcctgcctgctccggccaggactgaaccccttctccacacctgaacagttggctcaagggccaccagaagcatttctttattattattattttttaacctggacatgcattaaagggtctattagctttctttccgtctgtctcaacagctgagatggggccgccaaggagtgccttccttttgctccctcctagctgggagtgacgggtgggagtgtgtgtgcccaggtgggggtgtctcctggctgggaaggagggaaagggagggagagttttgcgggggttggcagtggagagcaggctggagaggagatggctaatagctgtttaatggaaacctgctgggctggagggagttaggctgaatttcccgacttcctctgccagttattgacacagctctctttgtaagagaggaaagaaactaaacccacccaagggatgatttcagggggagaggtggagggcagatgtcctgggcaaaccgggcccctctgcccacacacctcacttgatccttttgccaaacttgtcaaactcaggggaactggcttcccagttgcccctttgccatattccaagtccccctcagacttcatgtctctgctcatcagcactgtcccaggatcctggagagggagaacccctggccccaggggaaagaggggggggtctcccgtttcctgtgcctgcaccagccctgcccccattgcgtctgcacacccctgcgtgtaactgcattccaaccactaataaagtgcctattgtacaggtc

SEQ ID NO: 428023 - DNA, 1419 bp, Homo sapiens
tcggatagtcctgaatcttggccatacctttatcctgacttgtaaacctatgctgacggtgatcgttggctcctacttgattgcacacggtttcttcagcgtctatggcatgtgtgtggacacgctgttcctctgcttcttggaggacctggagaggaatgacggctcggccgagaggccttacttcatgtcttccaccctcaagaaactcttgaacaagaccaacaagaaggcagcggagtcctgaaggccccgtgctccccacctctcaaggagtctcatgccgcagggtgctcagtagctgggtctgttcccccagccccttgggctcacctgaagtcctatcactgccgctctgcccctccccatgagccagatcccaccagtttctggacgtggagagtctggggcatctccttcttatgccaaggggcgcttggagttttcatggctgcccctccagactgcgagaaacaagtaaaaacccattggggcctcttgatgtctgggatggcacgtggcccgacctccacaagctccctcatgcttcctgtcccccgcttacacgacaacgggccagaccacgggaaggacggtgtttgtgtctgagggagctgctggccacagtgaacacccacgtttattcctgcctgctccggccaggactgaaccccttctccacacctgaacagttggctcaagggccaccagaagcatttctttattattattattttttaacctggacatgcattaaagggtctattagctttctttccgtctgtctcaacagctgagatggggccgccaaggagtgccttccttttgctccctcctagctgggagtgacgggtgggagtgtgtgtgcccaggtgggggtgtctcctggctgggaaggagggaaagggagggagagttttgcgggggttggcagtggagagcaggctggagaggagatggctaatagctgtttaatggaaacctgctgggctggagggagttaggctgaatttcccgacttcctctgccagttattgacacagctctctttgtaagagaggaaagaaactaaacccacccaagggatgatttcagggggagaggtggagggcagatgtcctgggcaaaccgggcccctctgcccacacacctcacttgatccttttgccaaacttgtcaaactcaggggaactggcttcccagttgcccctttgccatattccaagtccccctcagacttcatgtctctgctcatcagcactgtcccaggatcctggagagggagaacccctggccccaggggaaagaggggggggtctcccgtttcctgtgcctgcaccagccctgcccccattgcgtctgcacacccctgcgtgtaactgcattccaaccactaataaagtgcctattgtacaggtc

SEQ ID NO: 428024 - DNA, 1395 bp, Homo sapiens
gagcagggacagctcgtttctccttgcccagacggtgatcgttggctcctacttgattgcacacggtttcttcagcgtctatggcatgtgtgtggacacgctgttcctctgcttcttggaggacctggagaggaatgacggctcggccgagaggccttacttcatgtcttccaccctcaagaaactcttgaacaagaccaacaagaaggcagcggagtcctgaaggccccgtgctccccacctctcaaggagtctcatgccgcagggtgctcagtagctgggtctgttcccccagccccttgggctcacctgaagtcctatcactgccgctctgcccctccccatgagccagatcccaccagtttctggacgtggagagtctggggcatctccttcttatgccaaggggcgcttggagttttcatggctgcccctccagactgcgagaaacaagtaaaaacccattggggcctcttgatgtctgggatggcacgtggcccgacctccacaagctccctcatgcttcctgtcccccgcttacacgacaacgggccagaccacgggaaggacggtgtttgtgtctgagggagctgctggccacagtgaacacccacgtttattcctgcctgctccggccaggactgaaccccttctccacacctgaacagttggctcaagggccaccagaagcatttctttattattattattttttaacctggacatgcattaaagggtctattagctttctttccgtctgtctcaacagctgagatggggccgccaaggagtgccttccttttgctccctcctagctgggagtgacgggtgggagtgtgtgtgcccaggtgggggtgtctcctggctgggaaggagggaaagggagggagagttttgcgggggttggcagtggagagcaggctggagaggagatggctaatagctgtttaatggaaacctgctgggctggagggagttaggctgaatttcccgacttcctctgccagttattgacacagctctctttgtaagagaggaaagaaactaaacccacccaagggatgatttcagggggagaggtggagggcagatgtcctgggcaaaccgggcccctctgcccacacacctcacttgatccttttgccaaacttgtcaaactcaggggaactggcttcccagttgcccctttgccatattccaagtccccctcagacttcatgtctctgctcatcagcactgtcccaggatcctggagagggagaacccctggccccaggggaaagaggggggggtctcccgtttcctgtgcctgcaccagccctgcccccattgcgtctgcacacccctgcgtgtaactgcattccaaccactaataaagtgcctattgtacaggtc

SEQ ID NO: 428025 - DNA, 2854 bp, Homo sapiens
cggggcggggcgtgcagcccgcggagcctcccgcccgcccgggctggggtcgcgctggctcggactccgctccccgccccgccgcggccatggaggacgagcggaaaaacggagcctacggaacgccacagaagtatgatcccactttcaaaggacccatttacaataggggctgcacggatatcatatgctgtgtgttcctgctcctggccattgtgggctacgtggctgtaggcatcatagcctggactcatggagaccctcgaaaggtgatctaccccactgatagccggggcgagttctgcgggcagaagggcacaaaaaacgagaacaaaccctatctgttttatttcaacattgtgaaatgtgccagccccctggttctgctggaattccaatgtcccactccccagatctgcgtggaaaaatgccccgaccgctacctcacgtacctgaatgctcgcagctcccgggactttgagtactataagcagttctgtgttcctggcttcaagaacaataaaggagtggctgaggtgcttcgagatggtgactgccctgctgtcctcatccccagcaaacccttggcccggagatgcttccccgctatccacgcctacaagggtgtcctgatggtgggcaatgagacgacctatgaggatgggcatggctcccggaaaaacatcacagacctggtggagggcgccaagaaagccaatggagtcctagaggcgcggcaactcgccatgcgcatatttgaagattacaccgtctcttggtactggattatcataggcctggtcattgccatggcgatgagcctcctgttcatcatcctgcttcgcttcctggctggtattatggtctgggtgatgatcatcatggtgattctggtgctgggctacggaatatttcactgctacatggagtactcccgactgcgtggtgaggccggctctgatgtctctttggtggacctcggctttcagacggatttccgggtgtacctgcacttacggcagacctggttggcctttatgatcattctgagtatccttgaagtcattatcatcttgctgctcatctttctccggaagagaattctcatcgcgattgcactcatcaaagaagccagcagggctgtgggatacgtcatgtgctccttgctctacccactggtcaccttcttcttgctgtgcctctgcatcgcctactgggccagcactgctgtcttcctgtccacttccaacgaagcggtctataagatctttgatgacagcccctgcccatttactgcgaaaacctgcaacccagagaccttcccctcctccaatgagtcccgccaatgccccaatgcccgttgccagttcgccttctacggtggtgagtcgggctaccaccgggccctgctgggcctgcagatcttcaatgccttcatgttcttctggttggccaacttcgtgctggcgctgggccaggtcacgctggccggggcctttgcctcctactactgggccctgcgcaagccggacgacctgccggccttcccgctcttctctgcctttggccgggcgctcaggtaccacacaggctccctggcctttggcgcgctcatcctggccattgtgcagatcatccgtgtgatactcgagtacctggatcagcggctgaaagctgcagagaacaagtttgccaagtgcctcatgacctgtctcaaatgctgcttctggtgcctggagaagttcatcaaattccttaataggaatgcctacatcatgattgccatctacggcaccaatttctgcacctcggccaggaatgccttcttcctgctcatgagaaacatcatcagagtggctgtcctggataaagttactgacttcctcttcctgttgggcaaacttctgatcgttggtagtgtggggatcctggctttcttcttcttcacccaccgtatcaggatcgtgcaggatacagcaccacccctcaattattactgggttcctatactgacggtgatcgttggctcctacttgattgcacacggtttcttcagcgtctatggcatgtgtgtggacacgctgttcctctgcttctgtgaggacctggaaaggaatgacggctctcaggagcgaccctacttcatgtcgcccgagctgagagacatcctgttgaaggggagtgcggaggaggggaagcgggcagaagccgaggagtagagatggaggacctggagaggaatgacggctcggccgagaggccttacttcatgtcttccaccctcaagaaactcttgaacaagaccaacaagaaggcagcggagtcctgaaggccccgtgctccccacctctcaaggagtctcatgccgcagggtgctcagtagctgggtctgttcccccagccccttgggctcacctgaagtcctatcactgccgctctgcccctccccatgagccagatcccaccagtttctggacgtggagagtctggggcatctccttcttatgccaaggggcgcttggagttttcatggctgcccctccagactgcgagaaacaagtaaaaacccattggggcctcttgatgtctgggatggcacgtggcccgacctccacaagctccctcatgcttcctgtcccccgcttacacgacaacgggccagaccacgggaaggacggtgtttgtgtctgagggagctgctggccacagtgaacacccacgtttattcctgcctgctccggccaggactgaaccccttctccacacctgaacagttggctcaagggccaccagaagcatttctttattattattattttttaacctggacatgcattaaagggtctattagctt

SEQ ID NO: 428026 - DNA, 2494 bp, Homo sapiens
cggggcggggcgtgcagcccgcggagcctcccgcccgcccgggctggggtcgcgctggctcggactccgctccccgccccgccgcggccatggaggacgagcggaaaaacggagcctacggaacgccacagaagtatgatcccactttcaaaggacccatttacaataggggctgcacggatatcatatgctgtgtgttcctgctcctggccattgtgggctacgtggctgtaggcatcatagcctggactcatggagaccctcgaaaggtgatctaccccactgatagccggggcgagttctgcgggcagaagggcacaaaaaacgagaacaaaccctatctgttttatttcaacattgtgaaatgtgccagccccctggttctgctggaattccaatgtcccactccccagatctgcgtggaaaaatgccccgaccgctacctcacgtacctgaatgctcgcagctcccgggactttgagtactataagcagttctgtgttcctggcttcaagaacaataaaggagtggctgaggtgcttcgagatggtgactgccctgctgtcctcatccccagcaaacccttggcccggagatgcttccccgctatccacgcctacaagggtgtcctgatggtgggcaatgagacgacctatgaggatgggcatggctcccggaaaaacatcacagacctggtggagggcgccaagaaagccaatggagtcctagaggcgcggcaactcgccatgcgcatatttgaagattacaccgtctcttggtactggattatcataggcctggtcattgccatggcgatgagcctcctgttcatcatcctgcttcgcttcctggctggtattatggtctgggtgatgatcatcatggtgattctggtgctgggctacggaatatttcactgctacatggagtactcccgactgcgtggtgaggccggctctgatgtctctttggtggacctcggctttcagacggatttccgggtgtacctgcacttacggcagacctggttggcctttatgatcattctgagtatccttgaagtcattatcatcttgctgctcatctttctccggaagagaattctcatcgcgattgcactcatcaaagaagccagcagggctgtgggatacgtcatgtgctccttgctctacccactggtcaccttcttcttgctgtgcctctgcatcgcctactgggccagcactgctgtcttcctgtccacttccaacgaagcggtctataagatctttgatgacagcccctgcccatttactgcgaaaacctgcaacccagagaccttcccctcctccaatgagtcccgccaatgccccaatgcccgttgccagttcgccttctacggtggtgagtcgggctaccaccgggccctgctgggcctgcagatcttcaatgccttcatgttcttctggttggccaacttcgtgctggcgctgggccaggtcacgctggccggggcctttgcctcctactactgggccctgcgcaagccggacgacctgccggccttcccgctcttctctgcctttggccgggcgctcaggtaccacacaggctccctggcctttggcgcgctcatcctggccattgtgcagatcatccgtgtgatactcgagtacctggatcagcggctgaaagctgcagagaacaagtttgccaagtgcctcatgacctgtctcaaatgctgcttctggtgcctggagaagttcatcaaattccttaataggaatgcctacatcatgattgccatctacggcaccaatttctgcacctcggccaggaatgccttcttcctgctcatgagaaacatcatcagagtggctgtcctggataaagttactgacttcctcttcctgttgggcaaacttctgatcgttggtagtgtggggatcctggctttcttcttcttcacccaccgtatcaggatcgtgcaggatacagcaccacccctcaattattactgggttcctatactggtatggacctctggggagagatgggggtttgggaagaaagaggtgttgggatttgcttggtcttctttgactagataaatgtggatagaggtcagaggtggggaattgattatttattcagaccaccaactttttgtttgtttttgaatccagagtcttgccctgtcgccctgactggagtgccgtggtgccatcttgactcactgccacctctgccttccgggttccagcgaattctcgagctcttgcctcccgagtagttgggattacaggtgcctgcccccacacctgcctaatttttgtatatttatttttttaattttaatttaattttttttttgagacagactcactctgttgcccaggttggagtgcagtgaaatgatcttggcttactgaaaccttcacctctctagttcagcgattcttgtgcctcgccccctgtgtagctgggatactgccgggcacctgccaccacacct

SEQ ID NO: 428027 - DNA, 1610 bp, Homo sapiens
cggggcggggcgtgcagcccgcggagcctcccgcccgcccgggctggggtcgcgctggctcggactccgctccccgccccgccgcggccatggaggacgagcggaaaaacggagcctacggaacgccacagaagtatgatcccactttcaaaggacccatttacaataggggctgcacggatatcatatgctgtgtgttcctgctcctggccattgtgggctacgtggctgtaggcatcatagcctggactcatggagaccctcgaaaggtgatctaccccactgatagccggggcgagttctgcgggcagaagggcacaaaaaacgagaacaaaccctatctgttttatttcaacattgtgaaatgtgccagccccctggttctgctggaattccaatgtcccactccccagatctgcgtggaaaaatgccccgaccgctacctcacgtacctgaatgctcgcagctcccgggactttgagtactataagcagttctgtgttcctggcttcaagaacaataaaggagtggctgaggtgcttcgagatggtgactgccctgctgtcctcatccccagcaaacccttggcccggagatgcttccccgctatccacgcctacaagggtgtcctgatggtgggcaatgagacgacctatgaggatgggcatggctcccggaaaaacatcacagacctggtggagggcgccaagaaagccaatggagtcctagaggcgcggcaactcgccatgcgcatatttgaagattacaccgtctcttggtactggattatcataggcctggtcattgccatggcgatgagcctcctgttcatcatcctgcttcgcttcctggctggtattatggtctgggtgatgatcatcatggtgattctggtgctgggctacggaatatttcactgctacatggagtactcccgactgcgtggtgaggccggctctgatgtctctttggtggacctcggctttcagacggatttccgggtgtacctgcacttacggcagacctggttggcctttatgatcattctgagtatccttgaagtcattatcatcttgctgctcatctttctccggaagagaattctcatcgcgattgcactcatcaaagaagccagcagggctgtgggatacgtcatgtgctccttgctctacccactggtcaccttcttcttgctgtgcctctgcatcgcctactgggccagcactgctgtcttcctgtccacttccaacgaagcggtctataagatctttgatgacagcccctgcccatttactgcgaaaacctgcaacccagagaccttcccctcctccaatgagtcccgccaatgccccaatgcccgttgccagttcgccttctacggtggtgagtcgggctaccaccgggccctgctgggcctgcagatcttcaatgccttcatgttcttctggttggccaacttcgtgctggcgctgggccaggtcacgctggccggggcctttgcctcctactactgggccctgcgcaagccggacgacctgccggccttcccgctcttctctgcctttggccgggcgctcaggtaccacaccacgacgacgaattccggcacg

SEQ ID NO: 428028 - DNA, 1532 bp, Homo sapiens
cggggcggggcgtgcagcccgcggagcctcccgcccgcccgggctggggtcgcgctggctcggactccgctccccgccccgccgcggccatggaggacgagcggaaaaacggagcctacggaacgccacagaagtatgatcccactttcaaaggacccatttacaataggggctgcacggatatcatatgctgtgtgttcctgctcctggccattgtgggctacgtggctgtaggcatcatagcctggactcatggagaccctcgaaaggtgatctaccccactgatagccggggcgagttctgcgggcagaagggcacaaaaaacgagaacaaaccctatctgttttatttcaacattgtgaaatgtgccagccccctggttctgctggaattccaatgtcccactccccagatctgcgtggaaaaatgccccgaccgctacctcacgtacctgaatgctcgcagctcccgggactttgagtactataagcagttctgtgttcctggcttcaagaacaataaaggagtggctgaggtgcttcgagatggtgactgccctgctgtcctcatccccagcaaacccttggcccggagatgcttccccgctatccacgcctacaagggtgtcctgatggtgggcaatgagacgacctatgaggatgggcatggctcccggaaaaacatcacagacctggtggagggcgccaagaaagccaatggagtcctagaggcgcggcaactcgccatgcgcatatttgaagattacaccgtctcttggtactggattatcataggcctggtcattgccatggcgatgagcctcctgttcatcatcctgcttcgcttcctggctggtattatggtctgggtgatgatcatcatggtgattctggtgctgggctacggaatatttcactgctacatggagtactcccgactgcgtggtgaggccggctctgatgtctctttggtggacctcggctttcagacggatttccgggtgtacctgcacttacggcagacctggttggcctttatgatcattctgagtatccttgaagtcattatcatcttgctgctcatctttctccggaagagaattctcatcgcgattgcactcatcaaagaagccagcagggctgtgggatacgtcatgtgctccttgctctacccactggtcaccttcttcttgctgtgcctctgcatcgcctactgggccagcactgctgtgtatctgcccccagacactgatctctgaccccagggatggctaaagaccaactttgcctagaagtgacctgcagcttagggatagggctggaaactggtgggagaatggattctttcccacaaaagtccctggggtcctcagtcctagacctctgcttccttaacgaacctccagcttcctgtccacttccaacgaagcggtctataagatctttgatgacagcccctgcccatttactgcgaaaacctgcaacccagaggtgggcgtccccggggtggggagggcaggtattgccccagc

SEQ ID NO: 428029 - DNA, 1837 bp, Homo sapiens
cgtatttcttcttaaaacagaataaataaatagtctgtctctttctccttctgttcacatttgccccagtttcttctcttgaatcatgacagtttggaaaattgtctggattgcttagtgccactgaatcatgccatggaaggattttgtatttcacttttaaacttctctgtgacaggagaagcactgcttcatggcttcttgcccaaggattttagatggacacagtgggtaataaatggatgaatttttgtttgggttgaagaatctctctgagaagttgacacgtgggggcaatggtttgtttctcttgtatttctgaagttgcaaataatcatgtaagcagttcaaccaggagtttacaccaaacttttaataggcgatatatcattattttttttcccattggtttggataacatccactttaactggcagttagtcatacttagctatttttgttaaagcaggtgatttattgttattttatatttatgacatgattaataagtgaatatggaagattttacattgacttaggggatcaaagttttcattatattaacacctttaattgccatgagttttctatttctagcatgcatattttgtgttcattcaagtgaagaaaacagtcttttgtgttctcaggtactgcataagccgaccacagtataagacttcttgtggcatctcttcattaatttcttgttggaatttcttatacagcacaatgggagctggaaaccttccacctattacccaagaagaagctttacatattctgggctttcaacctccatttgaagatattaggtttggtcctttcacggggaatacaacacttatgaggtggtttagacaaattaatgaccacttccatgtaaaaggatgctcttatgttctatataagcctcatgggaagaataaaacagcaggagaaactgcttcaggggccctgtcaaagttaacccgtggattgaaagatgaatcgctggcttatatctatcattgccaaaatcattatttttgtccaattggcttcgaagcaacccctgttaaagctaataaagcattcagcaggggacctctctcaccacaggaagttgaatattggatcttaattggagaatcaagtagaaaacatcctgccattcactgtaaaaaatgggcagatattgttactgatctaaacactcaaaatccagaatacctggatatccggcacttagagaggggactgcagtatagaaaaacaaagaaggttgggggaaatttgcattgcatcatagcattccagagacttaactggcaaagatttggcctttggaactttccatttggaaccattagacaagaatcacaacctccaacacatgcccagggaattgccaaatctgagagtgaagacaatatttccaagaagcagcatgggcgtctgggccggtctttcagtgctagtttccatcaggactcggcatggaaaaagatgtctagtatccatgagagaaggaacagtggttaccagggttacagtgattacgatgggaatgattgactatgcttgctactgaacagctggcattatatatgaaactgctatatacaggactgtataaagacagtagaagattttagtaagcctacattaaataggagcagatcttgtggtataaaaaataaccttgtagttctccagatactaagcttgtatatgattatggtgggtgatttcagatatataagcagataagcacagattattgtcctttcaagttaagagtatataatctggacagaaaatttcacaaaattcaataaaattacaactgttgtct

SEQ ID NO: 428030 - DNA, 3705 bp, Homo sapiens
ctgccaggattttaccacctctcgcccatttatttacttctcggtcaccgctttcgggggacagataaacaccacagatgcccatcaaaggggcgcacgggtctggaggcgcagctcaggtttttgcgttggtcaccctgccctccgcacgtggagagggcaggcataaagcaccttgaaaggaaggtgctgtcaatgctatccgacgacctgtcgccgggcaccgcagcatcctcgctcgctccgatgggacgagggacgccggccccagggtaacaggaggcgcctcgccggccgcgcgctggatgctgtgatccaggaatcagtttagacttgaaattcagtttttcctgaaactgatcagaagttagtgacaccttgattggatccgtttttctgtcaggagctcattttgcagctctcaagcttttatagcatgctgtaaacaattgtcaaagttgtttatcaagaaacagatagagttgcaacttgtttctagtaatagaaacttttacactgcattcaatgcctaacgttgcagaaacagaaaggtcaaatgattctggaaatggtgagcacaaatctgagagaaagtcacctgaagagaatctacaaggtgctgtaaaatctttctgcacaagtgcctcaggagcacccttgggtcccaaaggagatggtcattatccatggagttgtccagtgactcatacacgggaaaaaatttatgccatctgttcggactatgcctttctcaaccaggcgacctcaatctataaaactccaaatccatcccgctctccttgcctccctgatagtacctctttatctgctggaaataattcatcaagatacattggtatcccgactagtacatcggaaattatctacaatgaagaaaatagcttggaaaacttatccaacagcctgggcaagctacctctcgcatgggaaattgataaatctgaatttgatggggtgaccacaaattcgaaacacaaatcaggcaatgcaaagaaacaagtttccaagagaaaaacttcagataaaaagggaagatatcagaaggaatgtcctcagcattctcctcttgaagatattaaacagcggaaagtattagacctcagacgatggtactgcataagccgaccacagtataagacttcttgtggcatctcttcattaatttcttgttggaatttcttatacagcacaatgggagctggaaaccttccacctattacccaagaagaagctttacatattctgggctttcaacctccatttgaagatattaggtttggtcctttcacggggaatacaacacttatgaggtggtttagacaaattaatgaccacttccatgtaaaaggatgctcttatgttctatataagcctcatgggaagaataaaacagcaggagaaactgcttcaggggccctgtcaaagttaacccgtggattgaaagatgaatcgctggcttatatctatcattgccaaaatcattatttttgtccaattggcttcgaagcaacccctgttaaagctaataaagcattcagcaggggacctctctcaccacaggaagttgaatattggatcttaattggagaatcaagtagaaaacatcctgccattcactgtaaaaaatgggcagatattgttactgatctaaacactcaaaatccagaatacctggatatccggcacttagagaggggactgcagtatagaaaaacaaagaaggttgggggaaatttgcattgcatcatagcattccagagacttaactggcaaagatttggcctttggaactttccatttggaaccattagacaagaatcacaacctccaacacatgcccagggaattgccaaatctgagagtgaagacaatatttccaagaagcagcatgggcgtctgggccggtctttcagtgctagtttccatcaggactcggcatggaaaaagatgtctagtatccatgagagaaggaacagtggttaccagggttacagtgattacgatgggaatgattgactatgcttgctactgaacagctggcattatatatgaaactgctatatacaggactgtataaagacagtagaagattttagtaagcctacattaaataggagcagatcttgtggtataaaaaataaccttgtagttctccagatactaagcttgtatatgattatggtgggtgatttcagatatataagcagataagcacagattattgtcctttcaagttaagagtatataatctggacagaaaatttcacaaaattcaataaaattacaactgttgtctaaataagtgaaacacaaattcacttaatagcatcaagatttgaaatacttaagcatgaagtgacttttataatgactcgatccctagacatttgttacagatagttttatgcctaagaccaagatgtaaagtaccatctgcccttaaaaaaaaattggggctgtcaatttctagttttcactcatggttaacacgcatttaaaattatttcatgagtctagtagttctttgatttatagcaggatcttgcttgcctcatttgtttcctggttatgttcttaggattctgactaagaggcaaaagagaaaagactcaagaaactgatcctggagatcgagaccatcctggctaacatggtgaaaccccgtctctactaaacatacaaaaaattagccgggtgtagtggtgggcacctgtagtcctagctactcgagaggctgaggcaggagaatggcgtgaacccgggaggtggagcttgcagtgagcggagatcgcgccactgcactccagcctgggcgacagggcaagactctgtctcaaaaaaaaaaaaaaaaaaaagacggatccttttttttggtgcaaatgggtgacttagtgcattgattcagatttttaaaatttcttgatgtggtttgtaataatcaaatattgacaagaaccttaggtctcgaaagacttttataggtctagatgacgtttgccttaggggtaaagtaaaagaacaattggcaccttaagtttctatacccaaggttatctgtgaaatgagatctcctgatatttgattgctttctcagtatggagtcatatgttgataacagtactgaagatgcataagaaatgcccaagtcactcagaggacaactacccatattccagactctgagctgtttcctttttaaaaatcatatagacaattagctgtttgaagtgagtattaaatatttcagaagtgtgaatttcatgtatttgagctcctctagttgctgtcggtttttcttctgctgccaacctgtgactcacaaatgactaggatctcttgttctttaattttagggtcttgttccaggactcaaatcagtaacttggtgattacaaggtgctgaatgtgttggtaaccatatcgcaatacacctcaaggaaaaggttcagatttttatttttaaaatattttcatttttttcttgaattttatatccgtttgttcactcgtacatgcctagcctacagaaggggatatatattatgaaatggtcatttttctgaagagaatattttgcttgaaatgcaaaggactgaaagagatttgtaggttgttgattttgttacttcatactggaacttttaaaaagatttcatcaaataaagttttgttttctacttttaa

SEQ ID NO: 428031 - DNA, 3578 bp, Homo sapiens
atccacccgcctcagcctcccaaagtgctgggattacaggtgtgagccaccacgccggcttagtaaatcttaatatagcaacacctcacttgcctggaagagggaaccgcaatcaatcaaaatgagggcctacagtaatgcctggcatgatgcaaacacttaaaaattatctgttgaatgagacgtctacaaatcctaggccctggggatacaataatctggaaaaccagacttgcaggatgcagacgttgatcatatgaacagatatgcacagaagagctcattttgcagctctcaagcttttatagcatgctgtaaacaattgtcaaagttgtttatcaagaaacagatagagttgcaacttgtttctagtaatagaaacttttacactgcattcaatgcctaacgttgcagaaacagaaaggtcaaatgattctggaaatggtgagcacaaatctgagagaaagtcacctgaagagaatctacaaggtgctgtaaaatctttctgcacaagtgcctcaggagcacccttgggtcccaaaggagatggtcattatccatggagttgtccagtgactcatacacgggaaaaaatttatgccatctgttcggactatgcctttctcaaccaggcgacctcaatctataaaactccaaatccatcccgctctccttgcctccctgatagtacctctttatctgctggaaataattcatcaagatacattggtatcccgactagtacatcggaaattatctacaatgaagaaaatagcttggaaaacttatccaacagcctgggcaagctacctctcgcatgggaaattgataaatctgaatttgatggggtgaccacaaattcgaaacacaaatcaggcaatgcaaagaaacaagtttccaagagaaaaacttcagataaaaagggaagatatcagaaggaatgtcctcagcattctcctcttgaagatattaaacagcggaaagtattagacctcagacgatggtactgcataagccgaccacagtataagacttcttgtggcatctcttcattaatttcttgttggaatttcttatacagcacaatgggagctggaaaccttccacctattacccaagaagaagctttacatattctgggctttcaacctccatttgaagatattaggtttggtcctttcacggggaatacaacacttatgaggtggtttagacaaattaatgaccacttccatgtaaaaggatgctcttatgttctatataagcctcatgggaagaataaaacagcaggagaaactgcttcaggggccctgtcaaagttaacccgtggattgaaagatgaatcgctggcttatatctatcattgccaaaatcattatttttgtccaattggcttcgaagcaacccctgttaaagctaataaagcattcagcaggggacctctctcaccacaggaagttgaatattggatcttaattggagaatcaagtagaaaacatcctgccattcactgtaaaaaatgggcagatattgttactgatctaaacactcaaaatccagaatacctggatatccggcacttagagaggggactgcagtatagaaaaacaaagaaggttgggggaaatttgcattgcatcatagcattccagagacttaactggcaaagatttggcctttggaactttccatttggaaccattagacaagaatcacaacctccaacacatgcccagggaattgccaaatctgagagtgaagacaatatttccaagaagcagcatgggcgtctgggccggtctttcagtgctagtttccatcaggactcggcatggaaaaagatgtctagtatccatgagagaaggaacagtggttaccagggttacagtgattacgatgggaatgattgactatgcttgctactgaacagctggcattatatatgaaactgctatatacaggactgtataaagacagtagaagattttagtaagcctacattaaataggagcagatcttgtggtataaaaaataaccttgtagttctccagatactaagcttgtatatgattatggtgggtgatttcagatatataagcagataagcacagattattgtcctttcaagttaagagtatataatctggacagaaaatttcacaaaattcaataaaattacaactgttgtctaaataagtgaaacacaaattcacttaatagcatcaagatttgaaatacttaagcatgaagtgacttttataatgactcgatccctagacatttgttacagatagttttatgcctaagaccaagatgtaaagtaccatctgcccttaaaaaaaaattggggctgtcaatttctagttttcactcatggttaacacgcatttaaaattatttcatgagtctagtagttctttgatttatagcaggatcttgcttgcctcatttgtttcctggttatgttcttaggattctgactaagaggcaaaagagaaaagactcaagaaactgatcctggagatcgagaccatcctggctaacatggtgaaaccccgtctctactaaacatacaaaaaattagccgggtgtagtggtgggcacctgtagtcctagctactcgagaggctgaggcaggagaatggcgtgaacccgggaggtggagcttgcagtgagcggagatcgcgccactgcactccagcctgggcgacagggcaagactctgtctcaaaaaaaaaaaaaaaaaaaagacggatccttttttttggtgcaaatgggtgacttagtgcattgattcagatttttaaaatttcttgatgtggtttgtaataatcaaatattgacaagaaccttaggtctcgaaagacttttataggtctagatgacgtttgccttaggggtaaagtaaaagaacaattggcaccttaagtttctatacccaaggttatctgtgaaatgagatctcctgatatttgattgctttctcagtatggagtcatatgttgataacagtactgaagatgcataagaaatgcccaagtcactcagaggacaactacccatattccagactctgagctgtttcctttttaaaaatcatatagacaattagctgtttgaagtgagtattaaatatttcagaagtgtgaatttcatgtatttgagctcctctagttgctgtcggtttttcttctgctgccaacctgtgactcacaaatgactaggatctcttgttctttaattttagggtcttgttccaggactcaaatcagtaacttggtgattacaaggtgctgaatgtgttggtaaccatatcgcaatacacctcaaggaaaaggttcagatttttatttttaaaatattttcatttttttcttgaattttatatccgtttgttcactcgtacatgcctagcctacagaaggggatatatattatgaaatggtcatttttctgaagagaatattttgcttgaaatgcaaaggactgaaagagatttgtaggttgttgattttgttacttcatactggaacttttaaaaagatttcatcaaataaagttttgttttctacttttaa

SEQ ID NO: 428032 - DNA, 3667 bp, Homo sapiens
cggcccttgggctctgcgggctggggactcggggtgcccgcgacacgcgcggaggcgcgggctgggttggccacgggcagggagcgcagccgcgctccttcctctctgcccgcgtcgcctccgcgcgcactggttctgcgcggcggggcttggcctgcgcgactgtctactccgtcccggcggcctcggagcccggccgagcggcgagcttgtcagaggacggtggtggaaacgctcccggcctccccaggggcgcgggctggaggctggcgccaggcgcggaggactcccggtatcttttgacaggctggcgcctcggctctggggacccgcaggaatcagtttagacttgaaattcagtttttcctgaaactgatcagaagttagtgacaccttgattggatccgtttttctgtcaggagctcattttgcagctctcaagcttttatagcatgctgtaaacaattgtcaaagttgtttatcaagaaacagatagagttgcaacttgtttctagtaatagaaacttttacactgcattcaatgcctaacgttgcagaaacagaaaggtcaaatgattctggaaatggtgagcacaaatctgagagaaagtcacctgaagagaatctacaaggtgctgtaaaatctttctgcacaagtgcctcaggagcacccttgggtcccaaaggagatggtcattatccatggagttgtccagtgactcatacacgggaaaaaatttatgccatctgttcggactatgcctttctcaaccaggcgacctcaatctataaaactccaaatccatcccgctctccttgcctccctgatagtacctctttatctgctggaaataattcatcaagatacattggtatcccgactagtacatcggaaattatctacaatgaagaaaatagcttggaaaacttatccaacagcctgggcaagctacctctcgcatgggaaattgataaatctgaatttgatggggtgaccacaaattcgaaacacaaatcaggcaatgcaaagaaacaagtttccaagagaaaaacttcagataaaaagcggaaagtattagacctcagacgatggtactgcataagccgaccacagtataagacttcttgtggcatctcttcattaatttcttgttggaatttcttatacagcacaatgggagctggaaaccttccacctattacccaagaagaagctttacatattctgggctttcaacctccatttgaagatattaggtttggtcctttcacggggaatacaacacttatgaggtggtttagacaaattaatgaccacttccatgtaaaaggatgctcttatgttctatataagcctcatgggaagaataaaacagcaggagaaactgcttcaggggccctgtcaaagttaacccgtggattgaaagatgaatcgctggcttatatctatcattgccaaaatcattatttttgtccaattggcttcgaagcaacccctgttaaagctaataaagcattcagcaggggacctctctcaccacaggaagttgaatattggatcttaattggagaatcaagtagaaaacatcctgccattcactgtaaaaaatgggcagatattgttactgatctaaacactcaaaatccagaatacctggatatccggcacttagagaggggactgcagtatagaaaaacaaagaaggttgggggaaatttgcattgcatcatagcattccagagacttaactggcaaagatttggcctttggaactttccatttggaaccattagacaagaatcacaacctccaacacatgcccagggaattgccaaatctgagagtgaagacaatatttccaagaagcagcatgggcgtctgggccggtctttcagtgctagtttccatcaggactcggcatggaaaaagatgtctagtatccatgagagaaggaacagtggttaccagggttacagtgattacgatgggaatgattgactatgcttgctactgaacagctggcattatatatgaaactgctatatacaggactgtataaagacagtagaagattttagtaagcctacattaaataggagcagatcttgtggtataaaaaataaccttgtagttctccagatactaagcttgtatatgattatggtgggtgatttcagatatataagcagataagcacagattattgtcctttcaagttaagagtatataatctggacagaaaatttcacaaaattcaataaaattacaactgttgtctaaataagtgaaacacaaattcacttaatagcatcaagatttgaaatacttaagcatgaagtgacttttataatgactcgatccctagacatttgttacagatagttttatgcctaagaccaagatgtaaagtaccatctgcccttaaaaaaaaattggggctgtcaatttctagttttcactcatggttaacacgcatttaaaattatttcatgagtctagtagttctttgatttatagcaggatcttgcttgcctcatttgtttcctggttatgttcttaggattctgactaagaggcaaaagagaaaagactcaagaaactgatcctggagatcgagaccatcctggctaacatggtgaaaccccgtctctactaaacatacaaaaaattagccgggtgtagtggtgggcacctgtagtcctagctactcgagaggctgaggcaggagaatggcgtgaacccgggaggtggagcttgcagtgagcggagatcgcgccactgcactccagcctgggcgacagggcaagactctgtctcaaaaaaaaaaaaaaaaaaaagacggatccttttttttggtgcaaatgggtgacttagtgcattgattcagatttttaaaatttcttgatgtggtttgtaataatcaaatattgacaagaaccttaggtctcgaaagacttttataggtctagatgacgtttgccttaggggtaaagtaaaagaacaattggcaccttaagtttctatacccaaggttatctgtgaaatgagatctcctgatatttgattgctttctcagtatggagtcatatgttgataacagtactgaagatgcataagaaatgcccaagtcactcagaggacaactacccatattccagactctgagctgtttcctttttaaaaatcatatagacaattagctgtttgaagtgagtattaaatatttcagaagtgtgaatttcatgtatttgagctcctctagttgctgtcggtttttcttctgctgccaacctgtgactcacaaatgactaggatctcttgttctttaattttagggtcttgttccaggactcaaatcagtaacttggtgattacaaggtgctgaatgtgttggtaaccatatcgcaatacacctcaaggaaaaggttcagatttttatttttaaaatattttcatttttttcttgaattttatatccgtttgttcactcgtacatgcctagcctacagaaggggatatatattatgaaatggtcatttttctgaagagaatattttgcttgaaatgcaaaggactgaaagagatttgtaggttgttgattttgttacttcatactggaacttttaaaaagatttcatcaaataaagttttgttttctacttttaa

SEQ ID NO: 428033 - DNA, 3171 bp, Homo sapiens
cgtatttcttcttaaaacagaataaataaatagtctgtctctttctccttctgttcacatttgccccagtttcttctcttgaatcatgacagtttggtttcacttttaaacttctctgtgacaggagaagcactgcttcatggcttcttgcccaaggattttagatggacacagtgggtaataaatggatgaatttttgtttgggttgaagaatctctctgagaagttgacacgtgggggcaatggtttgtttctcttgtatttctgaagttgcaaataatcatgtaagcagttcaaccaggagtttacaccaaacttttaataggcgatatatcattattttttttcccattggtttggataacatccactttaactggcagttagtcatacttagctatttttgttaaagcaggtgatttattgttattttatatttatgacatgattaataagtgaatatggaagattttacattgacttaggggatcaaagttttcattatattaacacctttaattgccatgagttttctatttctagcatgcatattttgtgttcattcaagtgaagaaaacagtcttttgtgttctcaggtactgcataagccgaccacagtataagacttcttgtggcatctcttcattaatttcttgttggaatttcttatacagcacaatgggagctggaaaccttccacctattacccaagaagaagctttacatattctgggctttcaacctccatttgaagatattaggtttggtcctttcacggggaatacaacacttatgaggtggtttagacaaattaatgaccacttccatgtaaaaggatgctcttatgttctatataagcctcatgggaagaataaaacagcaggagaaactgcttcaggggccctgtcaaagttaacccgtggattgaaagatgaatcgctggcttatatctatcattgccaaaatcattatttttgtccaattggcttcgaagcaacccctgttaaagctaataaagcattcagcaggggacctctctcaccacaggaagttgaatattggatcttaattggagaatcaagtagaaaacatcctgccattcactgtaaaaaatgggcagatattgttactgatctaaacactcaaaatccagaatacctggatatccggcacttagagaggggactgcagtatagaaaaacaaagaaggttgggggaaatttgcattgcatcatagcattccagagacttaactggcaaagatttggcctttggaactttccatttggaaccattagacaagaatcacaacctccaacacatgcccagggaattgccaaatctgagagtgaagacaatatttccaagaagcagcatgggcgtctgggccggtctttcagtgctagtttccatcaggactcggcatggaaaaagatgtctagtatccatgagagaaggaacagtggttaccagggttacagtgattacgatgggaatgattgactatgcttgctactgaacagctggcattatatatgaaactgctatatacaggactgtataaagacagtagaagattttagtaagcctacattaaataggagcagatcttgtggtataaaaaataaccttgtagttctccagatactaagcttgtatatgattatggtgggtgatttcagatatataagcagataagcacagattattgtcctttcaagttaagagtatataatctggacagaaaatttcacaaaattcaataaaattacaactgttgtctaaataagtgaaacacaaattcacttaatagcatcaagatttgaaatacttaagcatgaagtgacttttataatgactcgatccctagacatttgttacagatagttttatgcctaagaccaagatgtaaagtaccatctgcccttaaaaaaaaattggggctgtcaatttctagttttcactcatggttaacacgcatttaaaattatttcatgagtctagtagttctttgatttatagcaggatcttgcttgcctcatttgtttcctggttatgttcttaggattctgactaagaggcaaaagagaaaagactcaagaaactgatcctggagatcgagaccatcctggctaacatggtgaaaccccgtctctactaaacatacaaaaaattagccgggtgtagtggtgggcacctgtagtcctagctactcgagaggctgaggcaggagaatggcgtgaacccgggaggtggagcttgcagtgagcggagatcgcgccactgcactccagcctgggcgacagggcaagactctgtctcaaaaaaaaaaaaaaaaaaaagacggatccttttttttggtgcaaatgggtgacttagtgcattgattcagatttttaaaatttcttgatgtggtttgtaataatcaaatattgacaagaaccttaggtctcgaaagacttttataggtctagatgacgtttgccttaggggtaaagtaaaagaacaattggcaccttaagtttctatacccaaggttatctgtgaaatgagatctcctgatatttgattgctttctcagtatggagtcatatgttgataacagtactgaagatgcataagaaatgcccaagtcactcagaggacaactacccatattccagactctgagctgtttcctttttaaaaatcatatagacaattagctgtttgaagtgagtattaaatatttcagaagtgtgaatttcatgtatttgagctcctctagttgctgtcggtttttcttctgctgccaacctgtgactcacaaatgactaggatctcttgttctttaattttagggtcttgttccaggactcaaatcagtaacttggtgattacaaggtgctgaatgtgttggtaaccatatcgcaatacacctcaaggaaaaggttcagatttttatttttaaaatattttcatttttttcttgaattttatatccgtttgttcactcgtacatgcctagcctacagaaggggatatatattatgaaatggtcatttttctgaagagaatattttgcttgaaatgcaaaggactgaaagagatttgtaggttgttgattttgttacttcatactggaacttttaaaaagatttcatcaaataaagttttgttttctacttttaa

SEQ ID NO: 428034 - DNA, 3712 bp, Homo sapiens
ctgccaggattttaccacctctcgcccatttatttacttctcggtcaccgctttcgggggacagataaacaccacagatgcccatcaaaggggcgcacgggtctggaggcgcagctcaggtttttgcgttggtcaccctgccctccgcacgtggagagggcaggcataaagcaccttgaaaggaaggtgctgtcaatgctatccgacgacctgtcgccgggcaccgcagcatcctcgctcgctccgatgggacgagggacgccggccccagggtaacaggaggcgcctcgccggccgcgcgctggatgctgtgatccaggaatcagtttagacttgaaattcagtttttcctgaaactgatcagaagttagtgacaccttgattggatccgtttttctgtcaggagctcattttgcagctctcaagcttttatagcatgctgtaaacaattgtcaaagttgtttatcaagaaacagatagagttgcaacttgtttctagtaatagaaacttttacactgcattcaatgcctaacgttgcagaaacagaaaggtcaaatgattctggaaatggtgagcacaaatctgagagaaagtcacctgaagagaatctacaaggtgctgtaaaatctttctgcacaagtgcctcaggagcacccttgggtcccaaaggagatggtcattatccatggagttgtccagtgactcatacacgggaaaaaatttatgccatctgttcggactatgcctttctcaaccaggcgacctcaatctataaaactccaaatccatcccgctctccttgcctccctgatagtacctctttatctgctggaaataattcatcaagatacattggtatcccgactagtacatcggaaattatctacaatgaagaaaatagcttggaaaacttatccaacagcctgggcaagctacctctcgcatgggaaattgataaatctgaatttgatggggtgaccacaaattcgaaacacaaatcaggcaatgcaaagaaacaagtttccaagagaaaaacttcagataaaaagggaagatatcagaaggaatgtcctcagcattctcctcttgaagatattaaacagcggaaagtattagacctcagacgatggtactgcataagccgaccacagtataagacttcttgtggcatctcttcattaatttcttgttggaatttcttatacagcacaatgggagctggaaaccttccacctattacccaagaagaagctttacatattctgggctttcaacctccatttgaagatattaggtttggtcctttcacggggaatacaacacttatgaggtggtttagacaaattaatgaccacttccatgtaaaaggatgctcttatgttctatataagcctcatgggaagaataaaacagcaggagaaactgcttcaggggccctgtcaaagttaacccgtggattgaaagatgaatcgctggcttatatctatcattgccaaaatcattatttttgtccaattggcttcgaagcaacccctgttaaagctaataaagcattcagcaggggacctctctcaccacaggaagttgaatattggatcttaattggagaatcaagtagaaaacatcctgccattcactgtaaaaaatgggcagatattgttactgatctaaacactcaaaatccagaatacctggatatccggcacttagagaggggactgcagtatagaaaaacaaagaaggttgggggaaatttgcattgcatcatagcattccagagacttaactggcaaagatttggcctttggaactttccatttggaaccattagacaagaatcacaacctccaacacatgcccagggaattgccaaatctgagagtgaagacaatatttccaagaagcagcatgggcgtctgggccggtctttcagtgctagtttccatcaggactcggcatggaaaaagatgtctagtatccatgagagaaggaacagtggttaccagggttacagtgattacgatgggaatgattgactatgcttgctactgaacagctggcattatatatgaaactgctatatacaggactgtataaagacagtagaagattttagtaagcctacattaaataggagcagatcttgtggtataaaaaataaccttgtagttctccagatactaagcttgtatatgattatggtgggtgatttcagatatataagcagataagcacagattattgtcctttcaagttaagagtatataatctggacagaaaatttcacaaaattcaataaaattacaactgttgtctaaataagtgaaacacaaattcacttaatagcatcaagatttgaaatacttaagcatgaagtgacttttataatgactcgatccctagacatttgttacagatagttttatgcctaagaccaagatgtaaagtaccatctgcccttaaaaaaaaattggggctgtcaatttctagttttcactcatggttaacacgcatttaaaattatttcatgagtctagtagttctttgatttatagcaggatcttgcttgcctcatttgtttcctggttatgttcttaggattctgactaagaggcaaaagagaaaagactcaagaaactgatcctggagatcgagaccatcctggctaacatggtgaaaccccgtctctactaaacatacaaaaaattagccgggtgtagtggtgggcacctgtagtcctagctactcgagaggctgaggcaggagaatggcgtgaacccgggaggtggagcttgcagtgagcggagatcgcgccactgcactccagcctgggcgacagggcaagactctgtctcaaaaaaaaaaaaaaaaaaaagacggatccttttttttggtgcaaatgggtgacttagtgcattgattcagatttttaaaatttcttgatgtggtttgtaataatcaaatattgacaagaaccttaggtctcgaaagacttttataggtctagatgacgtttgccttaggggtaaagtaaaagaacaattggcaccttaagtttctatacccaaggttatctgtgaaatgagatctcctgatatttgattgctttctcagtatggagtcatatgttgataacagtactgaagatgcataagaaatgcccaagtcactcagaggacaactacccatattccagactctgagctgtttcctttttaaaaatcatatagacaattagctgtttgaagtgagtattaaatatttcagaagtgtgaatttcatgtatttgagctcctctagttgctgtcggtttttcttctgctgccaacctgtgactcacaaatgactaggatctcttgttctttaattttagggtcttgttccaggactcaaatcagtaacttggtgattacaaggtgctgaatgtgttggtaaccatatcgcaatacacctcaaggaaaaggttcagatttttatttttaaaatattttcatttttttcttgaattttatatccgtttgttcactcgtacatgcctagcctgcggaactgcagatacggtatgccatggtcagttttgtaaggcagaaagtagctttccagtgtgcagggcgcacaatgtgtagccgcctcttcggcccgtggagcagcaccagccgctgtcgccgccgctgctgctgggactgccgcggagccgggggtcatggagtg

SEQ ID NO: 428035 - DNA, 3653 bp, Homo sapiens
ctgccaggattttaccacctctcgcccatttatttacttctcggtcaccgctttcgggggacagataaacaccacagatgcccatcaaaggggcgcacgggtctggaggcgcagctcaggtttttgcgttggtcaccctgccctccgcacgtggagagggcaggcataaagcaccttgaaaggaaggtgctgtcaatgctatccgacgacctgtcgccgggcaccgcagcatcctcgctcgctccgatgggacgagggacgccggccccagggtaacaggaggcgcctcgccggccgcgcgctggatgctgtgatccaggaatcagtttagacttgaaattcagtttttcctgaaactgatcagaagttagtgacaccttgattggatccgtttttctgtcaggagctcattttgcagctctcaagcttttatagcatgctgtaaacaattgtcaaagttgtttatcaagaaacagatagagttgcaacttgtttctagtaatagaaacttttacactgcattcaatgcctaacgttgcagaaacagaaaggtcaaatgattctggaaatggtgagcacaaatctgagagaaagtcacctgaagagaatctacaaggtgctgtaaaatctttctgcacaagtgcctcaggagcacccttgggtcccaaaggagatggtcattatccatggagttgtccagtgactcatacacgggaaaaaatttatgccatctgttcggactatgcctttctcaaccaggcgacctcaatctataaaactccaaatccatcccgctctccttgcctccctgatagtacctctttatctgctggaaataattcatcaagatacattggtatcccgactagtacatcggaaattatctacaatgaagaaaatagcttggaaaacttatccaacagcctgggcaagctacctctcgcatgggaaattgataaatctgaatttgatggggtgaccacaaattcgaaacacaaatcaggcaatgcaaagaaacaagtttccaagagaaaaacttcagataaaaagggaagatatcagaaggaatgtcctcagcattctcctcttgaagatattaaacagcggaaagtattagacctcagacgatggtactgcataagccgaccacagtataagacttcttgtggcatctcttcattaatttcttgttggaatttcttatacagcacaatgggagctggaaaccttccacctattacccaagaagaagctttacatattctgggctttcaacctccatttgaagatattaggtttggtcctttcacggggaatacaacacttatgaggtggtttagacaaattaatgaccacttccatgtaaaaggatgctcttatgttctatataagcctcatgggaagaataaaacagcaggagaaactgcttcaggggccctgtcaaagttaacccgtggattgaaagatgaatcgctggcttatatctatcattgccaaaatcattatttttgtccaattggcttcgaagcaacccctgttaaagctaataaagcattcagcaggggacctctctcaccacaggaagttgaatattggatcttaattggagaatcaagtagaaaacatcctgccattcactgtaaaaaatgggcagatattgttactgatctaaacactcaaaatccagaatacctggatatccggcacttagagaggggactgcagtatagaaaaacaaagaaggttgggggaaatttgcattgcatcatagcattccagagacttaactggcaaagatttggcctttggaactttccatttggaaccattagacaagaatcacaacctccaacacatgcccagggaattgccaaatctgagagtgaagacaatatttccaagaagcagcatgggcgtctgggccggtctttcagtgctagtttccatcaggactcggcatggatgattacgatgggaatgattgactatgcttgctactgaacagctggcattatatatgaaactgctatatacaggactgtataaagacagtagaagattttagtaagcctacattaaataggagcagatcttgtggtataaaaaataaccttgtagttctccagatactaagcttgtatatgattatggtgggtgatttcagatatataagcagataagcacagattattgtcctttcaagttaagagtatataatctggacagaaaatttcacaaaattcaataaaattacaactgttgtctaaataagtgaaacacaaattcacttaatagcatcaagatttgaaatacttaagcatgaagtgacttttataatgactcgatccctagacatttgttacagatagttttatgcctaagaccaagatgtaaagtaccatctgcccttaaaaaaaaattggggctgtcaatttctagttttcactcatggttaacacgcatttaaaattatttcatgagtctagtagttctttgatttatagcaggatcttgcttgcctcatttgtttcctggttatgttcttaggattctgactaagaggcaaaagagaaaagactcaagaaactgatcctggagatcgagaccatcctggctaacatggtgaaaccccgtctctactaaacatacaaaaaattagccgggtgtagtggtgggcacctgtagtcctagctactcgagaggctgaggcaggagaatggcgtgaacccgggaggtggagcttgcagtgagcggagatcgcgccactgcactccagcctgggcgacagggcaagactctgtctcaaaaaaaaaaaaaaaaaaaagacggatccttttttttggtgcaaatgggtgacttagtgcattgattcagatttttaaaatttcttgatgtggtttgtaataatcaaatattgacaagaaccttaggtctcgaaagacttttataggtctagatgacgtttgccttaggggtaaagtaaaagaacaattggcaccttaagtttctatacccaaggttatctgtgaaatgagatctcctgatatttgattgctttctcagtatggagtcatatgttgataacagtactgaagatgcataagaaatgcccaagtcactcagaggacaactacccatattccagactctgagctgtttcctttttaaaaatcatatagacaattagctgtttgaagtgagtattaaatatttcagaagtgtgaatttcatgtatttgagctcctctagttgctgtcggtttttcttctgctgccaacctgtgactcacaaatgactaggatctcttgttctttaattttagggtcttgttccaggactcaaatcagtaacttggtgattacaaggtgctgaatgtgttggtaaccatatcgcaatacacctcaaggaaaaggttcagatttttatttttaaaatattttcatttttttcttgaattttatatccgtttgttcactcgtacatgcctagcctacagaaggggatatatattatgaaatggtcatttttctgaagagaatattttgcttgaaatgcaaaggactgaaagagatttgtaggttgttgattttgttacttcatactggaacttttaaaaagatttcatcaaataaagttttgttttctacttttaa

SEQ ID NO: 428036 - DNA, 625 bp, Homo sapiens
cttaatatagcaacacctcacttgcctggaagagggaaccgcaatcaatcaaaatgagggcctacagtaatgcctggcatgatgcaaacacttaaaaattatctgttgaatgagacgtctacaaatcctaggccctggggatacaataatctggaaaaccagacttgcaggatgcagacgttgatcatatgaacagatatgcacagaagtaagtgtaaaattgccacctggtaagacctgtgtgaggaaggtactagagtctgtaccgggtcacctggcctagtttgagaagccaagaaggtttcccccagaaagtgacatttgagctgacattggaaagatgaatgggaatgagctaagtaagggagacagtattgggagaaccaaaaagtaatgtggagcttggggggtgggggaaaggaatgagatggagctaaccagatagatctagggaccatcaggagttggccttttgttctaagagcagaggctttcaggcagaggagttctgtgatcatatatatgtagcaaactttattttctaatatctctgcacaggtcaggttagaagtgtcaactcactgggaatagtttataaatagagaaacaaaaggagataaaagat

SEQ ID NO: 428037 - DNA, 3721 bp, Homo sapiens
cggcccttgggctctgcgggctggggactcggggtgcccgcgacacgcgcggaggcgcgggctgggttggccacgggcagggagcgcagccgcgctccttcctctctgcccgcgtcgcctccgcgcgcactggttctgcgcggcggggcttggcctgcgcgactgtctactccgtcccggcggcctcggagcccggccgagcggcgagcttgtcagaggacggtggtggaaacgctcccggcctccccaggggcgcgggctggaggctggcgccaggcgcggaggactcccggtatcttttgacaggctggcgcctcggctctggggacccgcaggaatcagtttagacttgaaattcagtttttcctgaaactgatcagaagttagtgacaccttgattggatccgtttttctgtcaggagctcattttgcagctctcaagcttttatagcatgctgtaaacaattgtcaaagttgtttatcaagaaacagatagagttgcaacttgtttctagtaatagaaacttttacactgcattcaatgcctaacgttgcagaaacagaaaggtcaaatgattctggaaatggtgagcacaaatctgagagaaagtcacctgaagagaatctacaaggtgctgtaaaatctttctgcacaagtgcctcaggagcacccttgggtcccaaaggagatggtcattatccatggagttgtccagtgactcatacacgggaaaaaatttatgccatctgttcggactatgcctttctcaaccaggcgacctcaatctataaaactccaaatccatcccgctctccttgcctccctgatagtacctctttatctgctggaaataattcatcaagatacattggtatcccgactagtacatcggaaattatctacaatgaagaaaatagcttggaaaacttatccaacagcctgggcaagctacctctcgcatgggaaattgataaatctgaatttgatggggtgaccacaaattcgaaacacaaatcaggcaatgcaaagaaacaagtttccaagagaaaaacttcagataaaaagggaagatatcagaaggaatgtcctcagcattctcctcttgaagatattaaacagcggaaagtattagacctcagacgatggtactgcataagccgaccacagtataagacttcttgtggcatctcttcattaatttcttgttggaatttcttatacagcacaatgggagctggaaaccttccacctattacccaagaagaagctttacatattctgggctttcaacctccatttgaagatattaggtttggtcctttcacggggaatacaacacttatgaggtggtttagacaaattaatgaccacttccatgtaaaaggatgctcttatgttctatataagcctcatgggaagaataaaacagcaggagaaactgcttcaggggccctgtcaaagttaacccgtggattgaaagatgaatcgctggcttatatctatcattgccaaaatcattatttttgtccaattggcttcgaagcaacccctgttaaagctaataaagcattcagcaggggacctctctcaccacaggaagttgaatattggatcttaattggagaatcaagtagaaaacatcctgccattcactgtaaaaaatgggcagatattgttactgatctaaacactcaaaatccagaatacctggatatccggcacttagagaggggactgcagtatagaaaaacaaagaaggttgggggaaatttgcattgcatcatagcattccagagacttaactggcaaagatttggcctttggaactttccatttggaaccattagacaagaatcacaacctccaacacatgcccagggaattgccaaatctgagagtgaagacaatatttccaagaagcagcatgggcgtctgggccggtctttcagtgctagtttccatcaggactcggcatggaaaaagatgtctagtatccatgagagaaggaacagtggttaccagggttacagtgattacgatgggaatgattgactatgcttgctactgaacagctggcattatatatgaaactgctatatacaggactgtataaagacagtagaagattttagtaagcctacattaaataggagcagatcttgtggtataaaaaataaccttgtagttctccagatactaagcttgtatatgattatggtgggtgatttcagatatataagcagataagcacagattattgtcctttcaagttaagagtatataatctggacagaaaatttcacaaaattcaataaaattacaactgttgtctaaataagtgaaacacaaattcacttaatagcatcaagatttgaaatacttaagcatgaagtgacttttataatgactcgatccctagacatttgttacagatagttttatgcctaagaccaagatgtaaagtaccatctgcccttaaaaaaaaattggggctgtcaatttctagttttcactcatggttaacacgcatttaaaattatttcatgagtctagtagttctttgatttatagcaggatcttgcttgcctcatttgtttcctggttatgttcttaggattctgactaagaggcaaaagagaaaagactcaagaaactgatcctggagatcgagaccatcctggctaacatggtgaaaccccgtctctactaaacatacaaaaaattagccgggtgtagtggtgggcacctgtagtcctagctactcgagaggctgaggcaggagaatggcgtgaacccgggaggtggagcttgcagtgagcggagatcgcgccactgcactccagcctgggcgacagggcaagactctgtctcaaaaaaaaaaaaaaaaaaaagacggatccttttttttggtgcaaatgggtgacttagtgcattgattcagatttttaaaatttcttgatgtggtttgtaataatcaaatattgacaagaaccttaggtctcgaaagacttttataggtctagatgacgtttgccttaggggtaaagtaaaagaacaattggcaccttaagtttctatacccaaggttatctgtgaaatgagatctcctgatatttgattgctttctcagtatggagtcatatgttgataacagtactgaagatgcataagaaatgcccaagtcactcagaggacaactacccatattccagactctgagctgtttcctttttaaaaatcatatagacaattagctgtttgaagtgagtattaaatatttcagaagtgtgaatttcatgtatttgagctcctctagttgctgtcggtttttcttctgctgccaacctgtgactcacaaatgactaggatctcttgttctttaattttagggtcttgttccaggactcaaatcagtaacttggtgattacaaggtgctgaatgtgttggtaaccatatcgcaatacacctcaaggaaaaggttcagatttttatttttaaaatattttcatttttttcttgaattttatatccgtttgttcactcgtacatgcctagcctacagaaggggatatatattatgaaatggtcatttttctgaagagaatattttgcttgaaatgcaaaggactgaaagagatttgtaggttgttgattttgttacttcatactggaacttttaaaaagatttcatcaaataaagttttgttttctacttttaa

SEQ ID NO: 428038 - DNA, 4040 bp, Homo sapiens
ctgccaggattttaccacctctcgcccatttatttacttctcggtcaccgctttcgggggacagataaacaccacagatgcccatcaaaggggcgcacgggtctggaggcgcagctcaggtttttgcgttggtcaccctgccctccgcacgtggagagggcaggcataaagcaccttgaaaggaaggtgctgtcaatgctatccgacgacctgtcgccgggcaccgcagcatcctcgctcgctccgatgggacgagggacgccggccccagggtaacaggaggcgcctcgccggccgcgcgctggatgctgtgatccaggaatcagtttagacttgaaattcagtttttcctgaaactgatcagaagttagtgacaccttgattggatccgtttttctgtcaggagctcattttgcagctctcaagcttttatagcatgctgtaaacaattgtcaaagttgtttatcaagaaacagatagagttgcaacttgtttctagtaatagaaacttttacactgcattcaatgcctaacgttgcagaaacagaaaggtcaaatgattctggaaatggtgagcacaaatctgagagaaagtcacctgaagagaatctacaaggtgctgtaaaatctttctgcacaagtgcctcaggagcacccttgggtcccaaaggagatggtcattatccatggagttgtccagtgactcatacacgggaaaaaatttatgccatctgttcggactatgcctttctcaaccaggcgacctcaatctataaaactccaaatccatcccgctctccttgcctccctgatagtacctctttatctgctggaaataattcatcaagatacattggtatcccgactagtacatcggaaattatctacaatgaagaaaatagcttggaaaacttatccaacagcctgggcaagctacctctcgcatgggaaattgataaatctgaatttgatggggtgaccacaaattcgaaacacaaatcaggcaatgcaaagaaacaagtttccaagagaaaaacttcagataaaaagggaagatatcagaaggaatgtcctcagcattctcctcttgaagatattaaacagcggaaagtattagacctcagacgatggtactgcataagccgaccacagtataagacttcttgtggcatctcttcattaatttcttgttggaatttcttatacagcacaatgggagctggaaaccttccacctattacccaagaagaagctttacatattctgggctttcaacctccatttgaagatattaggtttggtcctttcacggggaatacaacacttatgaggtggtttagacaaattaatgaccacttccatgtaaaaggatgctcttatgttctatataagcctcatgggaagaataaaacagcaggagaaactgcttcaggggccctgtcaaagttaacccgtggattgaaagatgaatcgctggcttatatctatcattgccaaaatcattatttttgtccaattggcttcgaagcaacccctgttaaagctaataaagcattcagcaggggacctctctcaccacaggaagttgaatattggatcttaattggagaatcaagtagaaaacatcctgccattcactgtaaaaaatgggcagatattgttactgatctaaacactcaaaatccagaatacctggatatccggcacttagagaggggactgcagtatagaaaaacaaagaaggttgggggaaatttgcattgcatcatagcattccagagacttaactggcaaagatttggcctttggaactttccatttggaaccattagacaagaatcacaacctccaacacatgcccagggaattgccaaatctgagagtgaagacaatatttccaagaagcagcatgggcgtctgggccggtctttcagtgctagtttccatcaggactcggcatggaaaaagatgtctagtatccatgagagaaggaacagtggttaccagggttacagtgattacgatgggaatgattgactatgcttgctactgaacagctggcattatatatgaaactgctatatacaggactgtataaagacagtagaagattttagtaagcctacattaaataggagcagatcttgtggtataaaaaataaccttgtagttctccagatactaagcttgtatatgattatggtgggtgatttcagatatataagcagataagcacagattattgtcctttcaagttaagagtatataatctggacagaaaatttcacaaaattcaataaaattacaactgttgtctaaataagtgaaacacaaattcacttaatagcatcaagatttgaaatacttaagcatgaagtgacttttataatgactcgatccctagacatttgttacagatagttttatgcctaagaccaagatgtaaagtaccatctgcccttaaaaaaaaattggggctgtcaatttctagttttcactcatggttaacacgcatttaaaattatttcatgagtctagtagttctttgatttatagcaggatcttgcttgcctcatttgtttcctggttatgttcttaggattctgactaagaggcaaaagagaaaagactcaagaaactgatcctggagatcgagaccatcctggctaacatggtgaaaccccgtctctactaaacatacaaaaaattagccgggtgtagtggtgggcacctgtagtcctagctactcgagaggctgaggcaggagaatggcgtgaacccgggaggtggagcttgcagtgagcggagatcgcgccactgcactccagcctgggcgacagggcaagactctgtctcaaaaaaaaaaaaaaaaaaaagacggatccttttttttggtgcaaatgggtgacttagtgcattgattcagatttttaaaatttcttgatgtggtttgtaataatcaaatattgacaagaaccttaggtctcgaaagacttttataggtctagatgacgtttgccttaggggtaaagtaaaagaacaattggcaccttaagtttctatacccaaggttatctgtgaaatgagatctcctgatatttgattgctttctcagtatggagtcatatgttgataacagtactgaagatgcataagaaatgcccaagtcactcagaggacaactacccatattccagactctgagctgtttcctttttaaaaatcatatagacaattagctgtttgaagtgagtattaaatatttcagaagtgtgaatttcatgtatttgagctcctctagttgctgtcggtttttcttctgctgccaacctgtgactcacaaatgactaggatctcttgttctttaattttagggtcttgttccaggactcaaatcagtaacttggtgattacaaggtgctgaatgtgttggtaaccatatcgcaatacacctcaaggaaaaggttcagatttttatttttaaaatattttcatttttttcttgaattttatatccgtttgttcactcgtacatgcctagcctacagaaggggatatatattatgaaatggtcatttttctgaagagaatattttgcttgaaatgcaaaggactgaaagagatttgtaggttgttgattttgttacttcatactggaacttttaaaaagatttcatcaaataaagttttgttttctacttttaaaaatatgaatgtttttaaacctttgttttaggtagaaggtaccattgtgtctttgaagtacatgataatttgtcaattctgctcaactggtacattgtaagaaaccatcttgagccttttataattaatgaaacaatatgcattatgatgactgtaattttagatttctaatttaataggaaatagaaaatttgattcttttattagcttgaaccaaatgaagttgtcatctttgtaggtcaaaaatggttgaatattagcaatttcatacagttcaactgaatatttcagagaagacgtaggtaggaagaaccaagaggaaaggagaaaaatgc

SEQ ID NO: 428039 - DNA, 3079 bp, Homo sapiens
ctgccaggattttaccacctctcgcccatttatttacttctcggtcaccgctttcgggggacagataaacaccacagatgcccatcaaaggggcgcacgggtctggaggcgcagctcaggtttttgcgttggtcaccctgccctccgcacgtggagagggcaggcataaagcaccttgaaaggaaggtgctgtcaatgctatccgacgacctgtcgccgggcaccgcagcatcctcgctcgctccgatgggacgagggacgccggccccagggtaacaggaggcgcctcgccggccgcgcgctggatgctgtgatccaggtccggagccgggttccgccgcggccgcagcgacccgaccccacccgacaggccagaggcaatgcaaagaaacaagtttccaagagaaaaacttcagataaaaagggaagatatcagaaggaatgtcctcagcattctcctcttgaagatattaaacagcggaaagtattagacctcagacgatggtactgcataagccgaccacagtataagacttcttgtggcatctcttcattaatttcttgttggaatttcttatacagcacaatgggagctggaaaccttccacctattacccaagaagaagctttacatattctgggctttcaacctccatttgaagatattaggtttggtcctttcacggggaatacaacacttatgaggtggtttagacaaattaatgaccacttccatgtaaaaggatgctcttatgttctatataagcctcatgggaagaataaaacagcaggagaaactgcttcaggggccctgtcaaagttaacccgtggattgaaagatgaatcgctggcttatatctatcattgccaaaatcattatttttgtccaattggcttcgaagcaacccctgttaaagctaataaagcattcagcaggggacctctctcaccacaggaagttgaatattggatcttaattggagaatcaagtagaaaacatcctgccattcactgtaaaaaatgggcagatattgttactgatctaaacactcaaaatccagaatacctggatatccggcacttagagaggggactgcagtatagaaaaacaaagaaggttgggggaaatttgcattgcatcatagcattccagagacttaactggcaaagatttggcctttggaactttccatttggaaccattagacaagaatcacaacctccaacacatgcccagggaattgccaaatctgagagtgaagacaatatttccaagaagcagcatgggcgtctgggccggtctttcagtgctagtttccatcaggactcggcatggaaaaagatgtctagtatccatgagagaaggaacagtggttaccagggttacagtgattacgatgggaatgattgactatgcttgctactgaacagctggcattatatatgaaactgctatatacaggactgtataaagacagtagaagattttagtaagcctacattaaataggagcagatcttgtggtataaaaaataaccttgtagttctccagatactaagcttgtatatgattatggtgggtgatttcagatatataagcagataagcacagattattgtcctttcaagttaagagtatataatctggacagaaaatttcacaaaattcaataaaattacaactgttgtctaaataagtgaaacacaaattcacttaatagcatcaagatttgaaatacttaagcatgaagtgacttttataatgactcgatccctagacatttgttacagatagttttatgcctaagaccaagatgtaaagtaccatctgcccttaaaaaaaaattggggctgtcaatttctagttttcactcatggttaacacgcatttaaaattatttcatgagtctagtagttctttgatttatagcaggatcttgcttgcctcatttgtttcctggttatgttcttaggattctgactaagaggcaaaagagaaaagactcaagaaactgatcctggagatcgagaccatcctggctaacatggtgaaaccccgtctctactaaacatacaaaaaattagccgggtgtagtggtgggcacctgtagtcctagctactcgagaggctgaggcaggagaatggcgtgaacccgggaggtggagcttgcagtgagcggagatcgcgccactgcactccagcctgggcgacagggcaagactctgtctcaaaaaaaaaaaaaaaaaaaagacggatccttttttttggtgcaaatgggtgacttagtgcattgattcagatttttaaaatttcttgatgtggtttgtaataatcaaatattgacaagaaccttaggtctcgaaagacttttataggtctagatgacgtttgccttaggggtaaagtaaaagaacaattggcaccttaagtttctatacccaaggttatctgtgaaatgagatctcctgatatttgattgctttctcagtatggagtcatatgttgataacagtactgaagatgcataagaaatgcccaagtcactcagaggacaactacccatattccagactctgagctgtttcctttttaaaaatcatatagacaattagctgtttgaagtgagtattaaatatttcagaagtgtgaatttcatgtatttgagctcctctagttgctgtcggtttttcttctgctgccaacctgtgactcacaaatgactaggatctcttgttctttaattttagggtcttgttccaggactcaaatcagtaacttggtgattacaaggtgctgaatgtgttggtaaccatatcgcaatacacctcaaggaaaaggttcagatttttatttttaaaatattttcatttttttcttgaattttatatccgtttgttcactcgtacatgcctagcctacagaaggggatatatattatgaaatggtcatttttctgaagagaatattttgcttgaaatgcaaaggactgaaagagatttgtaggttgttgattttgttacttcatactggaacttttaaaaagatttcatcaaataaagttttgttttctacttttaa

SEQ ID NO: 428040 - DNA, 1770 bp, Homo sapiens
ctgccaggattttaccacctctcgcccatttatttacttctcggtcaccgctttcgggggacagataaacaccacagatgcccatcaaaggggcgcacgggtctggaggcgcagctcaggtttttgcgttggtcaccctgccctccgcacgtggagagggcaggcataaagcaccttgaaaggaaggtgctgtcaatgctatccgacgacctgtcgccgggcaccgcagcatcctcgctcgctccgatgggacgagggacgccggccccagggtaacaggaggcgcctcgccggccgcgcgctggatgctgtgatccaggaatcagtttagacttgaaattcagtttttcctgaaactgatcagaagttagtgacaccttgattggatccgtttttctgtcaggagctcattttgcagctctcaagcttttatagcatgctgtaaacaattgtcaaagttgtttatcaagaaacagatagagttgcaacttgtttctagtaatagaaacttttacactgcattcaatgcctaacgttgcagaaacagaaaggtcaaatgattctggaaatggtgagcacaaatctgagagaaagtcacctgaagagaatctacaaggtgctgtaaaatctttctgcacaagtgcctcaggagcacccttgggtcccaaaggagatggtcattatccatggagttgtccagtgactcatacacgggaaaaaatttatgccatctgttcggactatgcctttctcaaccaggcgacctcaatctataaaactccaaatccatcccgctctccttgcctccctgatagtacctctttatctgctggaaataattcatcaagatacattggtatcccgactagtacatcggaaattatctacaatgaagaaaatagcttggaaaacttatccaacagcctgggcaagctacctctcgcatgggaaattgataaatctgaatttgatggggtgaccacaaattcgaaacacaaatcaggcaatgcaaagaaacaagtttccaagagaaaaacttcagataaaaagggaagatatcagaaggaatgtcctcagcattctcctcttgaagatattaaacagcggaaagtattagacctcagacgatggtgatgttatcagtttttatttttttcatttttgaaatatgtaatatatgttggcaataacgtagcagtttacaaattaacacattatatgtatcataaatatttttatttctaaaattattaccaggatttctgaatatttaaagtcaccacaaatgtttgaagtagattaataatgagttatgctggtctttcccaaactcggcttattattagagtcatctgtgtgactccacgtaactgccatgtagatttaacaatgattaaccttttgatgtagttaaatacttagcttttcattgctgaagaattttcaagtaagtgactgatttttattatatttcatctcaagttacctaagtatgcatctctaaaaaatgacttttttctacttaaccacaatacttttgtcatacttaataagattaacgatatttccctagtgtctaattcccaggctaaattcacgtttcccagattgttctgaaaaggtcttcacatctgtttgttcaaagtgggacccagttgtgaaccacatgtttgcttgtcatgacccataattctctcaatctaggtcagtctccaccccactttcccccttgtcttttaaaaattctattattttaatcgacaaatgaga

SEQ ID NO: 428041 - DNA, 4824 bp, Homo sapiens
ggtccctgagcctccagttctgcgtcggtttcaaggctcctccctcctggtgaaagacagactacggggcgcctggaaaccggtccgagggcgcgcgaggcagaggagagggagcgagttgagggattgacacaaatggtcaggcggcggcggcggagaaggaggcggaggcgcaggggggagccgagcccgctgggctgcggagagttgcgctctctacggggccgcggccactagcgcggcgccgccagccgggagccagcgagccgagggccaggaaggcgggacacgaccccggcgcgccctagccacccgggttctccccgccgcccgcgcttcatgaatcgcaagtttccgcggcggcggcggctgcggtacgcagaacaggagccgggggagcgggccgaaagcggcttgggctcgacggagggcacccgcgcagaggtctccctggccgcagggggagccgccgccggccgtgcccctggcagccccagcggagcggcgccaagagaggagccgagaaagtatggctgaggaggaggcgcctaagaagtcccgggccgccggcggtggcgcgagctgggaactttgtgccggggcgctctcggcccggctggcggaggagggcagcggggacgccggtggccgccgccgcccgccagttgacccccggcgattggcgcgccagctgctgctgctgctttggctgctggaggctccgctgctgctgggggtccgggcccaggcggcgggccaggggccaggccaggggcccgggccggggcagcaaccgccgccgccgcctcagcagcaacagagcgggcagcagtacaacggcgagcggggcatctccgtcccggaccacggctattgccagcccatctccatcccgctgtgcacggacatcgcgtacaaccagaccatcatgcccaacctgctgggccacacgaaccaggaggacgcgggcctggaggtgcaccagttctaccctctagtgaaagtgcagtgttccgctgagctcaagttcttcctgtgctccatgtacgcgcccgtgtgcaccgtgctagagcaggcgctgccgccctgccgctccctgtgcgagcgcgcgcgccagggctgcgaggcgctcatgaacaagttcggcttccagtggccagacacgctcaagtgtgagaagttcccggtgcacggcgccggcgagctgtgcgtgggccagaacacgtccgacaagggcaccccgacgccctcgctgcttccagagttctggaccagcaaccctcagcacggcggcggagggcaccgtggcggcttcccggggggcgccggcgcgtcggagcgaggcaagttctcctgcccgcgcgccctcaaggtgccctcctacctcaactaccacttcctgggggagaaggactgcggcgcaccttgtgagccgaccaaggtgtatgggctcatgtacttcgggcccgaggagctgcgcttctcgcgcacctggattggcatttggtcagtgctgtgctgcgcctccacgctcttcacggtgcttacgtacctggtggacatgcggcgcttcagctacccggagcggcccatcatcttcttgtccggctgttacacggccgtggccgtggcctacatcgccggcttcctcctggaagaccgagtggtgtgtaatgacaagttcgccgaggacggggcacgcactgtggcgcagggcaccaagaaggagggctgcaccatcctcttcatgatgctctacttcttcagcatggccagctccatctggtgggtgatcctgtcgctcacctggttcctggcggctggcatgaagtggggccacgaggccatcgaagccaactcacagtattttcacctggccgcctgggctgtgccggccatcaagaccatcaccatcctggcgctgggccaggtggacggcgatgtgctgagcggagtgtgcttcgtggggcttaacaacgtggacgcgctgcgtggcttcgtgctggcgcccctcttcgtgtacctgtttatcggcacgtcctttctgctggccggctttgtgtcgctcttccgcatccgcaccatcatgaagcacgatggcaccaagaccgagaagctggagaagctcatggtgcgcattggcgtcttcagcgtgctgtacactgtgccagccaccatcgtcatcgcctgctacttctacgagcaggccttccgggaccagtgggaacgcagctgggtggcccagagctgcaagagctacgctatcccctgccctcacctccaggcgggcggaggcgccccgccgcacccgcccatgagcccggacttcacggtcttcatgattaagtaccttatgacgctgatcgtgggcatcacgtcgggcttctggatctggtccggcaagaccctcaactcctggaggaagttctacacgaggctcaccaacagcaaacaaggggagactacagtctgagacccggggctcagcccatgcccaggcctcggccggggcgcagcgatcccccaaagccagcgccgtggagttcgtgccaatcctgacatctcgaggtttcctcactagacaactctctttcgcaggctcctttgaacaactcagctcctgcaaaagcttccgtccctgaggcaaaaggacacgagggcccgactgccagagggaggatggacagacctcttgccctcacactctggtaccaggactgttcgcttttatgattgtaaatagcctgtgtaagatttttgtaagtatatttgtatttaaatgacgaccgatcacgcgtttttctttttcaaaagtttttaattatttagggcggtttaaccatttgaggcttttccttcttgcccttttcggagtattgcaaaggagctaaaactggtgtgcaaccgcacagcgctcctggtcgtcctcgcgcgcctctccctaccacgggtgctcgggacggctgggcgccagctccggggcgagttcagcactgcggggtgcgactagggctgcgctgccagggtcacttcccgcctcctccttttgccccctccccctccttctgtcccctccctttctttcctggcttgaggtaggggctcttaaggtacagaactccacaaaccttccaaatctggaggagggcccccatacattacaattcctcccttgctcggcggtggattgcgaaggcccgtcccttcgacttcctgaagctggatttttaactgtccagaactttcctccaacttcatgggggcccacgggtgtgggcgctggcagtctcagcctccctccacggtcaccttcaacgcccagacactcccttctcccaccttagttggttacagggtgagtgagataaccaatgccaaactttttgaagtctaatttttgaggggtgagctcatttcattctctagtgtctaaaacctggtatgggtttggccagcgtcatggaaagatgtggttactgagatttgggaagaagcatgaagctttgtgtgggttggaagagactgaagatatgggttataaaatgttaattctaattgcatacggatgcctggcaaccttgcctttgagaatgagacagcctgcgcttagattttaccggtctgtaaaatggaaatgttgaggtcacctggaaagctttgttaaggagttgatgtttgctttccttaacaagacagcaaaacgtaaacagaaattgaaaacttgaaggatatttcagtgtcatggacttcctcaaaatgaagtgctattttcttatttttaatcaaataactagacatatatcagaaactttaaaatgtaaaagttgtacactttcaacattttattacgattattattcagcagcacattctgaggggggaacaattcacaccaccaataataacctggtaagatttcaggaggtaaagaaggtggaataattgacggggagatagcgcctgaaataaacaaaatatgggcatgcatgctaaagggaaaatgtgtgcaggtctactgcattaaatcctgtgtgctcctcttttggatttacagaaatgtgtcaaatgtaaatctttcaaagccatttaaaaatattcactttagttctctgtgaagaagaggagaaaagcaatcctcctgattgtattgttttaaactttaagaatttatcaaaatgccggtacttaggacctaaatttatctatgtctgtcatacgctaaaatgatattggtctttgaatttggtatacatttattctgttcactatcacaaaatcatctatatttatagaggaatagaagtttatatatatataataccatatttttaatttcacaaataaaaaattcaaagttttgtacaaaattatatggattttgtgcctgaaaataatagagcttgagctgtctgaactattttacattttatggtgtctcatagccaatcccacagtgtaaaaattcaggaattcaatgaaaaaagtctacccttaaaccctcagatcagtctttccaaagaattactctgtttgcattgttgtgattgacatttgtgaagtcccaagaaaagatctgttttcatgacagtagaaaatagaagtttgcaaattatttctttactcaaagaggattaaaagagaactctaattttaatattaaagctttcttttctttcagggaataaatttacatgactttttatattatggaggtttatttttaaatcatcacctttctcatattttttagaggtattgtcttatctcttccataatcttggatattacaaaaccctaaataggcaatcaataaatggttaactg

SEQ ID NO: 428042 - DNA, 4750 bp, Homo sapiens
ggtccctgagcctccagttctgcgtcggtttcaaggctcctccctcctggtgaaagacagactacggggcgcctggaaaccggtccgagggcgcgcgaggcagaggagagggagcgagttgagggattgacacaaatggtcaggcggcggcggcggagaaggaggcggaggcgcaggggggagccgagcccgctgggctgcggagagttgcgctctctacggggccgcggccactagcgcggcgccgccagccgggagccagcgagccgagggccaggaaggcgggacacgaccccggcgcgccctagccacccgggttctccccgccgcccgcgcttcatgaatcgcaagtttccgcggcggcggcggctgcggtacgcagaacaggagccgggggagcgggccgaaagcggcttgggctcgacggagggcacccgcgcagaggtctccctggccgcagggggagccgccgccggccgtgcccctggcagccccagcggagcggcgccaagagaggagccgagaaagtatggctgaggaggaggcgcctaagaagtcccgggccgccggcggtggcgcgagctgggaactttgtgccggggcgctctcggcccggctggcggaggagggcagcggggacgccggtggccgccgccgcccgccagttgacccccggcgattggcgcgccagctgctgctgctgctttggctgctggaggctccgctgctgctgggggtccgggcccaggcggcgggccaggggccaggccaggggcccgggccggggcagcaaccgccgccgccgcctcagcagcaacagagcgggcagcagtacaacggcgagcggggcatctccgtcccggaccacggctattgccagcccatctccatcccgctgtgcacggacatcgcgtacaaccagaccatcatgcccaacctgctgggccacacgaaccaggaggacgcgggcctggaggtgcaccagttctaccctctagtgaaagtgcagtgttccgctgagctcaagttcttcctgtgctccatgtacgcgcccgtgtgcaccgtgctagagcaggcgctgccgccctgccgctccctgtgcgagcgcgcgcgccagggctgcgaggcgctcatgaacaagttcggcttccagtggccagacacgctcaagtgtgagaagttcccggtgcacggcgccggcgagctgtgcgtgggccagaacacgtccgacaagggcaccccgacgccctcgctgcttccagagttctggaccagcaaccctcagcacggcggcggagggcaccgtggcggcttcccggggggcgccggcgcgtcggagcgaggcaagttctcctgcccgcgcgccctcaaggtgccctcctacctcaactaccacttcctgggggagaaggactgcggcgcaccttgtgagccgaccaaggtgtatgggctcatgtacttcgggcccgaggagctgcgcttctcgcgcacctggattggcatttggtcagtgctgtgctgcgcctccacgctcttcacggtgcttacgtacctggtggacatgcggcgcttcagctacccggagcggcccatcatcttcttgtccggctgttacacggccgtggccgtggcctacatcgccggcttcctcctggaagaccgagtggtgtgtaatgacaagttcgccgaggacggggcacgcactgtggcgcagggcaccaagaaggagggctgcaccatcctcttcatgatgctctacttcttcagcatggccagctccatctggtgggtgatcctgtcgctcacctggttcctggcggctggcatgaagtggggccacgaggccatcgaagccaactcacagtattttcacctggccgcctgggctgtgccggccatcaagaccatcaccatcctggcgctgggccaggtggacggcgatgtgctgagcggagtgtgcttcgtggggcttaacaacgtggacgcgctgcgtggcttcgtgctggcgcccctcttcgtgtacctgtttatcggcacgtcctttctgctggccggctttgtgtcgctcttccgcatccgcaccatcatgaagcacgatggcaccaagaccgagaagctggagaagctcatggtgcgcattggcgtcttcagcgtgctgtacactgtgccagccaccatcgtcatcgcctgctacttctacgagcaggccttccgggaccagtgggaacgcagctgggtggcccagagctgcaagagctacgctatcccctgccctcacctccaggcgggcggaggcgccccgccgcacccgcccatgagcccggacttcacggtcttcatgattaagtaccttatgacgctgatcgtgggcatcacgtcgggcttctggatctggtccggcaagaccctcaactcctggaggaagttctacacgaggctcaccaacagcaaacaaggggagactacagtctgagacccggggctcagcccatgcccaggcctcggccggggcgcagcgatcccccaaagccagcgccgtggagttcgtgccaatcctgacatctcgaggtttcctcactagacaactctctttcgcaggctcctttgaacaactcagctcctgcaaaagcttccgtccctgaggcaaaaggacacgagggcccgactgccagagggaggatggacagacctcttgccctcacactctggtaccaggactgttcgcttttatgattgtaaatagcctgtgtaagatttttgtaagtatatttgtatttaaatgacgaccgatcacgcgtttttctttttcaaaagtttttaattatttagggcggtttaaccatttgaggcttttccttcttgcccttttcggagtattgcaaaggagctaaaactggtgtgcaaccgcacagcgctcctggtcgtcctcgcgcgcctctccctaccacgggtgctcgggacggctgggcgccagctccggggcgagttcagcactgcggggtgcgactagggctgcgctgccagggtcacttcccgcctcctccttttgccccctccccctccttctgtcccggcccccatacattacaattcctcccttgctcggcggtggattgcgaaggcccgtcccttcgacttcctgaagctggatttttaactgtccagaactttcctccaacttcatgggggcccacgggtgtgggcgctggcagtctcagcctccctccacggtcaccttcaacgcccagacactcccttctcccaccttagttggttacagggtgagtgagataaccaatgccaaactttttgaagtctaatttttgaggggtgagctcatttcattctctagtgtctaaaacctggtatgggtttggccagcgtcatggaaagatgtggttactgagatttgggaagaagcatgaagctttgtgtgggttggaagagactgaagatatgggttataaaatgttaattctaattgcatacggatgcctggcaaccttgcctttgagaatgagacagcctgcgcttagattttaccggtctgtaaaatggaaatgttgaggtcacctggaaagctttgttaaggagttgatgtttgctttccttaacaagacagcaaaacgtaaacagaaattgaaaacttgaaggatatttcagtgtcatggacttcctcaaaatgaagtgctattttcttatttttaatcaaataactagacatatatcagaaactttaaaatgtaaaagttgtacactttcaacattttattacgattattattcagcagcacattctgaggggggaacaattcacaccaccaataataacctggtaagatttcaggaggtaaagaaggtggaataattgacggggagatagcgcctgaaataaacaaaatatgggcatgcatgctaaagggaaaatgtgtgcaggtctactgcattaaatcctgtgtgctcctcttttggatttacagaaatgtgtcaaatgtaaatctttcaaagccatttaaaaatattcactttagttctctgtgaagaagaggagaaaagcaatcctcctgattgtattgttttaaactttaagaatttatcaaaatgccggtacttaggacctaaatttatctatgtctgtcatacgctaaaatgatattggtctttgaatttggtatacatttattctgttcactatcacaaaatcatctatatttatagaggaatagaagtttatatatatataataccatatttttaatttcacaaataaaaaattcaaagttttgtacaaaattatatggattttgtgcctgaaaataatagagcttgagctgtctgaactattttacattttatggtgtctcatagccaatcccacagtgtaaaaattcaggaattcaatgaaaaaagtctacccttaaaccctcagatcagtctttccaaagaattactctgtttgcattgttgtgattgacatttgtgaagtcccaagaaaagatctgttttcatgacagtagaaaatagaagtttgcaaattatttctttactcaaagaggattaaaagagaactctaattttaatattaaagctttcttttctttcagggaataaatttacatgactttttatattatggaggtttatttttaaatcatcacctttctcatattttttagaggtattgtcttatctcttccataatcttggatattacaaaaccctaaataggcaatcaataaatggttaactg

SEQ ID NO: 428043 - DNA, 4671 bp, Homo sapiens
ggtccctgagcctccagttctgcgtcggtttcaaggctcctccctcctggtgaaagacagactacggggcgcctggaaaccggtccgagggcgcgcgaggcagaggagagggagcgagttgagggattgacacaaatggtcaggcggcggcggcggagaaggaggcggaggcgcaggggggagccgagcccgctgggctgcggagagttgcgctctctacggggccgcggccactagcgcggcgccgccagccgggagccagcgagccgagggccaggaaggcgggacacgaccccggcgcgccctagccacccgggttctccccgccgcccgcgcttcatgaatcgcaagtttccgcggcggcggcggctgcggtacgcagaacaggagccgggggagcgggccgaaagcggcttgggctcgacggagggcacccgcgcagaggtctccctggccgcagggggagccgccgccggccgtgcccctggcagccccagcggagcggcgccaagagaggagccgagaaagtatggctgaggaggaggcgcctaagaagtcccgggccgccggcggtggcgcgagctgggaactttgtgccggggcgctctcggcccggctggcggaggagggcagcggggacgccggtggccgccgccgcccgccagttgacccccggcgattggcgcgccagctgctgctgctgctttggctgctggaggctccgctgctgctgggggtccgggcccaggcggcgggccaggggccaggccaggggcccgggccggggcagcaaccgccgccgccgcctcagcagcaacagagcgggcagcagtacaacggcgagcggggcatctccgtcccggaccacggctattgccagcccatctccatcccgctgtgcacggacatcgcgtacaaccagaccatcatgcccaacctgctgggccacacgaaccaggaggacgcgggcctggaggtgcaccagttctaccctctagtgaaagtgcagtgttccgctgagctcaagttcttcctgtgctccatgtacgcgcccgtgtgcaccgtgctagagcaggcgctgccgccctgccgctccctgtgcgagcgcgcgcgccagggctgcgaggcgctcatgaacaagttcggcttccagtggccagacacgctcaagtgtgagaagttcccggtgcacggcgccggcgagctgtgcgtgggccagaacacgtccgacaagggcaccccgacgccctcgctgcttccagagttctggaccagcaaccctcagcacggcggcggagggcaccgtggcggcttcccggggggcgccggcgcgtcggagcgaggcaagttctcctgcccgcgcgccctcaaggtgccctcctacctcaactaccacttcctgggggagaaggactgcggcgcaccttgtgagccgaccaaggtgtatgggctcatgtacttcgggcccgaggagctgcgcttctcgcgcacctggattggcatttggtcagtgctgtgctgcgcctccacgctcttcacggtgcttacgtacctggtggacatgcggcgcttcagctacccggagcggcccatcatcttcttgtccggctgttacacggccgtggccgtggcctacatcgccggcttcctcctggaagaccgagtggtgtgtaatgacaagttcgccgaggacggggcacgcactgtggcgcagggcaccaagaaggagggctgcaccatcctcttcatgatgctctacttcttcagcatggccagctccatctggtgggtgatcctgtcgctcacctggttcctggcggctggcatgaagtggggccacgaggccatcgaagccaactcacagtattttcacctggccgcctgggctgtgccggccatcaagaccatcaccatcctggcgctgggccaggtggacggcgatgtgctgagcggagtgtgcttcgtggggcttaacaacgtggacgcgctgcgtggcttcgtgctggcgcccctcttcgtgtacctgtttatcggcacgtcctttctgctggccggctttgtgtcgctcttccgcatccgcaccatcatgaagcacgatggcaccaagaccgagaagctggagaagctcatggtgcgcattggcgtcttcagcgtgctgtacactgtgccagccaccatcgtcatcgcctgctacttctacgagcaggccttccgggaccagtgggaacgcagctgggtggcccagagctgcaagagctacgctatcccctgccctcacctccaggcgggcggaggcgccccgccgcacccgcccatgagcccggacttcacggtcttcatgattaagtaccttatgacgctgatcgtgggcatcacgtcgggcttctggatctggtccggcaagaccctcaactcctggaggaagttctacacgaggctcaccaacagcaaacaaggggagactacagtctgagacccggggctcagcccatgcccaggcctcggccggggcgcagcgatcccccaaagccagcgccgtggagttcgtgccaatcctgacatctcgaggtttcctcactagacaactctctttcgcaggctcctttgaacaactcagctcctgcaaaagcttccgtccctgaggcaaaaggacacgagggcccgactgccagagggaggatggacagacctcttgccctcacactctggtaccaggactgttcgcttttatgattgtaaatagcctgtgtaagatttttgtaagtatatttgtatttaaatgacgaccgatcacgcgtttttctttttcaaaagtttttaattatttagggcggtttaaccatttgaggcttttccttcttgcccttttcggagtattgcaaaggagctaaaactggtgtgcaaccgcacagcgctcctggtcgtcctcgcgcgcctctccctaccacgggtgctcgggacggctgggcgccagctccggggcgagttcagcactgcggggtgcgactagggctgcgctgccagggtcacttcccgcctcctccttttgccccctccccctccttctgtcccctccctttctttcctggcttgaggtaggggctcttaaggtacagaactccacaaaccttccaaatctggaggagggcccccatacattacaattcctccactcccttctcccaccttagttggttacagggtgagtgagataaccaatgccaaactttttgaagtctaatttttgaggggtgagctcatttcattctctagtgtctaaaacctggtatgggtttggccagcgtcatggaaagatgtggttactgagatttgggaagaagcatgaagctttgtgtgggttggaagagactgaagatatgggttataaaatgttaattctaattgcatacggatgcctggcaaccttgcctttgagaatgagacagcctgcgcttagattttaccggtctgtaaaatggaaatgttgaggtcacctggaaagctttgttaaggagttgatgtttgctttccttaacaagacagcaaaacgtaaacagaaattgaaaacttgaaggatatttcagtgtcatggacttcctcaaaatgaagtgctattttcttatttttaatcaaataactagacatatatcagaaactttaaaatgtaaaagttgtacactttcaacattttattacgattattattcagcagcacattctgaggggggaacaattcacaccaccaataataacctggtaagatttcaggaggtaaagaaggtggaataattgacggggagatagcgcctgaaataaacaaaatatgggcatgcatgctaaagggaaaatgtgtgcaggtctactgcattaaatcctgtgtgctcctcttttggatttacagaaatgtgtcaaatgtaaatctttcaaagccatttaaaaatattcactttagttctctgtgaagaagaggagaaaagcaatcctcctgattgtattgttttaaactttaagaatttatcaaaatgccggtacttaggacctaaatttatctatgtctgtcatacgctaaaatgatattggtctttgaatttggtatacatttattctgttcactatcacaaaatcatctatatttatagaggaatagaagtttatatatatataataccatatttttaatttcacaaataaaaaattcaaagttttgtacaaaattatatggattttgtgcctgaaaataatagagcttgagctgtctgaactattttacattttatggtgtctcatagccaatcccacagtgtaaaaattcaggaattcaatgaaaaaagtctacccttaaaccctcagatcagtctttccaaagaattactctgtttgcattgttgtgattgacatttgtgaagtcccaagaaaagatctgttttcatgacagtagaaaatagaagtttgcaaattatttctttactcaaagaggattaaaagagaactctaattttaatattaaagctttcttttctttcagggaataaatttacatgactttttatattatggaggtttatttttaaatcatcacctttctcatattttttagaggtattgtcttatctcttccataatcttggatattacaaaaccctaaataggcaatcaataaatggttaactg

SEQ ID NO: 428044 - DNA, 4552 bp, Homo sapiens
ggtccctgagcctccagttctgcgtcggtttcaaggctcctccctcctggtgaaagacagactacggggcgcctggaaaccggtccgagggcgcgcgaggcagaggagagggagcgagttgagggattgacacaaatggtcaggcggcggcggcggagaaggaggcggaggcgcaggggggagccgagcccgctgggctgcggagagttgcgctctctacggggccgcggccactagcgcggcgccgccagccgggagccagcgagccgagggccaggaaggcgggacacgaccccggcgcgccctagccacccgggttctccccgccgcccgcgcttcatgaatcgcaagtttccgcggcggcggcggctgcggtacgcagaacaggagccgggggagcgggccgaaagcggcttgggctcgacggagggcacccgcgcagaggtctccctggccgcagggggagccgccgccggccgtgcccctggcagccccagcggagcggcgccaagagaggagccgagaaagtatggctgaggaggaggcgcctaagaagtcccgggccgccggcggtggcgcgagctgggaactttgtgccggggcgctctcggcccggctggcggaggagggcagcggggacgccggtggccgccgccgcccgccagttgacccccggcgattggcgcgccagctgctgctgctgctttggctgctggaggctccgctgctgctgggggtccgggcccaggcggcgggccaggggccaggccaggggcccgggccggggcagcaaccgccgccgccgcctcagcagcaacagagcgggcagcagtacaacggcgagcggggcatctccgtcccggaccacggctattgccagcccatctccatcccgctgtgcacggacatcgcgtacaaccagaccatcatgcccaacctgctgggccacacgaaccaggaggacgcgggcctggaggtgcaccagttctaccctctagtgaaagtgcagtgttccgctgagctcaagttcttcctgtgctccatgtacgcgcccgtgtgcaccgtgctagagcaggcgctgccgccctgccgctccctgtgcgagcgcgcgcgccagggctgcgaggcgctcatgaacaagttcggcttccagtggccagacacgctcaagtgtgagaagttcccggtgcacggcgccggcgagctgtgcgtgggccagaacacgtccgacaagggcaccccgacgccctcgctgcttccagagttctggaccagcaaccctcagcacggcggcggagggcaccgtggcggcttcccggggggcgccggcgcgtcggagcgaggcaagttctcctgcccgcgcgccctcaaggtgccctcctacctcaactaccacttcctgggggagaaggactgcggcgcaccttgtgagccgaccaaggtgtatgggctcatgtacttcgggcccgaggagctgcgcttctcgcgcacctggattggcatttggtcagtgctgtgctgcgcctccacgctcttcacggtgcttacgtacctggtggacatgcggcgcttcagctacccggagcggcccatcatcttcttgtccggctgttacacggccgtggccgtggcctacatcgccggcttcctcctggaagaccgagtggtgtgtaatgacaagttcgccgaggacggggcacgcactgtggcgcagggcaccaagaaggagggctgcaccatcctcttcatgatgctctacttcttcagcatggccagctccatctggtgggtgatcctgtcgctcacctggttcctggcggctggcatgaagtggggccacgaggccatcgaagccaactcacagtattttcacctggccgcctgggctgtgccggccatcaagaccatcaccatcctggcgctgggccaggtggacggcgatgtgctgagcggagtgtgcttcgtggggcttaacaacgtggacgcgctgcgtggcttcgtgctggcgcccctcttcgtgtacctgtttatcggcacgtcctttctgctggccggctttgtgtcgctcttccgcatccgcaccatcatgaagcacgatggcaccaagaccgagaagctggagaagctcatggtgcgcattggcgtcttcagcgtgctgtacactgtgccagccaccatcgtcatcgcctgctacttctacgagcaggccttccgggaccagtgggaacgcagctgggtggcccagagctgcaagagctacgctatcccctgccctcacctccaggcgggcggaggcgccccgccgcacccgcccatgagcccggacttcacggtcttcatgattaagtaccttatgacgctgatcgtgggcatcacgtcgggcttctggatctggtccggcaagaccctcaactcctggaggaagttctacacgaggctcaccaacagcaaacaaggggagactacagtctgagacccggggctcagcccatgcccaggcctcggccggggcgcagcgatcccccaaagccagcgccgtggagttcgtgccaatcctgacatctcgaggtttcctcactagacaactctctttcgcaggctcctttgaacaactcagctcctgcaaaagcttccgtccctgaggcaaaaggacacgagggcccgactgccagagggaggatggacagacctcttgccctcacactctggtaccaggactgttcgcttttatgattgtaaatagcctgtgtaagatttttgtaagtatatttgtatttaaatgacgaccgatcacgcgtttttctttttcaaaagtttttaattatttagggcggtttaaccatttgaggcttttccttcttgcccttttcggagtattgcaaaggagctaaaactggtgtgcaaccgcacagcgctcctggtcgtcctcgcgcgcctctccctaccacgggtgctcgggacggctgggcgccagctccggggcgagttcagcactgcggggtgcgactagggctgcgctgccagggtcacttcccgcctcctccttttgccccctccccctccttctgtcccctccctttctttcctggcttgaggtaggggctcttaaggtacagaactccacaaaccttccaaatctggaggagggcccccatacattacaattcctcccttgctcggcggtggattgcgaaggcccgtcccttcgacttcctgaagctggatttttaactgtccagaactttcctccaacttcatgggggcccacgggtgtgggcgctggcagtctcagcctccctccacggtcaccttcaacgcccagacactcccttctcccaccttagttggttacagggtgagtgagataaccaatgccaaactttttgaagtctaatttttgaggggtgagctcatttcattctctagtgtctaaaacctggtatgggtttggccagcgtcatggaaagatgtggttactgagatttgggaagaagcatgaagctttgtgtgggttggaagagactgaagatatgggttataaaatgttaattctaattgcatacggatgcctggcaaccttgcctttgagaatgagacagcctgcgcttagattttaccggtctgtaaaatggaaatgttgaggtcacctggaaagctttgttaaggagttgatgtttgctttccttaacaagacagcaaaacgtaaacagaaattgaaaacttgaaggatatttcagtgtcatggacttcctcaaaatgaagtgctattttcttatttttaatcaaataactagacatatatcagaaactttaaaatgtaaaagttgtacactttcaacattttattacgattattattcagcagcacattctgaggggggaacaattcacaccaccaataataacctggtaagatttcaggaggtaaagaaggtggaataattgacggggagatagcgcctgaaataaacaaaatatgggcatgcatgctaaagggaaaatgtgtgcaggtctactgcattaaatcctgtgtgctcctcttttggatttacagaaatgtgtcaaatgtaaatctttcaaagccatttaaaaatattcactttagttctctgtgaagaagaggagaaaagcaatcctcctgattgtattgttttaaactttaagaatttatcaaaatgccggtacttaggacctaaatttatctatgtctgtcatacgctaaaatgatattggtctttgaatttggtatacatttattctgttcactatcacaaaatcatctatatttatagaggaatagaagtttatatatatataataccatatttttaatttcacaaataaaaaattcaaagttttgtagaacacaccaacaacccaaaacaacaaatgtggggggggccggggcccagaaaaaggtttttaaaccctcttgtttgggcgccggcccagtgggttagtgcacctgggcccaggcgtggtcccaagggaacctggccggcatggggctggtttccccaaataaaaacgcgggggcaccggcgtttggcaa

SEQ ID NO: 428045 - DNA, 3215 bp, Homo sapiens
ggtccctgagcctccagttctgcgtcggtttcaaggctcctccctcctggtgaaagacagactacggggcgcctggaaaccggtccgagggcgcgcgaggcagaggagagggagcgagttgagggattgacacaaatggtcaggcggcggcggcggagaaggaggcggaggcgcaggggggagccgagcccgctgggctgcggagagttgcgctctctacggggccgcggccactagcgcggcgccgccagccgggagccagcgagccgagggccaggaaggcgggacacgaccccggcgcgccctagccacccgggttctccccgccgcccgcgcttcatgaatcgcaagtttccgcggcggcggcggctgcggtacgcagaacaggagccgggggagcgggccgaaagcggcttgggctcgacggagggcacccgcgcagaggtctccctggccgcagggggagccgccgccggccgtgcccctggcagccccagcggagcggcgccaagagaggagccgagaaagtatggctgaggaggaggcgcctaagaagtcccggccaccatcgtcatcgcctgctacttctacgagcaggccttccgggaccagtgggaacgcagctgggtggcccagagctgcaagagctacgctatcccctgccctcacctccaggcgggcggaggcgccccgccgcacccgcccatgagcccggacttcacggtcttcatgattaagtaccttatgacgctgatcgtgggcatcacgtcgggcttctggatctggtccggcaagaccctcaactcctggaggaagttctacacgaggctcaccaacagcaaacaaggggagactacagtctgagacccggggctcagcccatgcccaggcctcggccggggcgcagcgatcccccaaagccagcgccgtggagttcgtgccaatcctgacatctcgaggtttcctcactagacaactctctttcgcaggctcctttgaacaactcagctcctgcaaaagcttccgtccctgaggcaaaaggacacgagggcccgactgccagagggaggatggacagacctcttgccctcacactctggtaccaggactgttcgcttttatgattgtaaatagcctgtgtaagatttttgtaagtatatttgtatttaaatgacgaccgatcacgcgtttttctttttcaaaagtttttaattatttagggcggtttaaccatttgaggcttttccttcttgcccttttcggagtattgcaaaggagctaaaactggtgtgcaaccgcacagcgctcctggtcgtcctcgcgcgcctctccctaccacgggtgctcgggacggctgggcgccagctccggggcgagttcagcactgcggggtgcgactagggctgcgctgccagggtcacttcccgcctcctccttttgccccctccccctccttctgtcccctccctttctttcctggcttgaggtaggggctcttaaggtacagaactccacaaaccttccaaatctggaggagggcccccatacattacaattcctcccttgctcggcggtggattgcgaaggcccgtcccttcgacttcctgaagctggatttttaactgtccagaactttcctccaacttcatgggggcccacgggtgtgggcgctggcagtctcagcctccctccacggtcaccttcaacgcccagacactcccttctcccaccttagttggttacagggtgagtgagataaccaatgccaaactttttgaagtctaatttttgaggggtgagctcatttcattctctagtgtctaaaacctggtatgggtttggccagcgtcatggaaagatgtggttactgagatttgggaagaagcatgaagctttgtgtgggttggaagagactgaagatatgggttataaaatgttaattctaattgcatacggatgcctggcaaccttgcctttgagaatgagacagcctgcgcttagattttaccggtctgtaaaatggaaatgttgaggtcacctggaaagctttgttaaggagttgatgtttgctttccttaacaagacagcaaaacgtaaacagaaattgaaaacttgaaggatatttcagtgtcatggacttcctcaaaatgaagtgctattttcttatttttaatcaaataactagacatatatcagaaactttaaaatgtaaaagttgtacactttcaacattttattacgattattattcagcagcacattctgaggggggaacaattcacaccaccaataataacctggtaagatttcaggaggtaaagaaggtggaataattgacggggagatagcgcctgaaataaacaaaatatgggcatgcatgctaaagggaaaatgtgtgcaggtctactgcattaaatcctgtgtgctcctcttttggatttacagaaatgtgtcaaatgtaaatctttcaaagccatttaaaaatattcactttagttctctgtgaagaagaggagaaaagcaatcctcctgattgtattgttttaaactttaagaatttatcaaaatgccggtacttaggacctaaatttatctatgtctgtcatacgctaaaatgatattggtctttgaatttggtatacatttattctgttcactatcacaaaatcatctatatttatagaggaatagaagtttatatatatataataccatatttttaatttcacaaataaaaaattcaaagttttgtacaaaattatatggattttgtgcctgaaaataatagagcttgagctgtctgaactattttacattttatggtgtctcatagccaatcccacagtgtaaaaattcaggaattcaatgaaaaaagtctacccttaaaccctcagatcagtctttccaaagaattactctgtttgcattgttgtgattgacatttgtgaagtcccaagaaaagatctgttttcatgacagtagaaaatagaagtttgcaaattatttctttactcaaagaggattaaaagagaactctaattttaatattaaagctttcttttctttcagggaataaatttacatgactttttatattatggaggtttatttttaaatcatcacctttctcatattttttagaggtattgtcttatctcttccataatcttggatattacaaaaccctaaataggcaatcaataaatggttaactg

SEQ ID NO: 428046 - DNA, 2607 bp, Homo sapiens
  misc_feature (1)..(1): n is a, c, g, or t
  misc_feature (37)..(37): n is a, c, g, or t
ncttaaggtacagaactccacaaaccttccaaatctnggaggagggcccccatacattacaattcctcccttgctcggcggtggattgcgaaggcccatgagcccggacttcacggtcttcatgattaagtaccttatgacgctgatcgtgggcatcacgtcgggcttctggatctggtccggcaagaccctcaactcctggaggaagttctacacgaggctcaccaacagcaaacaaggggagactacagtctgagacccggggctcagcccatgcccaggcctcggccggggcgcagcgatcccccaaagccagcgccgtggagttcgtgccaatcctgacatctcgaggtttcctcactagacaactctctttcgcaggctcctttgaacaactcagctcctgcaaaagcttccgtccctgaggcaaaaggacacgagggcccgactgccagagggaggatggacagacctcttgccctcacactctggtaccaggactgttcgcttttatgattgtaaatagcctgtgtaagatttttgtaagtatatttgtatttaaatgacgaccgatcacgcgtttttctttttcaaaagtttttaattatttagggcggtttaaccatttgaggcttttccttcttgcccttttcggagtattgcaaaggagctaaaactggtgtgcaaccgcacagcgctcctggtcgtcctcgcgcgcctctccctaccacgggtgctcgggacggctgggcgccagctccggggcgagttcagcactgcggggtgcgactagggctgcgctgccagggtcacttcccgcctcctccttttgccccctccccctccttctgtcccctccctttctttcctggcttgaggtaggggctcttaaggtacagaactccacaaaccttccaaatctggaggagggcccccatacattacaattcctcccttgctcggcggtggattgcgaaggcccgtcccttcgacttcctgaagctggatttttaactgtccagaactttcctccaacttcatgggggcccacgggtgtgggcgctggcagtctcagcctccctccacggtcaccttcaacgcccagacactcccttctcccaccttagttggttacagggtgagtgagataaccaatgccaaactttttgaagtctaatttttgaggggtgagctcatttcattctctagtgtctaaaacctggtatgggtttggccagcgtcatggaaagatgtggttactgagatttgggaagaagcatgaagctttgtgtgggttggaagagactgaagatatgggttataaaatgttaattctaattgcatacggatgcctggcaaccttgcctttgagaatgagacagcctgcgcttagattttaccggtctgtaaaatggaaatgttgaggtcacctggaaagctttgttaaggagttgatgtttgctttccttaacaagacagcaaaacgtaaacagaaattgaaaacttgaaggatatttcagtgtcatggacttcctcaaaatgaagtgctattttcttatttttaatcaaataactagacatatatcagaaactttaaaatgtaaaagttgtacactttcaacattttattacgattattattcagcagcacattctgaggggggaacaattcacaccaccaataataacctggtaagatttcaggaggtaaagaaggtggaataattgacggggagatagcgcctgaaataaacaaaatatgggcatgcatgctaaagggaaaatgtgtgcaggtctactgcattaaatcctgtgtgctcctcttttggatttacagaaatgtgtcaaatgtaaatctttcaaagccatttaaaaatattcactttagttctctgtgaagaagaggagaaaagcaatcctcctgattgtattgttttaaactttaagaatttatcaaaatgccggtacttaggacctaaatttatctatgtctgtcatacgctaaaatgatattggtctttgaatttggtatacatttattctgttcactatcacaaaatcatctatatttatagaggaatagaagtttatatatatataataccatatttttaatttcacaaataaaaaattcaaagttttgtacaaaattatatggattttgtgcctgaaaataatagagcttgagctgtctgaactattttacattttatggtgtctcatagccaatcccacagtgtaaaaattcaggaattcaatgaaaaaagtctacccttaaaccctcagatcagtctttccaaagaattactctgtttgcattgttgtgattgacatttgtgaagtcccaagaaaagatctgttttcatgacagtagaaaatagaagtttgcaaattatttctttactcaaagaggattaaaagagaactctaattttaatattaaagctttcttttctttcagggaataaatttacatgactttttatattatggaggtttatttttaaatcatcacctttctcatattttttagaggtattgtcttatctcttccataatcttggatattacaaaaccctaaataggcaatcaataaatggttaactg

SEQ ID NO: 428047 - DNA, 3543 bp, Homo sapiens
ggtccctgagcctccagttctgcgtcggtttcaaggctcctccctcctggtgaaagacagactacggggcgcctggaaaccggtccgagggcgcgcgaggcagaggagagggagcgagttgagggattgacacaaatggtcaggcggcggcggcggagaaggaggcggaggcgcaggggggagccgagcccgctgggctgcggagagttgcgctctctacggggccgcggccactagcgcggcgccgccagccgggagccagcgagccgagggccaggaaggcgggacacgaccccggcgcgccctagccacccgggttctccccgccgcccgcgcttcatgaatcgcaagtttccgcggcggcggcggctgcggtacgcagaacaggagccgggggagcgggccgaaagcggcttgggctcgacggagggcacccgcgcagaggtctccctggccgcagggggagccgccgccggccgtgcccctggcagccccagcggagcggcgccaagagaggagccgagaaagtatggctgaggaggaggcgcctaagaagtcccgggccgccggcggtggcgcgagctgggaactttgtgccggggcgctctcggcccggctggcggaggagggcagcggggacgccggtggccgccgccgcccgccagttgacccccggcgattggcgcgccagctgctgctgctgctttggctgctggaggctccgctgctgctgggggtccgggcccaggcggcgggccaggggccaggccaggggcccgggccggggcagcaaccgccgccgccgcctcagcagcaacagagcgggcagcagtacaacggcgagcggggcatctccgtcccggaccacggctattgccagcccatctccatcccgctgtgcacggacatcgcgtacaaccagaccatcatgcccaacctgctgggccacacgaaccaggaggacgcgggcctggaggtgcaccagttctaccctctagtgaaagtgcagtgttccgctgagctcaagttcttcctgtgctccatgtacgcgcccgtgtgcaccgtgctagagcaggcgctgccgccctgccgctccctgtgcgagcgcgcgcgccagggctgcgaggcgctcatgaacaagttcggcttccagtggccagacacgctcaagtgtgagaagttcccggtgcacggcgccggcgagctgtgcgtgggccagaacacgtccgacaagggcaccccgacgccctcgctgcttccagagttctggaccagcaaccctcagcacggcggcggagggcaccgtggcggcttcccggggggcgccggcgcgtcggagcgaggcaagttctcctgcccgcgcgccctcaaggtgccctcctacctcaactaccacttcctgggggagaaggactgcggcgcaccttgtgagccgaccaaggtgtatgggctcatgtacttcgggcccgaggagctgcgcttctcgcgcacctggattggcatttggtcagtgctgtgctgcgcctccacgctcttcacggtgcttacgtacctggtggacatgcggcgcttcagctacccggagcggcccatcatcttcttgtccggctgttacacggccgtggccgtggcctacatcgccggcttcctcctggaagaccgagtggtgtgtaatgacaagttcgccgaggacggggcacgcactgtggcgcagggcaccaagaaggagggctgcaccatcctcttcatgatgctctacttcttcagcatggccagctccatctggtgggtgatcctgtcgctcacctggttcctggcggctggcatgaagtggggccacgaggccatcgaagccaactcacagtattttcacctggccgcctgggctgtgccggccatcaagaccatcaccatcctggcgctgggccaggtggacggcgatgtgctgagcggagtgtgcttcgtggggcttaacaacgtggacgcgctgcgtggcttcgtgctggcgcccctcttcgtgtacctgtttatcggcacgtcctttctgctggccggctttgtgtcgctcttccgcatccgcaccatcatgaagcacgatggcaccaagaccgagaagctggagaagctcatggtgcgcattggcgtcttcagcgtgctgtacactgtgccagccaccatcgtcatcgcctgctacttctacgagcaggccttccgggaccagtgggaacgcagctgggtggcccagagctgcaagagctacgctatcccctgccctcacctccaggcgggcggaggcgccccgccgcacccgcccatgagcccggacttcacggtcttcatgattaagtaccttatgacgctgatcgtgggcatcacgtcgggcttctggatctggtccggcaagaccctcaactcctggaggaagttctacacgaggctcaccaacagcaaacaaggggagactacagtctgagacccggggctcagcccatgcccaggcctcggccggggcgcagcgatcccccaaagccagcgccgtggagttcgtgccaatcctgacatctcgaggtttcctcactagacaactctctttcgcaggctcctttgaacaactcagctcctgcaaaagcttccgtccctgaggcaaaaggacacgagggcccgactgccagagggaggatggacagacctcttgccctcacactctggtaccaggactgttcgcttttatgattgtaaatagcctgtgtaagatttttgtaagtatatttgtatttaaatgacgaccgatcacgcgtttttctttttcaaaagtttttaattatttagggcggtttaaccatttgaggcttttccttcttgcccttttcggagtattgcaaaggagctaaaactggtgtgcaaccgcacagcgctcctggtcgtcctcgcgcgcctctccctaccacgggtgctcgggacggctgggcgccagctccggggcgagttcagcactgcggggtgcgactagggctgcgctgccagggtcacttcccgcctcctccttttgccccctccccctccttctgtcccctccctttctttcctggcttgaggtaggggctcttaaggtacagaactccacaaaccttccaaatctggaggagggcccccatacattacaattcctcccttgctcggcggtggattgcgaaggcccgtcccttcgacttcctgaagctggatttttaactgtccagaactttcctccaacttcatgggggcccacgggtgtgggcgctggcagtctcagcctccctccacggtcaccttcaacgcccagacagcttccactttgcaggtagtcaacctcccctatctcctaccccgcacccagtagttaccagtctgacctgggttctcatcccgttgtgctaccagttgcacactacagctaccctcttgcatgccggccctaacaatatcctctctgcccgcgcgtaaacccatctccttcatgcaccggtcctaaaaaacagatgcacgttccccgagggaaccggg

SEQ ID NO: 428048 - DNA, 578 bp, Homo sapiens
atcatctatatttatagaggaatagaagtttatatatatataataccatatttttaatttcacaaataaaaaattcaaagttttgtacaaaattatatggattttgtgcctgaaaataatagagcttgagctgtctgaactattttacattttatggtgtctcatagccaatcccacagtgtaaaaattcaggaattcaatgaaaaaagtctacccttaaaccctcagatcagtctttccaaagaattactctgtttgcattgttgtgattgacatttgtgaagtcccaagaaaagatctgttttcatgacagtagaaaatagaagtttgcaaattatttctttactcaaagaggattaaaagagaactctaattttaatattaaagctttcttttctttcagggaataaatttacatgactttttatattatggaggtttatttttaaatcatcacctttctcatattttttagaggtattgtcttatctcttccataatcttggatattacaaaaccctaaataggcaatcaataaatggttaactggctatgtgttcataaacattttaaacagc

SEQ ID NO: 428049 - DNA, 3684 bp, Homo sapiens
ggtccccggctgcccgcagcccgctcgcggcgcttctccggcccggctccttctccgctcgttaacgtcgccaaccccccccacccctcatatctctctccacccacccaaccgccccccgctccttctcgccgcctcgagtccgcttgggggaaaacttcaaagagccggatcgcaggctccctgcctactcccccaccggggatttcagactagacgcttgaagcaaagctgccatcccagaagacgacatgctctcagcaacccccctgtatgggaacgttcacagctggatgaacagcgagagggtccgcatgtgtggggcgagcgaagacaggaaaatccttgtaaatgatggtgacgcttcaaaagccagactggaactgagggaagagaatcccttgaaccacaacgtggtggatgcgagcacggcccataggatcgatggcctggcagcactgagcatggaccgcactggcctgatccgggaagggctgcgggtcccgggaaacatcgtctattctagcttgtgtggactgggctcagagaaaggtcgggaggctgccacaagcactctaggtggccttgggttttcttcggaaagaaatccagagatgcagttcaaaccgaatacacccgagacagtggaggcttctgccgtctctggaaaacccccaaatggcttcagtgctatatacaaaacaccgcctggaatacaaaaaagtgctgtagccacagcagaagcgctgggcttggacaggcctgccagcgacaaacagagccctctcaacatcaatggtgctagttatctgcggctgccctgggtcaatccttacatggagggtgccacgccagccatctaccctttcctcgactcgccaaataagtattcactgaacatgtacaaggccttgctacctcagcagtcctacagcttggcccagccgctgtattctccagtctgcaccaatggggagcgctttctctacctgccgccacctcactacgtcggtccccacatcccatcgtccttggcatcacccatgaggctctcgacaccttcggcctccccagccatcccgcctctcgtccattgcgcagacaaaagcctcccgtggaagatgggcgtcagccctgggaatcctgttgattcccacgcctatcctcacatccagaacagtaagcagcccagggttccctctgccaaggcggtcaccagtggcctgccgggggacacagctctcctgttgcccccctcgcctcggccgtcaccccgagtccaccttcccacccagcctgctgcagacacctactcggagttccacaagcactatgccaggatctccacctctccttcagttgccctgtcaaagccatacatgacagttagcagcgagttccccgcggccaggctctccaatggcaagtatcccaaggctccggaagggggcgaaggtgcccagccagtgcccgggcatgcccggaagacagcggttcaagacagaaaagacggcagctcacctcctctgttggagaagcagaccgttaccaaagacgtcacagataagccactagacttgtcttctaaagtggtggatgtagatgcttccaaagctgaccacatgaaaaagatggctcccacggtcctggttcacagcagggctggaagtggcttagtgctctccggaagtgagattccgaaagaaacactatctcctccaggaaatggttgtgctatctatagatctgaaatcatcagcactgctccctcatcctgggtggtgcccgggccaagtcctaacgaagagaacaatggcaaaagcatgtcgctgaaaaacaaggcattggactgggcgataccacagcagcggagttcatcatgcccgcgcatgggcggcaccgatgctgtcatcactaacgtttcagggtcagtgtcgagtgcaggccgcccagcctccgcatcacccgcccccaatgccaatgcagatggcaccaaaaccagcaggagctctgtagaaaccacaccatccgttattcagcacgtgggccagcccccggccactcctgccaagcacagtagcagcaccagcagcaagggcgccaaagccagcaacccagaaccgagtttcaaagcaaacgagaacggccttccaccaagctctatatttctgtctccaaatgaggcattcaggtccccaccaattccctaccccaggagttacctcccttacccagcccctgagggcattgctgtaagtcccctctccttacatggcaaaggacctgtctaccctcacccagttttgttacccaatggcagtctgtttcctgggcaccttgccccaaagcctgggctgccctatgggcttcccaccggccgtccagagtttgtgacctaccaagatgccctggggttgggcatggtgcatcccatgttgataccacacacgcccatagagattactaaagaggagaaaccagagaggagatcccggtcccatgagagagcccgttacgaggacccaaccctccggaatcggttttccgagattttggaaactagcagcaccaagttacatccagatgtccccaccgacaagaacctaaagccgaaccccaactggaatcaagggaagactgttgtcaaaagcgacaagcttgtctacgtagaccttctccgagaagaaccagatgctaaaactgacacaaacgtgtccaaacccagctttgcagcagagagtgttggccagagcgctgagccccccaagccctcagttgagccggccctgcagcagcaccgtgatttcatcgccctgagagaggagttggggcgcatcagtgacttccacgaaacttatactttcaaacagccagtcttcaccgtaagcaaggacagtgttctggcaggtaccaacaaagagaacctagggttgccagtctcgactccattcctggagccacctctggggagcgatggccctgctgtaacttttggtaaaacccaagaggatcccaaaccattttgtgtgggcagtgccccaccaagtgtggatgtgacccccacctataccaaagatggagctgatgaggctgaatcaaatgatggcaaagttctgaaaccgaagccatctaagctggcaaagagaatcgccaactcagcgggttacgtgggtgaccgattcaaatgtgtcactaccgaactgtatgcagattccagtcagctcagccgggagcaacgggcattgcaggtgagcccccccacctgaatttcagttactttaccagttgtcagttttttaatgtgtaaacaggattgggggagtatggtagggcagggcaccaggcagatttggtgaatgaagcttgtggtaatttgaatatatgcaatgtggccagtaagagaacgtgagtggtagcactgaggcgtgtctggatgctttaagttattctgtagattataagggaactccactcaattgctgataaccgatgttttaattattgtgaagggtatctaaagactgcatgacgtttacctatcaattgctttgatttctctgcctgtaagatagcaaatatacctagaagtgctgcttagaatgccttacttgatacctggtagagatgtgtagcagccgcatgtctgtgggattcatgcaaatttttcaccaaaaagaaaggaaa

SEQ ID NO: 428050 - DNA, 462 bp, Homo sapiens
ctccttccctgctcataacatttcctttccttggaaacattgccttctgcagctgtagtatcagtttttgaaccacagtaatgggaagaaagacaaatggattcccttagaagtaagatttctatttgcaggatgagttgggcagggaaaagggtcagggttcatcaggtgaactcaacacaggtaaggagctgttagatctggtggaattcacgaacgaaattcagactctgctgggctcctctgtagagtggctccaccccagtgatctggcctcagacaactactggtgagcaagctggacccaccatgtacagtgtgttatagtgttaatccttgtgcatatgtgtcataatacaactatttctgtaaagaaaggacactattacatatgaaaatatctcttctttatataagagaaattactccagggaaggaggctcagggaaggaggcattgcca

SEQ ID NO: 428051 - DNA, 6297 bp, Homo sapiens
  misc_feature (6285)..(6285): n is a, c, g, or t
ggtccccggctgcccgcagcccgctcgcggcgcttctccggcccggctccttctccgctcgttaacgtcgccaaccccccccacccctcatatctctctccacccacccaaccgccccccgctccttctcgccgcctcgagtccgcttgggggaaaacttcaaagagccggatcgcaggctccctgcctactcccccaccggggatttcagactagacgcttgaagcaaagctgccatcccagaagacgacatgctctcagcaacccccctgtatgggaacgttcacagctggatgaacagcgagagggtccgcatgtgtggggcgagcgaagacaggaaaatccttgtaaatgatggtgacgcttcaaaagccagactggaactgagggaagagaatcccttgaaccacaacgtggtggatgcgagcacggcccataggatcgatggcctggcagcactgagcatggaccgcactggcctgatccgggaagggctgcgggtcccgggaaacatcgtctattctagcttgtgtggactgggctcagagaaaggtcgggaggctgccacaagcactctaggtggccttgggttttcttcggaaagaaatccagagatgcagttcaaaccgaatacacccgagacagtggaggcttctgccgtctctggaaaacccccaaatggcttcagtgctatatacaaaacaccgcctggaatacaaaaaagtgctgtagccacagcagaagcgctgggcttggacaggcctgccagcgacaaacagagccctctcaacatcaatggtgctagttatctgcggctgccctgggtcaatccttacatggagggtgccacgccagccatctaccctttcctcgactcgccaaataagtattcactgaacatgtacaaggccttgctacctcagcagtcctacagcttggcccagccgctgtattctccagtctgcaccaatggggagcgctttctctacctgccgccacctcactacgtcggtccccacatcccatcgtccttggcatcacccatgaggctctcgacaccttcggcctccccagccatcccgcctctcgtccattgcgcagacaaaagcctcccgtggaagatgggcgtcagccctgggaatcctgttgattcccacgcctatcctcacatccagaacagtaagcagcccagggttccctctgccaaggcggtcaccagtggcctgccgggggacacagctctcctgttgcccccctcgcctcggccgtcaccccgagtccaccttcccacccagcctgctgcagacacctactcggagttccacaagcactatgccaggatctccacctctccttcagttgccctgtcaaagccatacatgacagttagcagcgagttccccgcggccaggctctccaatggcaagtatcccaaggctccggaagggggcgaaggtgcccagccagtgcccgggcatgcccggaagacagcggttcaagacagaaaagacggcagctcacctcctctgttggagaagcagaccgttaccaaagacgtcacagataagccactagacttgtcttctaaagtggtggatgtagatgcttccaaagctgaccacatgaaaaagatggctcccacggtcctggttcacagcagggctggaagtggcttagtgctctccggaagtgagattccgaaagaaacactatctcctccaggaaatggttgtgctatctatagatctgaaatcatcagcactgctccctcatcctgggtggtgcccgggccaagtcctaacgaagagaacaatggcaaaagcatgtcgctgaaaaacaaggcattggactgggcgataccacagcagcggagttcatcatgcccgcgcatgggcggcaccgatgctgtcatcactaacgtttcagggtcagtgtcgagtgcaggccgcccagcctccgcatcacccgcccccaatgccaatgcagatggcaccaaaaccagcaggagctctgtagaaaccacaccatccgttattcagcacgtgggccagcccccggccactcctgccaagcacagtagcagcaccagcagcaagggcgccaaagccagcaacccagaaccgagtttcaaagcaaacgagaacggccttccaccaagctctatatttctgtctccaaatgaggcattcaggtccccaccaattccctaccccaggagttacctcccttacccagcccctgagggcattgctgtaagtcccctctccttacatggcaaaggacctgtctaccctcacccagttttgttacccaatggcagtctgtttcctgggcaccttgccccaaagcctgggctgccctatgggcttcccaccggccgtccagagtttgtgacctaccaagatgccctggggttgggcatggtgcatcccatgttgataccacacacgcccatagagattactaaagaggagaaaccagagaggagatcccggtcccatgagagagcccgttacgaggacccaaccctccggaatcggttttccgagattttggaaactagcagcaccaagttacatccagatgtccccaccgacaagaacctaaagccgaaccccaactggaatcaagggaagactgttgtcaaaagcgacaagcttgtctacgtagaccttctccgagaagaaccagatgctaaaactgacacaaacgtgtccaaacccagctttgcagcagagagtgttggccagagcgctgagccccccaagccctcagttgagccggccctgcagcagcaccgtgatttcatcgccctgagagaggagttggggcgcatcagtgacttccacgaaacttatactttcaaacagccagtcttcaccgtaagcaaggacagtgttctggcaggtaccaacaaagagaacctagggttgccagtctcgactccattcctggagccacctctggggagcgatggccctgctgtaacttttggtaaaacccaagaggatcccaaaccattttgtgtgggcagtgccccaccaagtgtggatgtgacccccacctataccaaagatggagctgatgaggctgaatcaaatgatggcaaagttctgaaaccgaagccatctaagctggcaaagagaatcgccaactcagcgggttacgtgggtgaccgattcaaatgtgtcactaccgaactgtatgcagattccagtcagctcagccgggagcaacgggcattgcagatggaaggattacaagaggacagtattttatgtctacccgctgcttactgtgagcgtgcaatgatgcgcttctcagagttggagatgaaagaaagagaaggtggccacccagcaaccaaagactccgagatgtgcaaattcagcccagccgactgggaaaggttgaaaggaaatcaggacaaaaagccaaagtcggtcaccctggaggaggccattgcagaacagaacgaaagtgagagatgcgagtatagtgttggaaacaagcaccgtgatccctttgaagccccagaggacaaagatcttcctgtggagaagtactttgtggagaggcagcctgtgagcgagcctcccgcagaccaggtggcctcggacatgcctcacagccccaccctccgggtggacaggaaacgcaaagtctcaggtgacagcagccacactgagaccactgcggaggaggtgccagaggaccctctgctgaaagccaaacgccgacgagtctctaaagggctccatcctaaaaaacaacgccacttgctgcaccttagagaacgatgggagcagcaggtgtcggcagcagatggcaaacctggccggcaaagcaggaaggaagtgacccaggccactcagcctgaggccattcctcaggggactaacatcactgaagagaaacctggcaggaaaagggcagaggccaaaggcaacagaagctggtcggaagagtctcttaaacccagtgacaatgaacaaggcttgcctgtgttctccggctctccgcccatgaagagtctttcatccaccagtgcaggcggcaaaaagcaggctcagccaagctgcgcaccagcctccaggccgcctgccaaacagcagaaaattaaagaaaaccagaagacagatgtgctgtgtgcagacgaagaagaggattgccaggctgcctccctgctgcagaaatacaccgacaacagcgagaagccatccgggaagagactgtgcaaaaccaaacacttgatccctcaggagtccaggcggggattgccactgacaggggaatactacgtggagaatgccgatggcaaggtgactgtccggagattcagaaagcggccggagcccagttcggactatgatctgtcaccagccaagcaggagccaaagcccttcgaccgcttgcagcaactgctaccagcctcccagtccacacagctgccatgctcaagttcccctcaggagaccacccagtctcgccctatgccgccggaagcacggagacttattgtcaataagaacgctggcgagacccttctgcagcgggcagccaggcttggctatgaggaagtggtcctgtactgcttagagaacaagatttgtgatgtaaatcatcgggacaacgcaggttactgcgccctgcatgaagcttgtgctaggggctggctcaacattgtgcgacacctccttgaatatggcgctgatgtcaactgtagtgcccaggatggaaccaggcctctgcacgatgctgttgagaacgatcacttggaaattgtccgactacttctctcttatggtgctgaccccaccttggctacgtactcaggtagaaccatcatgaaaatgacccacagtgaacttatggaaaagttcttaacagattatttaaatgacctccagggtcgcaatgatgatgacgccagtggcacttgggacttctatggcagctctgtttgtgaaccagatgatgaaagtggctatgatgttttagccaaccccccaggaccagaagaccaggatgatgatgacgatgcctatagcgatgtgtttgaatttgaattttcagagacccccctcttaccgtgttataacatccaagtatctgtggctcaggggccacgaaactggctactgctttcggatgtccttaagaaattgaaaatgtcctcccgcatatttcgctgcaattttccaaacgtggaaattgtcaccattgcagaggcagaattttatcggcaggtttctgcaagtctcttgttctcttgctccaaagacctggaagccttcaaccctgaaagtaaggagctgttagatctggtggaattcacgaacgaaattcagactctgctgggctcctctgtagagtggctccaccccagtgatctggcctcagacaactactggtgagcaagctggacccaccatgtacagtgtgttatagtgttaatccttgtgcatatgtgtcataatacaactatttctgtaaagaaaggacactattacatatgaaaatatctcttctttatataagagaaattactccagtcagaaggacttagaaacatgtttttttccttttaaacttttaagtcagtttttatgaagttgttataatgtttctttacttttcaatgcacacatgctttgggatacgtttgtttttacttggaacatttgtttcttttcttttttaaggagaaaaaaaaatgagtaaaaggagctccacactttgacttaatttcatacaaagctctgatgacaggccatgactgtagagtggtcagaactgtgtggttggtttgagggagcgaattcggggaaggcacttggtgatataactttgttttgtttacagagtacctgctcgggccaggtaaatgctattggatgtaatccagtagtgtgtaatataaattcaaaccatatccacacacaacaactaattgtatgaaacttttatatcctaatttaaaagctgtgaaattagttttcacgcatcaaaccggattgtttatatgtttaaacattttatgctcttatttaaagaagactttgagctatttttttctgtaccctgtaaaatattgaaaactaacataatatgttgaggttgcttggaaatgtacataaaactaaaattttctgaatcgtgtgtttatgtttgaaatctgtgttttaactttgtaagtaaattctctgcctttgtatttatattttacaaaaattttcttaaaaggcaataaaactgttgaggaaaggagaaaaaaaaactatnaaaaaaaaagaa

SEQ ID NO: 428052 - DNA, 6434 bp, Homo sapiens
gtatttccgaagctggccaggccctctgctgctgaccctggaaatcgggtcacactagacaaggctgcatgtgcggggagaaggcgggggggctcctttgcacgcggctgctcgcgtttccccaaggcctccaaatagtctaaaaactcacctcggaggaggagaaagagcgtgaagtggctctttcgatctgagacaccccctcccggagaactcgccccctcccccccagcccagagcggagtgaaatcttagaagccgtggctgctgggtttgaacggaatgctggagtcagtggaagacggagctggtcggcccgaagactagacgcttgaagcaaagctgccatcccagaagacgacatgctctcagcaacccccctgtatgggaacgttcacagctggatgaacagcgagagggtccgcatgtgtggggcgagcgaagacaggaaaatccttgtaaatgatggtgacgcttcaaaagccagactggaactgagggaagagaatcccttgaaccacaacgtggtggatgcgagcacggcccataggatcgatggcctggcagcactgagcatggaccgcactggcctgatccgggaagggctgcgggtcccgggaaacatcgtctattctagcttgtgtggactgggctcagagaaaggtcgggaggctgccacaagcactctaggtggccttgggttttcttcggaaagaaatccagagatgcagttcaaaccgaatacacccgagacagtggaggcttctgccgtctctggaaaacccccaaatggcttcagtgctatatacaaaacaccgcctggaatacaaaaaagtgctgtagccacagcagaagcgctgggcttggacaggcctgccagcgacaaacagagccctctcaacatcaatggtgctagttatctgcggctgccctgggtcaatccttacatggagggtgccacgccagccatctaccctttcctcgactcgccaaataagtattcactgaacatgtacaaggccttgctacctcagcagtcctacagcttggcccagccgctgtattctccagtctgcaccaatggggagcgctttctctacctgccgccacctcactacgtcggtccccacatcccatcgtccttggcatcacccatgaggctctcgacaccttcggcctccccagccatcccgcctctcgtccattgcgcagacaaaagcctcccgtggaagatgggcgtcagccctgggaatcctgttgattcccacgcctatcctcacatccagaacagtaagcagcccagggttccctctgccaaggcggtcaccagtggcctgccgggggacacagctctcctgttgcccccctcgcctcggccgtcaccccgagtccaccttcccacccagcctgctgcagacacctactcggagttccacaagcactatgccaggatctccacctctccttcagttgccctgtcaaagccatacatgacagttagcagcgagttccccgcggccaggctctccaatggcaagtatcccaaggctccggaagggggcgaaggtgcccagccagtgcccgggcatgcccggaagacagcggttcaagacagaaaagacggcagctcacctcctctgttggagaagcagaccgttaccaaagacgtcacagataagccactagacttgtcttctaaagtggtggatgtagatgcttccaaagctgaccacatgaaaaagatggctcccacggtcctggttcacagcagggctggaagtggcttagtgctctccggaagtgagattccgaaagaaacactatctcctccaggaaatggttgtgctatctatagatctgaaatcatcagcactgctccctcatcctgggtggtgcccgggccaagtcctaacgaagagaacaatggcaaaagcatgtcgctgaaaaacaaggcattggactgggcgataccacagcagcggagttcatcatgcccgcgcatgggcggcaccgatgctgtcatcactaacgtttcagggtcagtgtcgagtgcaggccgcccagcctccgcatcacccgcccccaatgccaatgcagatggcaccaaaaccagcaggagctctgtagaaaccacaccatccgttattcagcacgtgggccagcccccggccactcctgccaagcacagtagcagcaccagcagcaagggcgccaaagccagcaacccagaaccgagtttcaaagcaaacgagaacggccttccaccaagctctatatttctgtctccaaatgaggcattcaggtccccaccaattccctaccccaggagttacctcccttacccagcccctgagggcattgctgtaagtcccctctccttacatggcaaaggacctgtctaccctcacccagttttgttacccaatggcagtctgtttcctgggcaccttgccccaaagcctgggctgccctatgggcttcccaccggccgtccagagtttgtgacctaccaagatgccctggggttgggcatggtgcatcccatgttgataccacacacgcccatagagattactaaagaggagaaaccagagaggagatcccggtcccatgagagagcccgttacgaggacccaaccctccggaatcggttttccgagattttggaaactagcagcaccaagttacatccagatgtccccaccgacaagaacctaaagccgaaccccaactggaatcaagggaagactgttgtcaaaagcgacaagcttgtctacgtagaccttctccgagaagaaccagatgctaaaactgacacaaacgtgtccaaacccagctttgcagcagagagtgttggccagagcgctgagccccccaagccctcagttgagccggccctgcagcagcaccgtgatttcatcgccctgagagaggagttggggcgcatcagtgacttccacgaaacttatactttcaaacagccagtcttcaccgtaagcaaggacagtgttctggcaggtaccaacaaagagaacctagggttgccagtctcgactccattcctggagccacctctggggagcgatggccctgctgtaacttttggtaaaacccaagaggatcccaaaccattttgtgtgggcagtgccccaccaagtgtggatgtgacccccacctataccaaagatggagctgatgaggctgaatcaaatgatggcaaagttctgaaaccgaagccatctaagctggcaaagagaatcgccaactcagcgggttacgtgggtgaccgattcaaatgtgtcactaccgaactgtatgcagattccagtcagctcagccgggagcaacgggcattgcagatggaaggattacaagaggacagtattttatgtctacccgctgcttactgtgagcgtgcaatgatgcgcttctcagagttggagatgaaagaaagagaaggtggccacccagcaaccaaagactccgagatgtgcaaattcagcccagccgactgggaaaggttgaaaggaaatcaggacaaaaagccaaagtcggtcaccctggaggaggccattgcagaacagaacgaaagtgagagatgcgagtatagtgttggaaacaagcaccgtgatccctttgaagccccagaggacaaagatcttcctgtggagaagtactttgtggagaggcagcctgtgagcgagcctcccgcagaccaggtggcctcggacatgcctcacagccccaccctccgggtggacaggaaacgcaaagtctcaggtgacagcagccacactgagaccactgcggaggaggtgccagaggaccctctgctgaaagccaaacgccgacgagtctctaaagggctccatcctaaaaaacaacgccacttgctgcaccttagagaacgatgggagcagcaggtgtcggcagcagatggcaaacctggccggcaaagcaggaaggaagtgacccaggccactcagcctgaggccattcctcaggggactaacatcactgaagagaaacctggcaggaaaagggcagaggccaaaggcaacagaagctggtcggaagagtctcttaaacccagtgacaatgaacaaggcttgcctgtgttctccggctctccgcccatgaagagtctttcatccaccagtgcaggcggcaaaaagcaggctcagccaagctgcgcaccagcctccaggccgcctgccaaacagcagaaaattaaagaaaaccagaagacagatgtgctgtgtgcagacgaagaagaggattgccaggctgcctccctgctgcagaaatacaccgacaacagcgagaagccatccgggaagagactgtgcaaaaccaaacacttgatccctcaggagtccaggcggggattgccactgacaggggaatactacgtggagaatgccgatggcaaggtgactgtccggagattcagaaagcggccggagcccagttcggactatgatctgtcaccagccaagcaggagccaaagcccttcgaccgcttgcagcaactgctaccagcctcccagtccacacagctgccatgctcaagttcccctcaggagaccacccagtctcgccctatgccgccggaagcacggagacttattgtcaataagaacgctggcgagacccttctgcagcgggcagccaggcttggctatgaggaagtggtcctgtactgcttagagaacaagatttgtgatgtaaatcatcgggacaacgcaggttactgcgccctgcatgaagcttgtgctaggggctggctcaacattgtgcgacacctccttgaatatggcgctgatgtcaactgtagtgcccaggatggaaccaggcctctgcacgatgctgttgagaacgatcacttggaaattgtccgactacttctctcttatggtgctgaccccaccttggctacgtactcaggtagaaccatcatgaaaatgacccacagtgaacttatggaaaagttcttaacagattatttaaatgacctccagggtcgcaatgatgatgacgccagtggcacttgggacttctatggcagctctgtttgtgaaccagatgatgaaagtggctatgatgttttagccaaccccccaggaccagaagaccaggatgatgatgacgatgcctatagcgatgtgtttgaatttgaattttcagagacccccctcttaccgtgttataacatccaagtatctgtggctcaggggtgagcatggctgtcatgtgattgaaaactagctgagctgctcttgaggccacgaaactggctactgctttcggatgtccttaagaaattgaaaatgtcctcccgcatatttcgctgcaattttccaaacgtggaaattgtcaccattgcagaggcagaattttatcggcaggtttctgcaagtctcttgttctcttgctccaaagacctggaagccttcaaccctgaaagtaaggagctgttagatctggtggaattcacgaacgaaattcagactctgctgggctcctctgtagagtggctccaccccagtgatctggcctcagacaactactggtgagcaagctggacccaccatgtacagtgtgttatagtgttaatccttgtgcatatgtgtcataatacaactatttctgtaaagaaaggacactattacatatgaaaatatctcttctttatataagagaaattactccagtcagaaggacttagaaacatgtttttttccttttaaacttttaagtcagtttttatgaagttgttataatgtttctttacttttcaatgcacacatgctttgggatacgtttgtttttacttggaacatttgtttcttttcttttttaaggagaaaaaaaaatgagtaaaaggagctccacactttgacttaatttcatacaaagctctgatgacaggccatgactgtagagtggtcagaactgtgtggttggtttgagggagcgaattcggggaaggcacttggtgatataactttgttttgtttacagagtacctgctcgggccaggtaaatgctattggatgtaatccagtagtgtgtaatataaattcaaaccatatccacacacaacaactaattgtatgaaacttttatatcctaatttaaaagctgtgaaattagttttcacgcatcaaaccggattgtttatatgtttaaacattttatgctcttatttaaagaagactttgagctatttttttctgtaccctgtaaaatattgaaaactaacataatatgttgaggttgcttggaaatgtacataaaactaaaattttctgaatcgtgtgtttatgtttgaaatctgtgttttaactttgtaagtaaattctctgcctttgtatttatattttacaaaaattttcttaaaaggcaataaaactgttgaggaaaggagaaaa

SEQ ID NO: 428053 - DNA, 6380 bp, Homo sapiens
gtatttccgaagctggccaggccctctgctgctgaccctggaaatcgggtcacactagacaaggctgcatgtgcggggagaaggcgggggggctcctttgcacgcggctgctcgcgtttccccaaggcctccaaatagtctaaaaactcacctcggaggaggagaaagagcgtgaagtggctctttcgatctgagacaccccctcccggagaactcgccccctcccccccagcccagagcggagtgaaatcttagaagccgtggctgctgggtttgaacggaatgctggagtcagtggaagacggagctggtcggcccgaagactagacgcttgaagcaaagctgccatcccagaagacgacatgctctcagcaacccccctgtatgggaacgttcacagctggatgaacagcgagagggtccgcatgtgtggggcgagcgaagacaggaaaatccttgtaaatgatggtgacgcttcaaaagccagactggaactgagggaagagaatcccttgaaccacaacgtggtggatgcgagcacggcccataggatcgatggcctggcagcactgagcatggaccgcactggcctgatccgggaagggctgcgggtcccgggaaacatcgtctattctagcttgtgtggactgggctcagagaaaggtcgggaggctgccacaagcactctaggtggccttgggttttcttcggaaagaaatccagagatgcagttcaaaccgaatacacccgagacagtggaggcttctgccgtctctggaaaacccccaaatggcttcagtgctatatacaaaacaccgcctggaatacaaaaaagtgctgtagccacagcagaagcgctgggcttggacaggcctgccagcgacaaacagagccctctcaacatcaatggtgctagttatctgcggctgccctgggtcaatccttacatggagggtgccacgccagccatctaccctttcctcgactcgccaaataagtattcactgaacatgtacaaggccttgctacctcagcagtcctacagcttggcccagccgctgtattctccagtctgcaccaatggggagcgctttctctacctgccgccacctcactacgtcggtccccacatcccatcgtccttggcatcacccatgaggctctcgacaccttcggcctccccagccatcccgcctctcgtccattgcgcagacaaaagcctcccgtggaagatgggcgtcagccctgggaatcctgttgattcccacgcctatcctcacatccagaacagtaagcagcccagggttccctctgccaaggcggtcaccagtggcctgccgggggacacagctctcctgttgcccccctcgcctcggccgtcaccccgagtccaccttcccacccagcctgctgcagacacctactcggagttccacaagcactatgccaggatctccacctctccttcagttgccctgtcaaagccatacatgacagttagcagcgagttccccgcggccaggctctccaatggcaagtatcccaaggctccggaagggggcgaaggtgcccagccagtgcccgggcatgcccggaagacagcggttcaagacagaaaagacggcagctcacctcctctgttggagaagcagaccgttaccaaagacgtcacagataagccactagacttgtcttctaaagtggtggatgtagatgcttccaaagctgaccacatgaaaaagatggctcccacggtcctggttcacagcagggctggaagtggcttagtgctctccggaagtgagattccgaaagaaacactatctcctccaggaaatggttgtgctatctatagatctgaaatcatcagcactgctccctcatcctgggtggtgcccgggccaagtcctaacgaagagaacaatggcaaaagcatgtcgctgaaaaacaaggcattggactgggcgataccacagcagcggagttcatcatgcccgcgcatgggcggcaccgatgctgtcatcactaacgtttcagggtcagtgtcgagtgcaggccgcccagcctccgcatcacccgcccccaatgccaatgcagatggcaccaaaaccagcaggagctctgtagaaaccacaccatccgttattcagcacgtgggccagcccccggccactcctgccaagcacagtagcagcaccagcagcaagggcgccaaagccagcaacccagaaccgagtttcaaagcaaacgagaacggccttccaccaagctctatatttctgtctccaaatgaggcattcaggtccccaccaattccctaccccaggagttacctcccttacccagcccctgagggcattgctgtaagtcccctctccttacatggcaaaggacctgtctaccctcacccagttttgttacccaatggcagtctgtttcctgggcaccttgccccaaagcctgggctgccctatgggcttcccaccggccgtccagagtttgtgacctaccaagatgccctggggttgggcatggtgcatcccatgttgataccacacacgcccatagagattactaaagaggagaaaccagagaggagatcccggtcccatgagagagcccgttacgaggacccaaccctccggaatcggttttccgagattttggaaactagcagcaccaagttacatccagatgtccccaccgacaagaacctaaagccgaaccccaactggaatcaagggaagactgttgtcaaaagcgacaagcttgtctacgtagaccttctccgagaagaaccagatgctaaaactgacacaaacgtgtccaaacccagctttgcagcagagagtgttggccagagcgctgagccccccaagccctcagttgagccggccctgcagcagcaccgtgatttcatcgccctgagagaggagttggggcgcatcagtgacttccacgaaacttatactttcaaacagccagtcttcaccgtaagcaaggacagtgttctggcaggtaccaacaaagagaacctagggttgccagtctcgactccattcctggagccacctctggggagcgatggccctgctgtaacttttggtaaaacccaagaggatcccaaaccattttgtgtgggcagtgccccaccaagtgtggatgtgacccccacctataccaaagatggagctgatgaggctgaatcaaatgatggcaaagttctgaaaccgaagccatctaagctggcaaagagaatcgccaactcagcgggttacgtgggtgaccgattcaaatgtgtcactaccgaactgtatgcagattccagtcagctcagccgggagcaacgggcattgcagcgtgcaatgatgcgcttctcagagttggagatgaaagaaagagaaggtggccacccagcaaccaaagactccgagatgtgcaaattcagcccagccgactgggaaaggttgaaaggaaatcaggacaaaaagccaaagtcggtcaccctggaggaggccattgcagaacagaacgaaagtgagagatgcgagtatagtgttggaaacaagcaccgtgatccctttgaagccccagaggacaaagatcttcctgtggagaagtactttgtggagaggcagcctgtgagcgagcctcccgcagaccaggtggcctcggacatgcctcacagccccaccctccgggtggacaggaaacgcaaagtctcaggtgacagcagccacactgagaccactgcggaggaggtgccagaggaccctctgctgaaagccaaacgccgacgagtctctaaagggctccatcctaaaaaacaacgccacttgctgcaccttagagaacgatgggagcagcaggtgtcggcagcagatggcaaacctggccggcaaagcaggaaggaagtgacccaggccactcagcctgaggccattcctcaggggactaacatcactgaagagaaacctggcaggaaaagggcagaggccaaaggcaacagaagctggtcggaagagtctcttaaacccagtgacaatgaacaaggcttgcctgtgttctccggctctccgcccatgaagagtctttcatccaccagtgcaggcggcaaaaagcaggctcagccaagctgcgcaccagcctccaggccgcctgccaaacagcagaaaattaaagaaaaccagaagacagatgtgctgtgtgcagacgaagaagaggattgccaggctgcctccctgctgcagaaatacaccgacaacagcgagaagccatccgggaagagactgtgcaaaaccaaacacttgatccctcaggagtccaggcggggattgccactgacaggggaatactacgtggagaatgccgatggcaaggtgactgtccggagattcagaaagcggccggagcccagttcggactatgatctgtcaccagccaagcaggagccaaagcccttcgaccgcttgcagcaactgctaccagcctcccagtccacacagctgccatgctcaagttcccctcaggagaccacccagtctcgccctatgccgccggaagcacggagacttattgtcaataagaacgctggcgagacccttctgcagcgggcagccaggcttggctatgaggaagtggtcctgtactgcttagagaacaagatttgtgatgtaaatcatcgggacaacgcaggttactgcgccctgcatgaagcttgtgctaggggctggctcaacattgtgcgacacctccttgaatatggcgctgatgtcaactgtagtgcccaggatggaaccaggcctctgcacgatgctgttgagaacgatcacttggaaattgtccgactacttctctcttatggtgctgaccccaccttggctacgtactcaggtagaaccatcatgaaaatgacccacagtgaacttatggaaaagttcttaacagattatttaaatgacctccagggtcgcaatgatgatgacgccagtggcacttgggacttctatggcagctctgtttgtgaaccagatgatgaaagtggctatgatgttttagccaaccccccaggaccagaagaccaggatgatgatgacgatgcctatagcgatgtgtttgaatttgaattttcagagacccccctcttaccgtgttataacatccaagtatctgtggctcaggggtgagcatggctgtcatgtgattgaaaactagctgagctgctcttgaggccacgaaactggctactgctttcggatgtccttaagaaattgaaaatgtcctcccgcatatttcgctgcaattttccaaacgtggaaattgtcaccattgcagaggcagaattttatcggcaggtttctgcaagtctcttgttctcttgctccaaagacctggaagccttcaaccctgaaagtaaggagctgttagatctggtggaattcacgaacgaaattcagactctgctgggctcctctgtagagtggctccaccccagtgatctggcctcagacaactactggtgagcaagctggacccaccatgtacagtgtgttatagtgttaatccttgtgcatatgtgtcataatacaactatttctgtaaagaaaggacactattacatatgaaaatatctcttctttatataagagaaattactccagtcagaaggacttagaaacatgtttttttccttttaaacttttaagtcagtttttatgaagttgttataatgtttctttacttttcaatgcacacatgctttgggatacgtttgtttttacttggaacatttgtttcttttcttttttaaggagaaaaaaaaatgagtaaaaggagctccacactttgacttaatttcatacaaagctctgatgacaggccatgactgtagagtggtcagaactgtgtggttggtttgagggagcgaattcggggaaggcacttggtgatataactttgttttgtttacagagtacctgctcgggccaggtaaatgctattggatgtaatccagtagtgtgtaatataaattcaaaccatatccacacacaacaactaattgtatgaaacttttatatcctaatttaaaagctgtgaaattagttttcacgcatcaaaccggattgtttatatgtttaaacattttatgctcttatttaaagaagactttgagctatttttttctgtaccctgtaaaatattgaaaactaacataatatgttgaggttgcttggaaatgtacataaaactaaaattttctgaatcgtgtgtttatgtttgaaatctgtgttttaactttgtaagtaaattctctgcctttgtatttatattttacaaaaattttcttaaaaggcaataaaactgttgaggaaaggagaaaa

SEQ ID NO: 428054 - DNA, 1505 bp, Homo sapiens
taagagagaagtagtcggacaatttccaagtgatcgttctcaacagcatcgtgcagaggcctggttctagaaccatcatgaaaatgacccacagtgaacttatggaaaagttcttaacagattatttaaatgacctccagggtcgcaatgatgatgacgccagtggcacttgggacttctatggcagctctgtttgtgaaccagatgatgaaagtggctatgatgttttagccaaccccccaggaccagaagaccaggatgatgatgacgatgcctatagcgatgtgtttgaatttgaattttcagagacccccctcttaccgtgttataacatccaagtatctgtggctcaggggccacgaaactggctactgctttcggatgtccttaagaaattgaaaatgtcctcccgcatatttcgctgcaattttccaaacgtggaaattgtcaccattgcagaggcagaattttatcggcaggtttctgcaagtctcttgttctcttgctccaaagacctggaagccttcaaccctgaaagtaaggagctgttagatctggtggaattcacgaacgaaattcagactctgctgggctcctctgtagagtggctccaccccagtgatctggcctcagacaactactggtgagcaagctggacccaccatgtacagtgtgttatagtgttaatccttgtgcatatgtgtcataatacaactatttctgtaaagaaaggacactattacatatgaaaatatctcttctttatataagagaaattactccagtcagaaggacttagaaacatgtttttttccttttaaacttttaagtcagtttttatgaagttgttataatgtttctttacttttcaatgcacacatgctttgggatacgtttgtttttacttggaacatttgtttcttttcttttttaaggagaaaaaaaaatgagtaaaaggagctccacactttgacttaatttcatacaaagctctgatgacaggccatgactgtagagtggtcagaactgtgtggttggtttgagggagcgaattcggggaaggcacttggtgatataactttgttttgtttacagagtacctgctcgggccaggtaaatgctattggatgtaatccagtagtgtgtaatataaattcaaaccatatccacacacaacaactaattgtatgaaacttttatatcctaatttaaaagctgtgaaattagttttcacgcatcaaaccggattgtttatatgtttaaacattttatgctcttatttaaagaagactttgagctatttttttctgtaccctgtaaaatattgaaaactaacataatatgttgaggttgcttggaaatgtacataaaactaaaattttctgaatcgtgtgtttatgtttgaaatctgtgttttaactttgtaagtaaattctctgcctttgtatttatattttacaaaaattttcttaaaaggcaataaaactgttgaggaaaggagaaaa

SEQ ID NO: 428055 - DNA, 5596 bp, Homo sapiens
gtatttccgaagctggccaggccctctgctgctgaccctggaaatcgggtcacactagacaaggctgcatgtgcggggagaaggcgggggggctcctttgcacgcggctgctcgcgtttccccaaggcctccaaatagtctaaaaactcacctcggaggaggagaaagagcgtgaagtggctctttcgatctgagacaccccctcccggagaactcgccccctcccccccagcccagagcggagtgaaatcttagaagccgtggctgctgggtttgaacggaatgctggagtcagtggaagacggagctggtcggcccgaagactagacgcttgaagcaaagctgccatcccagaagacgacatgctctcagcaacccccctgtatgggaacgttcacagctggatgaacagcgagagggtccgcatgtgtggggcgagcgaagacaggaaaatccttgtaaatgatggtgacgcttcaaaagccagactggaactgagggaagagaatcccttgaaccacaacgtggtggatgcgagcacggcccataggatcgatggcctggcagcactgagcatggaccgcactggcctgatccgggaagggctgcgggtcccgggaaacatcgtctattctagcttgtgtggactgggctcagagaaaggtcgggaggctgccacaagcactctaggtggccttgggttttcttcggaaagaaatccagagatgcagttcaaaccgaatacacccgagacagtggaggcttctgccgtctctggaaaacccccaaatggcttcagtgctatatacaaaacaccgcctggaatacaaaaaagtgctgtagccacagcagaagcgctgggcttggacaggcctgccagcgacaaacagagccctctcaacatcaatggtgctagttatctgcggctgccctgggtcaatccttacatggagggtgccacgccagccatctaccctttcctcgactcgccaaataagtattcactgaacatgtacaaggccttgctacctcagcagtcctacagcttggcccagccgctgtattctccagtctgcaccaatggggagcgctttctctacctgccgccacctcactacgtcggtccccacatcccatcgtccttggcatcacccatgaggctctcgacaccttcggcctccccagccatcccgcctctcgtccattgcgcagacaaaagcctcccgtggaagatgggcgtcagccctgggaatcctgttgattcccacgcctatcctcacatccagaacagtaagcagcccagggttccctctgccaaggcggtcaccagtggcctgccgggggacacagctctcctgttgcccccctcgcctcggccgtcaccccgagtccaccttcccacccagcctgctgcagacacctactcggagttccacaagcactatgccaggatctccacctctccttcagttgccctgtcaaagccatacatgacagttagcagcgagttccccgcggccaggctctccaatggcaagtatcccaaggctccggaagggggcgaaggtgcccagccagtgcccgggcatgcccggaagacagcggttcaagacagaaaagacggcagctcacctcctctgttggagaagcagaccgttaccaaagacgtcacagataagccactagacttgtcttctaaagtggtggatgtagatgcttccaaagctgaccacatgaaaaagatggctcccacggtcctggttcacagcagggctggaagtggcttagtgctctccggaagtgagattccgaaagaaacactatctcctccaggaaatggttgtgctatctatagatctgaaatcatcagcactgctccctcatcctgggtggtgcccgggccaagtcctaacgaagagaacaatggcaaaagcatgtcgctgaaaaacaaggcattggactgggcgataccacagcagcggagttcatcatgcccgcgcatgggcggcaccgatgctgtcatcactaacgtttcagggtcagtgtcgagtgcaggccgcccagcctccgcatcacccgcccccaatgccaatgcagatggcaccaaaaccagcaggagctctgtagaaaccacaccatccgttattcagcacgtgggccagcccccggccactcctgccaagcacagtagcagcaccagcagcaagggcgccaaagccagcaacccagaaccgagtttcaaagcaaacgagaacggccttccaccaagctctatatttctgtctccaaatgaggcattcaggtccccaccaattccctaccccaggagttacctcccttacccagcccctgagggcattgctgtaagtcccctctccttacatggcaaaggacctgtctaccctcacccagttttgttacccaatggcagtctgtttcctgggcaccttgccccaaagcctgggctgccctatgggcttcccaccggccgtccagagtttgtgacctaccaagatgccctggggttgggcatggtgcatcccatgttgataccacacacgcccatagagattactaaagaggagaaaccagagaggagatcccggtcccatgagagagcccgttacgaggacccaaccctccggaatcggttttccgagattttggaaactagcagcaccaagttacatccagatgtccccaccgacaagaacctaaagccgaaccccaactggaatcaagggaagactgttgtcaaaagcgacaagcttgtctacgtagaccttctccgagaagaaccagatgctaaaactgacacaaacgtgtccaaacccagctttgcagcagagagtgttggccagagcgctgagccccccaagccctcagttgagccggccctgcagcagcaccgtgatttcatcgccctgagagaggagttggggcgcatcagtgacttccacgaaacttatactttcaaacagccagtcttcaccgtaagcaaggacagtgttctggcaggtaccaacaaagagaacctagggttgccagtctcgactccattcctggagccacctctggggagcgatggccctgctgtaacttttggtaaaacccaagaggatcccaaaccattttgtgtgggcagtgccccaccaagtgtggatgtgacccccacctataccaaagatggagctgatgaggctgaatcaaatgatggcaaagttctgaaaccgaagccatctaagctggcaaagagaatcgccaactcagcgggttacgtgggtgaccgattcaaatgtgtcactaccgaactgtatgcagattccagtcagctcagccgggagcaacgggcattgcagatggaaggattacaagaggacagtattttatgtctacccgctgcttactgtgagcgtgcaatgatgcgcttctcagagttggagatgaaagaaagagaaggtggccacccagcaaccaaagactccgagatgtgcaaattcagcccagccgactgggaaaggttgaaaggaaatcaggacaaaaagccaaagtcggtcaccctggaggaggccattgcagaacagaacgaaagtgagagatgcgagtatagtgttggaaacaagcaccgtgatccctttgaagccccagaggacaaagatcttcctgtggagaagtactttgtggagaggcagcctgtgagcgagcctcccgcagaccaggtggcctcggacatgcctcacagccccaccctccgggtggacaggaaacgcaaagtctcaggtgacagcagccacactgagaccactgcggaggaggtgccagaggaccctctgctgaaagccaaacgccgacgagtctctaaagggctccatcctaaaaaacaacgccacttgctgcaccttagagaacgatgggagcagcaggtgtcggcagcagatggcaaacctggccggcaaagcaggaaggaagtgacccaggccactcagcctgaggccattcctcaggggactaacatcactgaagagaaacctggcaggaaaagggcagaggccaaaggcaacagaagctggtcggaagagtctcttaaacccagtgacaatgaacaaggcttgcctgtgttctccggctctccgcccatgaagagtctttcatccaccagtgcaggcggcaaaaagcaggctcagccaagctgcgcaccagcctccaggccgcctgccaaacagcagaaaattaaagaaaaccagaagacagatgtgctgtgtgcagacgaagaagaggattgccaggctgcctccctgctgcagaaatacaccgacaacagcgagaagccatccgggaagagactgtgcaaaaccaaacacttgatccctcaggagtccaggcggggattgccactgacaggggaatactacgtggagaatgccgatggcaaggtgactgtccggagattcagaaagcggccggagcccagttcggactatgatctgtcaccagccaagcaggagccaaagcccttcgaccgcttgcagcaactgctaccagcctcccagtccacacagctgccatgctcaagttcccctcaggagaccacccagtctcgccctatgccgccggaagcacggagacttattgtcaataagaacgctggcgagacccttctgcagcgggcagccaggcttggctatgaggaagtggtcctgtactgcttagagaacaagatttgtgatgtaaatcatcgggacaacgcaggttactgcgccctgcatgaagcttgtgctaggggctggctcaacattgtgcgacacctccttgaatatggcgctgatgtcaactgtagtgcccaggatggaaccaggcctctgcacgatgctgttgagaacgatcacttggaaattgtccgactacttctctcttatggtgctgaccccaccttggctacgtactcaggtagaaccatcatgaaaatgacccacagtgaacttatggaaaagttcttaacagattatttaaatgacctccagggtcgcaatgatgatgacgccagtggcacttgggacttctatggcagctctgtttgtgaaccagatgatgaaagtggctatgatgttttagccaaccccccaggaccagaagaccaggatgatgatgacgatgcctatagcgatgtgtttgaatttgaattttcagagacccccctcttaccgtgttataacatccaagtatctgtggctcaggggccacgaaactggctactgctttcggatgtccttaagaaattgaaaatgtcctcccgcatatttcgctgcaattttccaaacgtggaaattgtcaccattgcagaggcagaattttatcggctctggatgcaaaagtgtcagaagatgaagaggaggaggatgtgaaactcttaagtatatctggaaaggcggtctgcccctggaggtggtagcaaggttccacagaaaaaagtaaaacttgctgctgatgacgatgatgacgatgatgataaaggggatgatgatcaagatgatgatgatgatgattttgatgctgaggaagctgaagaacaagcgccagtaaagaaatctatacgaga

SEQ ID NO: 428056 - DNA, 6275 bp, Homo sapiens
ggtccccggctgcccgcagcccgctcgcggcgcttctccggcccggctccttctccgctcgttaacgtcgccaaccccccccacccctcatatctctctccacccacccaaccgccccccgctccttctcgccgcctcgagtccgcttgggggaaaacttcaaagagccggatcgcaggctccctgcctactcccccaccggggatttcagactagacgcttgaagcaaagctgccatcccagaagacgacatgctctcagcaacccccctgtatgggaacgttcacagctggatgaacagcgagagggtccgcatgtgtggggcgagcgaagacaggaaaatccttgtaaatgatggtgacgcttcaaaagccagactggaactgagggaagagaatcccttgaaccacaacgtggtggatgcgagcacggcccataggatcgatggcctggcagcactgagcatggaccgcactggcctgatccgggaagggctgcgggtcccgggaaacatcgtctattctagcttgtgtggactgggctcagagaaaggtcgggaggctgccacaagcactctaggtggccttgggttttcttcggaaagaaatccagagatgcagttcaaaccgaatacacccgagacagtggaggcttctgccgtctctggaaaacccccaaatggcttcagtgctatatacaaaacaccgcctggaatacaaaaaagtgctgtagccacagcagaagcgctgggcttggacaggcctgccagcgacaaacagagccctctcaacatcaatggtgctagttatctgcggctgccctgggtcaatccttacatggagggtgccacgccagccatctaccctttcctcgactcgccaaataagtattcactgaacatgtacaaggccttgctacctcagcagtcctacagcttggcccagccgctgtattctccagtctgcaccaatggggagcgctttctctacctgccgccacctcactacgtcggtccccacatcccatcgtccttggcatcacccatgaggctctcgacaccttcggcctccccagccatcccgcctctcgtccattgcgcagacaaaagcctcccgtggaagatgggcgtcagccctgggaatcctgttgattcccacgcctatcctcacatccagaacagtaagcagcccagggttccctctgccaaggcggtcaccagtggcctgccgggggacacagctctcctgttgcccccctcgcctcggccgtcaccccgagtccaccttcccacccagcctgctgcagacacctactcggagttccacaagcactatgccaggatctccacctctccttcagttgccctgtcaaagccatacatgacagttagcagcgagttccccgcggccaggctctccaatggcaagtatcccaaggctccggaagggggcgaaggtgcccagccagtgcccgggcatgcccggaagacagcggttcaagacagaaaagacggcagctcacctcctctgttggagaagcagaccgttaccaaagacgtcacagataagccactagacttgtcttctaaagtggtggatgtagatgcttccaaagctgaccacatgaaaaagatggctcccacggtcctggttcacagcagggctggaagtggcttagtgctctccggaagtgagattccgaaagaaacactatctcctccaggaaatggttgtgctatctatagatctgaaatcatcagcactgctccctcatcctgggtggtgcccgggccaagtcctaacgaagagaacaatggcaaaagcatgtcgctgaaaaacaaggcattggactgggcgataccacagcagcggagttcatcatgcccgcgcatgggcggcaccgatgctgtcatcactaacgtttcagggtcagtgtcgagtgcaggccgcccagcctccgcatcacccgcccccaatgccaatgcagatggcaccaaaaccagcaggagctctgtagaaaccacaccatccgttattcagcacgtgggccagcccccggccactcctgccaagcacagtagcagcaccagcagcaagggcgccaaagccagcaacccagaaccgagtttcaaagcaaacgagaacggccttccaccaagctctatatttctgtctccaaatgaggcattcaggtccccaccaattccctaccccaggagttacctcccttacccagcccctgagggcattgctgtaagtcccctctccttacatggcaaaggacctgtctaccctcacccagttttgttacccaatggcagtctgtttcctgggcaccttgccccaaagcctgggctgccctatgggcttcccaccggccgtccagagtttgtgacctaccaagatgccctggggttgggcatggtgcatcccatgttgataccacacacgcccatagagattactaaagaggagaaaccagagaggagatcccggtcccatgagagagcccgttacgaggacccaaccctccggaatcggttttccgagattttggaaactagcagcaccaagttacatccagatgtccccaccgacaagaacctaaagccgaaccccaactggaatcaagggaagactgttgtcaaaagcgacaagcttgtctacgtagaccttctccgagaagaaccagatgctaaaactgacacaaacgtgtccaaacccagctttgcagcagagagtgttggccagagcgctgagccccccaagccctcagttgagccggccctgcagcagcaccgtgatttcatcgccctgagagaggagttggggcgcatcagtgacttccacgaaacttatactttcaaacagccagtcttcaccgtaagcaaggacagtgttctggcaggtaccaacaaagagaacctagggttgccagtctcgactccattcctggagccacctctggggagcgatggccctgctgtaacttttggtaaaacccaagaggatcccaaaccattttgtgtgggcagtgccccaccaagtgtggatgtgacccccacctataccaaagatggagctgatgaggctgaatcaaatgatggcaaagttctgaaaccgaagccatctaagctggcaaagagaatcgccaactcagcgggttacgtgggtgaccgattcaaatgtgtcactaccgaactgtatgcagattccagtcagctcagccgggagcaacgggcattgcagatggaaggattacaagaggacagtattttatgtctacccgctgcttactgtgagcgtgcaatgatgcgcttctcagagttggagatgaaagaaagagaaggtggccacccagcaaccaaagactccgagatgtgcaaattcagcccagccgactgggaaaggttgaaaggaaatcaggacaaaaagccaaagtcggtcaccctggaggaggccattgcagaacagaacgaaagtgagagatgcgagtatagtgttggaaacaagcaccgtgatccctttgaagccccagaggacaaagatcttcctgtggagaagtactttgtggagaggcagcctgtgagcgagcctcccgcagaccaggtggcctcggacatgcctcacagccccaccctccgggtggacaggaaacgcaaagtctcaggtgacagcagccacactgagaccactgcggaggaggtgccagaggaccctctgctgaaagccaaacgccgacgagtctctaaagggctccatcctaaaaaacaacgccacttgctgcaccttagagaacgatgggagcagcaggtgtcggcagcagatggcaaacctggccggcaaagcaggaaggaagtgacccaggccactcagcctgaggccattcctcaggggactaacatcactgaagagaaacctggcaggaaaagggcagaggccaaaggcaacagaagctggtcggaagagtctcttaaacccagtgacaatgaacaaggcttgcctgtgttctccggctctccgcccatgaagagtctttcatccaccagtgcaggcggcaaaaagcaggctcagccaagctgcgcaccagcctccaggccgcctgccaaacagcagaaaattaaagaaaaccagaagacagatgtgctgtgtgcagacgaagaagaggattgccaggctgcctccctgctgcagaaatacaccgacaacagcgagaagccatccgggaagagactgtgcaaaaccaaacacttgatccctcaggagtccaggcggggattgccactgacaggggaatactacgtggagaatgccgatggcaaggtgactgtccggagattcagaaagcggccggagcccagttcggactatgatctgtcaccagccaagcaggagccaaagcccttcgaccgcttgcagcaactgctaccagcctcccagtccacacagctgccatgctcaagttcccctcaggagaccacccagtctcgccctatgccgccggaagcacggagacttattgtcaataagaacgctggcgagacccttctgcagcgggcagccaggcttggctatgaggaagtggtcctgtactgcttagagaacaagatttgtgatgtaaatcatcgggacaacgcaggttactgcgccctgcatgaagcttgtgctaggggctggctcaacattgtgcgacacctccttgaatatggcgctgatgtcaactgtagtgcccaggatggaaccaggcctctgcacgatgctgttgagaacgatcacttggaaattgtccgactacttctctcttatggtgctgaccccaccttggctacgtactcaggtagaaccatcatgaaaatgacccacagtgaacttatggaaaagttcttaacagattatttaaatgacctccagggtcgcaatgatgatgacgccagtggcacttgggacttctatggcagctctgtttgtgaaccagatgatgaaagtggctatgatgttttagccaaccccccaggaccagaagaccaggatgatgatgacgatgcctatagcgatgtgtttgaatttgaattttcagagacccccctcttaccgtgttataacatccaagtatctgtggctcaggggccacgaaactggctactgctttcggatgtccttaagaaattgaaaatgtcctcccgcatatttcgctgcaattttccaaacgtggaaattgtcaccattgcagaggcagaattttatcggcaggtttctgcaagtctcttgttctcttgctccaaagacctggaagccttcaaccctgaaagtaaggagctgttagatctggtggaattcacgaacgaaattcagactctgctgggctcctctgtagagtggctccaccccagtgatctggcctcagacaactactggtgagcaagctggacccaccatgtacagtgtgttatagtgttaatccttgtgcatatgtgtcataatacaactatttctgtaaagaaaggacactattacatatgaaaatatctcttctttatataagagaaattactccagtcagaaggacttagaaacatgtttttttccttttaaacttttaagtcagtttttatgaagttgttataatgtttctttacttttcaatgcacacatgctttgggatacgtttgtttttacttggaacatttgtttcttttcttttttaaggagaaaaaaaaatgagtaaaaggagctccacactttgacttaatttcatacaaagctctgatgacaggccatgactgtagagtggtcagaactgtgtggttggtttgagggagcgaattcggggaaggcacttggtgatataactttgttttgtttacagagtacctgctcgggccaggtaaatgctattggatgtaatccagtagtgtgtaatataaattcaaaccatatccacacacaacaactaattgtatgaaacttttatatcctaatttaaaagctgtgaaattagttttcacgcatcaaaccggattgtttatatgtttaaacattttatgctcttatttaaagaagactttgagctatttttttctgtaccctgtaaaatattgaaaactaacataatatgttgaggttgcttggaaatgtacataaaactaaaattttctgaatcgtgtgtttatgtttgaaatctgtgttttaactttgtaagtaaattctctgcctttgtatttatattttacaaaaattttcttaaaaggcaataaaactgttgaggaaaggagaaaa

SEQ ID NO: 428057 - DNA, 6200 bp, Homo sapiens
ggtccccggctgcccgcagcccgctcgcggcgcttctccggcccggctccttctccgctcgttaacgtcgccaaccccccccacccctcatatctctctccacccacccaaccgccccccgctccttctcgccgcctcgagtccgcttgggggaaaacttcaaagagccggatcgcaggctccctgcctactcccccaccggggatttcagactagacgcttgaagcaaagctgccatcccagaagacgacatgctctcagcaacccccctgtatgggaacgttcacagctggatgaacagcgagagggtccgcatgtgtggggcgagcgaagacaggaaaatccttgtaaatgatggtgacgcttcaaaagccagactggaactgagggaagagaatcccttgaaccacaacgtggtggatgcgagcacggcccataggatcgatggcctggcagcactgagcatggaccgcactggcctgatccgggaagggctgcgggtcccgggaaacatcgtctattctagcttgtgtggactgggctcagagaaaggtcgggaggctgccacaagcactctaggtggccttgggttttcttcggaaagaaatccagagatgcagttcaaaccgaatacacccgagacagtggaggcttctgccgtctctggaaaacccccaaatggcttcagtgctatatacaaaacaccgcctggaatacaaaaaagtgctgtagccacagcagaagcgctgggcttggacaggcctgccagcgacaaacagagccctctcaacatcaatggtgctagttatctgcggctgccctgggtcaatccttacatggagggtgccacgccagccatctaccctttcctcgactcgccaaataagtattcactgaacatgtacaaggccttgctacctcagcagtcctacagcttggcccagccgctgtattctccagtctgcaccaatggggagcgctttctctacctgccgccacctcactacgtcggtccccacatcccatcgtccttggcatcacccatgaggctctcgacaccttcggcctccccagccatcccgcctctcgtccattgcgcagacaaaagcctcccgtggaagatgggcgtcagccctgggaatcctgttgattcccacgcctatcctcacatccagaacagtaagcagcccagggttccctctgccaaggcggtcaccagtggcctgccgggggacacagctctcctgttgcccccctcgcctcggccgtcaccccgagtccaccttcccacccagcctgctgcagacacctactcggagttccacaagcactatgccaggatctccacctctccttcagttgccctgtcaaagccatacatgacagttagcagcgagttccccgcggccaggctctccaatggcaagtatcccaaggctccggaagggggcgaaggtgcccagccagtgcccgggcatgcccggaagacagcggttcaagacagaaaagacggcagctcacctcctctgttggagaagcagaccgttaccaaagacgtcacagataagccactagacttgtcttctaaagtggtggatgtagatgcttccaaagctgaccacatgaaaaagatggctcccacggtcctggttcacagcagggctggaagtggcttagtgctctccggaagtgagattccgaaagaaacactatctcctccaggaaatggttgtgctatctatagatctgaaatcatcagcactgctccctcatcctgggtggtgcccgggccaagtcctaacgaagagaacaatggcaaaagcatgtcgctgaaaaacaaggcattggactgggcgataccacagcagcggagttcatcatgcccgcgcatgggcggcaccgatgctgtcatcactaacgtttcagggtcagtgtcgagtgcaggccgcccagcctccgcatcacccgcccccaatgccaatgcagatggcaccaaaaccagcaggagctctgtagaaaccacaccatccgttattcagcacgtgggccagcccccggccactcctgccaagcacagtagcagcaccagcagcaagggcgccaaagccagcaacccagaaccgagtttcaaagcaaacgagaacggccttccaccaagctctatatttctgtctccaaatgaggcattcaggtccccaccaattccctaccccaggagttacctcccttacccagcccctgagggcattgctgtaagtcccctctccttacatggcaaaggacctgtctaccctcacccagttttgttacccaatggcagtctgtttcctgggcaccttgccccaaagcctgggctgccctatgggcttcccaccggccgtccagagtttgtgacctaccaagatgccctggggttgggcatggtgcatcccatgttgataccacacacgcccatagagattactaaagaggagaaaccagagaggagatcccggtcccatgagagagcccgttacgaggacccaaccctccggaatcggttttccgagattttggaaactagcagcaccaagttacatccagatgtccccaccgacaagaacctaaagccgaaccccaactggaatcaagggaagactgttgtcaaaagcgacaagcttgtctacgtagaccttctccgagaagaaccagatgctaaaactgacacaaacgtgtccaaacccagctttgcagcagagagtgttggccagagcgctgagccccccaagccctcagttgagccggccctgcagcagcaccgtgatttcatcgccctgagagaggagttggggcgcatcagtgacttccacgaaacttatactttcaaacagccagtcttcaccgtaagcaaggacagtgttctggcaggtaccaacaaagagaacctagggttgccagtctcgactccattcctggagccacctctggggagcgatggccctgctgtaacttttggtaaaacccaagaggatcccaaaccattttgtgtgggcagtgccccaccaagtgtggatgtgacccccacctataccaaagatggagctgatgaggctgaatcaaatgatggcaaagttctgaaaccgaagccatctaagctggcaaagagaatcgccaactcagcgggttacgtgggtgaccgattcaaatgtgtcactaccgaactgtatgcagattccagtcagctcagccgggagcaacgggcattgcagatggaaggattacaagaggacagtattttatgtctacccgctgcttactgtgagcgtgcaatgatgcgcttctcagagttggagatgaaagaaagagaaggtggccacccagcaaccaaagactccgagatgtgcaaattcagcccagccgactgggaaaggttgaaaggaaatcaggacaaaaagccaaagtcggtcaccctggaggaggccattgcagaacagaacgaaagtgagagatgcgagtatagtgttggaaacaagcaccgtgatccctttgaagccccagaggacaaagatcttcctgtggagaagtactttgtggagaggcagcctgtgagcgagcctcccgcagaccaggtggcctcggacatgcctcacagccccaccctccgggtggacaggaaacgcaaagtctcaggtgacagcagccacactgagaccactgcggaggaggtgccagaggaccctctgctgaaagccaaacgccgacgagtctctaaagggctccatcctaaaaaacaacgccacttgctgcaccttagagaacgatgggagcagcaggtgtcggcagcagatggcaaacctggccggcaaagcaggaaggaagtgacccaggccactcagcctgaggccattcctcaggggactaacatcactgaagagaaacctggcaggaaaagggcagaggccaaaggcaacagaagctggtcggaagagtctcttaaacccagtgacaatgaacaaggcttgcctgtgttctccggctctccgcccatgaagagtctttcatccaccagtgcaggcggcaaaaagcaggctcagccaagctgcgcaccagcctccaggccgcctgccaaacagcagaaaattaaagaaaaccagaagacagatgtgctgtgtgcagacgaagaagaggattgccaggctgcctccctgctgcagaaatacaccgacaacagcgagaagccatccgggaagagactgtgcaaaaccaaacacttgatccctcaggagtccaggcggggattgccactgacaggggaatactacgtggagaatgccgatggcaaggtgactgtccggagattcagaaagcggccggagcccagttcggactatgatctgtcaccagccaagcaggagccaaagcccttcgaccgcttgcagcaactgctaccagcctcccagtccacacagctgccatgctcaagttcccctcaggagaccacccagtctcgccctatgccgccggaagcacggagacttattgtcaataagaacgctggcgagacccttctgcagcgggcagccaggcttggctatgaggaagtggtcctgtactgcttagagaacaagatttgtgatgtaaatcatcgggacaacgcaggttactgcgccctgcatgaagcttgtgctaggggctggctcaacattgtgcgacacctccttgaatatggcgctgatgtcaactgtagtgcccaggatggaaccaggcctctgcacgatgctgttgagaacgatcacttggaaattgtccgactacttctctcttatggtgctgaccccaccttggctacgtactcaggtagaaccatcatgaaaatgacccacagtgaacttatggaaaagttcttaacagattatttaaatgacctccagggtcgcaatgatgatgacgccagtggcacttgggacttctatggcagctctgtttgtgaaccagatgatgaaagtggctatgatgttttagccaaccccccaggaccagaagaccaggatgatgatgacgatgcctatagcgatgtgtttgaatttgaattttcagagacccccctcttaccgtgttataacatccaagtatctgtggctcaggggccacgaaactggctactgctttcggatgtccttaagaaattgaaaatgtcctcccgcatatttcgctgcaattttccaaacgtggaaattgtcaccattgcagaggcagaattttatcggcaggtttctgcaagtctcttgttctcttgctccaaagacctggaagccttcaaccctgaaagtaaggagctgttagatctggtggaattcacgaacgaaattcagactctgctgggctcctctgtagagtggctccaccccagtgatctggcctcagacaactactggtgagcaagctggacccaccatgtacagtgtgttatagtgttaatccttgtgcatatgtgtcataatacaactatttctgtaaagaaaggacactattacatatgaaaatatctcttctttatataagagaaattactccagtcagaaggacttagaaacatgtttttttccttttaaacttttaagtcagtttttatgaagttgttataatgtttctttacttttcaatgcacacatgctttgggatacgtttgtttttacttggaacatttgtttcttttcttttttaaggagaaaaaaaaatgagtaaaaggagctccacactttgacttaatttcatacaaagctctgatgacaggccatgactgtagagtggtcagaactgtgtggttggtttgagggagcgaattcggggaaggcacttggtgatataactttgttttgtttacagagtacctgctcgggccaggtaaatgctattggatgtaatccagtagtgtgtaatataaattcaaaccatatccacacacaacaactaattgtatgaaacttttatatcctaatttaaaagctgtgaaattagttttcacgcatcaaaccggattgtttatatgtttaaacattttatgctcttatttaaagaagactttgagctatttttttctgtaccctgtaaaatattgaaaactaacataatatgttgaggttgcttggaaatgtacataaaactaaaattttctgaatcgtgtgtttatgtctggttcttcggcgtgtgcagggtaccga

SEQ ID NO: 428058 - DNA, 2604 bp, Homo sapiens
ctgaccaacctgaaggtgtgcattgaattaacagggctccatcctaaaaaacaacgccacttgctgcaccttagagaacgatgggagcagcaggtgtcggcagcagatggcaaacctggccggcaaagcaggaaggaagtgacccaggccactcagcctgaggccattcctcaggggactaacatcactgaagagaaacctggcaggaaaagggcagaggccaaaggcaacagaagctggtcggaagagtctcttaaacccagtgacaatgaacaaggcttgcctgtgttctccggctctccgcccatgaagagtctttcatccaccagtgcaggcggcaaaaagcaggctcagccaagctgcgcaccagcctccaggccgcctgccaaacagcagaaaattaaagaaaaccagaagacagatgtgctgtgtgcagacgaagaagaggattgccaggctgcctccctgctgcagaaatacaccgacaacagcgagaagccatccgggaagagactgtgcaaaaccaaacacttgatccctcaggagtccaggcggggattgccactgacaggggaatactacgtggagaatgccgatggcaaggtgactgtccggagattcagaaagcggccggagcccagttcggactatgatctgtcaccagccaagcaggagccaaagcccttcgaccgcttgcagcaactgctaccagcctcccagtccacacagctgccatgctcaagttcccctcaggagaccacccagtctcgccctatgccgccggaagcacggagacttattgtcaataagaacgctggcgagacccttctgcagcgggcagccaggcttggctatgaggaagtggtcctgtactgcttagagaacaagatttgtgatgtaaatcatcgggacaacgcaggttactgcgccctgcatgaagcttgtgctaggggctggctcaacattgtgcgacacctccttgaatatggcgctgatgtcaactgtagtgcccaggatggaaccaggcctctgcacgatgctgttgagaacgatcacttggaaattgtccgactacttctctcttatggtgctgaccccaccttggctacgtactcaggtagaaccatcatgaaaatgacccacagtgaacttatggaaaagttcttaacagattatttaaatgacctccagggtcgcaatgatgatgacgccagtggcacttgggacttctatggcagctctgtttgtgaaccagatgatgaaagtggctatgatgttttagccaaccccccaggaccagaagaccaggatgatgatgacgatgcctatagcgatgtgtttgaatttgaattttcagagacccccctcttaccgtgttataacatccaagtatctgtggctcaggggtgagcatggctgtcatgtgattgaaaactagctgagctgctcttgaggccacgaaactggctactgctttcggatgtccttaagaaattgaaaatgtcctcccgcatatttcgctgcaattttccaaacgtggaaattgtcaccattgcagaggcagaattttatcggcaggtttctgcaagtctcttgttctcttgctccaaagacctggaagccttcaaccctgaaagtaaggagctgttagatctggtggaattcacgaacgaaattcagactctgctgggctcctctgtagagtggctccaccccagtgatctggcctcagacaactactggtgagcaagctggacccaccatgtacagtgtgttatagtgttaatccttgtgcatatgtgtcataatacaactatttctgtaaagaaaggacactattacatatgaaaatatctcttctttatataagagaaattactccagtcagaaggacttagaaacatgtttttttccttttaaacttttaagtcagtttttatgaagttgttataatgtttctttacttttcaatgcacacatgctttgggatacgtttgtttttacttggaacatttgtttcttttcttttttaaggagaaaaaaaaatgagtaaaaggagctccacactttgacttaatttcatacaaagctctgatgacaggccatgactgtagagtggtcagaactgtgtggttggtttgagggagcgaattcggggaaggcacttggtgatataactttgttttgtttacagagtacctgctcgggccaggtaaatgctattggatgtaatccagtagtgtgtaatataaattcaaaccatatccacacacaacaactaattgtatgaaacttttatatcctaatttaaaagctgtgaaattagttttcacgcatcaaaccggattgtttatatgtttaaacattttatgctcttatttaaagaagactttgagctatttttttctgtaccctgtaaaatattgaaaactaacataatatgttgaggttgcttggaaatgtacataaaactaaaattttctgaatcgtgtgtttatgtttgaaatctgtgttttaactttgtaagtaaattctctgcctttgtatttatattttacaaaaattttcttaaaaggcaataaaactgttgaggaaaggagaaaa

SEQ ID NO: 428059 - DNA, 5970 bp, Homo sapiens
gtatttccgaagctggccaggccctctgctgctgaccctggaaatcgggtcacactagacaaggctgcatgtgcggggagaaggcgggggggctcctttgcacgcggctgctcgcgtttccccaaggcctccaaatagtctaaaaactcacctcggaggaggagaaagagcgtgaagtggctctttcgatctgagacaccccctcccggagaactcgccccctcccccccagcccagagcggagtgaaatcttagaagccgtggctgctgggtttgaacggaatgctggagtcagtggaagacggagctggtcggcccgaagactagacgcttgaagcaaagctgccatcccagaagacgacatgctctcagcaacccccctgtatgggaacgttcacagctggatgaacagcgagagggtccgcatgtgtggggcgagcgaagacaggaaaatccttgtaaatgatggtgacgcttcaaaagccagactggaactgagggaagagaatcccttgaaccacaacgtggtggatgcgagcacggcccataggatcgatggcctggcagcactgagcatggaccgcactggcctgatccgggaagggctgcgggtcccgggaaacatcgtctattctagcttgtgtggactgggctcagagaaaggtcgggaggctgccacaagcactctaggtggccttgggttttcttcggaaagaaatccagagatgcagttcaaaccgaatacacccgagacagtggaggcttctgccgtctctggaaaacccccaaatggcttcagtgctatatacaaaacaccgcctggaatacaaaaaagtgctgtagccacagcagaagcgctgggcttggacaggcctgccagcgacaaacagagccctctcaacatcaatggtgctagttatctgcggctgccctgggtcaatccttacatggagggtgccacgccagccatctaccctttcctcgactcgccaaataagtattcactgaacatgtacaaggccttgctacctcagcagtcctacagcttggcccagccgctgtattctccagtctgcaccaatggggagcgctttctctacctgccgccacctcactacgtcggtccccacatcccatcgtccttggcatcacccatgaggctctcgacaccttcggcctccccagccatcccgcctctcgtccattgcgcagacaaaagcctcccgtggaagatgggcgtcagccctgggaatcctgttgattcccacgcctatcctcacatccagaacagtaagcagcccagggttccctctgccaaggcggtcaccagtggcctgccgggggacacagctctcctgttgcccccctcgcctcggccgtcaccccgagtccaccttcccacccagcctgctgcagacacctactcggagttccacaagcactatgccaggatctccacctctccttcagttgccctgtcaaagccatacatgacagttagcagcgagttccccgcggccaggctctccaatggcaagtatcccaaggctccggaagggggcgaaggtgcccagccagtgcccgggcatgcccggaagacagcggttcaagacagaaaagacggcagctcacctcctctgttggagaagcagaccgttaccaaagacgtcacagataagccactagacttgtcttctaaagtggtggatgtagatgcttccaaagctgaccacatgaaaaagatggctcccacggtcctggttcacagcagggctggaagtggcttagtgctctccggaagtgagattccgaaagaaacactatctcctccaggaaatggttgtgctatctatagatctgaaatcatcagcactgctccctcatcctgggtggtgcccgggccaagtcctaacgaagagaacaatggcaaaagcatgtcgctgaaaaacaaggcattggactgggcgataccacagcagcggagttcatcatgcccgcgcatgggcggcaccgatgctgtcatcactaacgtttcagggtcagtgtcgagtgcaggccgcccagcctccgcatcacccgcccccaatgccaatgcagatggcaccaaaaccagcaggagctctgtagaaaccacaccatccgttattcagcacgtgggccagcccccggccactcctgccaagcacagtagcagcaccagcagcaagggcgccaaagccagcaacccagaaccgagtttcaaagcaaacgagaacggccttccaccaagctctatatttctgtctccaaatgaggcattcaggtccccaccaattccctaccccaggagttacctcccttacccagcccctgagggcattgctgtaagtcccctctccttacatggcaaaggacctgtctaccctcacccagttttgttacccaatggcagtctgtttcctgggcaccttgccccaaagcctgggctgccctatgggcttcccaccggccgtccagagtttgtgacctaccaagatgccctggggttgggcatggtgcatcccatgttgataccacacacgcccatagagattactaaagaggagaaaccagagaggagatcccggtcccatgagagagcccgttacgaggacccaaccctccggaatcggttttccgagattttggaaactagcagcaccaagttacatccagatgtccccaccgacaagaacctaaagccgaaccccaactggaatcaagggaagactgttgtcaaaagcgacaagcttgtctacgtagaccttctccgagaagaaccagatgctaaaactgacacaaacgtgtccaaacccagctttgcagcagagagtgttggccagagcgctgagccccccaagccctcagttgagccggccctgcagcagcaccgtgatttcatcgccctgagagaggagttggggcgcatcagtgacttccacgaaacttatactttcaaacagccagtcttcaccgtaagcaaggacagtgttctggcaggtaccaacaaagagaacctagggttgccagtctcgactccattcctggagccacctctggggagcgatggccctgctgtaacttttggtaaaacccaagaggatcccaaaccattttgtgtgggcagtgccccaccaagtgtggatgtgacccccacctataccaaagatggagctgatgaggctgaatcaaatgatggcaaagttctgaaaccgaagccatctaagctggcaaagagaatcgccaactcagcgggttacgtgggtgaccgattcaaatgtgtcactaccgaactgtatgcagattccagtcagctcagccgggagcaacgggcattgcagatggaaggattacaagaggacagtattttatgtctacccgctgcttactgtgagcgtgcaatgatgcgcttctcagagttggagatgaaagaaagagaaggtggccacccagcaaccaaagactccgagatgtgcaaattcagcccagccgactgggaaaggttgaaaggaaatcaggacaaaaagccaaagtcggtcaccctggaggaggccattgcagaacagaacgaaagtgagagatgcgagtatagtgttggaaacaagcaccgtgatccctttgaagccccagaggacaaagatcttcctgtggagaagtactttgtggagaggcagcctgtgagcgagcctcccgcagaccaggtggcctcggacatgcctcacagccccaccctccgggtggacaggaaacgcaaagtctcaggtgacagcagccacactgagaccactgcggaggaggtgccagaggaccctctgctgaaagccaaacgccgacgagtctctaaagggctccatcctaaaaaacaacgccacttgctgcaccttagagaacgatgggagcagcaggtgtcggcagcagatggcaaacctggccggcaaagcaggaaggaagtgacccaggccactcagcctgaggccattcctcaggggactaacatcactgaagagaaacctggcaggaaaagggcagaggccaaaggcaacagaagctggtcggaagagtctcttaaacccagtgacaatgaacaaggcttgcctgtgttctccggctctccgcccatgaagagtctttcatccaccagtgcaggcggcaaaaagcaggctcagccaagctgcgcaccagcctccaggccgcctgccaaacagcagaaaattaaagaaaaccagaagacagatgtgctgtgtgcagacgaagaagaggattgccaggctgcctccctgctgcagaaatacaccgacaacagcgagaagccatccgggaagagactgtgcaaaaccaaacacttgatccctcaggagtccaggcggggattgccactgacaggggaatactacgtggagaatgccgatggcaaggtgactgtccggagattcagaaagcggccggagcccagttcggactatgatctgtcaccagccaagcaggagccaaagcccttcgaccgcttgcagcaactgctaccagcctcccagtccacacagctgccatgctcaagttcccctcaggagaccacccagtctcgccctatgccgccggaagcacggagacttattgtcaataagaacgctggcgagacccttctgcagcgggcagccaggcttggctatgaggaagtggtcctgtactgcttagagaacaagatttgtgatgtaaatcatcgggacaacgcaggttactgcgccctgcatgaagcttgtgctaggggctggctcaacattgtgcgacacctccttgaatatggcgctgatgtcaactgtagtgcccaggatggaaccaggcctctgcacgatgctgttgagaacgatcacttggaaattgtccgactacttctctcttatggtgctgaccccaccttggctacgtactcaggtagaaccatcatgaaaatgacccacagtgaacttatggaaaagttcttaacagattatttaaatgacctccagggtcgcaatgatgatgacgccagtggcacttgggacttctatggcagctctgtttgtgaaccagatgatgaaagtggctatgatgttttagccaaccccccaggaccagaagaccaggatgatgatgacgatgcctatagcgatgtgtttgaatttgaattttcagagacccccctcttaccgtgttataacatccaagtatctgtggctcaggggtgagcatggctgtcatgtgattgaaaactagctgagctgctcttgaggtgacaggagttagaaatgcgctttgagcagatgagggtgggtgggtgagtgacctccttaactgtccacgaacctcacacaatgcagtagatattttccagaaagggtacacatcagcttccttacacccagtgtggtggggggtggggcacagcatggtataaacctgccctcatcactaacaccaaggcttaagtcactccccagagaagtgggtgactggaactttatggaagggtcagcaccttggatacttaaatccttaaacactttgagaaggtgtcctccctaggactgcctgcaacagaccactgtaggatgttttgagatgtacggactacactgataaaccaccttgtgtaaggttaggacaatcattgtacatgacacttaggatattggtgtgtcatcagatttagttaatcccctctgccccctatggttgagcccctattcgccagtgaccaatcatcttgggtgtacttgtcaagagactgctctgctgtgtgttgacagagctgcttgatgagtaacatcctcctcagccctgaagctataaacatatatgccattacaaacagtgatggaaatcataaagtatggtaggttgtatgcaaggaatgtaacaccttccttctcaaaagtgtcactcccaaaagaatggaaggatgggagtggacatgcc

SEQ ID NO: 428060 - DNA, 2754 bp, Homo sapiens
ggcgcgtcggcgcaggtttccgcagctgagggggcagctccgcggcggcgtccggggtctccagtagggctgacgctccggtgctcgcacaatcccccgcctcggctggcaacgggcgtccctccactccccgagtccccggcagccgccgccaccccagcgcgccccgatctggccccctgccccgcgaagatggctgccgtacgccgggcccgcagttattgccgctgcctggtgcgcttctccgaccgagaactctgctaagctccgctgcagagacaggcaggagtagacacccggacacccagcacccctcctccggggggcggtgcagagggggcacggagagcccctcgagcgcagcaggccgccccgccagcatggcagaagctgaggaagattgtcattctgatactgtcagagcagatgatgatgaagaaaatgaaagtcctgctgaaacagatctgcaggcacaactccagatgttccgagctcagtggatgtttgaacttgctccaggtgtaagctctagcaatttagaaaatcgaccttgcagagcagcaagaggctctctccagaaaacatcggcagataccaaaggaaaacaagaacaggcaaaagaagaaaaggctcgagaactcttcctaaaagcagtagaagaagaacaaaatggagctctctatgaagccatcaagttttatcgtagggctatgcaacttgtacctgatatagagttcaagattacttatacccggtctccagatggtgatggcgttggaaacagctacattgaagataatgatgatgacagcaaaatggcagatctcttgtcctacttccagcagcaactcacatttcaggagtctgtgcttaaactgtgtcagcctgagcttgagagcagtcagattcacatatcagtgctgccaatggaggtcctgatgtacatcttccgatgggtggtgtctagtgacttggacctcagatcattggagcagttgtcgctggtgtgcagaggattctacatctgtgccagagaccctgaaatatggcgtctggcctgcttgaaagtttggggcagaagctgtattaaacttgttccgtacacgtcctggagagagatgtttttagaacggcctcgtgttcggtttgatggcgtgtatatcagtaaaaccacatatattcgtcaaggggaacagtctcttgatggtttctatagagcctggcaccaagtggaatattacaggtacataagattctttcctgatggccatgtgatgatgttgacaacccctgaagagcctcagtccattgttccacgtttaagaactaggaataccaggactgatgcaattctactgggtcactatcgcttgtcacaagacacagacaatcagaccaaagtatttgctgtaataactaagaaaaaagaagaaaaaccacttgactataaatacagatattttcgtcgtgtccctgtacaagaagcagatcagagttttcatgtggggctacagctatgttccagtggtcaccagaggttcaacaaactcatctggatacatcattcttgtcacattacttacaaatcaactggtgagactgcagtcagtgcttttgagattgacaagatgtacacccccttgttcttcgccagagtaaggagctacacagctttctcagaaaggcctctgtagagcctcaagtccagtcctctatcacttttgcatgaattaaagtatatagcgcaaaagaaaaaaaaaaaaaactctctcctcgtgccgaattcggcacgagggactacaacctctcccaggtatgcgacgggaaagtatccgtccacgtcatcgagggtgaccaccgcacgctgctggagggcagcggcctggagtccatcatcagcatcatccacagctccctggctgagccacgcgtgagcgtgcgggagggctaggcccgtgcccccgcctgcaccggaggtcactcaccatccccaccccaccccacccccgccatgcaacgggattgaagggtcctgccggtgggaccctgtccggcccagtgccactgccccccgaggctgctagacgtaggtgttaggcatgtcccacccacccgccgcctcccacggcacctcggggacaccagagctgccgacttggagactcctggtctgtgaagagccggtggtgcccgtgcccgcaggaactgggctgggcctcgtgcgcccgtggggtctgcgcttggtctttctgtgcttggatttgcatatttattgcattgctggtagagacccccaggcctgtccaccctgccaagactcctcaggcagcgtgtgggtcccgcactctgcccccatttccccgatgtcccctgcgggcgcgggcagccacccaagcctgctggctgcggccccctctcggccaggcattggctcagcccgctgagtggggggtcgtgggccagtccccgaggagctgggcccctgcacaggcacacagggcccggccacacccagcggccccccgcacagccacccgtggggtgctgcccttatgcccggcgccgggcaccaactccatgtttggtgtttgtctgtgtttgtttttcaagaaatgattcaaattgctgcttggattttgaaatttactgtaactgtcagtgtacacgtctggaccccgtttcatttttacaccaatttggtaaaaatgctgctctcagcctcccacaattaaaccgcatgtgatctccaaaaaa

SEQ ID NO: 428061 - DNA, 2933 bp, Homo sapiens
ggcgcgtcggcgcaggtttccgcagctgagggggcagctccgcggcggcgtccggggtctccagtagggctgacgctccggtgctcgcacaatcccccgcctcggctggcaacgggcgtccctccactccccgagtccccggcagccgccgccaccccagcgcgccccgatctggccccctgccccgcgaagatggctgccgtacgccgggcccgcagttattgccgctgcctggtgcgcttctccgaccgagaactctgctaagctccgctgcagagacaggcaggagtagacacccggacacccagcacccctcctccggggggcggtgcagagggggcacggagagcccctcgagcgcagcaggccgccccgccagcatggcagaagctgaggaagattgtcattctgatactgtcagagcagatgatgatgaagaaaatgaaagtcctgctgaaacagatctgcaggcacaactccagatgttccgagctcagtggatgtttgaacttgctccaggtgtaagctctagcaatttagaaaatcgaccttgcagagcagcaagaggctctctccagaaaacatcggcagataccaaaggaaaacaagaacaggcaaaagaagaaaaggctcgagaactcttcctaaaagcagtagaagaagaacaaaatggagctctctatgaagccatcaagttttatcgtagggctatgcaacttgtacctgatatagagttcaagattacttatacccggtctccagatggtgatggcgttggaaacagctacattgaagataatgatgatgacagcaaaatggcagatctcttgtcctacttccagcagcaactcacatttcaggagtctgtgcttaaactgtgtcagcctgagcttgagagcagtcagattcacatatcagtgctgccaatggaggtcctgatgtacatcttccgatgggtggtgtctagtgacttggacctcagatcattggagcagttgtcgctggtgtgcagaggattctacatctgtgccagagaccctgaaatatggcgtctggcctgcttgaaagtttggggcagaagctgtattaaacttgttccgtacacgtcctggagagagatgtttttagaacggcctcgtgttcggtttgatggcgtgtatatcagtaaaaccacatatattcgtcaaggggaacagtctcttgatggtttctatagagcctggcaccaagtggaatattacaggtacataagattctttcctgatggccatgtgatgatgttgacaacccctgaagagcctcagtccattgttccacgtttaagaactaggaataccaggactgatgcaattctactgggtcactatcgcttgtcacaagacacagacaatcagaccaaagtatttgctgtaataactaagaaaaaagaagaaaaaaaaaaactcgagactagttctcaaagaaatatgaacctcctgtaccaactagagtggggaaaaagaagaagaaaacaaagggaccagatgctgccagcaaactgccactggtgacacctcacactcagtgccggttaaaattactgaagttagagagaattaaagactatcttctcatggaggaagaattcattagaaatcaggaacaaatgaaaccattagaagaaaagcaagaggaggaaagatcaaaagtggatgatctgagggggaccccgatgtcagtaggaaccttggaagagattattgatgacaatcatgccatcgtgtctacatctgtgggctcagaacactacgtcagcattctttcatttgtagacaaggatctgctggaacctggctgctcggtcctgctcaaccacaaggtgcatgccgtgataggggtgctgatggatgacacggatcccctggtcacagtgatgaaggtagaaaaggccccccaggagacctatgcagatattggggggttggacaaccaaattcaggaaattaaggaatctgtggagcttcctctcacccatcctgaatattatgaagagatgggtataaagcctcctaagggggtcattctctatggtccacctggcacaggtaaaaccttgttagccaaagcagtagcaaaccaaacctcagccactttcttgagagtggttggctctgaacttattcagaagtacctaggtgatgggcccaaactcgtacgggaattgttccgagttgctgaagaacatgcaccgtccatcgtgtttattgatgaaattgacgccattgggacaaaaagatatgactccaattctggtggtgagagagaaattcagcgaacaatgttggaactgctgaaccagttggatggatttgattctaggggagatgtgaaagttatcatggccacaaaccgaatagaaactttggatccagcacttatcagaccaggccgcattgacaggaagattgagttccccctgcctgatgaaaagacgaagaagcgcatctttcagattcacacaagcaggatgacgctggctgatgatgtaaccctggacgacctgatcatggctaaagatgacctctctggtgctgacatcaaggcaatctgtacagaagctggtctgatggccttaagagaacgtagaatgaaagtaacaaatgaagacttcaaaaaatctaaagaaaatgttctttataagaaacaggaaggcacccctgaggggctgtatctctaatgaaccatggctgtcatcaggaaaatggttgggagatttctcaatccctgaaagggatgaggttgggggagttgcccagaggaatccctgttcccactgatttttattagcaaaacatcctgtgtcttttggagtacgatgtgtaagtgcccattgggtggcctgttggtcactgtgcagcagtctgcttcccaataaagcgtgctctttcacaaac

SEQ ID NO: 428062 - DNA, 1588 bp, Homo sapiens
  misc_feature (1)..(2): n is a, c, g, or t
  misc_feature (4)..(4): n is a, c, g, or t
  misc_feature (7)..(8): n is a, c, g, or t
nncncannctccagtctgtctgtgctctcaaaaactttagtcgttataacaactgtgactgttgagaaatttcactgttttcctgcattcctggcgcgggactctagccagaggctccgaggactttgtagcgactgtcccaagcgtccagttcgatgcttctcagggcggcttgctttaagggcccacccctaaatttgggttgtaaaaatttttgaggcagaagctgaggaagattgtcattctgatactgtcagagcagatgatgatgaagaaaatgaaagtcctgctgaaacagatctgcaggcacaactccagatgttccgagctcagtggatgtttgaacttgctccaggtgtaagctctagcaatttagaaaatcgaccttgcagagcagcaagaggctctctccagaaaacatcggcagataccaaaggaaaacaagaacaggcaaaagaagaaaaggctcgagaactcttcctaaaagcagtagaagaagaacaaaatggagctctctatgaagccatcaagttttatcgtagggctatgcaacttgtacctgatatagagttcaagattacttatacccggtctccagatggtgatggcgttggaaacagctacattgaagataatgatgatgacagcaaaatggcagatctcttgtcctacttccagcagcaactcacatttcaggagtctgtgcttaaactgtgtcagcctgagcttgagagcagtcagattcacatatcagtgctgccaatggaggtcctgatgtacatcttccgatgggtggtgtctagtgacttggacctcagatcattggagcagttgtcgctggtgtgcagaggattctacatctgtgccagagaccctgaaatatggcgtctggcctgcttgaaagtttggggcagaagctgtattaaacttgttccgtacacgtcctggagagagatgtttttagaacggcctcgtgttcggtttgatggcgtgtatatcagtaaaaccacatatattcgtcaaggggaacagtctcttgatggtttctatagagcctggcaccaagtggaatattacaggtacataagattctttcctgatggccatgtgatgatgttgacaacccctgaagagcctcagtccattgttccacgtttaagaactaggaataccaggactgatgcaattctactgggtcactatcgcttgtcacaagacacagacaatcagaccaaagtatttgctgtaataactaagaaaaaagaagaaaaaccacttgactataaatacagatattttcgtcgtgtccctgtacaagaagcagatcagagttttcatgtggggctacagctatgttccagtggtcaccagaggttcaacaaactcatctggatacatcattcttgtcacattacttacaaatcaactggtgagactgcagtcagtgcttttgagattgacaagatgtacacccccttgttcttcgccagagtaaggagctacacagctttctcagaaaggcctctgtagagcctcaagtccagtcctctatcacttttgcatgaattaaagtatatagcgcaaaaga

SEQ ID NO: 428063 - DNA, 921 bp, Homo sapiens
tcctatcaccttgttggccacgaaaaaactggcgtctccacttccctctgatgggctcctggagcctgggcagcagcagcctgagagacagagagagttgctttgactgtgactgcaggtttcctgagaaaccacttgactataaatacagatattttcgtcgtgtccctgtacaagaagcagatcagagttttcatgtggggctacagctatgttccagtggtcaccagaggttcaacaaactcatctggatacatcattcttgtcacattacttacaaatcaactggtgagactgcagtcagtgcttttgagattgacaagatgtacacccccttgttcttcgccagagtaaggagctacacagctttctcagaaaggcctctgtagagcctcaagtccagtcctctatcacttttgcatgaattaaagtatatagcgcaaaagagcacctaagttataaatgtgtgtgtgtgtgtgtgtgtgtatatatatatatatatatatatatatatatatatatatatggaattggaacttattttaaattgttggagttcttttaagaagaatataaattgattattttttttatttaaagggatagttgattcctggggtgttttgaaattaagttggaattaagttgcttaagcatatttatgttgtgagaaaccttaatatgaggtttatcatgccctttttcaagcagatttatgagcagatttctgtcacataagtcgtcttctgcttgagtatcctaatatttcaatgcatcaggggagcgctccactggataagcattttatttcccgcatggcatagtgtttttgcactaaaggctcaaagtgtgagaacctgttctggatttgtttgaaattatttcaccaataaagatcataaataaatgtttctttcaaga

SEQ ID NO: 428064 - DNA, 772 bp, Homo sapiens
agagaatatgcttttcagactcattttcctttggaaattaatagtaaggtctcaagtgccccctacagccttgctactcaaagtgggttccacaaagtgttgacagtatggtactaaatagaaagtggctgaatgagaaatgtagattgcagagggcaactggtgtgtttatatgcctgacattatttgggttttcccccctcaggcagaagctgaggaagattgtcattctgatactgtcagagcagatgatgatgaagaaaatgaaagtcctgctgaaacagatctgcaggcacaactccagatgttccgagctcagtggatgtttgaacttgctccaggtgtaagctctagcaatttagaaaatcgaccttgcagagcagcaagaggctctctccagaaaacatcggcagataccaaaggaaaacaagaacaggcaaaagaagaaaagttaagtattatagatattgtaacaaattacattttttttttttggcacatggaaattttcactgacacagtaagtaggcattataaccagactttcgggacataaacacatatcttgtaaaataaaaattttgactagtatactagtttatatatttctcacaatttcttctaggtactttggatggtaccactactcctgcatggcttttttctctgtgggtacactgtcttcattgagctgtcttttgttaatttatagacctctgggattcatgtggttcctaaaagattggtgtctctgaatttattaacagaacca

SEQ ID NO: 428065 - DNA, 3772 bp, Homo sapiens
ggcgcgtcggcgcaggtttccgcagctgagggggcagctccgcggcggcgtccggggtctccagtagggctgacgctccggtgctcgcacaatcccccgcctcggctggcaacgggcgtccctccactccccgagtccccggcagccgccgccaccccagcgcgccccgatctggccccctgccccgcgaagatggctgccgtacgccgggcccgcagttattgccgctgcctggtgcgcttctccgaccgagaactctgctaagctccgctgcagagacaggcaggagtagacacccggacacccagcacccctcctccggggggcggtgcagagggggcacggagagcccctcgagcgcagcaggccgccccgccagcatggcagaagctgaggaagattgtcattctgatactgtcagagcagatgatgatgaagaaaatgaaagtcctgctgaaacagatctgcaggcacaactccagatgttccgagctcagtggatgtttgaacttgctccaggtgtaagctctagcaatttagaaaatcgaccttgcagagcagcaagaggctctctccagaaaacatcggcagataccaaaggaaaacaagaacaggcaaaagaagaaaaggctcgagaactcttcctaaaagcagtagaagaagaacaaaatggagctctctatgaagccatcaagttttatcgtagggctatgcaacttgtacctgatatagagttcaagattacttatacccggtctccagatggtgatggcgttggaaacagctacattgaagataatgatgatgacagcaaaatggcagatctcttgtcctacttccagcagcaactcacatttcaggagtctgtgcttaaactgtgtcagcctgagcttgagagcagtcagattcacatatcagtgctgccaatggaggtcctgatgtacatcttccgatgggtggtgtctagtgacttggacctcagatcattggagcagttgtcgctggtgtgcagaggattctacatctgtgccagagaccctgaaatatggcgtctggcctgcttgaaagtttggggcagaagctgtattaaacttgttccgtacacgtcctggagagagatgtttttagaacggcctcgtgttcggtttgatggcgtgtatatcagtaaaaccacatatattcgtcaaggggaacagtctcttgatggtttctatagagcctggcaccaagtggaatattacaggtacataagattctttcctgatggccatgtgatgatgttgacaacccctgaagagcctcagtccattgttccacgtttaagaactaggaataccaggactgatgcaattctactgggtcactatcgcttgtcacaagacacagacaatcagaccaaagtatttgctgtaataactaagaaaaaagaagaaaaaccacttgactataaatacagatattttcgtcgtgtccctgtacaagaagcagatcagagttttcatgtggggctacagctatgttccagtggtcaccagaggttcaacaaactcatctggatacatcattcttgtcacattacttacaaatcaactggtgagactgcagtcagtgcttttgagattgacaagatgtacacccccttgttcttcgccagagtaaggagctacacagctttctcagaaaggcctctgtagagcctcaagtccagtcctctatcacttttgcatgaattaaagtatatagcgcaaaagagcacctaagttataaatgtgtgtgtgtgtgtgtgtgtgtatatatatatatatatatatatatatatatatatatatatggaattggaacttattttaaattgttggagttcttttaagaagaatataaattgattattttttttatttaaagggatagttgattcctggggtgttttgaaattaagttggaattaagttgcttaagcatatttatgttgtgagaaaccttaatatgaggtttatcatgccctttttcaagcagatttatgagcagatttctgtcacataagtcgtcttctgcttgagtatcctaatatttcaatgcatcaggggagcgctccactggataagcattttatttcccgcatggcatagtgtttttgcactaaaggctcaaagtgtgagaacctgttctggatttgtttgaaattatttcaccaataaagatcataaataaatgtttctttcaagaaaatatatttggatggcctttttaaagtaacaggatatttaataagagtcctagatagccagcggagactttaagaatcattgcctctagctgggtgtggtggcatgcacctgtagtcccagctatttgggaggctgatgcaggagaatagcttaagcccaggaatttgagtctgggagtttgagtccagcatgggcaacataacaagaccccatcccttattaaaagaaaaaaaaataattcctcatttcatcattggtctttatatgtagccacaaacactgacctcatgtaggcaccttaccaatatatgacattaagtgagagtgaatcccttaggactggaacacttcaagctcaaccaactgactcagttgtcattcttcacaaaagaatagtagaggatcatgtaaacctgagcctaactcttgttccagtatgaaagttgggggagagcaccagccacctaggaaaactgtatgttacctttttactcaaaggagtcccccctgcccagtaacagtcctattagtgtttaatttcagagtttgtgtctggtagacctctacctgattcagatttggttttgttgtttcaaccatagttagagacaaattctcatgtactttcagaaatcaatatctgcagccactgttacttttaattgacattaagagacacttcataggttcccacaattcagtatgggataggctttttaaaaagcacatacagaccaggcgtggtggctcatgcctataatcccagcactttgggaggctaagacaggcagatcacctgagctcaggagtccaagaccagcctgggcaacatggcaaaacaccgtctctacaaaaaaaaaaaaaaaaaaaattagccaagtacagtggggcacacctatagtcgcagctacttgggaggctggggcaggagaattgcctgagcctgggaagtggaagttgcagtgagccaagatcgtgccattccactccagcctgagcaacacagtgagaccctatctcaaaaaaataatgatgatagtacacgttatgttaaaggtgaaatgtgcatacagaaggaagagagttggccaggtgtggtgactcacacctataatcccaatactttgggaggccaaggcaggaggattgcttgaggtcaggagttttagaccagcctggacaacatagcaagacctcatctcttctaaaaattaaaaaaaaaaaaaataggcatggtggtacacacctgtggtcccagctagttgggaggctaaggcaggaggatcacttagccaggaggctgaggctacagtgagccaagattgcaccactgtgctccagcctgggtgagaaagcgagaccctgtctcaaaaaagaaaaaaaagagaggttggccttttgtagcaatctgagaagtgtgtttttcaagttggaaaggaaggagaaaagcaacttgcctaagataaggtagctcttcatgatatgactgttatttctgatatacaaataaatagaacatgattaggacatagtcaaatatagct

SEQ ID NO: 428066 - DNA, 2226 bp, Homo sapiens
ggcgcgtcggcgcaggtttccgcagctgagggggcagctccgcggcggcgtccggggtctccagtagggctgacgctccggtgctcgcacaatcccccgcctcggctggcaacgggcgtccctccactccccgagtccccggcagccgccgccaccccagcgcgccccgatctggccccctgccccgcgaagatggctgccgtacgccgggcccgcagttattgccgctgcctggtgcgcttctccgaccgagaactctgctaagctccgctgcagagacaggcaggagtagacacccggacacccagcacccctcctccggggggcggtgcagagggggcacggagagcccctcgagcgcagcaggccgccccgccagcatggcagaagctgaggaagattgtcattctgatactgtcagagcagatgatgatgaagaaaatgaaagtcctgctgaaacagatctgcaggcacaactccagatgttccgagctcagtggatgtttgaacttgctccaggtgtaagctctagcaatttagaaaatcgaccttgcagagcagcaagaggctctctccagaaaacatcggcagataccaaaggaaaacaagaacaggcaaaagaagaaaaggctcgagaactcttcctaaaagcagtagaagaagaacaaaatggagctctctatgaagccatcaagttttatcgtagggctatgcaacttgtacctgatatagagttcaagattacttatacccggtctccagatggtgatggcgttggaaacagctacattgaagataatgatgatgacagcaaaatggcagatctcttgtcctacttccagcagcaactcacatttcaggagtctgtgcttaaactgtgtcagcctgagcttgagagcagtcagattcacatatcagtgctgccaatggaggtcctgatgtacatcttccgatgggtggtgtctagtgacttggacctcagatcattggagcagttgtcgctggtgtgcagaggattctacatctgtgccagagaccctgaaatatggcgtctggcctgcttgaaagtttggggcagaagctgtattaaacttgttccgtacacgtcctggagagagatgtttttagaacggcctcgtgttcggtttgatggcgtgtatatcagtaaaaccacatatattcgtcaaggggaacagtctcttgatggtttctatagagcctggcaccaagtggaatattacaggtacataagattctttcctgatggccatgtgatgatgttgacaacccctgaagagcctcagtccattgttccacgtttaagaactaggaataccaggactgatgcaattctactgggtcactatcgcttgtcacaagacacagacaatcagaccaaagtatttgctgtaataactaagaaaaaagaagaaaaaccacttgactataaatacagatattttcgtcgtgtccctgtacaagaagcagatcagagttttcatgtggggctacagctatgttccagtggtcaccagaggttcaacaaactcatctggatacatcattcttgtcacattacttacaaatcaactggtgagactgcagtcagtgcttttgagattgacaagatgtacacccccttgttcttcgccagagtaaggagctacacagctttctcagaaaggcctctgtagagcctcaagtccagtcctctatcacttttgcatgaattaaagtatatagcgcaaaagagcacctaagttataaatgtgtgtgtgtgtgtgtgtgtgtatatatatatatatatatatatatatatatatatatatatggaattggaacttattttaaattgttggagttcttttaagaagaatataaattgattattttttttatttaaagggatagttgattcctggggtgttttgaaattaagttggaattaagttgcttaagcatatttatgttgtgagaaaccttaatatgaggtttatcatgccctttttcaagcagatttatgagcagatttctgtcacataagtcgtcttctgcttgagtatcctaatatttcaatgcatcaggggagcgctccactggataagcattttatttcccgcatggcatagtgtttttgcactaaaggctcaaagtgtgagaacctgttctggatttgtttgaaattatttcaccaataaagatcataaataaatgtttctttcaaga

SEQ ID NO: 428067 - DNA, 3719 bp, Homo sapiens
ggcgcgtcggcgcaggtttccgcagctgagggggcagctccgcggcggcgtccggggtctccagtagggctgacgctccggtgctcgcacaatcccccgcctcggctggcaacgggcgtccctccactccccgagtccccggcagccgccgccaccccagcgcgccccgatctggccccctgccccgcgaagatggctgccgtacgccgggcccgcagttattgccgctgcctggtgcgcttctccgaccgagaactctgctaagctccgctgcagagacaggcaggagtagacacccggacacccagcacccctcctccggggggcggtgcagagggggcacggagagcccctcgagcgcagcaggccgccccgccagcatggcagaagctgaggaagattgtcattctgatactgtcagagcagatgatgatgaagaaaatgaaagtcctgctgaaacagatctgcaggcacaactccagatgttccgagctcagtggatgtttgaacttgctccaggtgtaagctctagcaatttagaaaatcgaccttgcagagcagcaagaggctctctccagaaaacatcggcagataccaaaggaaaacaagaacaggcaaaagaagaaaaggctcgagaactcttcctaaaagcagtagaagaagaacaaaatggagctctctatgaagccatcaagttttatcgtagggctatgcaacttgtacctgatatagagttcaagattacttatacccggtctccagatggtgatggcgttggaaacagctacattgaagataatgatgatgacagcaaaatggcagatctcttgtcctacttccagcagcaactcacatttcaggagtctgtgcttaaactgtgtcagcctgagcttgagagcagtcagattcacatatcagtgctgccaatggaggtcctgatgtacatcttccgatgggtggtgtctagtgacttggacctcagatcattggagcagttgtcgctggtgtgcagaggattctacatctgtgccagagaccctgaaatatggcgtctggcctgcttgaaagtttggggcagaagctgtattaaacttgttccgtacacgtcctggagagagatgtttttagaacggcctcgtgttcggtttgatggcgtgtatatcagtaaaaccacatatattcgtcaaggggaacagtctcttgatggtttctatagagcctggcaccaagtggaatattacaggtacataagattctttcctgatggccatgtgatgatgttgacaacccctgaagagcctcagtccattgttccacgtttaagaactaggaataccaggactgatgcaattctactgggtcactatcgcttgtcacaagacacagacaatcagaccaaagtatttgctgtaataactaagaaaaaagaagaaaaaccacttgactataaatacagatattttcgtcgtgtccctgtacaagaagcagatcagagttttcatgtggggctacagctatgttccagtggtcaccagaggttcaacaaactcatctggatacatcattcttgtcacattacttacaaatcaactggtgagactgcagtcagtgcttttgagattgacaagatgtacacccccttgttcttcgccagagtaaggagctacacagctttctcagaaaggcctctgtagagcctcaagtccagtcctctatcacttttgcatgaattaaagtatatagcgcaaaagagcacctaagttataaatgtgtgtgtgtgtgtgtgtgtgtatatatatatatatatatatatatatatatatatatatatggaattggaacttattttaaattgttggagttcttttaagaagaatataaattgattattttttttatttaaagggatagttgattcctggggtgttttgaaattaagttggaattaagttgcttaagcatatttatgttgtgagaaaccttaatatgaggtttatcatgccctttttcaagcagatttatgagcagatttctgtcacataagtcgtcttctgcttgagtatcctaatatttcaatgcatcaggggagcgctccactggataagcattttatttcccgcatggcatagtgtttttgcactaaaggctcaaagtgtgagaacctgttctggatttgtttgaaattatttcaccaataaagatcataaataaatgtttctttcaagaaaatatatttggatggcctttttaaagtaacaggatatttaataagagtcctagatagccagcggagactttaagaatcattgcctctagctgggtgtggtggcatgcacctgtagtcccagctatttgggaggctgatgcaggagaatagcttaagcccaggaatttgagtctgggagtttgagtccagcatgggcaacataacaagaccccatcccttattaaaagaaaaactcatgtaggcaccttaccaatatatgacattaagtgagagtgaatcccttaggactggaacacttcaagctcaaccaactgactcagttgtcattcttcacaaaagaatagtagaggatcatgtaaacctgagcctaactcttgttccagtatgaaagttgggggagagcaccagccacctaggaaaactgtatgttacctttttactcaaaggagtcccccctgcccagtaacagtcctattagtgtttaatttcagagtttgtgtctggtagacctctacctgattcagatttggttttgttgtttcaaccatagttagagacaaattctcatgtactttcagaaatcaatatctgcagccactgttacttttaattgacattaagagacacttcataggttcccacaattcagtatgggataggctttttaaaaagcacatacagaccaggcgtggtggctcatgcctataatcccagcactttgggaggctaagacaggcagatcacctgagctcaggagtccaagaccagcctgggcaacatggcaaaacaccgtctctacaaaaaaaaaaaaaaaaaaaattagccaagtacagtggggcacacctatagtcgcagctacttgggaggctggggcaggagaattgcctgagcctgggaagtggaagttgcagtgagccaagatcgtgccattccactccagcctgagcaacacagtgagaccctatctcaaaaaaataatgatgatagtacacgttatgttaaaggtgaaatgtgcatacagaaggaagagagttggccaggtgtggtgactcacacctataatcccaatactttgggaggccaaggcaggaggattgcttgaggtcaggagttttagaccagcctggacaacatagcaagacctcatctcttctaaaaattaaaaaaaaaaaaaataggcatggtggtacacacctgtggtcccagctagttgggaggctaaggcaggaggatcacttagccaggaggctgaggctacagtgagccaagattgcaccactgtgctccagcctgggtgagaaagcgagaccctgtctcaaaaaagaaaaaaaagagaggttggccttttgtagcaatctgagaagtgtgtttttcaagttggaaaggaaggagaaaagcaacttgcctaagataaggtagctcttcatgatatgactgttatttctgatatacaaataaatagaacatgattaggacatagtcaaatatagct

SEQ ID NO: 428068 - DNA, 2048 bp, Homo sapiens
agagaatatgcttttcagactcattttcctttggaaattaatagtaaggtctcaagtgccccctacagccttgctactcaaagtgggttccacaaagtgttgacagtatggtactaaatagaaagtggctgaatgagaaatgtagattgcagagggcaactggtgtgtttatatgcctgacattatttgggttttcccccctcaggcagaagctgaggaagattgtcattctgatactgtcagagcagatgatgatgaagaaaatgaaagtcctgctgaaacagatctgcaggcacaactccagatgttccgagctcagtggatgtttgaacttgctccaggtgtaagctctagcaatttagaaaatcgaccttgcagagcagcaagaggctctctccagaaaacatcggcagataccaaaggaaaacaagaacaggcaaaagaagaaaaggctcgagaactcttcctaaaagcagtagaagaagaacaaaatggagctctctatgaagccatcaagttttatcgtagggctatgcaacttgtacctgatatagagttcaagattacttatacccggtctccagatggtgatggcgttggaaacagctacattgaagataatgatgatgacagcaaaatggcagatctcttgtcctacttccagcagcaactcacatttcaggagtctgtgcttaaactgtgtcagcctgagcttgagagcagtcagattcacatatcagtgctgccaatggaggtcctgatgtacatcttccgatgggtggtgtctagtgacttggacctcagatcattggagcagttgtcgctggtgtgcagaggattctacatctgtgccagagaccctgaaatatggcgtctggcctgcttgaaagtttggggcagaagctgtattaaacttgttccgtacacgtcctggagagagatgtttttagaacggcctcgtgttcggtttgatggcgtgtatatcagtaaaaccacatatattcgtcaaggggaacagtctcttgatggtttctatagagcctggcaccaagtggaatattacaggtacataagattctttcctgatggccatgtgatgatgttgacaacccctgaagagcctcagtccattgttccacgtttaagaactaggaataccaggactgatgcaattctactgggtcactatcgcttgtcacaagacacagacaatcagaccaaagtatttgctgtaataactaagaaaaaagaagaaaaaccacttgactataaatacagatattttcgtcgtgtccctgtacaagaagcagatcagagttttcatgtggggctacagctatgttccagtggtcaccagaggttcaacaaactcatctggatacatcattcttgtcacattacttacaaatcaactggtgagactgcagtcagtgcttttgagattgacaagatgtacacccccttgttcttcgccagagtaaggagctacacagctttctcagaaaggcctctgtagagcctcaagtccagtcctctatcacttttgcatgaattaaagtatatagcgcaaaagagcacctaagttataaatgtgtgtgtgtgtgtgtgtgtgtatatatatatatatatatatatatatatatatatatatatggaattggaacttattttaaattgttggagttcttttaagaagaatataaattgattattttttttatttaaagggatagttgattcctggggtgttttgaaattaagttggaattaagttgcttaagcatatttatgttgtgagaaaccttaatatgaggtttatcatgccctttttcaagcagatttatgagcagatttctgtcacataagtcgtcttctgcttgagtatcctaatatttcaatgcatcaggggagcgctccactggataagcattttatttcccgcatggcatagtgtttttgcactaaaggctcaaagtgtgagaacctgttctggatttgtttgaaattatttcaccaataaagatcataaataaatgtttctttcaaga

SEQ ID NO: 428069 - DNA, 3740 bp, Homo sapiens
  misc_feature (1824)..(1824): n is a, c, g, or t
  misc_feature (1853)..(1854): n is a, c, g, or t
  misc_feature (1857)..(1857): n is a, c, g, or t
  misc_feature (1862)..(1863): n is a, c, g, or t
  misc_feature (1865)..(1865): n is a, c, g, or t
  misc_feature (1871)..(1871): n is a, c, g, or t
  misc_feature (1873)..(1873): n is a, c, g, or t
  misc_feature (1875)..(1875): n is a, c, g, or t
  misc_feature (1877)..(1877): n is a, c, g, or t
  misc_feature (1879)..(1879): n is a, c, g, or t
  misc_feature (1882)..(1882): n is a, c, g, or t
ggcgcgtcggcgcaggtttccgcagctgagggggcagctccgcggcggcgtccggggtctccagtagggctgacgctccggtgctcgcacaatcccccgcctcggctggcaacgggcgtccctccactccccgagtccccggcagccgccgccaccccagcgcgccccgatctggccccctgccccgcgaagatggctgccgtacgccgggcccgcagttattgccgctgcctggtgcgcttctccgaccgagaactctgctaagctccgctgcagagacaggcaggagtagacacccggacacccagcacccctcctccggggggcggtgcagagggggcacggagagcccctcgagcgcagcaggccgccccgccagcatggcagaagctgaggaagattgtcattctgatactgtcagagcagatgatgatgaagaaaatgaaagtcctgctgaaacagatctgcaggcacaactccagatgttccgagctcagtggatgtttgaacttgctccaggtgtaagctctagcaatttagaaaatcgaccttgcagagcagcaagaggctctctccagaaaacatcggcagataccaaaggaaaacaagaacaggcaaaagaagaaaaggctcgagaactcttcctaaaagcagtagaagaagaacaaaatggagctctctatgaagccatcaagttttatcgtagggctatgcaacttgtacctgatatagagttcaagattacttatacccggtctccagatggtgatggcgttggaaacagctacattgaagataatgatgatgacagcaaaatggcagatctcttgtcctacttccagcagcaactcacatttcaggagtctgtgcttaaactgtgtcagcctgagcttgagagcagtcagattcacatatcagtgctgccaatggaggtcctgatgtacatcttccgatgggtggtgtctagtgacttggacctcagatcattggagcagttgtcgctggtgtgcagaggattctacatctgtgccagagaccctgaaatatggcgtctggcctgcttgaaagtttggggcagaagctgtattaaacttgttccgtacacgtcctggagagagatgtttttagaacggcctcgtgttcggtttgatggcgtgtatatcagtaaaaccacatatattcgtcaaggggaacagtctcttgatggtttctatagagcctggcaccaagtggaatattacaggtacataagattctttcctgatggccatgtgatgatgttgacaacccctgaagagcctcagtccattgttccacgtttaagaactaggaataccaggactgatgcaattctactgggtcactatcgcttgtcacaagacacagacaatcagaccaaagtatttgctgtaataactaagaaaaaagaagaaaaaccacttgactataaatacagatattttcgtcgtgtccctgtacaagaagcagatcagagttttcatgtggggctacagctatgttccagtggtcaccagaggttcaacaaactcatctggatacatcattcttgtcacattacttacaaatcaactggtgagactgcagtcagtgcttttgagattgacaagatgtacacccccttgttcttcgccagagtaaggagctacacagctttctcagaaaggcctctgtagagcctcaagtccagtcctctatcacttttgcatgaattaaagtatatagcgcaaaagagcacctaagttataaatgtgtgtgtgtgtgtgtgtgtgtatatatatatatatatatatatatacacacacncacacacacacacacacacacacacacannccnctgcnncnattttncnangncncanttcttttaagaagaatataaattgattattttttttatttaaagggatagttgattcctggggtgttttgaaattaagttggaattaagttgcttaagcatatttatgttgtgagaaaccttaatatgaggtttatcatgccctttttcaagcagatttatgagcagatttctgtcacataagtcgtcttctgcttgagtatcctaatatttcaatgcatcaggggagcgctccactggataagcattttatttcccgcatggcatagtgtttttgcactaaaggctcaaagtgtgagaacctgttctggatttgtttgaaattatttcaccaataaagatcataaataaatgtttctttcaagaaaatatatttggatggcctttttaaagtaacaggatatttaataagagtcctagatagccagcggagactttaagaatcattgcctctagctgggtgtggtggcatgcacctgtagtcccagctatttgggaggctgatgcaggagaatagcttaagcccaggaatttgagtctgggagtttgagtccagcatgggcaacataacaagaccccatcccttattaaaagaaaaactcatgtaggcaccttaccaatatatgacattaagtgagagtgaatcccttaggactggaacacttcaagctcaaccaactgactcagttgtcattcttcacaaaagaatagtagaggatcatgtaaacctgagcctaactcttgttccagtatgaaagttgggggagagcaccagccacctaggaaaactgtatgttacctttttactcaaaggagtcccccctgcccagtaacagtcctattagtgtttaatttcagagtttgtgtctggtagacctctacctgattcagatttggttttgttgtttcaaccatagttagagacaaattctcatgtactttcagaaatcaatatctgcagccactgttacttttaattgacattaagagacacttcataggttcccacaattcagtatgggataggctttttaaaaagcacatacagaccaggcgtggtggctcatgcctataatcccagcactttgggaggctaagacaggcagatcacctgagctcaggagtccaagaccagcctgggcaacatggcaaaacaccgtctctacaaaaaaaaaaaaaaaaaaaattagccaagtacagtggggcacacctatagtcgcagctacttgggaggctggggcaggagaattgcctgagcctgggaagtggaagttgcagtgagccaagatcgtgccattccactccagcctgagcaacacagtgagaccctatctcaaaaaaataatgatgatagtacacgttatgttaaaggtgaaatgtgcatacagaaggaagagagttggccaggtgtggtgactcacacctataatcccaatactttgggaggccaaggcaggaggattgcttgaggtcaggagttttagaccagcctggacaacatagcaagacctcatctcttctaaaaattaaaaaaaaaaaaaataggcatggtggtacacacctgtggtcccagctagttgggaggctaaggcaggaggatcacttagccaggaggctgaggctacagtgagccaagattgcaccactgtgctccagcctgggtgagaaagcgagaccctgtctcaaaaaagaaaaaaaagagaggttggccttttgtagcaatctgagaagtgtgtttttcaagttggaaaggaaggagaaaagcaacttgcctaagataaggtagctcttcatgatatgactgttatttctgatatacaaataaatagaacatgattaggacatagtcaaatatagct

SEQ ID NO: 428070 - DNA, 2300 bp, Homo sapiens
  misc_feature (177)..(177): n is a, c, g, or t
aggcgtcgtgagacacgttcgcgcggctgacggggccggctccgtgaagggagctactggggatcatccatgtaggcgtaggacagcatccgtggtgtcatcgcaactaagtgcctctgggcacttccgtgcactggacaatacagagagacagcgtcccgcgcaggtcacaccggnagtcgctccgtggaagcacagatcgcacgaatgcgagttgctggcagcggtcattaggtggcatcttatcaggcagagagatcgcgaatgcgagctcgagatcaacagttactgcactccgccgctgcctggtgcgcttctccgaccgagaactctgctaagctccgctgcagagacaggcaggagtagacacccggacacccagcacccctcctccggggggcggtgcagagggggcacggagagcccctcgagcgcagcaggccgccccgccagcatggcagaagctgaggaagattgtcattctgatactgtcagagcagatgatgatgaagaaaatgaaagtcctgctgaaacagatctgcaggcacaactccagatgttccgagctcagtggatgtttgaacttgctccaggtgtaagctctagcaatttagaaaatcgaccttgcagagcagcaagaggctctctccagaaaacatcggcagataccaaaggaaaacaagaacaggcaaaagaagaaaaggctcgagaactcttcctaaaagcagtagaagaagaacaaaatggagctctctatgaagccatcaagttttatcgtagggctatgcaacttgtacctgatatagagttcaagattacttatacccggtctccagatggtgatggcgttggaaacagctacattgaagataatgatgatgacagcaaaatggcagatctcttgtcctacttccagcagcaactcacatttcaggagtctgtgcttaaactgtgtcagcctgagcttgagagcagtcagattcacatatcagtgctgccaatggaggtcctgatgtacatcttccgatgggtggtgtctagtgacttggacctcagatcattggagcagttgtcgctggtgtgcagaggattctacatctgtgccagagaccctgaaatatggcgtctggcctgcttgaaagtttggggcagaagctgtattaaacttgttccgtacacgtcctggagagagatgtttttagaacggcctcgtgttcggtttgatggcgtgtatatcagtaaaaccacatatattcgtcaaggggaacagtctcttgatggtttctatagagcctggcaccaagtggaatattacaggtacataagattctttcctgatggccatgtgatgatgttgacaacccctgaagagcctcagtccattgttccacgtttaagaactaggaataccaggactgatgcaattctactgggtcactatcgcttgtcacaagacacagacaatcagaccaaagtatttgctgtaataactaagaaaaaagaagaaaaaccacttgactataaatacagatattttcgtcgtgtccctgtacaagaagcagatcagagttttcatgtggggctacagctatgttccagtggtcaccagaggttcaacaaactcatctggatacatcattcttgtcacattacttacaaatcaactggtgagactgcagtcagtgcttttgagattgacaagatgtacacccccttgttcttcgccagagtaaggagctacacagctttctcagaaaggcctctgtagagcctcaagtccagtcctctatcacttttgcatgaattaaagtatatagcgcaaaagagcacctaagttataaatgtgtgtgtgtgtgtgtgtgtgtatatatatatatatatatatatatatatatatatatatatggaattggaacttattttaaattgttggagttcttttaagaagaatataaattgattattttttttatttaaagggatagttgattcctggggtgttttgaaattaagttggaattaagttgcttaagcatatttatgttgtgagaaaccttaatatgaggtttatcatgccctttttcaagcagatttatgagcagatttctgtcacataagtcgtcttctgcttgagtatcctaatatttcaatgcatcaggggagcgctccactggataagcattttatttcccgcatggcatagtgtttttgcactaaaggctcaaagtgtgagaacctgttctggatttgtttgaaattatttcaccaataaagatcataaataaatgtttctttcaaga

SEQ ID NO: 428071 - DNA, 2062 bp, Homo sapiens
  misc_feature (1)..(2): n is a, c, g, or t
  misc_feature (4)..(4): n is a, c, g, or t
  misc_feature (7)..(8): n is a, c, g, or t
nncncannctccagtctgtctgtgctctcaaaaactttagtcgttataacaactgtgactgttgagaaatttcactgttttcctgcattcctggcgcgggactctagccagaggctccgaggactttgtagcgactgtcccaagcgtccagttcgatgcttctcagggcggcttgctttaagggcccacccctaaatttgggttgtaaaaatttttgaggcagaagctgaggaagattgtcattctgatactgtcagagcagatgatgatgaagaaaatgaaagtcctgctgaaacagatctgcaggcacaactccagatgttccgagctcagtggatgtttgaacttgctccaggtgtaagctctagcaatttagaaaatcgaccttgcagagcagcaagaggctctctccagaaaacatcggcagataccaaaggaaaacaagaacaggcaaaagaagaaaaggctcgagaactcttcctaaaagcagtagaagaagaacaaaatggagctctctatgaagccatcaagttttatcgtagggctatgcaacttgtacctgatatagagttcaagattacttatacccggtctccagatggtgatggcgttggaaacagctacattgaagataatgatgatgacagcaaaatggcagatctcttgtcctacttccagcagcaactcacatttcaggagtctgtgcttaaactgtgtcagcctgagcttgagagcagtcagattcacatatcagtgctgccaatggaggtcctgatgtacatcttccgatgggtggtgtctagtgacttggacctcagatcattggagcagttgtcgctggtgtgcagaggattctacatctgtgccagagaccctgaaatatggcgtctggcctgcttgaaagtttggggcagaagctgtattaaacttgttccgtacacgtcctggagagagatgtttttagaacggcctcgtgttcggtttgatggcgtgtatatcagtaaaaccacatatattcgtcaaggggaacagtctcttgatggtttctatagagcctggcaccaagtggaatattacaggtacataagattctttcctgatggccatgtgatgatgttgacaacccctgaagagcctcagtccattgttccacgtttaagaactaggaataccaggactgatgcaattctactgggtcactatcgcttgtcacaagacacagacaatcagaccaaagtatttgctgtaataactaagaaaaaagaagaaaaaccacttgactataaatacagatattttcgtcgtgtccctgtacaagaagcagatcagagttttcatgtggggctacagctatgttccagtggtcaccagaggttcaacaaactcatctggatacatcattcttgtcacattacttacaaatcaactggtgagactgcagtcagtgcttttgagattgacaagatgtacacccccttgttcttcgccagagtaaggagctacacagctttctcagaaaggcctctgtagagcctcaagtccagtcctctatcacttttgcatgaattaaagtatatagcgcaaaagagcacctaagttataaatgtgtgtgtgtgtgtgtgtgtgtatatatatatatatatatatatatatatatatatatatatggaattggaacttattttaaattgttggagttcttttaagaagaatataaattgattattttttttatttaaagggatagttgattcctggggtgttttgaaattaagttggaattaagttgcttaagcatatttatgttgtgagaaaccttaatatgaggtttatcatgccctttttcaagcagatttatgagcagatttctgtcacataagtcgtcttctgcttgagtatcctaatatttcaatgcatcaggggagcgctccactggataagcattttatttcccgcatggcatagtgtttttgcactaaaggctcaaagtgtgagaacctgttctggatttgtttgaaattatttcaccaataaagatcataaataaatgtttctttcaaga

SEQ ID NO: 428072 - DNA, 1868 bp, Homo sapiens
acaaacttccagatgtgtttcagcaggactttcattttcttcatcatcatctgctctgacagtatcagatgatgatgaagaaaatgaaagtcctgctgaaacagatctgcaggcacaactccagatgttccgagctcagtggatgtttgaacttgctccaggtgtaagctctagcaatttagaaaatcgaccttgcagagcagcaagaggctctctccagaaaacatcggcagataccaaaggaaaacaagaacaggcaaaagaagaaaaggctcgagaactcttcctaaaagcagtagaagaagaacaaaatggagctctctatgaagccatcaagttttatcgtagggctatgcaacttgtacctgatatagagttcaagattacttatacccggtctccagatggtgatggcgttggaaacagctacattgaagataatgatgatgacagcaaaatggcagatctcttgtcctacttccagcagcaactcacatttcaggagtctgtgcttaaactgtgtcagcctgagcttgagagcagtcagattcacatatcagtgctgccaatggaggtcctgatgtacatcttccgatgggtggtgtctagtgacttggacctcagatcattggagcagttgtcgctggtgtgcagaggattctacatctgtgccagagaccctgaaatatggcgtctggcctgcttgaaagtttggggcagaagctgtattaaacttgttccgtacacgtcctggagagagatgtttttagaacggcctcgtgttcggtttgatggcgtgtatatcagtaaaaccacatatattcgtcaaggggaacagtctcttgatggtttctatagagcctggcaccaagtggaatattacaggtacataagattctttcctgatggccatgtgatgatgttgacaacccctgaagagcctcagtccattgttccacgtttaagaactaggaataccaggactgatgcaattctactgggtcactatcgcttgtcacaagacacagacaatcagaccaaagtatttgctgtaataactaagaaaaaagaagaaaaaccacttgactataaatacagatattttcgtcgtgtccctgtacaagaagcagatcagagttttcatgtggggctacagctatgttccagtggtcaccagaggttcaacaaactcatctggatacatcattcttgtcacattacttacaaatcaactggtgagactgcagtcagtgcttttgagattgacaagatgtacacccccttgttcttcgccagagtaaggagctacacagctttctcagaaaggcctctgtagagcctcaagtccagtcctctatcacttttgcatgaattaaagtatatagcgcaaaagagcacctaagttataaatgtgtgtgtgtgtgtgtgtgtgtatatatatatatatatatatatatatatatatatatatatggaattggaacttattttaaattgttggagttcttttaagaagaatataaattgattattttttttatttaaagggatagttgattcctggggtgttttgaaattaagttggaattaagttgcttaagcatatttatgttgtgagaaaccttaatatgaggtttatcatgccctttttcaagcagatttatgagcagatttctgtcacataagtcgtcttctgcttgagtatcctaatatttcaatgcatcaggggagcgctccactggataagcattttatttcccgcatggcatagtgtttttgcactaaaggctcaaagtgtgagaacctgttctggatttgtttgaaattatttcaccaataaagatcataaataaatgtttctttcaaga

SEQ ID NO: 428073 - DNA, 2867 bp, Homo sapiens
ggcgcgtcggcgcaggtttccgcagctgagggggcagctccgcggcggcgtccggggtctccagtagggctgacgctccggtgctcgcacaatcccccgcctcggctggcaacgggcgtccctccactccccgagtccccggcagccgccgccaccccagcgcgccccgatctggccccctgccccgcgaagatggctgccgtacgccgggcccgcagttattgccgctgcctggtgcgcttctccgaccgagaactctgctaagctccgctgcagagacaggcaggagtagacacccggacacccagcacccctcctccggggggcggtgcagagggggcacggagagcccctcgagcgcagcaggccgccccgccagcatggcagaagctgaggaagattgtcattctgatactgtcagagcagatgatgatgaagaaaatgaaagtcctgctgaaacagatctgcaggcacaactccagatgttccgagctcagtggatgtttgaacttgctccaggtgtaagctctagcaatttagaaaatcgaccttgcagagcagcaagaggctctctccagaaaacatcggcagataccaaaggaaaacaagaacaggcaaaagaagaaaaggctcgagaactcttcctaaaagcagtagaagaagaacaaaatggagctctctatgaagccatcaagttttatcgtagggctatgcaacttgtacctgatatagagttcaagattacttatacccggtctccagatggtgatggcgttggaaacagctacattgaagataatgatgatgacagcaaaatggcagatctcttgtcctacttccagcagcaactcacatttcaggagtctgtgcttaaactgtgtcagcctgagcttgagagcagtcagattcacatatcagtgctgccaatggaggtcctgatgtacatcttccgatgggtggtgtctagtgacttggacctcagatcattggagcagttgtcgctggtgtgcagaggattctacatctgtgccagagaccctgaaatatggcgtctggcctgcttgaaagtttggggcagaagctgtattaaacttgttccgtacacgtcctggagagagatgtttttagaacggcctcgtgttcggtttgatggcgtgtatatcagtaaaaccacatatattcgtcaaggggaacagtctcttgatggtttctatagagcctggcaccaagtggaatattacaggtacaactgtagtacactgagtgagtggaaaattctctctctccatgtattagttaaatggacatctgttctttgttgcttttgattgacccgcaaaatggccctcagtatttttatctagtactcaatgtaggaattgcactaaaaaaaaaaataggctaatataaattacagaatttcttctggcctcttttagatttcttcttgtcttttgccctgggtgtatttacttgccttttcaaatagcttgtgcttttattccaccttattgcttgccaaatattattgtcatttagaaaaaaatagacatgttaaccgttgtgtgtggctctcactttgtttgaaattgttgctttgggaaaaacacagaactttaataaaacaatatttgacttttattcagtgagtaaaacttaaaagttcaacagtttcccctgaggaagataaaatatctttggttctttgttgctggactaacaggtagtcagtaatatttgttttaatgttttagcagttctttagcccgtggtatttcagtgttggtttcatagctatgaataggcataggtactaatagataaggacatattttatactttgtgtggggggtgtgttttggtcttccttttcttattacataggtacataagattctttcctgatggccatgtgatgatgttgacaacccctgaagagcctcagtccattgttccacgtttaagaactaggaataccaggactgatgcaattctactgggtcactatcgcttgtcacaagacacagacaatcagaccaaagtatttgctgtaataactaagaaaaaagaagaaaaaccacttgactataaatacagatattttcgtcgtgtccctgtacaagaagcagatcagagttttcatgtggggctacagctatgttccagtggtcaccagaggttcaacaaactcatctggatacatcattcttgtcacattacttacaaatcaactggtgagactgcagtcagtgcttttgagattgacaagatgtacacccccttgttcttcgccagagtaaggagctacacagctttctcagaaaggcctctgtagagcctcaagtccagtcctctatcacttttgcatgaattaaagtatatagcgcaaaagagcacctaagttataaatgtgtgtgtgtgtgtgtgtgtgtatatatatatatatatatatatatatatatatatatatatggaattggaacttattttaaattgttggagttcttttaagaagaatataaattgattattttttttatttaaagggatagttgattcctggggtgttttgaaattaagttggaattaagttgcttaagcatatttatgttgtgagaaaccttaatatgaggtttatcatgccctttttcaagcagatttatgagcagatttctgtcacataagtcgtcttctgcttgagtatcctaatatttcaatgcatcaggggagcgctccactggataagcattttatttcccgcatggcatagtgtttttgcactaaaggctcaaagtgtgagaacctgttctggatttgtttgaaattatttcaccaataaagatcataaataaatgtttctttcaaga

SEQ ID NO: 428074 - DNA, 1752 bp, Homo sapiens
ggcgcgtcggcgcaggtttccgcagctgagggggcagctccgcggcggcgtccggggtctccagtagggctgacgctccggtgctcgcacaatcccccgcctcggctggcaacgggcgtccctccactccccgagtccccggcagccgccgccaccccagcgcgccccgatctggccccctgccccgcgaagatggctgccgtacgccgggcccgcagttattgccgctgcctggtgcgcttctccgaccgagaactctgctaagctccgctgcagagacaggcaggagtagacacccggacacccagcacccctcctccggggggcggtgcagagggggcacggagagcccctcgagcgcagcaggccgccccgccagcatggcagaagctgaggaagattgtcattctgatactgtcagagcagatgatgatgaagaaaatgaaagtcctgctgaaacagatctgcaggcacaactccagatgttccgagctcagtggatgtttgaacttgctccaggtgtaagctctagcaatttagaaaatcgaccttgcagagcagcaagaggctctctccagaaaacatcggcagataccaaaggaaaacaagaacaggcaaaagaagaaaaggctcgagaactcttcctaaaagcagtagaagaagaacaaaatggagctctctatgaagccatcaagttttatcgtagggctatgcaacttgtacctgatatagagttcaagattacttatacccggtctccagatggtgatggcgttggaaacagctacattgaagataatgatgatgacagcaaaatggcagatctcttgtcctacttccagcagcaactcacatttcaggagtctgtgcttaaactgtgtcagcctgagcttgagagcagtcagattcacatatcagtgctgccaatggaggtcctgatgtacatcttccgatgggtggtgtctagtgacttggacctcagatcattggagcagttgtcgctggtgtgcagaggattctacatctgtgccagagaccctgaaatatggcgtctggcctgcttgaaagtttggggcagaagctgtattaaacttgttccgtacacgtcctggagagagatgtttttagaacggcctcgtgttcggtttgatggcgtgtatatcagtaaaaccacatatattcgtcaaggggaacagtctcttgatggtttctatagagcctggcaccaagtggaatattacaggtacataagattctttcctgatggccatgtgatgatgttgacaacccctgaagagcctcagtccattgttccacgtttaagaactaggaataccaggactgatgcaattctactgggtcactatcgcttgtcacaagacacagacaatcagaccaaagtatttgctgtaataactaagaaaaaagaagaaaaaccacttgactataaatacagatattttcgtcgtgtccctgtacaagaagcagatcagagttttcatgtggggctacagctatgttccagtggtcaccagaggttcaacaaactcatctggatacatcattcttgtcacattacttacaaatcaactggtgagactgcagtcagtgcttttgagattgacaagatgtacacccccttgttcttcgccagagtaaggagctacacagctttctcagaaaggcctctgtagagcctcaagtccagtcctctatcacttttgcatgaattaaagtatatagcgcaaaaga

SEQ ID NO: 428075 - DNA, 1711 bp, Homo sapiens
agtgcaattcctacattgagtactagataaaaatactgagggccattttgcggctctctccagaaaacatcggcagataccaaaggaaaacaagaacaggcaaaagaagaaaaggctcgagaactcttcctaaaagcagtagaagaagaacaaaatggagctctctatgaagccatcaagttttatcgtagggctatgcaacttgtacctgatatagagttcaagattacttatacccggtctccagatggtgatggcgttggaaacagctacattgaagataatgatgatgacagcaaaatggcagatctcttgtcctacttccagcagcaactcacatttcaggagtctgtgcttaaactgtgtcagcctgagcttgagagcagtcagattcacatatcagtgctgccaatggaggtcctgatgtacatcttccgatgggtggtgtctagtgacttggacctcagatcattggagcagttgtcgctggtgtgcagaggattctacatctgtgccagagaccctgaaatatggcgtctggcctgcttgaaagtttggggcagaagctgtattaaacttgttccgtacacgtcctggagagagatgtttttagaacggcctcgtgttcggtttgatggcgtgtatatcagtaaaaccacatatattcgtcaaggggaacagtctcttgatggtttctatagagcctggcaccaagtggaatattacaggtacataagattctttcctgatggccatgtgatgatgttgacaacccctgaagagcctcagtccattgttccacgtttaagaactaggaataccaggactgatgcaattctactgggtcactatcgcttgtcacaagacacagacaatcagaccaaagtatttgctgtaataactaagaaaaaagaagaaaaaccacttgactataaatacagatattttcgtcgtgtccctgtacaagaagcagatcagagttttcatgtggggctacagctatgttccagtggtcaccagaggttcaacaaactcatctggatacatcattcttgtcacattacttacaaatcaactggtgagactgcagtcagtgcttttgagattgacaagatgtacacccccttgttcttcgccagagtaaggagctacacagctttctcagaaaggcctctgtagagcctcaagtccagtcctctatcacttttgcatgaattaaagtatatagcgcaaaagagcacctaagttataaatgtgtgtgtgtgtgtgtgtgtgtatatatatatatatatatatatatatatatatatatatatggaattggaacttattttaaattgttggagttcttttaagaagaatataaattgattattttttttatttaaagggatagttgattcctggggtgttttgaaattaagttggaattaagttgcttaagcatatttatgttgtgagaaaccttaatatgaggtttatcatgccctttttcaagcagatttatgagcagatttctgtcacataagtcgtcttctgcttgagtatcctaatatttcaatgcatcaggggagcgctccactggataagcattttatttcccgcatggcatagtgtttttgcactaaaggctcaaagtgtgagaacctgttctggatttgtttgaaattatttcaccaataaagatcataaataaatgtttctttcaaga

SEQ ID NO: 428076 - DNA, 2304 bp, Homo sapiens
ggcgcgtcggcgcaggtttccgcagctgagggggcagctccgcggcggcgtccggggtctccagtagggctgacgctccggtgctcgcacaatcccccgcctcggctggcaacgggcgtccctccactccccgagtccccggcagccgccgccaccccagcgcgccccgatctggccccctgccccgcgaagatggctgccgtacgccgggcccgcagttattgccgctgcctggtgcgcttctccgaccgagaactctgctaagctccgctgcagagacaggcaggagtagacacccggacacccagcacccctcctccggggggcggtgcagagggggcacggagagcccctcgagcgcagcaggccgccccgccagcatggcagaagctgaggaagattgtcattctgatactgtcagagcagatgatgatgaagaaaatgaaagtcctgctgaaacagatctgcaggcacaactccagatgttccgagctcagtggatgtttgaacttgctccaggtgtaagctctagcaatttagaaaatcgaccttgcagagcagcaagaggctctctccagaaaacatcggcagataccaaaggaaaacaagaacaggcaaaagaagaaaaggctcgagaactcttcctaaaagcagtagaagaagaacaaaatggagctctctatgaagccatcaagttttatcgtagggctatgcaacttgtacctgatatagagttcaagattacttatacccggtctccagatggtgatggcgttggaaacagctacattgaagataatgatgatgacagcaaaatggcagatctcttgtcctacttccagcagcaactcacatttcaggagtctgtgcttaaactgtgtcagcctgagcttgagagcagtcagattcacatatcagtgctgccaatggaggtcctgatgtacatcttccgatgggtggtgtctagtgacttggacctcagatcattggagcagttgtcgctggtgtgcagaggattctacatctgtgccagttggcgtgttgtagtccaatcctggaggaaactaggagaattcatcaaacagtccggtgtacgtgtggataacaacagagaccctgaaatatggcgtctggcctgcttgaaagtttggggcagaagctgtattaaacttgttccgtacacgtcctggagagagatgtttttagaacggcctcgtgttcggtttgatggcgtgtatatcagtaaaaccacatatattcgtcaaggggaacagtctcttgatggtttctatagagcctggcaccaagtggaatattacaggtacataagattctttcctgatggccatgtgatgatgttgacaacccctgaagagcctcagtccattgttccacgtttaagaactaggaataccaggactgatgcaattctactgggtcactatcgcttgtcacaagacacagacaatcagaccaaagtatttgctgtaataactaagaaaaaagaagaaaaaccacttgactataaatacagatattttcgtcgtgtccctgtacaagaagcagatcagagttttcatgtggggctacagctatgttccagtggtcaccagaggttcaacaaactcatctggatacatcattcttgtcacattacttacaaatcaactggtgagactgcagtcagtgcttttgagattgacaagatgtacacccccttgttcttcgccagagtaaggagctacacagctttctcagaaaggcctctgtagagcctcaagtccagtcctctatcacttttgcatgaattaaagtatatagcgcaaaagagcacctaagttataaatgtgtgtgtgtgtgtgtgtgtgtatatatatatatatatatatatatatatatatatatatatggaattggaacttattttaaattgttggagttcttttaagaagaatataaattgattattttttttatttaaagggatagttgattcctggggtgttttgaaattaagttggaattaagttgcttaagcatatttatgttgtgagaaaccttaatatgaggtttatcatgccctttttcaagcagatttatgagcagatttctgtcacataagtcgtcttctgcttgagtatcctaatatttcaatgcatcaggggagcgctccactggataagcattttatttcccgcatggcatagtgtttttgcactaaaggctcaaagtgtgagaacctgttctggatttgtttgaaattatttcaccaataaagatcataaataaatgtttctttcaaga

SEQ ID NO: 428077 - DNA, 2508 bp, Homo sapiens
ggcgcgtcggcgcaggtttccgcagctgagggggcagctccgcggcggcgtccggggtctccagtagggctgacgctccggtgctcgcacaatcccccgcctcggctggcaacgggcgtccctccactccccgagtccccggcagccgccgccaccccagcgcgccccgatctggccccctgccccgcgaagatggctgccgtacgccgggcccgcagttattgccgctgcctggtgcgcttctccgaccgagaactctgctaagctccgctgcagagacaggcaggagtagacacccggacacccagcacccctcctccggggggcggtgcagagggggcacggagagcccctcgagcgcagcaggccgccccgccagcatggcagaagctgaggaagattgtcattctgatactgtcagagcagatgatgatgaagaaaatgaaagtcctgctgaaacagatctgcaggcacaactccagatgttccgagctcagtggatgtttgaacttgctccaggtgtaagctctagcaatttagaaaatcgaccttgcagagcagcaagaggctctctccagaaaacatcggcagataccaaaggaaaacaagaacaggcaaaagaagaaaaggctcgagaactcttcctaaaagcagtagaagaagaacaaaatggagctctctatgaagccatcaagttttatcgtagggctatgcaacttgtacctgatatagagttcaagattacttatacccggtctccagatggtgatggcgttggaaacagctacattgaagataatgatgatgacagcaaaatggcagatctcttgtcctacttccagcagcaactcacatttcaggagtctgtgcttaaactgtgtcagcctgagcttgagagcagtcagattcacatatcagtgctgccaatggaggtcctgatgtacatcttccgatgggtggtgtctagtgacttggacctcagatcattggagcagttgtcgctggtgtgcagaggattctacatctgtgccagagaccctgaaatatggcgtctggcctgcttgaaagtttggggcagaagctgtattaaacttgttccgtacacgtcctggagagagatgtttttagaacggcctcgtgttcggtttgatggcgtgtatatcagtaaaaccacatatattcgtcaaggggaacagtctcttgatggtttctatagagcctggcaccaagtggaatattacaggtacataagattctttcctgatggccatgtgatgatgttgacaacccctgaagagcctcagtccattgttccacgtttaagaactaggaataccaggactgatgcaattctactgggtcactatcgcttgtcacaagacacagacaatcagaccaaagtatttgctgtaataactaagaaaaaagaagaaaaaccacttgactataaatacagatattttcgtcgtgtccctgtacaagaagcagatcagagttttcatgtggggctacagctatgttccagtggtcaccagaggttcaacaaactcatctggatacatcattcttgtcacattacttacaaatcaactggtgagactgcagtcagtgcttttgagattgacaagatgtacacccccttgttcttcgccagagtaaggagctacacagctttctcagaaaggcctctgtagagcctcaagtccagtcctctatcacttttgcatgaattaaagtatatagcgcaaaagaaaaaaaaaaaaaaaaaaaaaaaaaaaaaaaaaaaaaaaaaaaaaaaaaaaaaaaaaaaaaaaaaaagaaaaaaaaaaagaataaacataaagaaaagaagacaagaaagaaagaagagcagaataaagataggcaaataacagcaacaataatacaaatatataagacatatgaatttagacaggaattcttaggcggcaagaggatatacaactcagtgtaaactatgcgggaaacacacaagcaggcaaagaggagagcgttgagattctgtcgagagggagtagaacacaaccaagaagatgcggcacaacacaacagcgccacgagagagagaggagaacagaaaaaccatgacgaagagagctcgcgacacaagcataagacacgacagagacaaacagcgcgccacaacaaaggagtaaaagaaaaaacataagagccaaccgaagacaccaaacgacaaggacacagcaaaagataaactgagggtgatagacacgggagaaagcagaatcatcatagcacaggagggtgacagaccgaaggctggtatacagtaaacgggggacaataatctagagggacataagaaagactgagcgcattatccgactgaagcatatacgacagaacgaagatacacctacggaaacgaagtcggggaaagacgaaggagcagcataagacagaacgacatcgacccagtaggcagaacgatgagcactgcgcatcagaagggaaaaatgagaaaag

SEQ ID NO: 428078 - DNA, 1803 bp, Homo sapiens
ggcgcgtcggcgcaggtttccgcagctgagggggcagctccgcggcggcgtccggggtctccagtagggctgacgctccggtgctcgcacaatcccccgcctcggctggcaacgggcgtccctccactccccgagtccccggcagccgccgccaccccagcgcgccccgatctggccccctgccccgcgaagatggctgccgtacgccgggcccgcagttattgccgctgcctggtgcgcttctccgaccgagaactctgctaagctccgctgcagagacaggcaggagtagacacccggacacccagcacccctcctccggggggcggtgcagagggggcacggagagcccctcgagcgcagcaggccgccccgccagcatggcagaagctgaggaagattgtcattctgatactgtcagagcagatgatgatgaagaaaatgaaagtcctgctgaaacagatctgcaggcacaactccagatgttccgagctcagtggatgtttgaacttgctccaggtgtaagctctagcaatttagaaaatcgaccttgcagagcagcaagaggctctctccagaaaacatcggcagataccaaaggaaaacaagaacaggcaaaagaagaaaaggctcgagaactcttcctaaaagcagtagaagaagaacaaaatggagctctctatgaagccatcaagttttatcgtagggctatgcaacttgtacctgatatagagttcaagattacttatacccggtctccagatggtgatggcgttggaaacagctacattgaagataatgatgatgacagcaaaatggcagatctcttgtcctacttccagcagcaactcacatttcaggagtctgtgcttaaactgtgtcagcctgagcttgagagcagtcagattcacatatcagtgctgccaatggaggtcctgatgtacatcttccgatgggtggtgtctagtgacttggacctcagatcattggagcagttgtcgctggtgtgcagaggattctacatctgtgccagagaccctgaaatatggcgtctggcctgcttgaaagtttggggcagaagctgtattaaacttgttccgtacacgtcctggagagagatgtttttagaacggcctcgtgttcggtttgatggcgtgtatatcagtaaaaccacatatattcgtcaaggggaacagtctcttgatggtttctatagagcctggcaccaagtggaatattacaggtacataagattctttcctgatggccatgtgatgatgttgacaacccctgaagagcctcagtccattgttccacgtttaagaactaggaataccaggactgatgcaattctactgggtcactatcgcttgtcacaagacacagacaatcagaccaaagtatttgctgtaataactaagaaaaaagaagaaaaaccacttgactataaatacagatattttcgtcgtgtccctgtacaagaagcagatcagagttttcatgtggggctacagctatgttccagtggtcaccagaggttcaacaaactcatctggatacatcattcttgtcacattacttacaaatcaactggtgagactgcagtcagtgcttttgagattgacaagatgtacacccccttgttcttcgccagagtaaggagctacacagctttctcagaaaggcctctgtagagcctcaagtccagtcctctatcacttttgcatgaattaaagtatatagcgcaaaagaacacgatagcacccgcgcgaatcccttgcaccagcacgattccctcagcat

SEQ ID NO: 428079 - DNA, 1762 bp, Homo sapiens
gcactccagcctgggcaacagagcaagaacctgtcacaaaaaaaaaagaaattcatgtatttttaatatgttaaatattgtttggttcggggctttttcagaggaggacaattaaaagttttcaaggagatgaaaataactttagtgttaatagatgcaatatggatcacacacacatagattattttcctaaaacatttattttaatatgtctggcaaaataatcttatgagggaaaagagtgctttataaaaagtagcttcagatctatactgaaaaaacaaagatatttatgtcttgatgttaagaaccattattattattgagtagctaaatacattcatgctttagctctgagcaatacagagggaaggtataaatgtactgggaatgtagttgtgacaatagaatgacatagaggagagtcactgaaggatgattttccttttgccagtgctgccaatggaggtcctgatgtacatcttccgatgggtggtgtctagtgacttggacctcagatcattggagcagttgtcgctggtgtgcagaggattctacatctgtgccagagaccctgaaatatggcgtctggcctgcttgaaagtttggggcagaagctgtattaaacttgttccgtacacgtcctggagagagatgtttttagaacggcctcgtgttcggtttgatggcgtgtatatcagtaaaaccacatatattcgtcaaggggaacagtctcttgatggtttctatagagcctggcaccaagtggaatattacaggtacataagattctttcctgatggccatgtgatgatgttgacaacccctgaagagcctcagtccattgttccacgtttaagaactaggaataccaggactgatgcaattctactgggtcactatcgcttgtcacaagacacagacaatcagaccaaagtatttgctgtaataactaagaaaaaagaagaaaaaccacttgactataaatacagatattttcgtcgtgtccctgtacaagaagcagatcagagttttcatgtggggctacagctatgttccagtggtcaccagaggttcaacaaactcatctggatacatcattcttgtcacattacttacaaatcaactggtgagactgcagtcagtgcttttgagattgacaagatgtacacccccttgttcttcgccagagtaaggagctacacagctttctcagaaaggcctctgtagagcctcaagtccagtcctctatcacttttgcatgaattaaagtatatagcgcaaaagagcacctaagttataaatgtgtgtgtgtgtgtgtgtgtgtatatatatatatatatatatatatatatatatatatatatggaattggaacttattttaaattgttggagttcttttaagaagaatataaattgattattttttttatttaaagggatagttgattcctggggtgttttgaaattaagttggaattaagttgcttaagcatatttatgttgtgagaaaccttaatatgaggtttatcatgccctttttcaagcagatttatgagcagatttctgtcacataagtcgtcttctgcttgagtatcctaatatttcaatgcatcaggggagcgctccactggataagcattttatttcccgcatggcatagtgtttttgcactaaaggctcaaagtgtgagaacctgttctggatttgtttgaaattatttcaccaataaagatcataaataaatgtttctttcaaga

SEQ ID NO: 428080 - DNA, 1549 bp, Homo sapiens
ggcgcgtcggcgcaggtttccgcagctgagggggcagctccgcggcggcgtccggggtctccagtagggctgacgctccggtgctcgcacaatcccccgcctcggctggcaacgggcgtccctccactccccgagtccccggcagccgccgccaccccagcgcgccccgatctggccccctgccccgcgaagatggctgccgtacgccgggcccgcagttattgccgctgcctggtgcgcttctccgaccgagaactctgctaagctccgctgcagagacaggcaggagtagacacccggacacccagcacccctcctccggggggcggtgcagagggggcacggagagcccctcgagcgcagcaggccgccccgccagcatggcagaagctgaggaagattgtcattctgatactgtcagagcagatgatgatgaagaaaatgaaagtcctgctgaaacagatctgcaggcacaactccagatgttccgagctcagtggatgtttgaacttgctccaggtgtaagctctagcaatttagaaaatcgaccttgcagagcagcaagaggctctctccagaaaacatcggcagataccaaaggaaaacaagaacaggcaaaagaagaaaaggctcgagaactcttcctaaaagcagtagaagaagaacaaaatggagctctctatgaagccatcaagttttatcgtagggctatgcaacttgtacctgatatagagttcaagattacttatacccggtctccagatggtgatggcgttggaaacagctacattgaagataatgatgatgacagcaaaatggcagatctcttgtcctacttccagcagcaactcacatttcaggagtctgtgcttaaactgtgtcagcctgagcttgagagcagtcagattcacatatcagtgctgccaatggaggtcctgatgtacatcttccgatgggtggtgtctagtgacttggacctcagatcattggagcagttgtcgctggtgtgcagaggattctacatctgtgccagagaccctgaaatatggcgtctggcctgcttgaaagtttggggcagaagctgtattaaacttgttccgtacacgtcctggagagagatgtttttagaacggcctcgtgttcggtttgatggcgtgtatatcagtaaaaccacatatattcgtcaaggggaacagtctcttgatggtttctatagagcctggcaccaagtggaatattacaggtacataagattctttcctgatggccatgtgatgatgttgacaacccctgaagagcctcagtccattgttccacgtttaagaactaggaataccaggactgatgcaattctactgggtcactatcgcttgtcacaagacacagacaatcagaccaaagtatttgctgtaataactaagaaaaaagaagaaaaaccacttgactataaatacagatattttcgtcgtgtccctgtacaagaagcagatcagagttttcatgtggggctacagccatttaggtacagccatttaggtacagccattag

SEQ ID NO: 428081 - DNA, 2506 bp, Homo sapiens
ggcgcgtcggcgcaggtttccgcagctgagggggcagctccgcggcggcgtccggggtctccagtagggctgacgctccggtgctcgcacaatcccccgcctcggctggcaacgggcgtccctccactccccgagtccccggcagccgccgccaccccagcgcgccccgatctggccccctgccccgcgaagatggctgccgtacgccgggcccgcagttattgccgctgcctggtgcgcttctccgaccgagaactctgctaagctccgctgcagagacaggcaggagtagacacccggacacccagcacccctcctccggggggcggtgcagagggggcacggagagcccctcgagcgcagcaggccgccccgccagcatggcagaagctgaggaagattgtcattctgatactgtcagagcagatgatgatgaagaaaatgaaagtcctgctgaaacagatctgcaggcacaactccagatgttccgagctcagtggatgtttgaacttgctccaggtgtaagctctagcaatttagaaaatcgaccttgcagagcagcaagaggctctctccagaaaacatcggcagataccaaaggaaaacaagaacaggcaaaagaagaaaaggctcgagaactcttcctaaaagcagtagaagaagaacaaaatggagctctctatgaagccatcaagttttatcgtagggctatgcaacttgtacctgatatagagttcaagattacttatacccggtctccagatggtgatggcgttggaaacagctacattgaagataatgatgatgacagcaaaatggcagatctcttgtcctacttccagcagcaactcacatttcaggagtctgtgcttaaactgtgtcagcctgagcttgagagcagtcagattcacatatcagtgctgccaatggaggtcctgatgtacatcttccgatgggtggtgtctagtgacttggacctcagatcattggagcagttgtcgctggtgtgcagaggattctacatctgtgccagagaccctgaaatatggcgtctggcctgcttgaaagtttggggcagaagctgtattaaacttgttccgtacacgtcctggagagagatgtttttagaacggcctcgtgttcggtttgatggcgtgtatatcagtaaaaccacatatattcgtcaaggggaacagtctcttgatggtttctatagagcctggcaccaagtggaatattacaggtacaactgtagtacactgagtgagtggaaaattctctctctccatgtattagttaaatggacatctgttctttgttgcttttgattgacccgcaaaatggccctcagtatttttatctagtactcaatgtaggaattgcactaaaaaaaaaaataggctaatataaattacagaatttcttctggcctcttttagatttcttcttgtcttttgccctgggtgtatttacttgccttttcaaatagcttgtgcttttattccaccttattgcttgccaaatattattgtcatttagaaaaaaatagacatgttaaccgttgtgtgtggctctcactttgtttgaaattgttgctttgggaaaaacacagaactttaataaaacaatatttgacttttattcagtgagtaaaacttaaaagttcaacagtttcccctgaggaagataaaatatctttggttctttgttgctggactaacaggtagtcagtaatatttgttttaatgttttagcagttctttagcccgtggtatttcagtgttggtttcatagctatgaataggcataggtactaatagataaggacatattttatactttgtgtggggggtgtgttttggtcttccttttcttattacataggtacataagattctttcctgatggccatgtgatgatgttgacaacccctgaagagcctcagtccattgttccacgtttaagaactaggaataccaggactgatgcaattctactgggtcactatcgcttgtcacaagacacagacaatcagaccaaagtatttgctgtaataactaagaaaaaagaagaaaaaccacttgactataaatacagatattttcgtcgtgtccctgtacaagaagcagatcagagttttcatgtggggctacagctatgttccagtggtcaccagaggttcaacaaactcatctggatacatcattcttgtcacattacttacaaatcaactggtgagactgcagtcagtgcttttgagattgacaagatgtacacccccttgttcttcgccagaatttatgagcagatttctgtcacataagtcgtcttctgcttgagtatcctaatatttcaatgcatcaggggagcgctccactggataagcattttatttcccgcatggcatagtgtttttgcactaaaggctcaaagtgtgagaacctgttctggatttgtttgaaattatttcaccaataaagatcataaataaatgtttctttcaaga

SEQ ID NO: 428082 - DNA, 1254 bp, Homo sapiens
aaagaagattcaccagggcagaaaaggcaagccgtggaagtagagtgctcagagcactcaaagaccctgaaatatggcgtctggcctgcttgaaagtttggggcagaagctgtattaaacttgttccgtacacgtcctggagagagatgtttttagaacggcctcgtgttcggtttgatggcgtgtatatcagtaaaaccacatatattcgtcaaggggaacagtctcttgatggtttctatagagcctggcaccaagtggaatattacaggtacataagattctttcctgatggccatgtgatgatgttgacaacccctgaagagcctcagtccattgttccacgtttaagaactaggaataccaggactgatgcaattctactgggtcactatcgcttgtcacaagacacagacaatcagaccaaagtatttgctgtaataactaagaaaaaagaagaaaaaccacttgactataaatacagatattttcgtcgtgtccctgtacaagaagcagatcagagttttcatgtggggctacagctatgttccagtggtcaccagaggttcaacaaactcatctggatacatcattcttgtcacattacttacaaatcaactggtgagactgcagtcagtgcttttgagattgacaagatgtacacccccttgttcttcgccagagtaaggagctacacagctttctcagaaaggcctctgtagagcctcaagtccagtcctctatcacttttgcatgaattaaagtatatagcgcaaaagagcacctaagttataaatgtgtgtgtgtgtgtgtgtgtgtatatatatatatatatatatatatatatatatatatatatggaattggaacttattttaaattgttggagttcttttaagaagaatataaattgattattttttttatttaaagggatagttgattcctggggtgttttgaaattaagttggaattaagttgcttaagcatatttatgttgtgagaaaccttaatatgaggtttatcatgccctttttcaagcagatttatgagcagatttctgtcacataagtcgtcttctgcttgagtatcctaatatttcaatgcatcaggggagcgctccactggataagcattttatttcccgcatggcatagtgtttttgcactaaaggctcaaagtgtgagaacctgttctggatttgtttgaaattatttcaccaataaagatcataaataaatgtttctttcaaga

SEQ ID NO: 428083 - DNA, 1318 bp, Homo sapiens
aacagaccccaaggtatagatgccacctacagggcaggacaggggactttacaggcagtgcgtggctgctgagggcgggacgaggaccggatggggaccaggagggtgacagctgaagggtacagggtttcttttgaagagatgaaaatgttctgaaattggctgtggtgacggcggcgggtttgtcaatacacgcaggtcccctgaggtgtacttttagaacggcctcgtgttcggtttgatggcgtgtatatcagtaaaaccacatatattcgtcaaggggaacagtctcttgatggtttctatagagcctggcaccaagtggaatattacaggtacataagattctttcctgatggccatgtgatgatgttgacaacccctgaagagcctcagtccattgttccacgtttaagaactaggaataccaggactgatgcaattctactgggtcactatcgcttgtcacaagacacagacaatcagaccaaagtatttgctgtaataactaagaaaaaagaagaaaaaccacttgactataaatacagatattttcgtcgtgtccctgtacaagaagcagatcagagttttcatgtggggctacagctatgttccagtggtcaccagaggttcaacaaactcatctggatacatcattcttgtcacattacttacaaatcaactggtgagactgcagtcagtgcttttgagattgacaagatgtacacccccttgttcttcgccagagtaaggagctacacagctttctcagaaaggcctctgtagagcctcaagtccagtcctctatcacttttgcatgaattaaagtatatagcgcaaaagagcacctaagttataaatgtgtgtgtgtgtgtgtgtgtgtatatatatatatatatatatatatatatatatatatatatggaattggaacttattttaaattgttggagttcttttaagaagaatataaattgattattttttttatttaaagggatagttgattcctggggtgttttgaaattaagttggaattaagttgcttaagcatatttatgttgtgagaaaccttaatatgaggtttatcatgccctttttcaagcagatttatgagcagatttctgtcacataagtcgtcttctgcttgagtatcctaatatttcaatgcatcaggggagcgctccactggataagcattttatttcccgcatggcatagtgtttttgcactaaaggctcaaagtgtgagaacctgttctggatttgtttgaaattatttcaccaataaagatcataaataaatgtttctttcaaga

SEQ ID NO: 428084 - DNA, 2343 bp, Homo sapiens
ggcgcgtcggcgcaggtttccgcagctgagggggcagctccgcggcggcgtccggggtctccagtagggctgacgctccggtgctcgcacaatcccccgcctcggctggcaacgggcgtccctccactccccgagtccccggcagccgccgccaccccagcgcgccccgatctggccccctgccccgcgaagatggctgccgtacgccgggcccgcagttattgccgctgcctggtgcgcttctccgaccgagaactctgctaagctccgctgcagagacaggcaggagtagacacccggacacccagcacccctcctccggggggcggtgcagagggggcacggagagcccctcgagcgcagcaggccgccccgccagcatggcagaagctgaggaagattgtcattctgatactgtcagagcagatgatgatgaagaaaatgaaagtcctgctgaaacagatctgcaggcacaactccagatgttccgagctcagtggatgtttgaacttgctccaggtgtaagctctagcaatttagaaaatcgaccttgcagagcagcaagaggctctctccagaaaacatcggcagataccaaaggaaaacaagaacaggcaaaagaagaaaaggctcgagaactcttcctaaaagcagtagaagaagaacaaaatggagctctctatgaagccatcaagttttatcgtagggctatgcaacttgtacctgatatagagttcaagattacttatacccggtctccagatggtgatggcgttggaaacagctacattgaagataatgatgatgacagcaaaatggcagatctcttgtcctacttccagcagcaactcacatttcaggagtctgtgcttaaactgtgtcagcctgagcttgagagcagtcagattcacatatcagtgctgccaatggaggtcctgatgtacatcttccgatgggtggtgtctagtgacttggacctcagatcattggagcagttgtcgctggtgtgcagaggattctacatctgtgccagagaccctgaaatatggcgtctggcctgcttgaaagtttggggcagaagctgtattaaacttgttccgtacacgtcctggagagagatgtttttagaacggcctcgtgttcggtttgatggcgtgtatatcagtaaaaccacatatattcgtcaaggggaacagtctcttgatggtttctatagagcctggcaccaagtggaatattacaggtacaactgtagtacactgagtgagtggaaaattctctctctccatgtattagttaaatggacatctgttctttgttgcttttgattgacccgcaaaatggccctcagtatttttatctagtactcaatgtaggaattgcactaaaaaaaaaaataggctaatataaattacagaatttcttctggcctcttttagatttcttcttgtcttttgccctgggtgtatttacttgccttttcaaatagcttgtgcttttattccaccttattgcttgccaaatattattgtcatttagaaaaaaatagacatgttaaccgttgtgtgtggctctcactttgtttgaaattgttgctttgggaaaaacacagaactttaataaaacaatatttgacttttattcagtgagtaaaacttaaaagttcaacagtttcccctgaggaagataaaatatctttggttctttgttgctggactaacaggtagtcagtaatatttgttttaatgttttagcagttctttagcccgtggtatttcagtgttggtttcatagctatgaataggcataggtactaatagataaggacatattttatactttgtgtggggggtgtgttttggtcttccttttcttattacataggtacataagattctttcctgatggccatgtgatgatgttgacaacccctgaagagcctcagtccattgttccacgtttaagaactaggaataccaggactgatgcaattctactgggtcactatcgcttgtcacaagacacagacaatcagaccaaagtatttatattttcgtcgtgtccctgtacaagaagcagatcagagttttcatgtggggctacagctatgttccagtggtcaccagaggttcaacaaactcatctggatacatcattcttgtcacattacttacaaatcaactggtgagactgcagtcagtgcttttgagattgacaagatgtacacccccttgttcttcgccagagtaaggagctacacagctttctcagaaaggcctctgtagagcctcaagtccagtcctctatcacttttgcatgaattaaagtatatagcgcaaaaga

SEQ ID NO: 428085 - DNA, 1296 bp, Homo sapiens
ggcgcgtcggcgcaggtttccgcagctgagggggcagctccgcggcggcgtccggggtctccagtagggctgacgctccggtgctcgcacaatcccccgcctcggctggcaacgggcgtccctccactccccgagtccccggcagccgccgccaccccagcgcgccccgatctggccccctgccccgcgaagatggctgccgtacgccgggcccgcagttattgccgctgcctggtgcgcttctccgaccgagaactctgctaagctccgctgcagagacaggcaggagtagacacccggacacccagcacccctcctccggggggcggtgcagagggggcacggagagcccctcgagcgcagcaggccgccccgccagcatggcagaagctgaggaagattgtcattctgatactgtcagagcagatgatgatgaagaaaatgaaagtcctgctgaaacagatctgcaggcacaactccagatgttccgagctcagtggatgtttgaacttgctccaggtgtaagctctagcaatttagaaaatcgaccttgcagagcagcaagaggctctctccagaaaacatcggcagataccaaaggaaaacaagaacaggcaaaagaagaaaaggctcgagaactcttcctaaaagcagtagaagaagaacaaaatggagctctctatgaagccatcaagttttatcgtagggctatgcaacttgtacctgatatagagttcaagattacttatacccggtctccagatggtgatggcgttggaaacagctacattgaagataatgatgatgacagcaaaatggcagatctcttgtcctacttccagcagcaactcacatttcaggagtctgtgcttaaactgtgtcagcctgagcttgagagcagtcagattcacatatcagtgctgccaatggaggtcctgatgtacatcttccgatgggtggtgtctagtgacttggacctcagatcattggagcagttgtcgctggtgtgcagaggattctacatctgtgccagagaccctgaaatatggcgtctggcctgcttgaaagtttggggcagaagctgtattaaacttgttccgtacacgtcctggagagagatgtttttagaacggcctcgtgttcggtttgatggtaagttggattctgtagaactcagcagaaatactgatctataatgctgatttttataaatacgccgtttaaattttctgtgatgaatgtgagtactgtaagcatgtttaaaggaaaccacagtaaatataatgctgggaatat

SEQ ID NO: 428086 - DNA, 941 bp, Homo sapiens
tgatggtgatggggaaaaaaatctgatatttttagagtatttaacagtttttaaagcactcatacattcttgtgatagtcatactatttctgtaaacatagaagtgaggtaaggtttcattataacttatgcatcttttcttttgcagaaaccacttgactataaatacagatattttcgtcgtgtccctgtacaagaagcagatcagagttttcatgtggggctacagctatgttccagtggtcaccagaggttcaacaaactcatctggatacatcattcttgtcacattacttacaaatcaactggtgagactgcagtcagtgcttttgagattgacaagatgtacacccccttgttcttcgccagagtaaggagctacacagctttctcagaaaggcctctgtagagcctcaagtccagtcctctatcacttttgcatgaattaaagtatatagcgcaaaagagcacctaagttataaatgtgtgtgtgtgtgtgtgtgtgtatatatatatatatatatatatatatatatatatatatatggaattggaacttattttaaattgttggagttcttttaagaagaatataaattgattattttttttatttaaagggatagttgattcctggggtgttttgaaattaagttggaattaagttgcttaagcatatttatgttgtgagaaaccttaatatgaggtttatcatgccctttttcaagcagatttatgagcagatttctgtcacataagtcgtcttctgcttgagtatcctaatatttcaatgcatcaggggagcgctccactggataagcattttatttcccgcatggcatagtgtttttgcactaaaggctcaaagtgtgagaacctgttctggatttgtttgaaattatttcaccaataaagatcataaataaatgtttctttcaaga

SEQ ID NO: 428087 - DNA, 2455 bp, Homo sapiens
  misc_feature (539)..(539): n is a, c, g, or t
  misc_feature (568)..(569): n is a, c, g, or t
  misc_feature (572)..(572): n is a, c, g, or t
  misc_feature (577)..(578): n is a, c, g, or t
  misc_feature (580)..(580): n is a, c, g, or t
  misc_feature (586)..(586): n is a, c, g, or t
  misc_feature (588)..(588): n is a, c, g, or t
  misc_feature (590)..(590): n is a, c, g, or t
  misc_feature (592)..(592): n is a, c, g, or t
  misc_feature (594)..(594): n is a, c, g, or t
  misc_feature (597)..(597): n is a, c, g, or t
tgatggtgatggggaaaaaaatctgatatttttagagtatttaacagtttttaaagcactcatacattcttgtgatagtcatactatttctgtaaacatagaagtgaggtaaggtttcattataacttatgcatcttttcttttgcagaaaccacttgactataaatacagatattttcgtcgtgtccctgtacaagaagcagatcagagttttcatgtggggctacagctatgttccagtggtcaccagaggttcaacaaactcatctggatacatcattcttgtcacattacttacaaatcaactggtgagactgcagtcagtgcttttgagattgacaagatgtacacccccttgttcttcgccagagtaaggagctacacagctttctcagaaaggcctctgtagagcctcaagtccagtcctctatcacttttgcatgaattaaagtatatagcgcaaaagagcacctaagttataaatgtgtgtgtgtgtgtgtgtgtgtatatatatatatatatatatatatacacacacncacacacacacacacacacacacacacannccnctgcnncnattttncnangncncanttcttttaagaagaatataaattgattattttttttatttaaagggatagttgattcctggggtgttttgaaattaagttggaattaagttgcttaagcatatttatgttgtgagaaaccttaatatgaggtttatcatgccctttttcaagcagatttatgagcagatttctgtcacataagtcgtcttctgcttgagtatcctaatatttcaatgcatcaggggagcgctccactggataagcattttatttcccgcatggcatagtgtttttgcactaaaggctcaaagtgtgagaacctgttctggatttgtttgaaattatttcaccaataaagatcataaataaatgtttctttcaagaaaatatatttggatggcctttttaaagtaacaggatatttaataagagtcctagatagccagcggagactttaagaatcattgcctctagctgggtgtggtggcatgcacctgtagtcccagctatttgggaggctgatgcaggagaatagcttaagcccaggaatttgagtctgggagtttgagtccagcatgggcaacataacaagaccccatcccttattaaaagaaaaactcatgtaggcaccttaccaatatatgacattaagtgagagtgaatcccttaggactggaacacttcaagctcaaccaactgactcagttgtcattcttcacaaaagaatagtagaggatcatgtaaacctgagcctaactcttgttccagtatgaaagttgggggagagcaccagccacctaggaaaactgtatgttacctttttactcaaaggagtcccccctgcccagtaacagtcctattagtgtttaatttcagagtttgtgtctggtagacctctacctgattcagatttggttttgttgtttcaaccatagttagagacaaattctcatgtactttcagaaatcaatatctgcagccactgttacttttaattgacattaagagacacttcataggttcccacaattcagtatgggataggctttttaaaaagcacatacagaccaggcgtggtggctcatgcctataatcccagcactttgggaggctaagacaggcagatcacctgagctcaggagtccaagaccagcctgggcaacatggcaaaacaccgtctctacaaaaaaaaaaaaaaaaaaaattagccaagtacagtggggcacacctatagtcgcagctacttgggaggctggggcaggagaattgcctgagcctgggaagtggaagttgcagtgagccaagatcgtgccattccactccagcctgagcaacacagtgagaccctatctcaaaaaaataatgatgatagtacacgttatgttaaaggtgaaatgtgcatacagaaggaagagagttggccaggtgtggtgactcacacctataatcccaatactttgggaggccaaggcaggaggattgcttgaggtcaggagttttagaccagcctggacaacatagcaagacctcatctcttctaaaaattaaaaaaaaaaaaaataggcatggtggtacacacctgtggtcccagctagttgggaggctaaggcaggaggatcacttagccaggaggctgaggctacagtgagccaagattgcaccactgtgctccagcctgggtgagaaagcgagaccctgtctcaaaaaagaaaaaaaagagaggttggccttttgtagcaatctgagaagtgtgtttttcaagttggaaaggaaggagaaaagcaacttgcctaagataaggtagctcttcatgatatgactgttatttctgatatacaaataaatagaacatgattaggacatagtcaaatatagct

SEQ ID NO: 428088 - DNA, 950 bp, Homo sapiens
ggcgcgtcggcgcaggtttccgcagctgagggggcagctccgcggcggcgtccggggtctccagtagggctgacgctccggtgctcgcacaatcccccgcctcggctggcaacgggcgtccctccactccccgagtccccggcagccgccgccaccccagcgcgccccgatctggccccctgccccgcgaagatggctgccgtacgccgggcccgcagttattgccgctgcctggtgcgcttctccgaccgagaactctgctaagctccgctgcagagacaggcaggagtagacacccggacacccagcacccctcctccggggggcggtgcagagggggcacggagagcccctcgagcgcagcaggccgccccgccagcatggcagaagctgaggaagattgtcattctgatactgtcagagcagatgatgatgaagaaaatgaaagtcctgctgaaacagatctgcaggcacaactccagatgttccgagctcagtggatgtttgaacttgctccaggtgtaagctctagcaatttagaaaatcgaccttgcagagcagcaagaggctctctccagaaaacatcggcagataccaaaggaaaacaagaacaggcaaaagaagaaaagttaagtattatagatattgtaacaaattacattttttttttttggcacatggaaattttcactgacacagtaagtaggcattataaccagactttcgggacataaacacatatcttgtaaaataaaaattttgactagtatactagtttatatatttctcacaatttcttctaggtactttggatggtaccactactcctgcatggcttttttctctgtgggtacactgtcttcattgagctgtcttttgttaatttatagacctctgggattcatgtggttcctaaaagattggtgtctctgaatttattaacagaacca

SEQ ID NO: 428089 - DNA, 540 bp, Homo sapiens
gatgattttccttttgccagtgctgccaatggaggtcctgatgtacatcttccgatgggtggtgtctagtgacttggacctcagatcattggagcagttgtcgctggtgtgcagaggattctacatctgtgccaggtactaagtttttgtttttgttttttaaacaactgaggcaatggtgaaaagaaagatggtcctttgccaatcctgataaaattacttgattggtgttctgagttaaagcttagaataaacaagttttgctaagctgtacttaactttctcaaataacttagaatttaaaggctagaatatgctaggtttctagggtatagaataatatgtaggacagatgtagtaacccatactactaccatagagtttacatgctagcttaactgatttgggaaaaagagttatattagaaaaatatattcaagtcatttttacactaactgtaaactcattgtggtaatggtttagattaaaacagcactagcattttcttatggctcattaaaagttattctatattttgaa

SEQ ID NO: 428090 - DNA, 441 bp, Homo sapiens
cagcagtatttgcagaagtgtaattctaatgaaccttgtcacagctgtttgctcatttattttactgttattgcaaaagataagttatactctgtgctttttcagcatccttcaccaatttatcactttccctcttaaaaaatgtccaagtgttttccagtagaaggaaatactaggcttagagataggagataataattttacatcccatctatgtaatgttggttacatagtagttttacctccctggatcttcattttttaagctagtaaatagaaataatgcaatcatatttaacacatgaggttattatgatgattaactgagatgatggtgatggggaaaaaaatctgatatttttagagtatttaacagtttttaaagcactcatacattcttgtgatagtcaaaacgactctttactgcatgcaaatattatg

SEQ ID NO: 428091 - DNA, 761 bp, Homo sapiens
ggctgcagtatgccggcagccccgccctgtgtgcggtgtctaaggattccgtccccaagcaaggacaacatattatcttccccgcccttctcttttctacagtatctgttacctcagtcagattgaggatgcacatatactgggaaaataatcgacttccagcgtccctcatgtagtctctacctgattcaggaatctctaacccagtatcggaacgttaagcggcttctccgctttcctgccgtgagaaactcgaggtgacaacctccgtttccggttggctccggttgcagagttgagtgtcctgagaggtcagattgctgtcagacatggcccatgaacatggacatgagcatggacatcataaaatggaacttccagattatagacaatggaagatagaagggacaccattagaaactatccagaagaagctggctgcaaaagggctaagggatccatggggccgcaatgaagcttggagatacatgggtggctttgcaaagagtgtttccttttctgatgtattctttaaaggattcaaatggggatttgctgcatttgtggtagctgtaggagctgaatattacctggagtccctgaataaagataagaagcatcactgaagataatacctggaagcatcatagtggtttcttaactctccaaaataagatttcttctctgtagcctacttgtctggtttatcccttacagaatattagtaagatttaatcaattaaaatatatatatatgccaa

SEQ ID NO: 428092 - DNA, 922 bp, Homo sapiens
ggctgcagtatgccggcagccccgccctgtgtgcggtgtctaaggattccgtccccaagcaaggacaacatattatcttccccgcccttctcttttctacagtatctgttacctcagtcagattgaggatgcacatatactgggaaaataatcgacttccagcgtccctcatgtagtctctacctgattcaggaatctctaacccagtatcggaacgttaagcggcttctccgctttcctgccgtgagaaactcgaggtgacaacctccgtttccggttggctccggttgcagagttgagtgtcctgagaggtcagattgctgtcagacatggcccatgaacatggacatgagcatggacatcataaaatggaacttccagattatagacaatggaagatagaagggacaccattagaaactatccagaagaagctggctgcaaaagggctaagggatccatggggccgcaatgaagcttggagatacatgggtggctttgcaaagagtgtttccttttctgatgtattctttaaaggattcaaatggggatttgctgcatttgtggtagctgtaggagctgaatattacctggagtccctgaataaagataagaagcatcactgaagataatacctggaagcatcatagtggtttcttaactctccaaaataagatttcttctctgtagcctacttgtctggtttatcccttacagaatattagtaagatttaatcaattaaaatatatatatatgccaaaaaaaaaaaacaaaagggggggggctaaagttacctggaagggccaggtttaggtcccgttttggcaagggccctaaggggggaaaagaaggcggggcgttaaagcggtggaaagggtggtttggagggcttggggggtcatgggaccgagatagccggaa

SEQ ID NO: 428093 - DNA, 643 bp, Homo sapiens
  misc_feature (6)..(6): n is a, c, g, or t
  misc_feature (22)..(22): n is a, c, g, or t
  misc_feature (29)..(29): n is a, c, g, or t
ctcgtncaatttcggcagaggnagaggtnagattgctgtcacatggcccatgaacatggacatgagcatggacatcataaaatggaacttccagattatagacaatggaagatagaagggacaccattagaaactatccagaagaagctggctgcaaaagggctaagggatccatggggccgcaatgaagcttggagatacatgggtggctttgcaaagagtgtttccttttctgatgtattctttaaaggattcaaatggggatttgctgcatttgtggtagctgtaggagctgaatattacctggagtccctgaataaagataagaagcatcactgaagataatacctggaagcatcatagtggtttcttaactctccaaaataagatttcttctctgtagcctacttgtctggtttatcccttacagaatattagtaagatttaatcaattaaaatatatatatatgccaaaaaaaaaaaggaatgaataaaggacaccctgaaccacctgttttaaacaagttttcaaatggtagcggtacgaattgtaaactgagggcctattagcatagaggattagaagcccatttggggttcatggcacattcgcctaagggggggggttaaattaacggcgcgt

SEQ ID NO: 428094 - DNA, 492 bp, Homo sapiens
gtttattcttctattttatatgtgaaacttgggcatatacttaattatcctatgccacagaaagattcctattgcgattcacttaaatgatcttctgtagggtagcatttaagtcaattagaaagatgaaaattaaatgtcttcaacgtatatacacacacgttgtgtatgattataattttttctttttttttttctagcaatgaagcttggagatacatgggtggctttgcaaagagtgtttccttttctgatgtattctttaaaggattcaaatggggatttgctgcatttgtggtagctgtaggagctgaatattacctggagtccctgaataaagataagaagcatcactgaagataatacctggaagcatcatagtggtttcttaactctccaaaataagatttcttctctgtagcctacttgtctggtttatcccttacagaatattagtaagatttaatcaattaaaatatatatatatgccaa

SEQ ID NO: 428095 - DNA, 347 bp, Homo sapiens
ttttattatttatatgttgtgtttaatttgatatattaatacatttacatgtgaacaatgaagcttggagatacatgggtggctttgcaaagagtgtttccttttctgatgtattctttaaaggattcaaatggggatttgctgcatttgtggtagctgtaggagctgaatattacctggagtccctgaataaagataagaagcatcactgaagataatacctggaagcatcatagtggtttcttaactctccaaaataagatttcttctctgtagcctacttgtctggtttatcccttacagaatattagtaagatttaatcaattaaaatatatatatatgccaa

SEQ ID NO: 428096 - DNA, 334 bp, Homo sapiens
gcgattctcctgcctctgcctcccgaatagctgggattacagcaatgaagcttggagatacatgggtggctttgcaaagagtgtttccttttctgatgtattctttaaaggattcaaatggggatttgctgcatttgtggtagctgtaggagctgaatattacctggagtccctgaataaagataagaagcatcactgaagataatacctggaagcatcatagtggtttcttaactctccaaaataagatttcttctctgtagcctacttgtctggtttatcccttacagaatattagtaagatttaatcaattaaaatatatatatatgccaa

SEQ ID NO: 428097 - DNA, 556 bp, Homo sapiens
tgtgattaggaataaaatgtctagaaaggttccttacagggacaatagttaaaaattggttgaaaaacactgccttagaatctcccagtatgtttctgtgattccatctcctccaccaagagacatggcccatgaacatggacatgagcatggacatcataaaatggaacttccagattatagacaatggaagatagaagggacaccattagaaactatccagaagaagctggctgcaaaagggctaagggatccatggggccgcaatgaagcttggagatacatgggtggctttgcaaagagtgtttccttttctgatgtattctttaaaggattcaaatggggatttgctgcatttgtggtagctgtaggagctgaatattacctggagtccctgaataaagataagaagcatcactgaagataatacctggaagcatcatagtggtttcttaactctccaaaataagatttcttctctgtagcctacttgtctggtttatcccttacagaatattagtaagatttaatcaattaaaatatatatatatgccaa

SEQ ID NO: 428098 - DNA, 784 bp, Homo sapiens
ggctgcagtatgccggcagccccgccctgtgtgcggtgtctaaggattccgtccccaagcaaggacaacatattatcttccccgcccttctcttttctacagtatctgttacctcagtcagattgaggatgcacatatactgggaaaataatcgacttccagcgtccctcatgtagtctctacctgattcaggaatctctaacccagtatcggaacgttaagcggcttctccgctttcctgccgtgagaaactcgaggtgacaacctccgtttccggttggctccggttgcagagttgagtgtcctgagaggtcagattgctgtcaggcagaagaacagcatcactaaaaacatggcccatgaacatggacatgagcatggacatcataaaatggaacttccagattatagacaatggaagatagaagggacaccattagaaactatccagaagaagctggctgcaaaagggctaagggatccatggggccgcaatgaagcttggagatacatgggtggctttgcaaagagtgtttccttttctgatgtattctttaaaggattcaaatggggatttgctgcatttgtggtagctgtaggagctgaatattacctggagtccctgaataaagataagaagcatcactgaagataatacctggaagcatcatagtggtttcttaactctccaaaataagatttcttctctgtagcctacttgtctggtttatcccttacagaatattagtaagatttaatcaattaaaatatatatatatgccaa

SEQ ID NO: 428099 - DNA, 474 bp, Homo sapiens
  misc_feature (6)..(6): n is a, c, g, or t
  misc_feature (22)..(22): n is a, c, g, or t
  misc_feature (29)..(29): n is a, c, g, or t
ctcgtncaatttcggcagaggnagaggtnagattgctgtcacatggcccatgaacatggacatgagcatggacatcataaaatggaacttccagattatagacaatggaagatagaagggacaccattagaaactatccagaagaagctggctgcaaaagggctaagggatccatggggccgcaatgaagcttggagatacatgggtggctttgcaaagagtgtttccttttctgatgtattctttaaaggattcaaatggggatttgctgcatttgtggtagctgtaggagctgaatattacctggagtccctgaataaagataagaagcatcactgaagataatacctggaagcatcatagtggtttcttaactctccaaaataagatttcttctctgtagcctacttgtctggtttatcccttacagaatattagtaagatttaatcaattaaaatatatatatatgccaa

SEQ ID NO: 428100 - DNA, 832 bp, Homo sapiens
ggctgcagtatgccggcagccccgccctgtgtgcggtgtctaaggattccgtccccaagcaaggacaacatattatcttccccgcccttctcttttctacagtatctgttacctcagtcagattgaggatgcacatatactgggaaaataatcgacttccagcgtccctcatgtagtctctacctgattcaggaatctctaacccagtatcggaacgttaagcggcttctccgctttcctgccgtgagaaactcgaggtgacaacctccgtttccggttggctccggttgcagagttgagtgtcctgagaggtcagattgctgtcagacatggcccatgaacatggacatgagcatggacatcataaaatggaacttccagattatagacaatggaagatagaagggacaccattagaaactatccagaagaagctggctgcaaaagggctaagggatccatggggccgcaatgaagcttggagatacatgggtggctttgcaaagagtgtttccttttctgatgtattctttaaaggattcaaatggggatttgctgcatttgtggtagctgtaggagctgaatattacctggagtccctgaataaagataagaagcatcactgaagataatacctggaagcatcatagtggtttcttaactctccaaaataagatttcttctctgtagcctacttgtctggtttatcccttacagaatattagtaagatttaatcaattaaaatatatatatatgccaacgaaaaaaaaaaataataaacaaagggatgaaagaaatattatctttttggccttttttggcctaaagggg

SEQ ID NO: 428101 - DNA, 803 bp, Homo sapiens
ggctgcagtatgccggcagccccgccctgtgtgcggtgtctaaggattccgtccccaagcaaggacaacatattatcttccccgcccttctcttttctacagtatctgttacctcagtcagattgaggatgcacatatactgggaaaataatcgacttccagcgtccctcatgtagtctctacctgattcaggaatctctaacccagtatcggaacgttaagcggcttctccgctttcctgccgtgagaaactcgaggtgacaacctccgtttccggttggctccggttgcagagttgagtgtcctgagaggtcagattgctgtcagacatggcccaagttgagtgtcctgagaggtcagattgctgtcacatggcccatgaacatggacatgagcatggacatcataaaatggaacttccagattatagacaatggaagatagaagggacaccattagaaactatccagaagaagctggctgcaaaagggctaagggatccatggggccgcaatgaagcttggagatacatgggtggctttgcaaagagtgtttccttttctgatgtattctttaaaggattcaaatggggatttgctgcatttgtggtagctgtaggagctgaatattacctggagtccctgaataaagataagaagcatcactgaagataatacctggaagcatcatagtggtttcttaactctccaaaataagatttcttctctgtagcctacttgtctggtttatcccttacagaatattagtaagatttaatcaattaaaatatatatatatgccaa

SEQ ID NO: 428102 - DNA, 1120 bp, Homo sapiens
ggctgcagtatgccggcagccccgccctgtgtgcggtgtctaaggattccgtccccaagcaaggacaacatattatcttccccgcccttctcttttctacagtatctgttacctcagtcagattgaggatgcacatatactgggaaaataatcgacttccagcgtccctcatgtagtctctacctgattcaggaatctctaacccagtatcggaacgttaagcggcttctccgctttcctgccgtgagaaactcgaggtgacaacctccgtttccggttggctccggttgcagagttgagtgtcctgagaggtcagattgctgtcagacatggcccatgaacatggacatgagcatggacatcataaaatggaacttccagattatagacaatggaagatagaagggacaccattagaaactatccagaagaagctggctgcaaaagggctaagggatccatggggccgcaatgaagcttggagatacatgggtggctttgcaaagagtgtttccttttctgatgtattctttaaaggattcaaatggggatttgctgcatttgtggtagctgtaggagctgaatattacctggagtccctgaataaagataagaagcatcactgaagataatacctggaagcatcatagtggtttcttaactctccaaaataagatttcttctctgtagcctacttgtctggtttatcccttacagaatattagtaagatttaatcaattaaaatatatatatatgccaaaaaaaaaaaaaaaaaaaaaaaaaaattgtgggggcgggccgggcccgggaaagttttcaacccctcggttggggggggggccccgggtggtaacgggcccaggggtcccaaggaaaccgggccagggcacaggcgtgggttctccccataaaaaacgcgcggggacccgggggtcggacaatccaagtgggttcgggcctccggtccacacgagggcccaggaagcacataccccgccccggggcggggaaagacagagacggaagcgaaaaaagaacacaagacgaggaaaaaacaacggaaaaaaagagcgaagagaacaaaaagcaaaaaaaacacaacacaagagacacacaagc

SEQ ID NO: 428103 - DNA, 1344 bp, Homo sapiens
gtgggtcgaaccttcacctactctttgtctgtacaagctcttgttgtctgggtgagcggcggaggcgctgctgtggattggtcacagggagaaacctctgatctgttcctattggcccgtccgtcaagggacgatgatgattggtagggcagagcaatctgagtcctagttggtggagttctgcccggatggaagctccggccgcggagtgatggtggcctcagcgaagatgggccgggcagggaccatggcggtggcagcagaggtggcaggggcggggcggctggcggtagaggaggctgtggtcctcagggggctgtaggtggaggtatggctcgggccagcagcgggaacggcagcgaggaggcctggggggcacttcgggcgccgcaacagcagcttcgagagctgtgcccaggagtgaacaaccagccctacctctgtgagagtggtcactgctgcggggagactggctgctgcacctactactatgagctctggtggttctggctgctctggactgtcctcatcctctttagctgctgttgcgccttccgccaccgacgagctaaactcaggctgcaacaacagcagcggcagcgtgaaatcaacttgttggcctatcatggggcatgccatggggctggtcctttccctaccggttcactgcttgaccttcgcttcctcagcaccttcaagcccccagcctacgaggatgtggttcaccgcccaggcacaccaccccccccttatactgtggccccaggccgccccttgactgcttccagtgaacaaacctgctgttcctcctcatccagctgccctgcccactttgaaggaacaaatgtggaaggtgtttcctcccaccagagtgccccccctcatcaggagggtgagcccggggcaggggtgacccctgcctccacacccccctcctgccgctatcgccgtttaactggcgactccggtattgagctctgcccttgtcctgcctccggtgagggtgagccagtcaaggaggtgagggttagtgccaccctgccagatctggaggactactccccgtgtgcactacccccagagtctgtaccgcagatctttcccatggggctgtcttccagtgaaggggacatcccataagtagttttgagagggtggatgggttacttgcccaccagaaacagccctagtcccaactccttgcgttcctttggcccctccctgcctacctagaatctgcctgaaagggctggagaggggcagtattgggggactgtgctagctttacccccgcaggacatacacaggagcctttgatctcattaaagagatgtgaaccagcta

SEQ ID NO: 428104 - DNA, 2223 bp, Homo sapiens
gtgggtcgaaccttcacctactctttgtctgtacaagctcttgttgtctgggtgagcggcggaggcgctgctgtggattggtcacagggagaaacctctgatctgttcctattggcccgtccgtcaagggacgatgatgattggtagggcagagcaatctgagtcctagttggtggagttctgcccggatggaagctccggccgcggagtgatggtggcctcagcgaagatgggccgggcagggaccatggcggtggcagcagaggtggcaggggcggggcggctggcggtagaggaggctgtggtcctcagggggctgtaggtggaggtatggctcgggccagcagcgggaacggcagcgaggaggcctggggggcacttcgggcgccgcaacagcagatcccaatagctccaaaacctatcacgacagccatttgtctctttcccctttccttgtcccttccttttgggggtgggggaggaactcacggagccaaaggtactgtgaagttcctaaacatgtctcttccactctttgtctaaactttgtaacgtagatgcagctgactttgcctgtagcctcatagaacccatcccatggctgcagtggaagcttgcggtggctctccagtgaccagaggcatagtgaggtcccagggaggctccctctgtcttgcaacagttatttgtgatctttttctatgtgcctattgtcacaacagagtccggcagcgtcttctcttgagggagcaatttggagaagagctggaacccagactcgcgccctggatgccatcctttatcatccacagcaatcccatctggttgggagcactgctctgggtctcacactgcccctcctctatcctagggagcctgaggcccaggggtggaaagatccagttgcgggtggggggtagtgaaccgtgcaggataatgaaagcaacttgctttggaaatgacctaccgctacccgttgtctgagactgagattatctcagactgtcttctggcttctgccaaaacactcccttaacagaaagcaccgaggggatgggggtaggggggttggggagagtgaggcttgagtgtgaaggaagtctcatatatgcagagctgaaatctccctctttgtatgtccacacttttgtcttgttctctagactgattcttgctattccaaatcctcttccacgttgacagcccttcagatatttcaacactcctctcagcatcctccacttcccccatctctccaagctgaacttggttcacaggcttcgagagctgtgcccaggagtgaacaaccagccctacctctgtgagagtggtcactgctgcggggagactggctgctgcacctactactatgagctctggtggttctggctgctctggactgtcctcatcctctttagctgctgttgcgccttccgccaccgacgagctaaactcaggctgcaacaacagcagcggcagcgtgaaatcaacttgttggcctatcatggggcatgccatggggctggtcctttccctaccggttcactgcttgaccttcgcttcctcagcaccttcaagcccccagcctacgaggatgtggttcaccgcccaggcacaccaccccccccttatactgtggccccaggccgccccttgactgcttccagtgaacaaacctgctgttcctcctcatccagctgccctgcccactttgaaggaacaaatgtggaaggtgtttcctcccaccagagtgccccccctcatcaggagggtgagcccggggcaggggtgacccctgcctccacacccccctcctgccgctatcgccgtttaactggcgactccggtattgagctctgcccttgtcctgcctccggtgagggtgagccagtcaaggaggtgagggttagtgccaccctgccagatctggaggactactccccgtgtgcactacccccagagtctgtaccgcagatctttcccatggggctgtcttccagtgaaggggacatcccataagtagttttgagagggtggatgggttacttgcccaccagaaacagccctagtcccaactccttgcgttcctttggcccctccctgcctacctagaatctgcctgaaagggctggagaggggcagtattgggggactgtgctagctttacccccgcaggacatacacaggagcctttgatctcattaaagagatgtgaaccagcta

SEQ ID NO: 428105 - DNA, 2313 bp, Homo sapiens
gtgggtcgaaccttcacctactctttgtctgtacaagctcttgttgtctgggtgagcggcggaggcgctgctgtggattggtcacagggagaaacctctgatctgttcctattggcccgtccgtcaagggacgatgatgattggtagggcagagcaatctgagtcctagttggtggagttctgcccggatggaagctccggccgcggagtgatggtggcctcagcgaagatgggccgggcagggaccatggcggtggcagcagaggtggcaggggcggggcggctggcggtagaggaggctgtggtcctcagggggctgtaggtggaggtatggctcgggccagcagcgggaacggcagcgaggaggcctggggggcacttcgggcgccgcaacagcagatcccaatagctccaaaacctatcacgacagccatttgtctctttcccctttccttgtcccttccttttgggggtgggggaggaactcacggagccaaaggtactgtgaagttcctaaacatgtctcttccactctttgtctaaactttgtaacgtagatgcagctgactttgcctgtagcctcatagaacccatcccatggctgcagtggaagcttgcggtggctctccagtgaccagaggcatagtgaggtcccagggaggctccctctgtcttgcaacagttatttgtgatctttttctatgtgcctattgtcacaacagagtccggcagcgtcttctcttgagggagcaatttggagaagagctggaacccagactcgcgccctggatgccatcctttatcatccacagcaatcccatctggttgggagcactgctctgggtctcacactgcccctcctctatcctagggagcctgaggcccaggggtggaaagatccagttgcgggtggggggtagtgaaccgtgcaggataatgaaagcaacttgctttggaaatgacctaccgctacccgttgtctgagactgagattatctcagactgtcttctggcttctgccaaaacactcccttaacagaaagcaccgaggggatgggggtaggggggttggggagagtgaggcttgagtgtgaaggaagtctcatatatgcagagctgaaatctccctctttgtatgtccacacttttgtcttgttctctagactgattcttgctattccaaatcctcttccacgttgacagcccttcagatatttcaacactcctctcagcatcctccacttcccccatctctccaagctgaacttggttcacagggtgggattgtgtatgtgcatgcaggaggtgggggtggacagtgccctgggctggaatcccccttagttctaagtgcctccttgcccgcagcttcgagagctgtgcccaggagtgaacaaccagccctacctctgtgagagtggtcactgctgcggggagactggctgctgcacctactactatgagctctggtggttctggctgctctggactgtcctcatcctctttagctgctgttgcgccttccgccaccgacgagctaaactcaggctgcaacaacagcagcggcagcgtgaaatcaacttgttggcctatcatggggcatgccatggggctggtcctttccctaccggttcactgcttgaccttcgcttcctcagcaccttcaagcccccagcctacgaggatgtggttcaccgcccaggcacaccaccccccccttatactgtggccccaggccgccccttgactgcttccagtgaacaaacctgctgttcctcctcatccagctgccctgcccactttgaaggaacaaatgtggaaggtgtttcctcccaccagagtgccccccctcatcaggagggtgagcccggggcaggggtgacccctgcctccacacccccctcctgccgctatcgccgtttaactggcgactccggtattgagctctgcccttgtcctgcctccggtgagggtgagccagtcaaggaggtgagggttagtgccaccctgccagatctggaggactactccccgtgtgcactacccccagagtctgtaccgcagatctttcccatggggctgtcttccagtgaaggggacatcccataagtagttttgagagggtggatgggttacttgcccaccagaaacagccctagtcccaactccttgcgttcctttggcccctccctgcctacctagaatctgcctgaaagggctggagaggggcagtattgggggactgtgctagctttacccccgcaggacatacacaggagcctttgatctcattaaagagatgtgaaccagcta

SEQ ID NO: 428106 - DNA, 2155 bp, Homo sapiens
gtgggtcgaaccttcacctactctttgtctgtacaagctcttgttgtctgggtgagcggcggaggcgctgctgtggattggtcacagggagaaacctctgatctgttcctattggcccgtccgtcaagggacgatgatgattggtagggcagagcaatctgagtcctagttggtggagttctgcccggatggaagctccggccgcggagtgatggtggcctcagcgaagatgggccgggcagggaccatggcggtggcagcagaggtggcaggggcggggcggctggcggtagaggaggctgtggtcctcagggggctgtaggtggaggtatggctcgggccagcagcgggaacggcagcgaggaggcctggggggcacttcgggcgccgcaacagcagtgggggtgggggaggaactcacggagccaaaggtactgtgaagttcctaaacatgtctcttccactctttgtctaaactttgtaacgtagatgcagctgactttgcctgtagcctcatagaacccatcccatggctgcagtggaagcttgcggtggctctccagtgaccagaggcatagtgaggtcccagggaggctccctctgtcttgcaacagttatttgtgatctttttctatgtgcctattgtcacaacagagtccggcagcgtcttctcttgagggagcaatttggagaagagctggaacccagactcgcgccctggatgccatcctttatcatccacagcaatcccatctggttgggagcactgctctgggtctcacactgcccctcctctatcctagggagcctgaggcccaggggtggaaagatccagttgcgggtggggggtagtgaaccgtgcaggataatgaaagcaacttgctttggaaatgacctaccgctacccgttgtctgagactgagattatctcagactgtcttctggcttctgccaaaacactcccttaacagaaagcaccgaggggatgggggtaggggggttggggagagtgaggcttgagtgtgaaggaagtctcatatatgcagagctgaaatctccctctttgtatgtccacacttttgtcttgttctctagactgattcttgctattccaaatcctcttccacgttgacagcccttcagatatttcaacactcctctcagcatcctccacttcccccatctctccaagctgaacttggttcacaggcttcgagagctgtgcccaggagtgaacaaccagccctacctctgtgagagtggtcactgctgcggggagactggctgctgcacctactactatgagctctggtggttctggctgctctggactgtcctcatcctctttagctgctgttgcgccttccgccaccgacgagctaaactcaggctgcaacaacagcagcggcagcgtgaaatcaacttgttggcctatcatggggcatgccatggggctggtcctttccctaccggttcactgcttgaccttcgcttcctcagcaccttcaagcccccagcctacgaggatgtggttcaccgcccaggcacaccaccccccccttatactgtggccccaggccgccccttgactgcttccagtgaacaaacctgctgttcctcctcatccagctgccctgcccactttgaaggaacaaatgtggaaggtgtttcctcccaccagagtgccccccctcatcaggagggtgagcccggggcaggggtgacccctgcctccacacccccctcctgccgctatcgccgtttaactggcgactccggtattgagctctgcccttgtcctgcctccggtgagggtgagccagtcaaggaggtgagggttagtgccaccctgccagatctggaggactactccccgtgtgcactacccccagagtctgtaccgcagatctttcccatggggctgtcttccagtgaaggggacatcccataagtagttttgagagggtggatgggttacttgcccaccagaaacagccctagtcccaactccttgcgttcctttggcccctccctgcctacctagaatctgcctgaaagggctggagaggggcagtattgggggactgtgctagctttacccccgcaggacatacacaggagcctttgatctcattaaagagatgtgaaccagcta

SEQ ID NO: 428107 - DNA, 1816 bp, Homo sapiens
gtgggtcgaaccttcacctactctttgtctgtacaagctcttgttgtctgggtgagcggcggaggcgctgctgtggattggtcacagggagaaacctctgatctgttcctattggcccgtccgtcaagggacgatgatgattggtagggcagagcaatctgagtcctagttggtggagttctgcccggatggaagctccggccgcggagtgatggtggcctcagcgaagatgggccgggcagggaccatggcggtggcagcagaggtggcaggggcggggcggctggcggtagaggaggctgtggtcctcagggggctgtaggtggaggtatggctcgggccagcagcgggaacggcagcgaggaggcctggggggcacttcgggcgccgcaacagcagtgggggtgggggaggaactcacggagccaaaggtactgtgaagttcctaaacatgtctcttccactctttgtctaaactttgtaacgtagatgcagctgactttgcctgtagcctcatagaacccatcccatggctgcagtggaagcttgcggtggctctccagtgaccagaggcatagtgaggtcccagggaggctccctctgtcttgcaacagttatttgtgatctttttctatgtgcctattgtcacaacagagtccggcagcgtcttctcttgagggagcaatttggagaagagctggaacccagactcgcgccctggatgccatcctttatcatccacagcaatcccatctgactgattcttgctattccaaatcctcttccacgttgacagcccttcagatatttcaacactcctctcagcatcctccacttcccccatctctccaagctgaacttggttcacaggcttcgagagctgtgcccaggagtgaacaaccagccctacctctgtgagagtggtcactgctgcggggagactggctgctgcacctactactatgagctctggtggttctggctgctctggactgtcctcatcctctttagctgctgttgcgccttccgccaccgacgagctaaactcaggctgcaacaacagcagcggcagcgtgaaatcaacttgttggcctatcatggggcatgccatggggctggtcctttccctaccggttcactgcttgaccttcgcttcctcagcaccttcaagcccccagcctacgaggatgtggttcaccgcccaggcacaccaccccccccttatactgtggccccaggccgccccttgactgcttccagtgaacaaacctgctgttcctcctcatccagctgccctgcccactttgaaggaacaaatgtggaaggtgtttcctcccaccagagtgccccccctcatcaggagggtgagcccggggcaggggtgacccctgcctccacacccccctcctgccgctatcgccgtttaactggcgactccggtattgagctctgcccttgtcctgcctccggtgagggtgagccagtcaaggaggtgagggttagtgccaccctgccagatctggaggactactccccgtgtgcactacccccagagtctgtaccgcagatctttcccatggggctgtcttccagtgaaggggacatcccataagtagttttgagagggtggatgggttacttgcccaccagaaacagccctagtcccaactccttgcgttcctttggcccctccctgcctacctagaatctgcctgaaagggctggagaggggcagtattgggggactgtgctagctttacccccgcaggacatacacaggagcctttgatctcattaaagagatgtgaaccagcta

SEQ ID NO: 428108 - DNA, 2065 bp, Homo sapiens
gtgggtcgaaccttcacctactctttgtctgtacaagctcttgttgtctgggtgagcggcggaggcgctgctgtggattggtcacagggagaaacctctgatctgttcctattggcccgtccgtcaagggacgatgatgattggtagggcagagcaatctgagtcctagttggtggagttctgcccggatggaagctccggccgcggagtgatggtggcctcagcgaagatgggccgggcagggaccatggcggtggcagcagaggtggcaggggcggggcggctggcggtagaggaggctgtggtcctcagggggctgtaggtggaggtatggctcgggccagcagcgggaacggcagcgaggaggcctggggggcacttcgggcgccgcaacagcagatgcagctgactttgcctgtagcctcatagaacccatcccatggctgcagtggaagcttgcggtggctctccagtgaccagaggcatagtgaggtcccagggaggctccctctgtcttgcaacagttatttgtgatctttttctatgtgcctattgtcacaacagagtccggcagcgtcttctcttgagggagcaatttggagaagagctggaacccagactcgcgccctggatgccatcctttatcatccacagcaatcccatctggttgggagcactgctctgggtctcacactgcccctcctctatcctagggagcctgaggcccaggggtggaaagatccagttgcgggtggggggtagtgaaccgtgcaggataatgaaagcaacttgctttggaaatgacctaccgctacccgttgtctgagactgagattatctcagactgtcttctggcttctgccaaaacactcccttaacagaaagcaccgaggggatgggggtaggggggttggggagagtgaggcttgagtgtgaaggaagtctcatatatgcagagctgaaatctccctctttgtatgtccacacttttgtcttgttctctagactgattcttgctattccaaatcctcttccacgttgacagcccttcagatatttcaacactcctctcagcatcctccacttcccccatctctccaagctgaacttggttcacaggcttcgagagctgtgcccaggagtgaacaaccagccctacctctgtgagagtggtcactgctgcggggagactggctgctgcacctactactatgagctctggtggttctggctgctctggactgtcctcatcctctttagctgctgttgcgccttccgccaccgacgagctaaactcaggctgcaacaacagcagcggcagcgtgaaatcaacttgttggcctatcatggggcatgccatggggctggtcctttccctaccggttcactgcttgaccttcgcttcctcagcaccttcaagcccccagcctacgaggatgtggttcaccgcccaggcacaccaccccccccttatactgtggccccaggccgccccttgactgcttccagtgaacaaacctgctgttcctcctcatccagctgccctgcccactttgaaggaacaaatgtggaaggtgtttcctcccaccagagtgccccccctcatcaggagggtgagcccggggcaggggtgacccctgcctccacacccccctcctgccgctatcgccgtttaactggcgactccggtattgagctctgcccttgtcctgcctccggtgagggtgagccagtcaaggaggtgagggttagtgccaccctgccagatctggaggactactccccgtgtgcactacccccagagtctgtaccgcagatctttcccatggggctgtcttccagtgaaggggacatcccataagtagttttgagagggtggatgggttacttgcccaccagaaacagccctagtcccaactccttgcgttcctttggcccctccctgcctacctagaatctgcctgaaagggctggagaggggcagtattgggggactgtgctagctttacccccgcaggacatacacaggagcctttgatctcattaaagagatgtgaaccagcta

SEQ ID NO: 428109 - DNA, 1393 bp, Homo sapiens
gtgggtcgaaccttcacctactctttgtctgtacaagctcttgttgtctgggtgagcggcggaggcgctgctgtggattggtcacagggagaaacctctgatctgttcctattggcccgtccgtcaagggacgatgatgattggtagggcagagcaatctgagtcctagttggtggagttctgcccggatggaagctccggccgcggagtgatggtggcctcagcgaagatgggccgggcagggaccatggcggtggcagcagagagtccggcagcgtcttctcttgagggagcaatttggagaagagctggaacccagactcgcgccctggatgccatcctttatcatccacagcaatcccatctgtgacagcccttcagatatttcaacactcctctcagcatcctccacttcccccatctctccaagctgaacttggttcacaggcttcgagagctgtgcccaggagtgaacaaccagccctacctctgtgagagtggtcactgctgcggggagactggctgctgcacctactactatgagctctggtggttctggctgctctggactgtcctcatcctctttagctgctgttgcgccttccgccaccgacgagctaaactcaggctgcaacaacagcagcggcagcgtgaaatcaacttgttggcctatcatggggcatgccatggggctggtcctttccctaccggttcactgcttgaccttcgcttcctcagcaccttcaagcccccagcctacgaggatgtggttcaccgcccaggcacaccaccccccccttatactgtggccccaggccgccccttgactgcttccagtgaacaaacctgctgttcctcctcatccagctgccctgcccactttgaaggaacaaatgtggaaggtgtttcctcccaccagagtgccccccctcatcaggagggtgagcccggggcaggggtgacccctgcctccacacccccctcctgccgctatcgccgtttaactggcgactccggtattgagctctgcccttgtcctgcctccggtgagggtgagccagtcaaggaggtgagggttagtgccaccctgccagatctggaggactactccccgtgtgcactacccccagagtctgtaccgcagatctttcccatggggctgtcttccagtgaaggggacatcccataagtagttttgagagggtggatgggttacttgcccaccagaaacagccctagtcccaactccttgcgttcctttggcccctccctgcctacctagaatctgcctgaaagggctggagaggggcagtattgggggactgtgctagctttacccccgcaggacatacacaggagcctttgatctcattaaagagatgtgaaccagcta

SEQ ID NO: 428110 - DNA, 1446 bp, Homo sapiens
gtgggtcgaaccttcacctactctttgtctgtacaagctcttgttgtctgggtgagcggcggaggcgctgctgtggattggtcacagggagaaacctctgatctgttcctattggcccgtccgtcaagggacgatgatgattggtagggcagagcaatctgagtcctagttggtggagttctgcccggatggaagctccggccgcggagtgatggtggcctcagcgaagatgggccgggcagggaccatggcggtggcagcagaggtggcaggggcggggcggctggcggtagaggaggctgtggtcctcagggggctgtaggtggaggtatggctcgggccagcagcgggaacggcagcgaggaggcctggggggcacttcgggcgccgcaacagcagagtccggcagcgtcttctcttgagggagcaatttggagaagagctggaacccagactcgcgccctggatgccatcctttatcatccacagcaatcccatctgcttcgagagctgtgcccaggagtgaacaaccagccctacctctgtgagagtggtcactgctgcggggagactggctgctgcacctactactatgagctctggtggttctggctgctctggactgtcctcatcctctttagctgctgttgcgccttccgccaccgacgagctaaactcaggctgcaacaacagcagcggcagcgtgaaatcaacttgttggcctatcatggggcatgccatggggctggtcctttccctaccggttcactgcttgaccttcgcttcctcagcaccttcaagcccccagcctacgaggatgtggttcaccgcccaggcacaccaccccccccttatactgtggccccaggccgccccttgactgcttccagtgaacaaacctgctgttcctcctcatccagctgccctgcccactttgaaggaacaaatgtggaaggtgtttcctcccaccagagtgccccccctcatcaggagggtgagcccggggcaggggtgacccctgcctccacacccccctcctgccgctatcgccgtttaactggcgactccggtattgagctctgcccttgtcctgcctccggtgagggtgagccagtcaaggaggtgagggttagtgccaccctgccagatctggaggactactccccgtgtgcactacccccagagtctgtaccgcagatctttcccatggggctgtcttccagtgaaggggacatcccataagtagttttgagagggtggatgggttacttgcccaccagaaacagccctagtcccaactccttgcgttcctttggcccctccctgcctacctagaatctgcctgaaagggctggagaggggcagtattgggggactgtgctagctttacccccgcaggacatacacaggagcctttgatctcattaaagagatgtgaaccagcta

SEQ ID NO: 428111 - DNA, 1210 bp, Homo sapiens
gtgggtcgaaccttcacctactctttgtctgtacaagctcttgttgtctgggtgagcggcggaggcgctgctgtggattggtcacagggagaaacctctgatctgttcctattggcccgtccgtcaagggacgatgatgattggtagggcagagcaatctgagtcctagttggtggagttctgcccggatggaagctccggccgcggagtgatggtggcctcagcgaagatgggccgggcagggaccatggcggtggcagcagagcttcgagagctgtgcccaggagtgaacaaccagccctacctctgtgagagtggtcactgctgcggggagactggctgctgcacctactactatgagctctggtggttctggctgctctggactgtcctcatcctctttagctgctgttgcgccttccgccaccgacgagctaaactcaggctgcaacaacagcagcggcagcgtgaaatcaacttgttggcctatcatggggcatgccatggggctggtcctttccctaccggttcactgcttgaccttcgcttcctcagcaccttcaagcccccagcctacgaggatgtggttcaccgcccaggcacaccaccccccccttatactgtggccccaggccgccccttgactgcttccagtgaacaaacctgctgttcctcctcatccagctgccctgcccactttgaaggaacaaatgtggaaggtgtttcctcccaccagagtgccccccctcatcaggagggtgagcccggggcaggggtgacccctgcctccacacccccctcctgccgctatcgccgtttaactggcgactccggtattgagctctgcccttgtcctgcctccggtgagggtgagccagtcaaggaggtgagggttagtgccaccctgccagatctggaggactactccccgtgtgcactacccccagagtctgtaccgcagatctttcccatggggctgtcttccagtgaaggggacatcccataagtagttttgagagggtggatgggttacttgcccaccagaaacagccctagtcccaactccttgcgttcctttggcccctccctgcctacctagaatctgcctgaaagggctggagaggggcagtattgggggactgtgctagctttacccccgcaggacatacacaggagcctttgatctcattaaagagatgtgaaccagcta

SEQ ID NO: 428112 - DNA, 2383 bp, Homo sapiens
gtgggtcgaaccttcacctactctttgtctgtacaagctcttgttgtctgggtgagcggcggaggcgctgctgtggattggtcacagggagaaacctctgatctgttcctattggcccgtccgtcaagggacgatgatgattggtagggcagagcaatctgagtcctagttggtggagttctgcccggatggaagctccggccgcggagtgatggtggcctcagcgaagatgggccgggcagggaccatggcggtggcagcagaggtggcaggggcggggcggctggcggtagaggaggctgtggtcctcagggggctgtaggtggaggtatggctcgggccagcagcgggaacggcagcgaggaggcctggggggcacttcgggcgccgcaacagcagatcccaatagctccaaaacctatcacgacagccatttgtctctttcccctttccttgtcccttccttttgggggtgggggaggaactcacggagccaaaggtactgtgaagttcctaaacatgtctcttccactctttgtctaaactttgtaacgtagatgcagctgactttgcctgtagcctcatagaacccatcccatggctgcagtggaagcttgcggtggctctccagtgaccagaggcatagtgaggtcccagggaggctccctctgtcttgcaacagttatttgtgatctttttctatgtgcctattgtcacaacagagtccggcagcgtcttctcttgagggagcaatttggagaagagctggaacccagactcgcgccctggatgccatcctttatcatccacagcaatcccatctggttgggagcactgctctgggtctcacactgcccctcctctatcctagggagcctgaggcccaggggtggaaagatccagttgcgggtggggggtagtgaaccgtgcaggataatgaaagcaacttgctttggaaatgacctaccgctacccgttgtctgagactgagattatctcagactgtcttctggcttctgccaaaacactcccttaacagaaagcaccgaggggatgggggtaggggggttggggagagtgaggcttgagtgtgaaggaagtctcatatatgcagagctgaaatctccctctttgtatgtccacacttttgtcttgttctctagactgattcttgctattccaaatcctcttccacgttgacagcccttcagatatttcaacactcctctcagcatcctccacttcccccatctctccaagctgaacttggttcacagggtgggattgtgtatgtgcatgcaggaggtgggggtggacagtgccctgggctggaatcccccttagttctaagtgcctccttgcccgcagcttcgagagctgtgcccaggagtgaacaaccagccctacctctgtgagagtggtcactgctgcggggagactggctgctgcacctactactatgagctctggtggttctggctgctctggactgtcctcatcctctttagctgctgttgcgccttccgccaccgacgagctaaactcaggctgcaacaacagcagcggcagcgtgaaatcaacttgttggcctatcatggggcatgccatggggctggtcctttccctaccggttcactgcttgaccttcgtgagtgacttgatgccctgggtcagctaccagtggccctccccaaaccagaaccccaaatcgtctcacattcccttttccacacatttcaaagtatttttccctaatataaaaactagcaccctatacctggttgtcttcaaccaatcatgccaattttctcccctgcaggcttccagtgaacaaacctgctgttcctcctcatccagctgccctgcccactttgaaggaacaaatgtggaaggtgtttcctcccaccagagtgccccccctcatcaggagggtgagcccggggcaggggtgacccctgcctccacacccccctcctgccgctatcgccgtttaactggcgactccggtattgagctctgcccttgtcctgcctccggtgagggtgagccagtcaaggaggtgagggttagtgccaccctgccagatctggaggactactccccgtgtgcactacccccagagtctgtaccgcagatctttcccatggggctgtcttccagtgaaggggacatcccataagtagttttgagagggtggatgggttacttgcccaccagaaacagccctagtcccaactccttgcgttcctttggcccctccctgcctacctagaatctgcctgaaagggctggagaggggcagtattgggggactgtgctagctttacccccgcaggacatacacaggagcctttgatctcattaaagagatgtgaaccagcta

SEQ ID NO: 428113 - DNA, 1432 bp, Homo sapiens
gtgggtcgaaccttcacctactctttgtctgtacaagctcttgttgtctgggtgagcggcggaggcgctgctgtggattggtcacagggagaaacctctgatctgttcctattggcccgtccgtcaagggacgatgatgattggtagggcagagcaatctgagtcctagttggtggagttctgcccggatggaagctccggccgcggagtgatggtggcctcagcgaagatgggccgggcagggaccatggcggtggcagcagaggtggcaggggcggggcggctggcggtagaggaggctgtggtcctcagggggctgtaggtggaggtatggctcgggccagcagcgggaacggcagcgaggaggcctggggggcacttcgggcgccgcaacagcagatgcagctgactttgcctgtagcctcatagaacccatcccatggctgcagtggaagcttgcggtggctctccagtgaccagaggcatacttcgagagctgtgcccaggagtgaacaaccagccctacctctgtgagagtggtcactgctgcggggagactggctgctgcacctactactatgagctctggtggttctggctgctctggactgtcctcatcctctttagctgctgttgcgccttccgccaccgacgagctaaactcaggctgcaacaacagcagcggcagcgtgaaatcaacttgttggcctatcatggggcatgccatggggctggtcctttccctaccggttcactgcttgaccttcgcttcctcagcaccttcaagcccccagcctacgaggatgtggttcaccgcccaggcacaccaccccccccttatactgtggccccaggccgccccttgactgcttccagtgaacaaacctgctgttcctcctcatccagctgccctgcccactttgaaggaacaaatgtggaaggtgtttcctcccaccagagtgccccccctcatcaggagggtgagcccggggcaggggtgacccctgcctccacacccccctcctgccgctatcgccgtttaactggcgactccggtattgagctctgcccttgtcctgcctccggtgagggtgagccagtcaaggaggtgagggttagtgccaccctgccagatctggaggactactccccgtgtgcactacccccagagtctgtaccgcagatctttcccatggggctgtcttccagtgaaggggacatcccataagtagttttgagagggtggatgggttacttgcccaccagaaacagccctagtcccaactccttgcgttcctttggcccctccctgcctacctagaatctgcctgaaagggctggagaggggcagtattgggggactgtgctagctttacccccgcaggacatacacaggagcctttgatctcattaaagagatgtgaaccagcta

SEQ ID NO: 428114 - DNA, 1516 bp, Homo sapiens
gtgggtcgaaccttcacctactctttgtctgtacaagctcttgttgtctgggtgagcggcggaggcgctgctgtggattggtcacagggagaaacctctgatctgttcctattggcccgtccgtcaagggacgatgatgattggtagggcagagcaatctgagtcctagttggtggagttctgcccggatggaagctccggccgcggagtgatggtggcctcagcgaagatgggccgggcagggaccatggcggtggcagcagaggtggcaggggcggggcggctggcggtagaggaggctgtggtcctcagggggctgtaggtggaggtatggctcgggccagcagcgggaacggcagcgaggaggcctggggggcacttcgggcgccgcaacagcagcttcgagagctgtgcccaggagtgaacaaccagccctacctctgtgagagtggtcactgctgcggggagactggctgctgcacctactactatgagctctggtggttctggctgctctggactgtcctcatcctctttagctgctgttgcgccttccgccaccgacgagctaaactcaggctgcaacaacagcagcggcagcgtgaaatcaacttgttggcctatcatggggcatgccatggggctggtcctttccctaccggttcactgcttgaccttcgtgagtgacttgatgccctgggtcagctaccagtggccctccccaaaccagaaccccaaatcgtctcacattcccttttccacacatttcaaagtatttttccctaatataaaaactagcaccctatacctggttgtcttcaaccaatcatgccaattttctcccctgcagggcttcctcagcaccttcaagcccccagcctacgaggatgtggttcaccgcccaggcacaccaccccccccttatactgtggccccaggccgccccttgactgcttccagtgaacaaacctgctgttcctcctcatccagctgccctgcccactttgaaggaacaaatgtggaaggtgtttcctcccaccagagtgccccccctcatcaggagggtgagcccggggcaggggtgacccctgcctccacacccccctcctgccgctatcgccgtttaactggcgactccggtattgagctctgcccttgtcctgcctccggtgagggtgagccagtcaaggaggtgagggttagtgccaccctgccagatctggaggactactccccgtgtgcactacccccagagtctgtaccgcagatctttcccatggggctgtcttccagtgaaggggacatcccataagtagttttgagagggtggatgggttacttgcccaccagaaacagccctagtcccaactccttgcgttcctttggcccctccctgcctacctagaatctgcctgaaagggctggagaggggcagtattgggggactgtgctagctttacccccgcaggacatacacaggagcctttgatctcattaaagagatgtgaaccagcta

SEQ ID NO: 428115 - DNA, 986 bp, Homo sapiens
gtgggtcgaaccttcacctactctttgtctgtacaagctcttgttgtctgggtgagcggcggaggcgctgctgtggattggtcacagggagaaacctctgatctgttcctattggcccgtccgtcaagggacgatgatgattggtagggcagagcaatctgagtcctagttggtggagttctgcccggatggaagctccggccgcggagtgatggtggcctcagcgaagatgggccgggcagggaccatggcggtggcagcagaggtggcaggggcggggcggctggcggtagaggaggctgtggtcctcagggggctgtaggtggaggtatggctcgggccagcagcgggaacggcagcgaggaggcctggggggcacaccaccccccccttatactgtggccccaggccgccccttgactgcttccagtgaacaaacctgctgttcctcctcatccagctgccctgcccactttgaaggaacaaatgtggaaggtgtttcctcccaccagagtgccccccctcatcaggagggtgagcccggggcaggggtgacccctgcctccacacccccctcctgccgctatcgccgtttaactggcgactccggtattgagctctgcccttgtcctgcctccggtgagggtgagccagtcaaggaggtgagggttagtgccaccctgccagatctggaggactactccccgtgtgcactacccccagagtctgtaccgcagatctttcccatggggctgtcttccagtgaaggggacatcccataagtagttttgagagggtggatgggttacttgcccaccagaaacagccctagtcccaactccttgcgttcctttggcccctccctgcctacctagaatctgcctgaaagggctggagaggggcagtattgggggactgtgctagctttacccccgcaggacatacacaggagcctttgatctcattaaagagatgtgaaccagcta

SEQ ID NO: 428116 - DNA, 1374 bp, Homo sapiens
  misc_feature (1330)..(1330): n is a, c, g, or t
gtgggtcgaaccttcacctactctttgtctgtacaagctcttgttgtctgggtgagcggcggaggcgctgctgtggattggtcacagggagaaacctctgatctgttcctattggcccgtccgtcaagggacgatgatgattggtagggcagagcaatctgagtcctagttggtggagttctgcccggatggaagctccggccgcggagtgatggtggcctcagcgaagatgggccgggcagggaccatggcggtggcagcagaggtggcaggggcggggcggctggcggtagaggaggctgtggtcctcagggggctgtaggtggaggtatggctcgggccagcagcgggaacggcagcgaggaggcctggggggcacttcgggcgccgcaacagcagcttcgagagctgtgcccaggagtgaacaaccagccctacctctgtgagagtggtcactgctgcggggagactggctgctgcacctactactatgagctctggtggttctggctgctctggactgtcctcatcctctttagctgctgttgcgccttccgccaccgacgagctaaactcaggctgcaacaacagcagcggcagcgtgaaatcaacttgttggcctatcatggggcatgccatggggctggtcctttccctaccggttcactgcttgaccttcgcttcctcagcaccttcaagcccccagcctacgaggatgtggttcaccgcccaggcacaccaccccccccttatactgtggccccaggccgccccttgactgcttccagtgaacaaacctgctgttcctcctcatccagctgccctgcccactttgaaggaacaaatgtggaaggtgtttcctcccaccagagtgccccccctcatcaggagggtgagcccggggcaggggtgacccctgcctccacacccccctcctgccgctatcgccgtttaactggcgactccggtattgagctctgcccttgtcctgcctccggtgagggtgagccagtcaaggaggtgagggttagtgccaccctgccagatctggaggactactccccgtgtgcactacccccagagtctgtaccgcagatctttcccatggggctgtcttccagtgaaggggacatcccataagtagttttgagagggtggatgggttacttgcccaccagaaacagccctagtcccaactccttgcgttcctttggcccctccctgcctacctagaatctgcctgaaagggctggagaggggcagtattgggtgtgaatcgaattcctgcagcccgggggatccactagttctagagcggccgccaccgcgntggagctccagtttttgttccctttagttattgttaattgcgca

SEQ ID NO: 428117 - DNA, 1422 bp, Homo sapiens
gtgggtcgaaccttcacctactctttgtctgtacaagctcttgttgtctgggtgagcggcggaggcgctgctgtggattggtcacagggagaaacctctgatctgttcctattggcccgtccgtcaagggacgatgatgattggtagggcagagcaatctgagtcctagttggtggagttctgcccggatggaagctccggccgcggagtgatggtggcctcagcgaagatgggccgggcagggaccatggcggtggcagcagaggtggcaggggcggggcggctggcggtagaggaggctgtggtcctcagggggctgtaggtggaggtatggctcgggccagcagcgggaacggcagcgaggaggcctggggggcacttcgggcgccgcaacagcagcttcgagagctgtgcccaggagtgaacaaccagccctacctctgtgagagtggtcactgctgcggggagactggctgctgcacctactactatgagctctggtggttctggctgctctggactgtcctcatcctctttagctgctgttgcgccttccgccaccgacgagctaaactcaggctgcaacaacagcagcggcagcgtgaaatcaacttgttggcctatcatggggcatgccatggggctggtcctttccctaccggttcactgcttgaccttcgcttcctcagcaccttcaagcccccagcctacgaggatgtggttcaccgcccaggcacaccaccccccccttatactgtggccccaggccgccccttgactgcttccagtgaacaaacctgctgttcctcctcatccagctgccctgcccactttgaaggaacaaatgtggaaggtgtttcctcccaccagagtgccccccctcatcaggagggtgagcccggggcaggggtgacccctgcctccacacccccctcctgccgctatcgccgtttaactggcgactccggtattgagctctgcccttgtcctgcctccggtgagggtgagccagtcaaggaggtgagggttagtgccaccctgccagatctggaggactactccccgtgtgcactacccccagagtctgtaccgcagatctttcccatggggctgtcttccagtgaaggggacatcccataagtagttttgagagggtggatgggttacttgcccaccagaaacagccctagtcccaactccttgcgttcctttggcccctccctgcctacctagaatctgcctgaaagggctggagaggggcagtattgggggactgtgctagctttacccccgcaggacatacacaggagcctttgatctcattaaagagatgtgaaccagctaaattaaatcccttattcacttcttccaagagggtaataactgaaaaaaaaaacccgttacttgtcctcctggggccat

SEQ ID NO: 428118 - DNA, 1916 bp, Homo sapiens
gtgggtcgaaccttcacctactctttgtctgtacaagctcttgttgtctgggtgagcggcggaggcgctgctgtggattggtcacagggagaaacctctgatctgttcctattggcccgtccgtcaagggacgatgatgattggtagggcagagcaatctgagtcctagttggtggagttctgcccggatggaagctccggccgcggagtgatggtggcctcagcgaagatgggccgggcagggaccatggcggtggcagcagaggtggcaggggcggggcggctggcggtagaggaggctgtggtcctcagggggctgtaggtggaggtatggctcgggccagcagcgggaacggcagcgaggaggcctggggggcacttcgggcgccgcaacagcagatcccaatagctccaaaacctatcacgacagccatttgtctctttcccctttccttgtcccttccttttgggggtgggggaggaactcacggagccaaaggtactgtgaagttcctaaacatgtctcttccactctttgtctaaactttgtaacgtagatgcagctgactttgcctgtagcctcatagaacccatcccatggctgcagtggaagcttgcggtggctctccagtgaccagaggcatagtgaggtcccagggaggctccctctgtcttgcaacagttatttgtgatctttttctatgtgcctattgtcacaacagagtccggcagcgtcttctcttgagggagcaatttggagaagagctggaacccagactcgcgccctggatgccatcctttatcatccacagcaatcccatctggttgggagcactgctctgggtctcacactgcccctcctctatcctagggagcctgaggcccaggggtggaaagatccagttgcgggtggggggtagtgaaccgtgcaggataatgaaagcaacttgctttggaaatgacctaccgctacccgttgtctgagactgagattatctcagactgtcttctggcttctgccaaaacactcccttaacagaaagcaccgaggggatgggggtaggggggttggggagagtgaggcttgagtgtgaaggaagtctcatatatgcagagctgaaatctccctctttgtatgtccacacttttgtcttgttctctagactgattcttgctattccaaatcctcttccacgttgacagcccttcagatatttcaacactcctctcagcatcctccacttcccccatctctccaagctgaacttggttcacagggtgggattgtgtatgtgcatgcaggaggtgggggtggacagtgccctgggctggaatcccccttagttctaagtgcctccttgcccgcagcttcgagagctgtgcccaggagtgaacaaccagccctacctctgtgagagtggtcactgctgcggggagactggctgctgcacctactactatgagctctggtggttctggctgctctggactgtcctcatcctctttagctgctgttgcgccttccgccaccgacgagctaaactcaggctgcaacaacagcagcggcagcgtgaaatcaacttgttggcctatcatggggcattgccaccctgccagatctggaggactactccccgtgtgcactacccccagagtctgtaccgcagatctttcccatggggctgtcttccagtgaaggggacatcccataagtagttttgagagggtggatgggttacttgcccaccagaaacagccctagtcccaactccttgcgttcctttggcccctccctgcctacctagaatctgcctgaaagggctggagaggggcagtattgggggactgtgctagctttacccccgcaggacatacacaggagcctttgatctcattaaagagatgtgaaccagcta

SEQ ID NO: 428119 - DNA, 1485 bp, Homo sapiens
gtgggtcgaaccttcacctactctttgtctgtacaagctcttgttgtctgggtgagcggcggaggcgctgctgtggattggtcacagggagaaacctctgatctgttcctattggcccgtccgtcaagggacgatgatgattggtagggcagagcaatctgagtcctagttggtggagttctgcccggatggaagctccggccgcggagtgatggtggcctcagcgaagatgggccgggcagggaccatggcggtggcagcagaggtggcaggggcggggcggctggcggtagaggaggctgtggtcctcagggggctgtaggtggaggtatggctcgggccagcagcgggaacggcagcgaggaggcctggggggcacttcgggcgccgcaacagcagatcccaatagctccaaaacctatcacgacagccatttgtctctttcccctttccttgtcccttccttttgggggtgggggaggaactcacggagccaaaggtactgtgaagttcctaaacatgtctcttccactctttgtctaaactttgtaacgtagatgcagctgactttgcctgtagcctcatagaacccatcccatggctgcagtggaagcttgcggtggctctccagtgaccagaggcatagtgaggtcccagggaggctccctctgtcttgcaacagttatttgtgatctttttctatgtgcctattgtcacaacagagtccggcagcgtcttctcttgagggagcaatttggagaagagctggaacccagactcgcgccctggatgccatcctttatcatccacagcaatcccatctggttgggagcactgctctgggtctcacactgcccctcctctatcctagggagcctgaggcccaggggtggaaagatccagttgcgggtggggggtagtgaaccgtgcaggataatgaaagcaacttgctttggaaatgacctaccgctacccgttgtctgagactgagattatctcagactgtcttctggcttctgccaaaacactcccttaacagaaagcaccgaggggatgggggtaggggggttggggagagtgaggcttgagtgtgaaggaagtctcatatatgcagagctgaaatctccctctttgtatgtccacacttttgtcttgttctctagactgattcttgctattccaaatcctcttccacgttactccccgtgtgcactacccccagagtctgtaccgcagatctttcccatggggctgtcttccagtgaaggggacatcccataagtagttttgagagggtggatgggttacttgcccaccagaaacagccctagtcccaactccttgcgttcctttggcccctccctgcctacctagaatctgcctgaaagggctggagaggggcagtattgggggactgtgctagctttacccccgcaggacatacacaggagcctttgatctcattaaagagatgtgaaccagcta

SEQ ID NO: 428120 - DNA, 1911 bp, Homo sapiens
gtgggtcgaaccttcacctactctttgtctgtacaagctcttgttgtctgggtgagcggcggaggcgctgctgtggattggtcacagggagaaacctctgatctgttcctattggcccgtccgtcaagggacgatgatgattggtagggcagagcaatctgagtcctagttggtggagttctgcccggatggaagctccggccgcggagtgatggtggcctcagcgaagatgggccgggcagggaccatggcggtggcagcagaggtggcaggggcggggcggctggcggtagaggaggctgtggtcctcagggggctgtaggtggaggtatggctcgggccagcagcgggaacggcagcgaggaggcctggggggcacttcgggcgccgcaacagcagatcccaatagctccaaaacctatcacgacagccatttgtctctttcccctttccttgtcccttccttttgggggtgggggaggaactcacggagccaaaggtactgtgaagttcctaaacatgtctcttccactctttgtctaaactttgtaacgtagatgcagctgactttgcctgtagcctcatagaacccatcccatggctgcagtggaagcttgcggtggctctccagtgaccagaggcatagtgaggtcccagggaggctccctctgtcttgcaacagttatttgtgatctttttctatgtgcctattgtcacaacagagtccggcagcgtcttctcttgagggagcaatttggagaagagctggaacccagactcgcgccctggatgccatcctttatcatccacagcaatcccatctggttgggagcactgctctgggtctcacactgcccctcctctatcctagggagcctgaggcccaggggtggaaagatccagttgcgggtggggggtagtgaaccgtgcaggataatgaaagcaacttgctttggaaatgacctaccgctacccgttgtctgagactgagattatctcagactgtcttctggcttctgccaaaacactcccttaacagaaagcaccgaggggatgggggtaggggggttggggagagtgaggcttgagtgtgaaggaagtctcatatatgcagagctgaaatctccctctttgtatgtccacacttttgtcttgttctctagactgattcttgctattccaaatcctcttccacgttgacagcccttcagatatttcaacactcctctcagcatcctccacttcccccatctctccaagctgaacttggttcacagggtgggattgtgtatgtgcatgcaggaggtgggggtggacagtgccctgggctggaatcccccttagttctaagtgcctccttgcccgcagcttcgagagctgtgcccaggagtgaacaaccagccctacctctgtgagagtggtcactgctgcggggagactggctgctgcacctactactatgagctctggtggttctggctgctctggactgtcctcatcctctttagctgctgttgcgccttccgccaccgacgagctaaactcaggctgcaacaacagcagcggcagcgtgaaatcaacttgttggcctatcatggggcatgccatggggctggtcctttccctaccggttcactgcttgaccttcgcttcctcagcaccttcaagcccccagcctacgaggatgtggttcaccgcccaggcacaccaccccccccttatactgtggccccaggccgccccttgactgcttccagtgaacaaacctgctggcggtagaggaggctgtggtcctcagggggctgtaggtggaggtatggctcgggccagcagcgggaacggcagcgaggaggcctggggggcacttcgggcgccgcaacagcagctttcggagagctttgcccagggagt

SEQ ID NO: 428121 - DNA, 1362 bp, Homo sapiens
gtgggtcgaaccttcacctactctttgtctgtacaagctcttgttgtctgggtgagcggcggaggcgctgctgtggattggtcacagggagaaacctctgatctgttcctattggcccgtccgtcaagggacgatgatgattggtagggcagagcaatctgagtcctagttggtggagttctgcccggatggaagctccggccgcggagtgatggtggcctcagcgaagatgggccgggcagggaccatggcggtggcagcagaggtggcaggggcggggcggctggcggtagaggaggctgtggtcctcagggggctgtaggtggaggtatggctcgggccagcagcgggaacggcagcgaggaggcctggggggcacttcgggcgccgcaacagcagatcccaatagctccaaaacctatcacgacagccatttgtctctttcccctttccttgtcccttccttttgggggtgggggaggaactcacggagccaaaggtactgtgaagttcctaaacatgtctcttccactctttgtctaaactttgtaacgtagatgcagctgactttgcctgtagcctcatagaacccatcccatggctgcagtggaagcttgcggtggctctccagtgaccagaggcatagtgaggtcccagggaggctccctctgtcttgcaacagttatttgtgatctttttctatgtgcctattgtcacaacagagtccggcagcgtcttctcttgagggagcaatttggagaagagctggaacccagactcgcgccctggatgccatcctttatcatccacagcaatcccatctggttgggagcactgctctgggtctcacactgcccctcctctatcctagggagcctgaggcccaggggtggaaagatccagttgcgggtggggggtagtgaaccgtgcaggataatgaaagcaacttgctttggaaatgacctaccgctacccgttgtctgagactgagattatctcagactgtcttctggcttctgccaaaacactcccttaacagaaagcaccgaggggatgggggtaggggggttggggagagtgaggcttgagtgtgaaggaaagtctgtaccgcagatctttcccatggggctgtcttccagtgaaggggacatcccataagtagttttgagagggtggatgggttacttgcccaccagaaacagccctagtcccaactccttgcgttcctttggcccctccctgcctacctagaatctgcctgaaagggctggagaggggcagtattgggggactgtgctagctttacccccgcaggacatacacaggagcctttgatctcattaaagagatgtgaaccagcta

SEQ ID NO: 428122 - DNA, 1420 bp, Homo sapiens
gtgggtcgaaccttcacctactctttgtctgtacaagctcttgttgtctgggtgagcggcggaggcgctgctgtggattggtcacagggagaaacctctgatctgttcctattggcccgtccgtcaagggacgatgatgattggtagggcagagcaatctgagtcctagttggtggagttctgcccggatggaagctccggccgcggagtgatggtggcctcagcgaagatgggccgggcagggaccatggcggtggcagcagaggtggcaggggcggggcggctggcggtagaggaggctgtggtcctcagggggctgtaggtggaggtatggctcgggccagcagcgggaacggcagcgaggaggcctggggggcacttcgggcgccgcaacagcagatcccaatagctccaaaacctatcacgacagccatttgtctctttcccctttccttgtcccttccttttgggggtgggggaggaactcacggagccaaaggtactgtgaagttcctaaacatgtctcttccactctttgtctaaactttgtaacgtagatgcagctgactttgcctgtagcctcatagaacccatcccatggctgcagtggaagcttgcggtggctctccagtgaccagaggcatagtgaggtcccagggaggctccctctgtcttgcaacagttatttgtgatctttttctatgtgcctattgtcacaacagagtccggcagcgtcttctcttgagggagcaatttggagaagagctggaacccagactcgcgccctggatgccatcctttatcatccacagcaatcccatctggttgggagcactgctctgggtctcacactgcccctcctctatcctagggagcctgaggcccaggggtggaaagatccagttgcgggtggggggtagtgaaccgtgcaggataatgaaagcaacttgctttggaaatgacctaccgctacccgttgtctgagactgagattatctcagactgtcttctggcttctgccaaaacactcccttaacagaaagcaccgaggggatgggggtaggggggttggggagagtgaggcttgagtgtgaaggaagtctcatatatgcagagctgaaatctccctctttgtatgtccacacttttgtcttgttctctagactgattcttgctattccaaatcctcttccacgttgaaggggacatcccataagtagttttgagagggtggatgggttacttgcccaccagaaacagccctagtcccaactccttgcgttcctttggcccctccctgcctacctagaatctgcctgaaagggctggagaggggcagtattgggggactgtgctagctttacccccgcaggacatacacaggagcctttgatctcattaaagagatgtgaaccagcta

SEQ ID NO: 428123 - DNA, 727 bp, Homo sapiens
gtgggtcgaaccttcacctactctttgtctgtacaagctcttgttgtctgggtgagcggcggaggcgctgctgtggattggtcacagggagaaacctctgatctgttcctattggcccgtccgtcaagggacgatgatgattggtagggcagagcaatctgagtcctagttggtggagttctgcccggatggaagctccggccgcggagtgatggtggcctcagcgaagatgggccgggcagggaccatggcggtggcagcagaggtggcaggggcggggcggctggcggtagaggaggctgtggtcctcagggggctgtaggtggaggtatggctcgggccagcagcgggaacggcagcgaggaggcctggggggcacttcgggcgccgcaacagcagatgcagctgactttgcctgtagcctcatagaacccatcccatggctgcagtggaagcttgcggtggctctccagtgaccagaggcatagtgaggtcccagggaggctccctctgtcttgcaacagttatttgtgatctttttctatgtgcctattgtcacaacagagtccggcagcgtcttctcttgagggagcaatttggagaagagctggaacccagactcgcgccctggatgccatcctttatcatccacagcaatcccatctgcccttcagatatttcacactcctctcagcatccgaacgtccggggatcttagatgacctcc

SEQ ID NO: 428124 - DNA, 466 bp, Homo sapiens
ccggtccgaaaattcccgggtcgcctaactactactaaattaacggccgcgtcgacgccagatagctggaagacattagatcagcaacagttcttcacagaggaagaactaaaagaatatgaaaatattattgctttacaagaaaatgaacttaagaagaaggcagatgagcttcagaaacaaaaagaagagctacaacgtcagcatgatcaactggaggctcagaagctggaatatcatcaggtcatacagcagatggaacaaaaaaaattacaacaaggaattcctccatcagggccagctggagaattgaagtttgagccacacatttaaagtctgaagtccaccagaacttggaagaaagctgttaactcaacatctatttcatctttttagctcccttcctttttctctgctcaataaatattttaaaagcatatttgaaataaagggagatactttttaa

SEQ ID NO: 428125 - DNA, 551 bp, Homo sapiens
ggggcagagcggagcggtgggccgggggctggaggacaggtttgtgcgctggacgcaagcaccaggcgcagcctcgctcgccgacacccggccaggtaaggccggtggccgcgcgaacgtgttacgagtcagtttttagtgaaaaaacattgagctaggagccaagacccatctcttcactattttggtattgtgcaagtcatcttacctctctggatctcagttgtctcatctgtaaaaaggagataaaaattatttacctgcctgaacatgaggtggaggaccatcctgctacagtattgctttctcttgattacatgtttacttactgctcttgaagctgtgcctattgacatagacaagacaaaagtacaaaatattcaccctgtggaaagtgcgaagatagaaccaccagtaagtgaaatgaagtgaaatgggaggaattataactaaatgaaatgaattataattgtaactaaatgaggtggaatgaggtgaaactataactaaatgaaatgagaggaattataacaaaaatattgctaatattt

SEQ ID NO: 428126 - DNA, 1646 bp, Homo sapiens
ggggcagagcggagcggtgggccgggggctggaggacaggtttgtgcgctggacgcaagcaccaggcgcagcctcgctcgccgacacccggccagaacgtgttacgagtcagtttttagtgaaaaaacattgagctaggagccaagacccatctcttcactattttggtattgtgcaagtcatcttacctctctggatctcagttgtctcatctgtaaaaaggagataaaaattatttacctgcctgaacatgaggtggaggaccatcctgctacagtattgctttctcttgattacatgtttacttactgctcttgaagctgtgcctattgacatagacaagacaaaagtacaaaatattcaccctgtggaaagtgcgaagatagaaccaccagatactggactttattatgatgaatatctcaagcaagtgattgatgtgctggaaacagataaacacttcagagaaaagctccagaaagcagacatagaggaaataaagagtgggaggctaagcaaagaactggatttagtaagtcaccatgtgaggacaaaacttgatgaactgaaaaggcaagaagtaggaaggttaagaatgttaattaaagctaagttggattcccttcaagatataggcatggaccaccaagctcttctaaaacaatttgatcacctaaaccacctgaatcctgacaagtttgaatccacagatttagatatgctaatcaaagcggcaacaagtgatctggaacactatgacaagactcgtcatgaagaatttaaaaaatatgaaatgatgaaggaacatgaaaggagagaatatttaaaaacattgaatgaagaaaagagaaaagaagaagagtctaaatttgaagaaatgaagaaaaagcatgaaaatcaccctaaagttaatcacccaggaagcaaagatcaactaaaagaggtatgggaagagactgatggattggatcctaatgactttgaccccaagacatttttcaaattacatgatgtcaatagtgatggattcctggatgaacaagaattagaagccctatttactaaagagttggagaaagtatatgaccctaaaaatgaagaggatgatatggtagaaatggaagaagaaaggcttagaatgagggaacatgtaatgaatgaggttgatactaacaaagacagattggtgactctggaggagtttttgaaagccacagaaaaaaaagaattcttggagccagatagctgggagacattagatcagcaacagttcttcacagaggaagaactaaaagaatatgaaaatattattgctttacaagaaaatgaacttaagaagaaggcagatgagcttcagaaacaaaaagaagagctacaacgtcagcatgatcaactggaggctcagaagctggaatatcatcaggtcatacagcagatggaacaaaaaaaattacaacaaggaattcctccatcagggccagctggagaattgaagtttgagccacacatttaaagtctgaagtccaccagaacttggaagaaagctgttaactcaacatctatttcatctttttagctcccttcctttttctctgctcaataaatattttaaaagcatatttgaaataaagggagatactttttaa

SEQ ID NO: 428127 - DNA, 2105 bp, Homo sapiens
ggggcagagcggagcggtgggccgggggctggaggacaggtttgtgcgctggacgcaagcaccaggcgcagcctcgctcgccgacacccggccaggtaaggccggtggccgcgcgaacgtgttacgagtcagtttttagtgaaaaaacattgagctaggagccaagacccatctcttcactattttggtattgtgcaagtcatcttacctctctggatctcagttgtctcatctgtaaaaaggagataaaaattatttacctgcctgaacatttctccttaaaaatatcagtcttggccgggcacggtggctcaggcctgtaatcccagcactttgggaggctgaggcgggcagatcacctgaggtcaggagttcaagaccagcctggccaacatgatgaggtggaggaccatcctgctacagtattgctttctcttgattacatgtttacttactgctcttgaagctgtgcctattgacatagacaagacaaaagtacaaaatattcaccctgtggaaagtgcgaagatagaaccaccagatactggactttattatgatgaatatctcaagcaagtgattgatgtgctggaaacagataaacacttcagagaaaagctccagaaagcagacatagaggaaataaagagtgggaggctaagcaaagaactggatttagtaagtcaccatgtgaggacaaaacttgatgaactgaaaaggcaagaagtaggaaggttaagaatgttaattaaagctaagttggattcccttcaagatataggcatggaccaccaagctcttctaaaacaatttgatcacctaaaccacctgaatcctgacaagtttgaatccacagatttagatatgctaatcaaagcggcaacaagtgatctggaacactatgacaagactcgtcatgaagaatttaaaaaatatgaaatgatgaaggaacatgaaaggagagaatatttaaaaacattgaatgaagaaaagagaaaagaagaagagtctaaatttgaagaaatgaagaaaaagcatgaaaatcaccctaaagttaatcacccaggaagcaaagatcaactaaaagaggtatgggaagagactgatggattggatcctaatgactttgaccccaagacatttttcaaattacatgatgtcaatagtgatggattcctggatgaacaagaattagaagccctatttactaaagagttggagaaagtatatgaccctaaaaatgaagaggatgatatggtagaaatggaagaagaaaggcttagaatgagggaacatgtaatgaatgaggttgatactaacaaagacagattggtgactctggaggagtttttgaaagccacagaaaaaaaagaattcttggagccagatagctgggagacattagatcagcaacagttcttcacagaggaagaactaaaagaatatgaaaatattattgctttacaagaaaatgaacttaagaagaaggcagatgagcttcagaaacaaaaagaagagctacaacgtcagcatgatcaactggaggctcagaagctggaatatcatcaggtcatacagcagatggaacaaaaaaaattacaacaaggaattcctccatcagggccagctggagaattgaagtttgagccacacatttaaagtctgaagtccaccagaacttggaagaaagctgttaactcaacatctatttcatctttttagctcccttcctttttctctgctcaataaatattttaaaagcatatttgaaataaagggagatactttttaaatgaaaacactttttttgggacacagatattaaaggattgaagtttatcagaaccaggaagaaaacaaactcactgtctgctctctgctctcacattcacacggctcttttatttatttttttgttctcctttaatgatttaattaagtggctttatgccataatttagtgaaactattaggaactatttaagtgagaaaactctgcctcttgcttttaaattagattgctctcacttactcgtaaacataggtattcttttatgggtgcttatcattccttctttcaataaatgtctgtttgatattaacaa

SEQ ID NO: 428128 - DNA, 2160 bp, Homo sapiens
ggggcagagcggagcggtgggccgggggctggaggacaggtttgtgcgctggacgcaagcaccaggcgcagcctcgctcgccgacacccggccaggtaaggccggtggccgcgcgaacgtgttacgagtcagtttttagtgaaaaaacattgagctaggagccaagacccatctcttcactattttggtattgtgcaagtcatcttacctctctggatctcagttgtctcatctgtaaaaaggagataaaaattatttacctgcctgaacatgaggtggaggaccatcctgctacagtattgctttctcttgattacatgtttacttactgctcttgaagctgtgcctattgacatagacaagacaaaagtacaaaatattcaccctgtggaaagtgcgaagatagaaccaccagatactggactttattatgatgaatatctcaagcaagtgattgatgtgctggaaacagataaacacttcagagaaaagctccagaaagcagacatagaggaaataaagagtgggaggctaagcaaagaactggatttagtaagtcaccatgtgaggacaaaacttgatgaactgaaaaggcaagaagtaggaaggttaagaatgttaattaaagctaagttggattcccttcaagatataggcatggaccaccaagctcttctaaaacaatttgatcacctaaaccacctgaatcctgacaagtttgaatccacagatttagatatgctaatcaaagcggcaacaagtgatctggaacactatgacaagactcgtcatgaagaatttaaaaaatatgaaatgatgaaggaacatgaaaggagagaatatttaaaaacattgaatgaagaaaagagaaaagaagaagagtctaaatttgaagaaatgaagaaaaagcatgaaaatcaccctaaagttaatcacccaggaagcaaagatcaactaaaagaggtatgggaagagactgatggattggatcctaatgactttgaccccaagacatttttcaaattacatgatgtcaatagtgatggattcctggatgaacaagaattagaagccctatttactaaagagttggagaaagtatatgaccctaaaaatgaagaggatgatatggtagaaatggaagaagaaaggcttagaatgagggaacatgtaatgaatgaggttgatactaacaaagacagattggtgactctggaggagtttttgaaagccacagaaaaaaaagaattcttggagccagatagctgggagacattagatcagcaacagttcttcacagaggaagaactaaaagaatatgaaaatattattgctttacaagaaaatgaacttaagaagaaggcagatgagcttcagaaacaaaaagaagagctacaacgtcagcatgatcaactggaggctcagaagctggaatatcatcaggtcatacagcagatggaacaaaaaaaattacaacaaggaattcctccatcagggccagctggagaattgaagtttgagccacgtccagaggtgtccttctaaagctggtagaggtttcacgagtcatcagggacccagaacccttctcttttgctgtccctttgtcctagtgcatggtttccacactgtggtgcaagatgtctcctcaagctctaggcattacatctgctatcctgctgtcagaaagaaggaaggggaaaagaagatcatttccttctctttaaggacatttcccagaagtcacacagaacatttccatttatattactttggccagaacttggtcatatggccacatttagttccagaatgattaggaaatgcagtcttttattgatccctgtgcccaggaaaatattggaggcctttttcaaggaaaaaggggaaaacagatattggttgacaaatagcagtctctgccatactgtccctggatacatgtctttgagtgaatgtcccttatttaccattctgattacttgttggatattttcaatatgtgttacaatatggttccaaaattgtatgtgatattccaacagcaagttggatgcaatgtgtcataaaaatgacctcagtgtcaaccagcatttgaataccgtgtctcaatgctgtgcaccaataaagaacacagaaagtcagagttttccataaata

SEQ ID NO: 428129 - DNA, 1922 bp, Homo sapiens
ggggcagagcggagcggtgggccgggggctggaggacaggtttgtgcgctggacgcaagcaccaggcgcagcctcgctcgccgacacccggccaggtaaggccggtggccgcgcgaacgtgttacgagtcagtttttagtgaaaaaacattgagctaggagccaagacccatctcttcactattttggtattgtgcaagtcatcttacctctctggatctcagttgtctcatctgtaaaaaggagataaaaattatttacctgcctgaacatgaggtggaggaccatcctgctacagtattgctttctcttgattacatgtttacttactgctcttgaagctgtgcctattgacatagacaagacaaaagtacaaaatattcaccctgtggaaagtgcgaagatagaaccaccagatactggactttattatgatgaatatctcaagcaagtgattgatgtgctggaaacagataaacacttcagagaaaagctccagaaagcagacatagaggaaataaagagtgggaggctaagcaaagaactggatttagtaagtcaccatgtgaggacaaaacttgatgaactgaaaaggcaagaagtaggaaggttaagaatgttaattaaagctaagttggattcccttcaagatataggcatggaccaccaagctcttctaaaacaatttgatcacctaaaccacctgaatcctgacaagtttgaatccacagatttagatatgctaatcaaagcggcaacaagtgatctggaacactatgacaagactcgtcatgaagaatttaaaaaatatgaaatgatgaaggaacatgaaaggagagaatatttaaaaacattgaatgaagaaaagagaaaagaagaagagtctaaatttgaagaaatgaagaaaaagcatgaaaatcaccctaaagttaatcacccaggaagcaaagatcaactaaaagaggtatgggaagagactgatggattggatcctaatgactttgaccccaagacatttttcaaattacatgatgtcaatagtgatggattcctggatgaacaagaattagaagccctatttactaaagagttggagaaagtatatgaccctaaaaatgaagaggatgatatggtagaaatggaagaagaaaggcttagaatgagggaacatgtaatgaatgaggttgatactaacaaagacagattggtgactctggaggagtttttgaaagccacagaaaaaaaagaattcttggagccagatagctgggagacattagatcagcaacagttcttcacagaggaagaactaaaagaatatgaaaatattattgctttacaagaaaatgaacttaagaagaaggcagatgagcttcagaaacaaaaagaagagctacaacgtcagcatgatcaactggaggctcagaagctggaatatcatcaggtcatacagcagatggaacaaaaaaaattacaacaaggaattcctccatcagggccagctggagaattgaagtttgagccacgtgtgtaattttgtttgattatttatttaggaaaataaattattttatcaattgaaatccacatttattacaaatataatttcaaatcattaagatgttatgttattttttgtgtattttttgtggtattagagcaatttagattatagaaaaatgaaaatgcctccaaaagttttatgtagcagcaaattttaagtgctgtatcatttgtataatttgataaccatatttatggtaaaatgatttatttcaactttatttgtaattctttctaattatattaatcttaccagagaatatgttttttaaaattgtgatctatgattagctaagcatattttttaaaacaagtatatttgtatatgaaggaacatttagaataaaggaagatactttt

SEQ ID NO: 428130 - DNA, 1567 bp, Homo sapiens
  misc_feature (16)..(16): n is a, c, g, or t
  misc_feature (25)..(25): n is a, c, g, or t
  misc_feature (34)..(34): n is a, c, g, or t
agctgttccgaggatncccgtcganagaatccangcaagtgattgatgtgctggaaacagataaacacttcagagaaaagctccagaaagcagacatagaggaaataaagagtgggaggctaagcaaagaactggatttagtaagtcaccatgtgaggacaaaacttgatgaactgaaaaggcaagaagtaggaaggttaagaatgttaattaaagctaagttggattcccttcaagatataggcatggaccaccaagctcttctaaaacaatttgatcacctaaaccacctgaatcctgacaagtttgaatccacagatttagatatgctaatcaaagcggcaacaagtgatctggaacactatgacaagactcgtcatgaagaatttaaaaaatatgaaatgatgaaggaacatgaaaggagagaatatttaaaaacattgaatgaagaaaagagaaaagaagaagagtctaaatttgaagaaatgaagaaaaagcatgaaaatcaccctaaagttaatcacccaggaagcaaagatcaactaaaagaggtatgggaagagactgatggattggatcctaatgactttgaccccaagacatttttcaaattacatgatgtcaatagtgatggattcctggatgaacaagaattagaagccctatttactaaagagttggagaaagtatatgaccctaaaaatgaagaggatgatatggtagaaatggaagaagaaaggcttagaatgagggaacatgtaatgaatgaggttgatactaacaaagacagattggtgactctggaggagtttttgaaagccacagaaaaaaaagaattcttggagccagatagctgggagacattagatcagcaacagttcttcacagaggaagaactaaaagaatatgaaaatattattgctttacaagaaaatgaacttaagaagaaggcagatgagcttcagaaacaaaaagaagagctacaacgtcagcatgatcaactggaggctcagaagctggaatatcatcaggtcatacagcagatggaacaaaaaaaattacaacaaggaattcctccatcagggccagctggagaattgaagtttgagccacacatttaaagtctgaagtccaccagaacttggaagaaagctgttaactcaacatctatttcatctttttagctcccttcctttttctctgctcaataaatattttaaaagcatatttgaaataaagggagatactttttaaatgaaaacactttttttgggacacagatattaaaggattgaagtttatcagaaccaggaagaaaacaaactcactgtctgctctctgctctcacattcacacggctcttttatttatttttttgttctcctttaatgatttaattaagtggctttatgccataatttagtgaaactattaggaactatttaagtgagaaaactctgcctcttgcttttaaattagattgctctcacttactcgtaaacataggtattcttttatgggtgcttatcattccttctttcaataaatgtctgtttgatattaacaa

SEQ ID NO: 428131 - DNA, 1220 bp, Homo sapiens
ccaacatctcatttcttcacatttagtcgtcatgaagaatttaaaaaatatgaaatgatgaaggaacatgaaaggagagaatatttaaaaacattgaatgaagaaaagagaaaagaagaagagtctaaatttgaagaaatgaagaaaaagcatgaaaatcaccctaaagttaatcacccaggaagcaaagatcaactaaaagaggtatgggaagagactgatggattggatcctaatgactttgaccccaagacatttttcaaattacatgatgtcaatagtgatggattcctggatgaacaagaattagaagccctatttactaaagagttggagaaagtatatgaccctaaaaatgaagaggatgatatggtagaaatggaagaagaaaggcttagaatgagggaacatgtaatgaatgaggttgatactaacaaagacagattggtgactctggaggagtttttgaaagccacagaaaaaaaagaattcttggagccagatagctgggagacattagatcagcaacagttcttcacagaggaagaactaaaagaatatgaaaatattattgctttacaagaaaatgaacttaagaagaaggcagatgagcttcagaaacaaaaagaagagctacaacgtcagcatgatcaactggaggctcagaagctggaatatcatcaggtcatacagcagatggaacaaaaaaaattacaacaaggaattcctccatcagggccagctggagaattgaagtttgagccacacatttaaagtctgaagtccaccagaacttggaagaaagctgttaactcaacatctatttcatctttttagctcccttcctttttctctgctcaataaatattttaaaagcatatttgaaataaagggagatactttttaaatgaaaacactttttttgggacacagatattaaaggattgaagtttatcagaaccaggaagaaaacaaactcactgtctgctctctgctctcacattcacacggctcttttatttatttttttgttctcctttaatgatttaattaagtggctttatgccataatttagtgaaactattaggaactatttaagtgagaaaactctgcctcttgcttttaaattagattgctctcacttactcgtaaacataggtattcttttatgggtgcttatcattccttctttcaataaatgtctgtttgatattaacaa

SEQ ID NO: 428132 - DNA, 1132 bp, Homo sapiens
taaattcgcggtcgcgtcgacgaaaagaagaagagtctaaatttgaagaaatgaagaaaaagcatgaaaatcaccctaaagttaatcacccaggaagcaaagatcaactaaaagaggtatgggaagagactgatggattggatcctaatgactttgaccccaagacatttttcaaattacatgatgtcaatagtgatggattcctggatgaacaagaattagaagccctatttactaaagagttggagaaagtatatgaccctaaaaatgaagaggatgatatggtagaaatggaagaagaaaggcttagaatgagggaacatgtaatgaatgaggttgatactaacaaagacagattggtgactctggaggagtttttgaaagccacagaaaaaaaagaattcttggagccagatagctgggagacattagatcagcaacagttcttcacagaggaagaactaaaagaatatgaaaatattattgctttacaagaaaatgaacttaagaagaaggcagatgagcttcagaaacaaaaagaagagctacaacgtcagcatgatcaactggaggctcagaagctggaatatcatcaggtcatacagcagatggaacaaaaaaaattacaacaaggaattcctccatcagggccagctggagaattgaagtttgagccacacatttaaagtctgaagtccaccagaacttggaagaaagctgttaactcaacatctatttcatctttttagctcccttcctttttctctgctcaataaatattttaaaagcatatttgaaataaagggagatactttttaaatgaaaacactttttttgggacacagatattaaaggattgaagtttatcagaaccaggaagaaaacaaactcactgtctgctctctgctctcacattcacacggctcttttatttatttttttgttctcctttaatgatttaattaagtggctttatgccataatttagtgaaactattaggaactatttaagtgagaaaactctgcctcttgcttttaaattagattgctctcacttactcgtaaacataggtattcttttatgggtgcttatcattccttctttcaataaatgtctgtttgatattaacaa

SEQ ID NO: 428133 - DNA, 1576 bp, Homo sapiens
ggggcagagcggagcggtgggccgggggctggaggacaggtttgtgcgctggacgcaagcaccaggcgcagcctcgctcgccgacacccggccaggtaaggccggtggccgcgcgaacgtgttacgagtcagtttttagtgaaaaaacattgagctaggagccaagacccatctcttcactattttggtattgtgcaagtcatcttacctctctggatctcagttgtctcatctgtaaaaaggagataaaaattatttacctgcctgaacatgaggtggaggaccatcctgctacagtattgctttctcttgattacatgtttacttactgctcttgaagctgtgcctattgacatagacaagacaaaagtacaaaatattcaccctgtggaaagtgcgaagatagaaccaccagatactggactttattatgatgaatatctcaagcaagtgattgatgtgctggaaacagataaacacttcagagaaaagctccagaaagcagacatagaggaaataaagagtgggaggctaagcaaagaactggatttagtaagtcaccatgtgaggacaaaacttgatgaactgaaaaggcaagaagtaggaaggttaagaatgttaattaaagctaagttggattcccttcaagatataggcatggaccaccaagctcttctaaaacaatttgatcacctaaaccacctgaatcctgacaagtttgaatccacagatttagatatgctaatcaaagcggcaacaagtgatctggaacactatgacaagactcgtcatgaagaatttaaaaaatatgaaatgatgaaggaacatgaaaggagagaatatttaaaaacattgaatgaagaaaagagaaaagaagaagagtctaaatttgaagaaatgaagaaaaagcatgaaaatcaccctaaagttaatcacccaggaagcaaagatcaactaaaagaggtatgggaagagactgatggattggatcctaatgactttgaccccaagacatttttcaaattacatgatgtcaatagtgatggattcctggatgaacaagaattagaagccctatttactaaagagttggagaaagtatatgaccctaaaaatgaagaggatgatatggtagaaatggaagaagaaaggcttagaatgagggaacatgtaatgaatgagacattagatcagcaacagttcttcacagaggaagaactaaaagaatatgaaaatattattgctttacaagaaaatgaacttaagaagaaggcagatgagcttcagaaacaaaaagaagagctacaacgtcagcatgatcaactggaggctcagaagctggaatatcatcaggtcatacagcagatggaacaaaaaaaattacaacaaggaattcctccatcagggccagctggagaattgaagtttgagccacacatttaaagtctgaagtccaccagaacttggaagaaagctgttaactcaacatctatttcatctttttagctcccttcctttttctctgctcaataaatattttaaaagcatatttgaaataaagggagatactttttaa

SEQ ID NO: 428134 - DNA, 1293 bp, Homo sapiens
ggggcagagcggagcggtgggccgggggctggaggacaggtttgtgcgctggacgcaagcaccaggcgcagcctcgctcgccgacacccggccaggtaaggccggtggccgcgcgaacgtgttacgagtcagtttttagtgaaaaaacattgagctaggagccaagacccatctcttcactattttggtattgtgcaagtcatcttacctctctggatctcagttgtctcatctgtaaaaaggagataaaaattatttacctgcctgaacatgaggtggaggaccatcctgctacagtattgctttctcttgattacatgtttacttactgctcttgaagctgtgcctattgacatagacaagacaaaagtacaaaatattcaccctgtggaaagtgcgaagatagaaccaccagatactggactttattatgatgaatatctcaagcaagtgattgatgtgctggaaacagataaacacttcagagaaaagctccagaaagcagacatagaggaaataaagagtgggaggctaagcaaagaactggatttagtaagtcaccatgtgaggacaaaacttgatgaactgaaaaggcaagaagtaggaaggttaagaatgttaattaaagctaagttggattcccttcaagatataggcatggaccaccaagctcttctaaaacaatttgatcacctaaaccacctgaatcctgacaagtttgaatccacagatttagatatgctaatcaaagcggcaacaagtgatctggaacactatgacaagactcgtcatgaagaatttaaaaaatatgaaatgatgaaggaacatgaaaggagagaatatttaaaaacattgaatgaagaaaagagaaaagaagaagagtctaaatttgaagaaatgaagaaaaagcatgaaaatcaccctaaagttaatcacccaggaagcaaagatcaactaaaagaggtatgggaagagactgatggattggatcctaatgactttgaccccaagacatttttcaaattacatgatgtcaatagtgatggattcctggatgaacaagaattagaagccctatttactaaagagttggagaaagtatatgaccctaaaaatgaagaggatgatatggtagaaatggaagaagaaaggcttagaatgagggaacatgtaatgaatgagagttgggtgcccattacatagactcaaattcgtctatgcgctgcgttcatgttgccctgccggatctagcgcagggtcatcgtattgtctcggcccaatcgcatgttatct

SEQ ID NO: 428135 - DNA, 161 bp, Homo sapiens
tcatgactttaccataattactcctttatttcagatgaggtggaggaccatcctgctacagtattgctttctcttgattacatgtttacttactgctcttgaagctgtgcctattgacatagacaagacaaaagtacaaaatattcaccctgtggaaagtg

SEQ ID NO: 428136 - DNA, 1959 bp, Homo sapiens
ggggcagagcggagcggtgggccgggggctggaggacaggtttgtgcgctggacgcaagcaccaggcgcagcctcgctcgccgacacccggccagaacgtgttacgagtcagtttttagtgaaaaaacattgagctaggagccaagacccatctcttcactattttggtattgtgcaagtcatcttacctctctggatctcagttgtctcatctgtaaaaaggagataaaaattatttacctgcctgaacatgaggtggaggaccatcctgctacagtattgctttctcttgattacatgtttacttactgctcttgaagctgtgcctattgacatagacaagacaaaagtacaaaatattcaccctgtggaaagtgcgaagatagaaccaccagatactggactttattatgatgaatatctcaagcaagtgattgatgtgctggaaacagataaacacttcagagaaaagctccagaaagcagacatagaggaaataaagagtgggaggctaagcaaagaactggatttagtaagtcaccatgtgaggacaaaacttgatgaactgaaaaggcaagaagtaggaaggttaagaatgttaattaaagctaagttggattcccttcaagatataggcatggaccaccaagctcttctaaaacaatttgatcacctaaaccacctgaatcctgacaagtttgaatccacagatttagatatgctaatcaaagcggcaacaagtgatctggaacactatgacaagactcgtcatgaagaatttaaaaaatatgaaatgatgaaggaacatgaaaggagagaatatttaaaaacattgaatgaagaaaagagaaaagaagaagagtctaaatttgaagaaatgaagaaaaagcatgaaaatcaccctaaagttaatcacccaggaagcaaagatcaactaaaagaggtatgggaagagactgatggattggatcctaatgactttgaccccaagacatttttcaaattacatgatgtcaatagtgatggattcctggatgaacaagaattagaagccctatttactaaagagttggagaaagtatatgaccctaaaaatgaagaggatgatatggtagaaatggaagaagaaaggcttagaatgagggaacatgtaatgaatgaggttgatactaacaaagacagattggtgactctggaggagtttttgaaagccacagaaaaaaaagaattcttggagccagatagctgggagacattagatcagcaacagttcttcacagaggaagaactaaaagaatatgaaaatattattgctttacaagaaaatgaacttaagaagaaggcagatgagcttcagaaacaaaaagaagagctacaacgtcagcatgatcaactggaggctcagaagctggaatatcatcaggtcatacagcagatggaacaaaaaaaattacaacaaggaattcctccatcagggccagctggagaattgaagtttgagccacacatttaaagtctgaagtccaccagaacttggaagaaagctgttaactcaacatctatttcatctttttagctcccttcctttttctctgctcaataaatattttaaaagcatatttgaaataaagggagatactttttaaatgaaaacactttttttgggacacagatattaaaggattgaagtttatcagaaccaggaagaaaacaaactcactgtctgctctctgctctcacattcacacggctcttttatttatttttttgttctcctttaatgatttaattaagtggctttatgccataatttagtgaaactattaggaactatttaagtgagaaaactctgcctcttgcttttaaattagattgctctcacttactcgtaaacataggtattcttttatgggtgcttatcattccttctttcaataaatgtctgtttgatattaacaa

SEQ ID NO: 428137 - DNA, 1738 bp, Homo sapiens
ggggcagagcggagcggtgggccgggggctggaggacaggtttgtgcgctggacgcaagcaccaggcgcagcctcgctcgccgacacccggccagaacgtgttacgagtcagtttttagtgaaaaaacattgagctaggagccaagacccatctcttcactattttggtattgtgcaagtcatcttacctctctggatctcagttgtctcatctgtaaaaaggagataaaaattatttacctgcctgaacatgaggtggaggaccatcctgctacagtattgctttctcttgattacatgtttacttactgctcttgaagctgtgcctattgacatagacaagacaaaagtacaaaatattcaccctgtggaaagtgcgaagatagaaccaccagatactggactttattatgatgaatatctcaagcaagtgattgatgtgctggaaacagataaacacttcagagaaaagctccagaaagcagacatagaggaaataaagagtgggaggctaagcaaagaactggatttagtaagtcaccatgtgaggacaaaacttgatgaactgaaaaggcaagaagtaggaaggttaagaatgttaattaaagctaagttggattcccttcaagatataggcatggaccaccaagctcttctaaaacaatttgatcacctaaaccacctgaatcctgacaagtttgaatccacagatttagatatgctaatcaaagcggcaacaagtgatctggaacactatgacaagactcgtcatgaagaatttaaaaaatatgaaatgatgaaggaacatgaaaggagagaatatttaaaaacattgaatgaagaaaagagaaaagaagaagagtctaaatttgaagaaatgaagaaaaagcatgaaaatcaccctaaagttaatcacccaggaagcaaagatcaactaaaagaggtatgggaagagactgatggattggatcctaatgactttgaccccaagacatttttcaaattacatgatgtcaatagtgatggattcctggatgaacaagaattagaagccctatttactaaagagttggagaaagtatatgaccctaaaaatgaagaggatgatatggtagaaatggaagaagaaaggcttagaatgagggaacatgtaatgaatgaggttgatactaacaaagacagattggtgactctggaggagtttttgaaagccacagaaaaaaaagaattcttggagccagatagctgggagacattagatcagcaacagttcttcacagaggaagaactaaaagaatatgaaaatattattgctttacaagaaaatgaacttaagaagaaggcagatgagcttcagaaacaaaaagaagagctacaacgtcagcatgatcaactggaggctcagaagctggaatatcatcaggtcatacagcagatggaacaaaaaaaattacaacaaggaattcctccatcagggccagctggagaattgaagtttgagccacacatttaaagtctgaagtccaccagaacttggaagaaagctgttaactcaacatctatttcatctttttagctcccttcctttttctctgctcaataaatattttaaaagcatatttgaaataaagggagatactttttaagaaaatagacaatgatataagatttgatcaaccaccaagataaaagtaaagggaaggaacgaaggaactataattggtctttttggcctaaa

SEQ ID NO: 428138 - DNA, 1786 bp, Homo sapiens
ggggcagagcggagcggtgggccgggggctggaggacaggtttgtgcgctggacgcaagcaccaggcgcagcctcgctcgccgacacccggccaggtaaggccggtggccgcgcgaacgtgttacgagtcagtttttagtgaaaaaacattgagctaggagccaagacccatctcttcactattttggtattgtgcaagtcatcttacctctctggatctcagttgtctcatctgtaaaaaggagataaaaattatttacctgcctgaacatgaggtggaggaccatcctgctacagtattgctttctcttgattacatgtttacttactgctcttgaagctgtgcctattgacatagacaagacaaaagtacaaaatattcaccctgtggaaagtgcgaagatagaaccaccagatactggactttattatgatgaatatctcaagcaagtgattgatgtgctggaaacagataaacacttcagagaaaagctccagaaagcagacatagaggaaataaagagtgggaggctaagcaaagaactggatttagtaagtcaccatgtgaggacaaaacttgatgaactgaaaaggcaagaagtaggaaggttaagaatgttaattaaagctaagttggattcccttcaagatataggcatggaccaccaagctcttctaaaacaatttgatcacctaaaccacctgaatcctgacaagtttgaatccacagatttagatatgctaatcaaagcggcaacaagtgatctggaacactatgacaagactcgtcatgaagaatttaaaaaatatgaaatgatgaaggaacatgaaaggagagaatatttaaaaacattgaatgaagaaaagagaaaagaagaagagtctaaatttgaagaaatgaagaaaaagcatgaaaatcaccctaaagttaatcacccaggaagcaaagatcaactaaaagaggtatgggaagagactgatggattggatcctaatgactttgaccccaagacatttttcaaattacatgatgtcaatagtgatggattcctggatgaacaagaattagaagccctatttactaaagagttggagaaagtatatgaccctaaaaatgaagaggatgatatggtagaaatggaagaagaaaggcttagaatgagggaacatgtaatgaatgaggttgatactaacaaagacagattggtgactctggaggagtttttgaaagccacagaaaaaaaagaattcttggagccagatagctgggagacattagatcagcaacagttcttcacagaggaagaactaaaagaatatgaaaatattattgctttacaagaaaatgaacttaagaagaaggcagatgagcttcagaaacaaaaagaagagctacaacgtcagcatgatcaactggaggctcagaagctggaatatcatcaggtcatacagcagatggaacaaaaaaaattacaacaaggaattcctccatcagggccagctggagaattgaagtttgagccacacatttaaagtctgaagtccaccagaacttggaagaaagctgttaactcaacatctatttcatctttttagctcccttcctttttctctgctcaataaatatttaaaccaaaaaaaaaaaaaaaaaatttgggcgccggcccagaaagtctaaacatccttgggccggccaagagagaaagggcaagcggcccagaaccgggagaggggggctcccaaaaaggggggcgggggaaaccgggtgggctgccaacagccacag

SEQ ID NO: 428139 - DNA, 2144 bp, Homo sapiens
  misc_feature (2131)..(2131): n is a, c, g, or t
  misc_feature (2139)..(2139): n is a, c, g, or t
  misc_feature (2144)..(2144): n is a, c, g, or t
ggggcagagcggagcggtgggccgggggctggaggacaggtttgtgcgctggacgcaagcaccaggcgcagcctcgctcgccgacacccggccaggtaaggccggtggccgcgcgaacgtgttacgagtcagtttttagtgaaaaaacattgagctaggagccaagacccatctcttcactattttggtattgtgcaagtcatcttacctctctggatctcagttgtctcatctgtaaaaaggagataaaaattatttacctgcctgaacatgaggtggaggaccatcctgctacagtattgctttctcttgattacatgtttacttactgctcttgaagctgtgcctattgacatagacaagacaaaagtacaaaatattcaccctgtggaaagtgcgaagatagaaccaccagatactggactttattatgatgaatatctcaagcaagtgattgatgtgctggaaacagataaacacttcagagaaaagctccagaaagcagacatagaggaaataaagagtgggaggctaagcaaagaactggatttagtaagtcaccatgtgaggacaaaacttgatgaactgaaaaggcaagaagtaggaaggttaagaatgttaattaaagctaagttggattcccttcaagatataggcatggaccaccaagctcttctaaaacaatttgatcacctaaaccacctgaatcctgacaagtttgaatccacagatttagatatgctaatcaaagcggcaacaagtgatctggaacactatgacaagactcgtcatgaagaatttaaaaaatatgaaatgatgaaggaacatgaaaggagagaatatttaaaaacattgaatgaagaaaagagaaaagaagaagagtctaaatttgaagaaatgaagaaaaagcatgaaaatcaccctaaagttaatcacccaggaagcaaagatcaactaaaagaggtatgggaagagactgatggattggatcctaatgactttgaccccaagacatttttcaaattacatgatgtcaatagtgatggattcctggatgaacaagaattagaagccctatttactaaagagttggagaaagtatatgaccctaaaaatgaagaggatgatatggtagaaatggaagaagaaaggcttagaatgagggaacatgtaatgaatgaggttgatactaacaaagacagattggtgactctggaggagtttttgaaagccacagaaaaaaaagaattcttggagccagatagctgggagacattagatcagcaacagttcttcacagaggaagaactaaaagaatatgaaaatattattgctttacaagaaaatgaacttaagaagaaggcagatgagcttcagaaacaaaaagaagagctacaacgtcagcatgatcaactggaggctcagaagctggaatatcatcaggtcatacagcagatggaacaaaaaaaattacaacaaggaattcctccatcagggccagctggagaattgaagtttgagccacgtccagaggtgtccttctaaagctggtagaggtttcacgagtcatcagggacccagaacccttctcttttgctgtccctttgtcctagtgcatggtttccacactgtggtgcaagatgtctcctcaagctctaggcattacatctgctatcctgctgtcagaaagaaggaaggggaaaagaagatcatttccttctctttaaggacatttcccagaagtcacacagaacatttccatttatattactttggccagaacttggtcatatggccacatttagttccagaatgattaggaaatgcagtcttttattgatccctgtgcccaggaaaatattggaggcctttttcaaggaaaaaggggaaaacagatattggttgacaaatagcagtctctgccatactgtccctggatacatgtctttgagtgaatgtcccttatttaccattctgattacttgttggatattttcaatatgtgttacaatatggttccaaaattgtatgtgatattccaacagcaagttggatgcaatgtgtcataaaaatgacctcagtgtcaaccagcatttgaataccgatggtcctgcggggtaccgagctcganaacgtaancgggn

SEQ ID NO: 428140 - DNA, 1614 bp, Homo sapiens
aaggtaaaccatccaagcagtttttattcattaatattcataaatacacacagcagcttcattagagatttcaattttcctcttcagtttgaatgtggagtattaggagagccttttgcatgtcaaggtacaggaagcagagatagaggaaataaagagtgggaggctaagcaaagaactggatttagtaagtcaccatgtgaggacaaaacttgatgaactgaaaaggcaagaagtaggaaggttaagaatgttaattaaagctaagttggattcccttcaagatataggcatggaccaccaagctcttctaaaacaatttgatcacctaaaccacctgaatcctgacaagtttgaatccacagatttagatatgctaatcaaagcggcaacaagtgatctggaacactatgacaagactcgtcatgaagaatttaaaaaatatgaaatgatgaaggaacatgaaaggagagaatatttaaaaacattgaatgaagaaaagagaaaagaagaagagtctaaatttgaagaaatgaagaaaaagcatgaaaatcaccctaaagttaatcacccaggaagcaaagatcaactaaaagaggtatgggaagagactgatggattggatcctaatgactttgaccccaagacatttttcaaattacatgatgtcaatagtgatggattcctggatgaacaagaattagaagccctatttactaaagagttggagaaagtatatgaccctaaaaatgaagaggatgatatggtagaaatggaagaagaaaggcttagaatgagggaacatgtaatgaatgaggttgatactaacaaagacagattggtgactctggaggagtttttgaaagccacagaaaaaaaagaattcttggagccagatagctgggagacattagatcagcaacagttcttcacagaggaagaactaaaagaatatgaaaatattattgctttacaagaaaatgaacttaagaagaaggcagatgagcttcagaaacaaaaagaagagctacaacgtcagcatgatcaactggaggctcagaagctggaatatcatcaggtcatacagcagatggaacaaaaaaaattacaacaaggaattcctccatcagggccagctggagaattgaagtttgagccacacatttaaagtctgaagtccaccagaacttggaagaaagctgttaactcaacatctatttcatctttttagctcccttcctttttctctgctcaataaatattttaaaagcatatttgaaataaagggagatactttttaaatgaaaacactttttttgggacacagatattaaaggattgaagtttatcagaaccaggaagaaaacaaactcactgtctgctctctgctctcacattcacacggctcttttatttatttttttgttctcctttaatgatttaattaagtggctttatgccataatttagtgaaactattaggaactatttaagtgagaaaactctgcctcttgcttttaaattagattgctctcacttactcgtaaacataggtattcttttatgggtgcttatcattccttctttcaataaatgtctgtttgatattaacaa

SEQ ID NO: 428141 - DNA, 1889 bp, Homo sapiens
ggggcagagcggagcggtgggccgggggctggaggacaggtttgtgcgctggacgcaagcaccaggcgcagcctcgctcgccgacacccggccaggtaaggccggtggccgcgcgaacgtgttacgagtcagtttttagtgaaaaaacattgagctaggagccaagacccatctcttcactattttggtattgtgcaagtcatcttacctctctggatctcagttgtctcatctgtaaaaaggagataaaaattatttacctgcctgaacatgaggtggaggaccatcctgctacagtattgctttctcttgattacatgtttacttactgctcttgaagctgtgcctattgacatagacaagacaaaagtacaaaatattcaccctgtggaaagtgcgaagatagaaccaccagatactggactttattatgatgaatatctcaagcaagtgattgatgtgctggaaacagataaacacttcagagaaaagctccagaaagcagacatagaggaaataaagagtgggaggctaagcaaagaactggatttagtaagtcaccatgtgaggacaaaacttgatgaactgaaaaggcaagaagtaggaaggttaagaatgttaattaaagctaagttggattcccttcaagatataggcatggaccaccaagctcttctaaaacaatttgatcacctaaaccacctgaatcctgacaagtttgaatccacagatttagatatgctaatcaaagcggcaacaagtgatctggaacactatgacaagactcgtcatgaagaatttaaaaaatatgaaatgatgaaggaacatgaaaggagagaatatttaaaaacattgaatgaagaaaagagaaaagaagaagagtctaaatttgaagaaatgaagaaaaagcatgaaaatcaccctaaagttaatcacccaggaagcaaagatcaactaaaagaggtatgggaagagactgatggattggatcctaatgactttgaccccaagacatttttcaaattacatgatgtcaatagtgatggattcctggatgaacaagaattagaagccctatttactaaagagttggagaaagtatatgaccctaaaaatgaagaggatgatatggtagaaatggaagaagaaaggcttagaatgagggaacatgtaatgaatgagacattagatcagcaacagttcttcacagaggaagaactaaaagaatatgaaaatattattgctttacaagaaaatgaacttaagaagaaggcagatgagcttcagaaacaaaaagaagagctacaacgtcagcatgatcaactggaggctcagaagctggaatatcatcaggtcatacagcagatggaacaaaaaaaattacaacaaggaattcctccatcagggccagctggagaattgaagtttgagccacacatttaaagtctgaagtccaccagaacttggaagaaagctgttaactcaacatctatttcatctttttagctcccttcctttttctctgctcaataaatattttaaaagcatatttgaaataaagggagatactttttaaatgaaaacactttttttgggacacagatattaaaggattgaagtttatcagaaccaggaagaaaacaaactcactgtctgctctctgctctcacattcacacggctcttttatttatttttttgttctcctttaatgatttaattaagtggctttatgccataatttagtgaaactattaggaactatttaagtgagaaaactctgcctcttgcttttaaattagattgctctcacttactcgtaaacataggtattcttttatgggtgcttatcattccttctttcaataaatgtctgtttgatattaacaa

SEQ ID NO: 428142 - DNA, 1808 bp, Homo sapiens
ggggcagagcggagcggtgggccgggggctggaggacaggtttgtgcgctggacgcaagcaccaggcgcagcctcgctcgccgacacccggccaggtaaggccggtggccgcgcgaacgtgttacgagtcagtttttagtgaaaaaacattgagctaggagccaagacccatctcttcactattttggtattgtgcaagtcatcttacctctctggatctcagttgtctcatctgtaaaaaggagataaaaattatttacctgcctgaacatgaggtggaggaccatcctgctacagtattgctttctcttgattacatgtttacttactgctcttgaagctgtgcctattgacatagacaagacaaaagtacaaaatattcaccctgtggaaagtgcgaagatagaaccaccagatactggactttattatgatgaatatctcaagcaagtgattgatgtgctggaaacagataaacacttcagagaaaagctccagaaagcagacatagaggaaataaagagtgggaggctaagcaaagaactggatttagtaagtcaccatgtgaggacaaaacttgatgaactgaaaaggcaagaagtaggaaggttaagaatgttaattaaagctaagttggattcccttcaagatataggcatggaccaccaagctcttctaaaacaatttgatcacctaaaccacctgaatcctgacaagtttgaatccacagatttagatatgctaatcaaagcggcaacaagtgatctggaacactatgacaagactcgtcatgaagaatttaaaaaatatgaaatgatgaaggaacatgaaaggagagaatatttaaaaacattgaatgaagaaaagagaaaagaagaagagtctaaatttgaagaaatgaagaaaaagcatgaaaatcaccctaaagttaatcacccaggaagcaaagatcaactaaaagaggtatgggaagagactgatggattggatcctaatgactttgaccccaagacatttttcaaattacatgatgtcaatagtgatggattcctggatgaacaagaattagaagccctatttactaaagagttggagaaagtatatgaccctaaaaatgaagaggatgatatggtagaaatggaagaagaaaggcttagaatgagggaacatgtaatgaatgaggttgatactaacaaagacagattggtgactctggaggagtttttgaaagccacagaaaaaaaagaattcttggagccagatagctgggaggtcatacagcagatggaacaaaaaaaattacaacaaggaattcctccatcagggccagctggagaattgaagtttgagccacacatttaaagtctgaagtccaccagaacttggaagaaagctgttaactcaacatctatttcatctttttagctcccttcctttttctctgctcaataaatattttaaaagcatatttgaaataaagggagatactttttaaatgaaaacactttttttgggacacagatattaaaggattgaagtttatcagaaccaggaagaaaacaaactcactgtctgctctctgctctcacattcacacggctcttttatttatttttttgttctcctttaatgatttaattaagtggctttatgccataatttagtgaaactattaggaactatttaagtgagaaaactctgcctcttgcttttaaattagattgctctcacttactcgtaaacataggtattcttttatgggtgcttatcattccttctttcaataaatgtctgtttgatattaacaa

SEQ ID NO: 428143 - DNA, 1427 bp, Homo sapiens
ggggcagagcggagcggtgggccgggggctggaggacaggtttgtgcgctggacgcaagcaccaggcgcagcctcgctcgccgacacccggccaggtaaggccggtggccgcgcgaacgtgttacgagtcagtttttagtgaaaaaacattgagctaggagccaagacccatctcttcactattttggtattgtgcaagtcatcttacctctctggatctcagttgtctcatctgtaaaaaggagataaaaattatttacctgcctgaacatgaggtggaggaccatcctgctacagtattgctttctcttgattacatgtttacttactgctcttgaagctgtgcctattgacatagacaagacaaaagtacaaaatattcaccctgtggaaagtgcgaagatagaaccaccagatactggactttattatgatgaatatctcaagcaagtgattgatgtgctggaaacagataaacacttcagagaaaagctccagaaagcagacatagaggaaataaagagtgggaggctaagcaaagaactggatttagtaagtcaccatgtgaggacaaaacttgatgaactgaaaaggcaagaagtaggaaggttaagaatgttaattaaagctaagttggattcccttcaagatataggcatggaccaccaagctcttctaaaacaatttgatcacctaaaccacctgaatcctgacaagtttgaatccacagatttagatatgctaatcaaagcggcaacaagtgatctggaacactatgacaagactcgtcatgaagaatttaaaaaatatgaaatgatgaaggaacatgaaaggagagaatatttaaaaacattgaatgaagaaaagagaaaagaagaagagtctaaatttgaagaaatgaagaaaaagcatgaaaatcaccctaaagttaatcacccaggaagcaaagatcaactaaaagaggtatgggaagagactgatggattggatcctaatgactttgaccccaagacatttttcaaattacatgatgtcaatagtgatggattcctggatgaacaagaattagaagccctatttactaaagagttggacacaacgtatattgaacgcttaaaaattgacgacagatgatactgggtcagaacactggcagcaagcaaaaggttacgaaatgcgcgggacctgcgtatgaatcgacgggtggatactcaaccaaaggacaggaattgcgggaacccttggacggagacctttggaaaaggccccgagacacaaaagaagttcttggggccccaattgctggggaacactctagccgacagagagtgcttcctcaaagggaagaacctctacgacactttgacaatgtattgctgcgtatacgaaacaagagtacacaacaacaggcactggatgttctctaa

SEQ ID NO: 428144 - DNA, 3828 bp, Homo sapiens
ggactttgggactggacagacctggtcacagtctaggttctacatcttactggtcgagcaactttagagtcaacctatttgatttcttgacaagaccacaatctgatcccaaagatgtgctccacaaatccaggcaaatgggtcacctttgatgatgatcctgctgttcaatcttctcaaaagtcaaagaattttcctctggagaatcaaggtgtctgtagaccaaatggactgaagctgaaccctcctggcctcagggaatttcccagtggatcttcctccaccagcagcactcctctctcctcccccattgtagatttttatttcagtccaggacctccaagtaactctcctctttctacacctaccaaagacttcccaggttttcctggcatccccaaagcagggactcatgtgctttatcctattccagaatcatcttcagacagcccactcgcaatatcaggaggagaatcttccttactgcctaccagaccaacatgtttatcccatgccttgttacccagtgaccactcatgtacacatccaactcccaaagtaggtcttccagatgaagttaatcctcaacaggctgaaagcctaggattccaaagtgatgatctcccccagtttcagtattttcgagaggactgtgctttttcaagtccatttcggaaagatgaaggcagtgattcccatttcacccttgacccaccaggaagcaaaaagatgttctcatcaagaaacaaggagatgcctattgaccaaaaaagcctaaataagtgttcactcaactatatctgtgagaagcttgaacatctccagtcagctgagaaccaagactcacttagaagtttgtctatgcactgtctatgtgctgaagaaaatgcctcttcctttgtcccccacacactcttcaggagtcagccaaaatccggatggtctttcatgctgagaattcctgagaagaagaatatgatgtcttcccggcaatggggaccaatttttctgaaagttttgcctggaggaattttgcagatgtattatgaacagggattagaaaaaccatttaaagagatacagcttgatccatattgtaggctttctgaacccaaggttgagaacttcagtgtagcaggaaaaatccacactgtgaagattgaacatgtgtcttacacagaaaaaaggaaataccattctaagacagaagtagttcatgaacctgacatagagcagatgctgaagttggggtccacatcgtaccatgacttccttgactttctgactactgtggaggaggagctgatgaagttgccagctgtttcaaaaccaaaaaagaactacgaggagcaagaaatttccttggaaattgtggacaacttttggggtaaagtcacaaaagaaggaaaatttgttgaaagtgctgtgataactcaaatttattgcctctgctttgtgaatgggaacctggaatgctttttaaccttgaatgaccttgagttgccgaagcgagatgaatcctattatgagaaggactcagaaaaaaaggggattgatattcttgactaccattttcataagtgtgtgaatgtacaagaatttgagcaatcaagaatcattaagtttgtacctctggatgcctgccggtttgagctgatgcgtttcaagactttgtataatggggataatcttcccttttccttgaagtctgtagtggttgtccagggagcatacgtggaacttcaggcttttgtcaacatggcctcattggcgcagaggtcatcctatgctggttccttaaggtcctgtgacaatataaggatacactttcctgtcccatcgcagtggatcaaggccctttggaccatgaacctccagaggcagaagtctctgaaagctaaaatgaaccgccgagcatgtctggggagtttacaggaacttgaatctgaacctgtcattcaagtcactgtggggtcagcaaaatatgagagtgcctaccaggcagtggtatggaagatagatcggcttccagacaaaaattcaagtctagatcatccccattgtctgtcatacaaattagagcttggatcagaccaagaaattccctctgattggtatccatttgctactgttcagttttccgtgcctgacacctgtgcctcaaggacagaggtcaggtctctgggagtggagagtgatgtccagccacagaaacatgttcagcagcgagcttgctacaacatccagcctaaactctacagatctgtaattgaagatgtaattgaaggagttcggaatctatttgctgaagaaggtatagaggaacaagttttaaaagacttgaagcagctctgggaaaccaaggttttgcagtctaaagcaacagaagacttcttcagaaatagcatccaatcacctctgtttactcttcagttgccgcacagcttgcaccaaacattgcaatcgtcaacagcatcattagttattcctgctggtagaactcttccaagttttaccacagcagaactgggcacttcaaactccagtgcaaactttacttttcctggttatcccattcatgtaccagcaggtgtgacactacagactgtatctggtcacctttataaagtcaatgtaccaattatggtgacagagacttctggaagagcaggtattcttcagcatccaattcagcaagtatttcaacagcttggccagccttcagtaatacaaactagtgttccacaattgaatccatggtctcttcaagcaactactgaaaaatcacagagaattgaaaccgtgctacagcaacccgcaattctaccttctgggccagtagataggaaacacttagaaaatgccaccagtgatatacttgtatctcctggaaatgagcataaaatcgtgcctgaagctttgttgtgtcatcaggaaagttctcactatatcagtcttccaggtgttgtattttctccacaggtctctcaaacaaattctgatgtggagtcagtgctcagtggttcagctagcatggctcaaaatctgcatgatgagtccctctccacaagccctcatggggctctccaccagcacgtgactgatattcagcttcatattcttaaaaataggatgtatggatgtgattctgtaaagcaaccaagaaatatagaggaacccagcaacatacctgtatcagagaaggattctaattctcaggtggatttaagcattcgggttactgatgatgatattggtgaaataattcaagtagatggaagcggtgatacatcttccaatgaagaaataggaagtacaagagatgcagatgagaatgaatttctagggaatattgacgggggagatctgaaggtacctgaagaagaagctgacagtatttcaaatgaggattcagccacaaacagtagtgataatgaagaccctcaagtaaacattgtagaagaggaccctttaaattctggagatgatgttagtgaacaggatgtgccagacctgtttgacacggataatgtaattgtctgtcagtatgataagattcatcgaagcaagaacaaatggaaattctatttgaaagatggtgttatgtgttttggagggagagactatgtatttgcaaaagccattggtgatgcagagtggtaaaccttgtgagctcagtacatctattttgtgaacatcagttggactatattgcatattgtgaattcatttttattttgaatatagtccagcacagagctgttcaaatttttagttcactgtatggaatttaataaaattataattcagatgcagatacaattacac

SEQ ID NO: 428145 - DNA, 1673 bp, Homo sapiens
tgcccagtgtttccctccgagggcactgcgtgccgcgcaggcgcaaagggccaggtgctggaggtgctgtcatggcctgcctcaacccggtgcctaaactctacagatctgtaattgaagatgtaattgaaggagttcggaatctatttgctgaagaaggtatagaggaacaagttttaaaagacttgaagcagctctgggaaaccaaggttttgcagtctaaagcaacagaagacttcttcagaaatagcatccaatcacctctgtttactcttcagttgccgcacagcttgcaccaaacattgcaatcgtcaacagcatcattagttattcctgctggtagaactcttccaagttttaccacagcagaactgggcacttcaaactccagtgcaaactttacttttcctggttatcccattcatgtaccagcaggtgtgacactacagactgtatctggtcacctttataaagtcaatgtaccaattatggtgacagagacttctggaagagcaggtattcttcagcatccaattcagcaagtatttcaacagcttggccagccttcagtaatacaaactagtgttccacaattgaatccatggtctcttcaagcaactactgaaaaatcacagagaattgaaaccgtgctacagcaacccgcaattctaccttctgggccagtagataggaaacacttagaaaatgccaccagtgatatacttgtatctcctggaaatgagcataaaatcgtgcctgaagctttgttgtgtcatcaggaaagttctcactatatcagtcttccaggtgttgtattttctccacaggtctctcaaacaaattctgatgtggagtcagtgctcagtggttcagctagcatggctcaaaatctgcatgatgagtccctctccacaagccctcatggggctctccaccagcacgtgactgatattcagcttcatattcttaaaaataggatgtatggatgtgattctgtaaagcaaccaagaaatatagaggaacccagcaacatacctgtatcagagaaggattctaattctcaggtggatttaagcattcgggttactgatgatgatattggtgaaataattcaagtagatggaagcggtgatacatcttccaatgaagaaataggaagtacaagagatgcagatgagaatgaatttctagggaatattgacgggggagatctgaaggtacctgaagaagaagctgacagtatttcaaatgaggattcagccacaaacagtagtgataatgaagaccctcaagtaaacattgtagaagaggaccctttaaattctggagatgatgttagtgaacaggatgtgccagacctgtttgacacggataatgtaattgtctgtcagtatgataagattcatcgaagcaagaacaaatggaaattctatttgaaagatggtgttatgtgttttggagggagagactatgtatttgcaaaagccattggtgatgcagagtggtaaaccttgtgagctcagtacatctattttgtgaacatcagttggactatattgcatattgtgaattcatttttattttgaatatagtccagcacagagctgttcaaatttttagttcactgtatggaatttaataaaattataattcagatgcagatacaattacac

SEQ ID NO: 428146 - DNA, 5530 bp, Homo sapiens
ggactttgggactggacagacctggtcacagtctaggttctacatcttactggtcgagcaactttagagtcaacctatttgatttcttgacaagaccacaatctgatcccaaagatgtgctccacaaatccaggcaaatgggtcacctttgatgatgatcctgctgttcaatcttctcaaaagtcaaagaattttcctctggagaatcaaggtgtctgtagaccaaatggactgaagctgaaccctcctggcctcagggaatttcccagtggatcttcctccaccagcagcactcctctctcctcccccattgtagatttttatttcagtccaggacctccaagtaactctcctctttctacacctaccaaagacttcccaggttttcctggcatccccaaagcagggactcatgtgctttatcctattccagaatcatcttcagacagcccactcgcaatatcaggaggagaatcttccttactgcctaccagaccaacatgtttatcccatgccttgttacccagtgaccactcatgtacacatccaactcccaaagtaggtcttccagatgaagttaatcctcaacaggctgaaagcctaggattccaaagtgatgatctcccccagtttcagtattttcgagaggactgtgctttttcaagtccatttcggaaagatgaaggcagtgattcccatttcacccttgacccaccaggaagcaaaaagatgttctcatcaagaaacaaggagatgcctattgaccaaaaaagcctaaataagtgttcactcaactatatctgtgagaagcttgaacatctccagtcagctgagaaccaagactcacttagaagtttgtctatgcactgtctatgtgctgaagaaaatgcctcttcctttgtcccccacacactcttcaggagtcagccaaaatccggatggtctttcatgctgagaattcctgagaagaagaatatgatgtcttcccggcaatggggaccaatttttctgaaagttttgcctggaggaattttgcagatgtattatgaacagggattagaaaaaccatttaaagagatacagcttgatccatattgtaggctttctgaacccaaggttgagaacttcagtgtagcaggaaaaatccacactgtgaagattgaacatgtgtcttacacagaaaaaaggaaataccattctaagacagaagtagttcatgaacctgacatagagcagatgctgaagttggggtccacatcgtaccatgacttccttgactttctgactactgtggaggaggagctgatgaagttgccagctgtttcaaaaccaaaaaagaactacgaggagcaagaaatttccttggaaattgtggacaacttttggggtaaagtcacaaaagaaggaaaatttgttgaaagtgctgtgataactcaaatttattgcctctgctttgtgaatgggaacctggaatgctttttaaccttgaatgaccttgagttgccgaagcgagatgaatcctattatgagaaggactcagaaaaaaaggggattgatattcttgactaccattttcataagtgtgtgaatgtacaagaatttgagcaatcaagaatcattaagtttgtacctctggatgcctgccggtttgagctgatgcgtttcaagactttgtataatggggataatcttcccttttccttgaagtctgtagtggttgtccagggagcatacgtggaacttcaggcttttgtcaacatggcctcattggcgcagaggtcatcctatgctggttccttaaggtcctgtgacaatataaggatacactttcctgtcccatcgcagtggatcaaggccctttggaccatgaacctccagaggcagaagtctctgaaagctaaaatgaaccgccgagcatgtctggggagtttacaggaacttgaatctgaacctgtcattcaagtcactgtggggtcagcaaaatatgagagtgcctaccaggcagtggtatggaagatagatcggcttccagacaaaaattcaagtctagatcatccccattgtctgtcatacaaattagagcttggatcagaccaagaaattccctctgattggtatccatttgctactgttcagttttccgtgcctgacacctgtgcctcaaggacagaggtcaggtctctgggagtggagagtgatgtccagccacagaaacatgttcagcagcgagcttgctacaacatccaggttgaaatagaaaaaaagtggattaaaatcgatggagaagacccagataaaattggtgactgcataactcagtaggagtagcaagagtttatgatgacagcccacttgtcaaatatgtaattcaccgaaaccacaccaagtcctgctactgtagagtggaaatgacttctgaatagcggttttaggacaggtctgatggctgtgtttagagaagtttagacctaaaaccgaacaatctgtattttttgcttttcatgtgtttttgtcctaggggttcgatctaaaatgtttctataattcgtgtgatgttttgcttcctattgaaactcaaaggcactgttactcgttgtgtgaccccgcagccagtatgatttttgattactcagtggctgactgttttgctctctggattactgaggtgccgtcttcatttcttcccatctcttcttgctgcttagtgtctgtactagagggtaagggaatcaaaggagacataaaccaaaatagttaattttccctctttcttgcctctgaaatgtggctaggtgtagaatgatgttgaaaccacaggctaaaatgtagatctggaagtatctgtgcttttgaattacttatttacctgtcctcttaccgttggtaaataataattggctatatttggtacctgtctctctcctactgtattgtcattttcaaaatgtgtttgttttctggcgcgtgctgcaaagaagctatttctgttgtcctacatattttagtataaatcactaagacatatttcctttcacttggcaggattcctttcaaaatggaatctgagtattagacactagttaacatatttgtgtatattaaatatgaatttttaaaatttataaatactattttccaaaagtacagactctaaggacatattttgataaagtattatttgtaatgaacacaagcctctcttgagtagaagtctaaatcacattatgattattttatactagttctgctatcatgctgttttatgctaattctgcttattttagagtatttttcattaaaaggtgagcaaagtgaaagatacttggtattttacccagatttctaagtggcaacatttttattcttcagagtcaggtaaatgactataatagtttggtttctaatgaaaagtcaatagcattagcagttataattctgtttataatttcctttcagcatttacagtgaaaagtgagaattttaaaatttatgaaatctatattccaggtattgtttttagtctgaaaaacaaactcccccatgtggtattaatataccttcaatttatgttgagtcttaaacataattaggagatatttttctctatttgctagatttgttttgagtcaaaactgatttagtgttcttccaaacaacatttatgtgttggcctacagagtttatttcatgtgttttttttaatatttaatattatattacattcattgaaatctgttcaaaaacagattaagacaaacatttatgatggtctgtatcaatcagcagattttattgcttttcattattttactgtaaaggcaaagaatgcaataggtgatggttggttgaaaggaattgttattgctgtttttattttttactttttttgagacagagtctcactctgttgcccagcctggagtgcagtgtgtcatcttggctcactgcaacctccgcctcctgggttcaagggattctcctgcctcagcctccaactagctgggattacaggcacaagccaccatgcctggctaaaattcttttgtatttttactacagacggagtttccccatgttggccgggctagtctcgaactcctgacctcaggtgatccaccagcctcggcctcccaaagttctgggattaaatgcgtgagccaccatgcccggccgctattgctctttttaacttcatttgatgccttgcttataatatcatatgcttgaggctcactgttgatgtagagtagggcaaatctgtgtgtgtatgtcattaaaaaaattctaccatctttctttatcatctggtgtgggcgcactctacagtgacttcagtctgctcagaacgaatgtggaggccggccgaaactgatgctgcccacagtcccagtgaagttaggtgggttaattactgccattcctttctaagtgtgttttatggcatcctgcccacaaagaactcacagtctgattaggatgaacttaatgactatttacacctcaaaatatattcagcaaagggttcacttagttgcccctcatgcttcacaggttgactagtatctgtgggtacctccctgcccaggttattcactcacaagccaccgggccttcaggacatctcaagattcagtcttgacaatataatagcaaaagctggactaaagcccaaatggattgtctgtggcaatgcagaagctgatagcattaacagcagggtgttacagcataattgttaattcgcacatctattaggatccttaaatattcattacttaatgttaaattaacattctgtgtagggaggggaggcttattcaattcttctgacctcagaactggcagaaggtcagatgtgactacagaactctaggtgaaaaatcaggtagggttcaaattaagtagaactgcccttgccggaatagtgatcttcaaaaaacccttgcttttaggggagggaagcggggaaggaaaggaatgagggaggaaatattcctttctagcattcattttgcttagatcactccattgtgagtttgaccattttggagtcaaatgagcagacttccaaggagttgaccagtttgtgactagtctggtcacctttccagttacaggatcatattaactgtgtaaatgaattcatgggtagatgatttgtgcagatctgaatttaagaacatttcctttttctgtgggaatcacaagagtttatccactaaaaaaagatatgtaaaaaagatactttccagcacataaataaaggctggaattttacaacctgatgtatatattagacagttctaggatgttagttcccttcattccagagctatgcttgtgatacagccccttttcttataaagtcagttagaaggacttccttaacaatgactattataatgtcttacttaaaatacagttttgtattctgtcaatgcaaatataagacaggttgagccttaatcatgtaacaaaatattttgtagattacatattgatttttcaaaaattaaaaatgtatttcaaa

SEQ ID NO: 428147 - DNA, 5926 bp, Homo sapiens
ggactttgggactggacagacctggtcacagtctaggttctacatcttactggtcgagcaactttagagtcaacctatttgatttcttgacaagaccacaatctgatcccaaagatgtgctccacaaatccaggcaaatgggtcacctttgatgatgatcctgctgttcaatcttctcaaaagtcaaagaattttcctctggagaatcaaggtgtctgtagaccaaatggactgaagctgaaccctcctggcctcagggaatttcccagtggatcttcctccaccagcagcactcctctctcctcccccattgtagatttttatttcagtccaggacctccaagtaactctcctctttctacacctaccaaagacttcccaggttttcctggcatccccaaagcagggactcatgtgctttatcctattccagaatcatcttcagacagcccactcgcaatatcaggaggagaatcttccttactgcctaccagaccaacatgtttatcccatgccttgttacccagtgaccactcatgtacacatccaactcccaaagtaggtcttccagatgaagttaatcctcaacaggctgaaagcctaggattccaaagtgatgatctcccccagtttcagtattttcgagaggactgtgctttttcaagtccatttcggaaagatgaaggcagtgattcccatttcacccttgacccaccaggaagcaaaaagatgttctcatcaagaaacaaggagatgcctattgaccaaaaaagcctaaataagtgttcactcaactatatctgtgagaagcttgaacatctccagtcagctgagaaccaagactcacttagaagtttgtctatgcactgtctatgtgctgaagaaaatgcctcttcctttgtcccccacacactcttcaggagtcagccaaaatccggatggtctttcatgctgagaattcctgagaagaagaatatgatgtcttcccggcaatggggaccaatttttctgaaagttttgcctggaggaattttgcagatgtattatgaacagggattagaaaaaccatttaaagagatacagcttgatccatattgtaggctttctgaacccaaggttgagaacttcagtgtagcaggaaaaatccacactgtgaagattgaacatgtgtcttacacagaaaaaaggaaataccattctaagacagaagtagttcatgaacctgacatagagcagatgctgaagttggggtccacatcgtaccatgacttccttgactttctgactactgtggaggaggagctgatgaagttgccagctgtttcaaaaccaaaaaagaactacgaggagcaagaaatttccttggaaattgtggacaacttttggggtaaagtcacaaaagaaggaaaatttgttgaaagtgctgtgataactcaaatttattgcctctgctttgtgaatgggaacctggaatgctttttaaccttgaatgaccttgagttgccgaagcgagatgaatcctattatgagaaggactcagaaaaaaaggggattgatattcttgactaccattttcataagtgtgtgaatgtacaagaatttgagcaatcaagaatcattaagtttgtacctctggatgcctgccggtttgagctgatgcgtttcaagactttgtataatggggataatcttcccttttccttgaagtctgtagtggttgtccagggagcatacgtggaacttcaggcttttgtcaacatggcctcattggcgcagaggtcatcctatgctggttccttaaggtcctgtgacaatataaggatacactttcctgtcccatcgcagtggatcaaggccctttggaccatgaacctccagaggcagaagtctctgaaagctaaaatgaaccgccgagcatgtctggggagtttacaggaacttgaatctgaacctgtcattcaagtcactgtggggtcagcaaaatatgagagtgcctaccaggcagtggtatggaagatagatcggcttccagacaaaaattcaagtctagatcatccccattgtctgtcatacaaattagagcttggatcagaccaagaaattccctctgattggtatccatttgctactgttcagttttccgtgcctgacacctgtgcctcaaggacagaggtcaggtctctgggagtggagagtgatgtccagccacagaaacatgttcagcagcgagcttgctacaacatccaggttgaaatagaaaaaaagtggattaaaatcgatggagaagacccagataaaattggtgactgcataactcagtaggagtagcaagagtttatgatgacagcccacttgtcaaatatgtaattcaccgaaaccacaccaagtcctgctactgtagagtggaaatgacttctgaatagcggttttaggacaggtctgatggctgtgtttagagaagtttagacctaaaaccgaacaatctgtattttttgcttttcatgtgtttttgtcctaggggttcgatctaaaatgtttctataattcgtgtgatgttttgcttcctattgaaactcaaaggcactgttactcgttgtgtgaccccgcagccagtatgatttttgattactcagtggctgactgttttgctctctggattactgaggtgccgtcttcatttcttcccatctcttcttgctgcttagtgtctgtactagagggtaagggaatcaaaggagacataaaccaaaatagttaattttccctctttcttgcctctgaaatgtggctaggtgtagaatgatgttgaaaccacaggctaaaatgtagatctggaagtatctgtgcttttgaattacttatttacctgtcctcttaccgttggtaaataataattggctatatttggtacctgtctctctcctactgtattgtcattttcaaaatgtgtttgttttctggcgcgtgctgcaaagaagctatttctgttgtcctacatattttagtataaatcactaagacatatttcctttcacttggcaggattcctttcaaaatggaatctgagtattagacactagttaacatatttgtgtatattaaatatgaatttttaaaatttataaatactattttccaaaagtacagactctaaggacatattttgataaagtattatttgtaatgaacacaagcctctcttgagtagaagtctaaatcacattatgattattttatactagttctgctatcatgctgttttatgctaattctgcttattttagagtatttttcattaaaaggtgagcaaagtgaaagatacttggtattttacccagatttctaagtggcaacatttttattcttcagagtcaggtaaatgactataatagtttggtttctaatgaaaagtcaatagcattagcagttataattctgtttataatttcctttcagcatttacagtgaaaagtgagaattttaaaatttatgaaatctatattccaggtattgtttttagtctgaaaaacaaactcccccatgtggtattaatataccttcaatttatgttgagtcttaaacataattaggagatatttttctctatttgctagatttgttttgagtcaaaactgatttagtgttcttccaaacaacatttatgtgttggcctacagagtttatttcatgtgttttttttaatatttaatattatattacattcattgaaatctgttcaaaaacagattaagacaaacatttatgatggtctgtatcaatcagcagattttattgcttttcattattttactgtaaaggcaaagaatgcaataggtgatggttggttgaaaggaattgttattgctgtttttattttttactttttttgagacagagtctcactctgttgcccagcctggagtgcagtgtgtcatcttggctcactgcaacctccgcctcctgggttcaagggattctcctgcctcagcctccaactagctgggattacaggcacaagccaccatgcctggctaaaattcttttgtatttttactacagacggagtttccccatgttggccgggctagtctcgaactcctgacctcaggtgatccaccagcctcggcctcccaaagttctgggattaaatgcgtgagccaccatgcccggccgctattgctctttttaacttcatttgatgccttgcttataatatcatatgcttgaggctcactgttgatgtagagtagggcaaatctgtgtgtgtatgtcattaaaaaaattctaccatctttctttatcatctggtgtgggcgcactctacagtgacttcagtctgctcagaacgaatgtggaggccggccgaaactgatgctgcccacagtcccagtgaagttaggtgggttaattactgccattcctttctaagtgtgttttatggcatcctgcccacaaagaactcacagtctgattaggatgaacttaatgactatttacacctcaaaatatattcagcaaagggttcacttagttgcccctcatgcttcacaggttgactagtatctgtgggtacctccctgcccaggttattcactcacaagccaccgggccttcaggacatctcaagattcagtcttgacaatataatagcaaaagctggactaaagcccaaatggattgtctgtggcaatgcagaagctgatagcattaacagcagggtgttacagcataattgttaattcgcacatctattaggatccttaaatattcattacttaatgttaaattaacattctgtgtagggaggggaggcttattcaattcttctgacctcagaactggcagaaggtcagatgtgactacagaactctaggtgaaaaatcaggtagggttcaaattaagtagaactgcccttgccggaatagtgatcttcaaaaaacccttgcttttaggggagggaagcggggaaggaaaggaatgagggaggaaatattcctttctagcattcattttgcttagatcactccattgtgagtttgaccattttggagtcaaatgagcagacttccaaggagttgaccagtttgtgactagtctggtcacctttccagttacaggatcatattaactgtgtaaatgaattcatgggtagatgatttgtgcagatctgaatttaagaacatttcctttttctgtgggaatcacaagagtttatccactaaaaaaagatatgtaaaaaagatactttccagcacataaataaaggctggaattttacaacctgatgtatatattagacagttctaggatgttagttcccttcattccagagctatgcttgtgatacagccccttttcttataaagtcagttagaaggacttccttaacaatgactattataatgtcttacttaaaatacagttttgtattctgtcaatgcaaatataagacaggttgagccttaatcatgtaacaaaatattttgtagattacatattgatttttcaaaaattaaaaatgtatttcaaagtattcttactgtgctgtgaatttatatcttcttctgcaagacctggggctatttttttttcttaaggtatgaaatcaatttcaataaccttaaacaattgaccctctgtcaggcatatgtcaggctccactcttaaggagtcagtgaccatgacctctttgcatatcctggaaaaatgacatcatcaaagtatagttgataatgttataaaggatgattttaaaaatagggtataatcatgactcacaaagatatgaggctgggtgtggtggctcacgcctgtaatcccagctctttgggaggccgaagcgggtggatcatgaggtcagaagatcaagaccatactggctagcacggtggagccccgtctctactaaaaatacaaaaaaaaaaaa

SEQ ID NO: 428148 - DNA, 4500 bp, Homo sapiens
ggactttgggactggacagacctggtcacagtctaggttctacatcttactggtcgagcaactttagagtcaacctatttgatttcttgacaagaccacaatctgatcccaaagatgtgctccacaaatccaggcaaatgggtcacctttgatgatgatcctgctgttcaatcttctcaaaagtcaaagaattttcctctggagaatcaaggtgtctgtagaccaaatggactgaagctgaaccctcctggcctcagggaatttcccagtggatcttcctccaccagcagcactcctctctcctcccccattgtagatttttatttcagtccaggacctccaagtaactctcctctttctacacctaccaaagacttcccaggttttcctggcatccccaaagcagggactcatgtgctttatcctattccagaatcatcttcagacagcccactcgcaatatcaggaggagaatcttccttactgcctaccagaccaacatgtttatcccatgccttgttacccagtgaccactcatgtacacatccaactcccaaagtaggtcttccagatgaagttaatcctcaacaggctgaaagcctaggattccaaagtgatgatctcccccagtttcagtattttcgagaggactgtgctttttcaagtccatttcggaaagatgaaggcagtgattcccatttcacccttgacccaccaggaagcaaaaagatgttctcatcaagaaacaaggagatgcctattgaccaaaaaagcctaaataagtgttcactcaactatatctgtgagaagcttgaacatctccagtcagctgagaaccaagactcacttagaagtttgtctatgcactgtctatgtgctgaagaaaatgcctcttcctttgtcccccacacactcttcaggagtcagccaaaatccggatggtctttcatgctgagaattcctgagaagaagaatatgatgtcttcccggcaatggggaccaatttttctgaaagttttgcctggaggaattttgcagatgtattatgaacagggattagaaaaaccatttaaagagatacagcttgatccatattgtaggctttctgaacccaaggttgagaacttcagtgtagcaggaaaaatccacactgtgaagattgaacatgtgtcttacacagaaaaaaggaaataccattctaagacagaagtagttcatgaacctgacatagagcagatgctgaagttggggtccacatcgtaccatgacttccttgactttctgactactgtggaggaggagctgatgaagttgccagctgtttcaaaaccaaaaaagaactacgaggagcaagaaatttccttggaaattgtggacaacttttggggtaaagtcacaaaagaaggaaaatttgttgaaagtgctgtgataactcaaatttattgcctctgctttgtgaatgggaacctggaatgctttttaaccttgaatgaccttgagttgccgaagcgagatgaatcctattatgagaaggactcagaaaaaaaggggattgatattcttgactaccattttcataagtgtgtgaatgtacaagaatttgagcaatcaagaatcattaagtttgtacctctggatgcctgccggtttgagctgatgcgtttcaagactttgtataatggggataatcttcccttttccttgaagtctgtagtggttgtccagggagcatacgtggaacttcaggcttttgtcaacatggcctcattggcgcagaggtcatcctatgctggttccttaaggtcctgtgacaatataaggatacactttcctgtcccatcgcagtggatcaaggccctttggaccatgaacctccagaggcagaagtctctgaaagctaaaatgaaccgccgagcatgtctggggagtttacaggaacttgaatctgaacctgtcattcaagtcactgtggggtcagcaaaatatgagagtgcctaccaggcagtggtatggaagatagatcggcttccagacaaaaattcaagtctagatcatccccattgtctgtcatacaaattagagcttggatcagaccaagaaattccctctgattggtatccatttgctactgttcagttttccgtgcctgacacctgtgcctcaaggacagaggtcaggtctctgggagtggagagtgatgtccagccacagaaacatgttcagcagcgagcttgctacaacatccaggttgaaatagaaaaaaagtggattaaaatcgatggagaagacccagataaaattggtgactgcataactcagtaggagtagcaagagtttatgatgacagcccacttgtcaaatatgtaattcaccgaaaccacaccaagtcctgctactgtagagtggaaatgacttctgaatagcggttttaggacaggtctgatggctgtgtttagagaagtttagacctaaaaccgaacaatctgtattttttgcttttcatgtgtttttgtcctaggggttcgatctaaaatgtttctataattcgtgtgatgttttgcttcctattgaaactcaaaggcactgttactcgttgtgtgaccccgcagccagtatgatttttgattactcagtggctgactgttttgctctctggattactgaggtgccgtcttcatttcttcccatctcttcttgctgcttagtgtctgtactagagggtaagggaatcaaaggagacataaaccaaaatagttaattttccctctttcttgcctctgaaatgtggctaggtgtagaatgatgttgaaaccacaggctaaaatgtagatctggaagtatctgtgcttttgaattacttatttacctgtcctcttaccgttggtaaataataattggctatatttggtacctgtctctctcctactgtattgtcattttcaaaatgtgtttgttttctggcgcgtgctgcaaagaagctatttctgttgtcctacatattttagtataaatcactaagacatatttcctttcacttggcaggattcctttcaaaatggaatctgagtattagacactagttaacatatttgtgtatattaaatatgaatttttaaaatttataaatactattttccaaaagtacagactctaaggacatattttgataaagtattatttgtaatgaacacaagcctctcttgagtagaagtctaaatcacattatgattattttatactagttctgctatcatgctgttttatgctaattctgcttattttagagtatttttcattaaaaggtgagcaaagtgaaagatacttggtattttacccagatttctaagtggcaacatttttattcttcagagtcaggtaaatgactataatagtttggtttctaatgaaaagtcaatagcattagcagttataattctgtttataatttcctttcagcatttacagtgaaaagtgagaattttaaaatttatgaaatctatattccaggtattgtttttagtctgaaaaacaaactcccccatgtggtattaatataccttcaatttatgttgagtcttaaacataattaggagatatttttctctatttgctagatttgttttgagtcaaaactgatttagtgttcttccaaacaacatttatgtgttggcctacagagtttatttcatgtgttttttttaatatttaatattatattacattcattgaaatctgttcaaaaacagattaagacaaacatttatgatggtctgtatcaatcagcagattttattgcttttcattattttactgtaaaggcaaagaatgcaataggtgatggttggttgaaaggaattgttattgctgtttttattttttactttttttgagacagagtctcactctgttgcccagcctggagtgcagtgtgtcatcttggctcactgcaacctccgcctcctgggttcaagggattctcctgcctcagcctccaactagctgggattacaggcacaagccaccatgcctggctaaaattcttttgtatttttactacagacggagtttccccatgttggccgggctagtctcgaactcctgacctcaggtgatccaccagcctcggcctcccaaagttctgggattaaatgcgtgagccaccatgcccggccgctattgctctttttaacttcatttgatgccttgcttataatatcatatgcttgaggctcactgttgatgtagagtagggcaaatctgtgtgtgtatgtcattaaaaaaattctaccatctttctttatcatctggtgtgggcgcactctacagtgacttcagtctgctcagaacgaatgtggaggccggccgaaactgatgctgcccacagtcccagtgaagttaggtgggttaattactgccattaaaggagctgtggcatgaacatggctcacagcaacctccacctccagggttcaagtgattttcctgccattaaaggagctg

SEQ ID NO: 428149 - DNA, 1661 bp, Homo sapiens
tgcccagtgtttccctccgagggcactgcgtgccgcgcaggcgcaaagggccaggtgctggaggtgctgtcatggcctgcctcaacccggtgcctaaactctacagatctgtaattgaagatgtaattgaaggagttcggaatctatttgctgaagaaggtatagaggaacaagttttaaaagacttgaagcagctctgggaaaccaaggttttgcagtctaaagcaacagaagacttcttcagaaatagcatccaatcacctctgtttactcttcagttgccgcacagcttgcaccaaacattgcaatcgtcaacagcatcattagttattcctgctggtagaactcttccaagttttaccacagcagaactgggcacttcaaactccagtgcaaactttacttttcctggttatcccattcatgtaccagcaggtgtgacactacagactgtatctggtcacctttataaagtcaatgtaccaattatggtgacagagacttctggaagagcaggtattcttcagcatccaattcagcaagtatttcaacagcttggccagccttcagtaatacaaactagtgttccacaattgaatccatggtctcttcaagcaactactgaaaaatcacagagaattgaaaccgtgctacagcaacccgcaattctaccttctgggccagtagataggaaacacttagaaaatgccaccagtgatatacttgtatctcctggaaatgagcataaaatcgtgcctgaagctttgttgtgtcatcaggaaagttctcactatatcagtcttccaggtgttgtattttctccacaggtctctcaaacaaattctgatgtggagtcagtgctcagtggttcagctagcatggctcaaaatctgcatgatgagtccctctccacaagccctcatggggctctccaccagcacgtgactgatattcagcttcatattcttaaaaataggatgtatggatgtgattctgtaaagcaaccaagaaatatagaggaacccagcaacatacctgtatcagagaaggattctaattctcaggtggatttaagcattcgggttactgatgatgatattggtgaaataattcaagtagatggaagcggtgatacatcttccaatgaagaaataggaagtacaagagatgcagatgagaatgaatttctagggaatattgacgggggagatctgaaggtacctgaagaagaagctgacagtatttcaaatgaggattcagccacaaacagtagtgataatgaagaccctcaagtaaacattgtagaagaggaccctttaaattctggagatgatgttagtgaacaggatgtgccagacctgtttgacacggataatgtaattgtctgtcagtatgataaggcattcccaagaaggacatcgtttaacacctaaactcatttaacaaaggatccgagaagaacagggacagtgtgggaagaaatcttcttgtgatggcatatttgcttcctatatttcttctggaatcatgttcgcttggcttcctgattaaaaacacagttttattgctctctgcactgccaaaccaataaatttacagaagagaaagctgtattccactgtaccccttgcagcatcaataaaactgacagccaaaaaaaa

SEQ ID NO: 428150 - DNA, 503 bp, Homo sapiens
ggactttgggactggacagacctggtcacagtctaggttctacatcttactggtcgagcaactttagagtcaacctatttgatttcttgacaagaccacaatctgatcccaaagatgtgctccacaaatccaggcaaatgggtcacctttgatgatgatcctgctgttcaatcttctcaaaagtcaaagaattttcctctggagaatcaaggtgtctgtagaccaaatggactgaagctgaaccctcctggcctcagggaatttcccagtggatcttcctccaccagcagcactcctctctcctcccccattgtagatttttatttcagtccaggacctccaagtaactctcctctttctacacctaccaaagacttcccaggttttcctggcatccccaaagcagggactcatgtgctttatcctattccagaatcatcttcagacagcaccagcacaccagcaccagcacgaattcccttagcaccagcacgaattccatt

SEQ ID NO: 428151 - DNA, 1955 bp, Homo sapiens
attcccgtttggctgagcactctaggcctacatccatgaagctaggagagcgacactcaaagactgcactattgagagaagctaacgttaaaggcagtgaatatattcgggagtccagctccggaacccgggagctcttttagtgggaggggcggcgctgatggcgcttctggcctccgaatgctagggggcgctgtgatcgccgggcggcctcttgggcgctgggagtccaccgcgcaagcgcatcctggcctttcttcagtccccacgtgcgatccttcccggcaactttttcgagaaaaatgcccaaattcaaggcggcccgtggggtggggggtcaggaaaaacatgcgcccctggccgatcagatcctggctgggaatgcggtgcgggcgggggtccgggagaagcggcggggtcgcgggacaggagaagcggaggaagagtatgtggggccccggctgagccgacggattttgcagcaagcacggcagcaacaggaggaactcgaggccgagcatgggactggggacaagcccgcggcgccgcgggaacgcaccacgcggctgggtccaagaatgcctcaggatggatcagatgacgaggacgaggagtggcccaccctggagaaggctgccacaatgacagcagcgggccatcatgcagaggtggttgtggaccctgaggatgagcgtgccatagagatgttcatgaacaagaaccctcctgccaggcgcaccctggctgacatcatcatggagaagctgactgagaagcagacagaggttgagacagtcatgtcagaggtgtcgggcttccctatgccccagctggacccccgggtcctagaagtgtacaggggggtccgggaggtattatctaagtaccgcagtggaaaactgcccaaggcatttaagatcatccctgcactctccaactgggagcaaatcctctacgtcacagagccggaggcctggactgcagctgccatgtaccaggccaccaggatttttgcctctaacctgaaggaacgcatggcccagcgcttctacaaccttgtcctgctccctcgagtacgagatgacgttgctgaatacaaacgactcaacttccatctctacatggctctcaagaaggcccttttcaaacctggagcctggttcaaagggatcctgattccactgtgcgagtctggcacttgtaccctccgggaagccatcattgtgggtagcatcatcaccaagtgctccatccctgtgttgcactccagtgcggccatgctgaaaattgctgagatggaatacagcggtgccaacagcatcttcctgcgactgctgctggataagaagtatgcactgccttaccgggtgctggatgccctagtcttccacttcctggggttccggacagagaagcgtgaactgcctgtgctgtggcaccagtgcctcctgactttggtccagcgctacaaggccgacttggccacagaccagaaagaggccctcttagaactgctccggctgcagccccatccacagctatcgcccgaaatcaggcgtgagcttcagagtgcagtcccccgcgatgtggaagatgttcccatcaccgtggagtgaggaaaacagtcagctgtcctggccaaaggggtttggaaggacaccaagacccccgttggtgactgaagatgacactgagctttaatggctgaagacccagatcagggcagtgacagatcacagggacatctgtggctcccagtccaggacaggaaggactgagggtctggctggttccctcttccattctaggcccttatccctgtttagttctgagagccaacttgagataccatatgctagcattcccagtccccagctggggcttggtgtgagtactttttctatggctattgtgtcaggtcactgtggataaaggcaaagacagatatttattga

SEQ ID NO: 428152 - DNA, 829 bp, Homo sapiens
tggcatgatctcggctcgctgcaacctccgcctccatggttcaagagattctcctgcctcagcctcctgagtagctgggactacaggtgcgtgccaccacgcctggctaatttttgtatttttagtagagacggggtggagaaggggtttcaccaggttggccaggctggtctcaaactcctgacctcaggtgatccacccgcctcggcctcccaaagtgctgggattacaggcatgagccactgcacccagcccaagtgcccatttttgtgtggcccatgagctaagaatgatttttccatttttaaatggggaaaaaattaaaacagtattttgtgataggtaggaattacatgaaattccagtttcagcatccataaatagttttgttggaacagccatgctcacccatttacatgttttctgtggctggttttgtgctacaacagcagagtttaagtataatcctgctataacccttgttatttgctttcgaaattgcgcatttgttccaacccatttaatatatttgggaacagtttgatcataacgcagacttcatgtttgcttgtgtgtgatttcatcctcgagaaatagtaggtgaatatgggaaactgtatctagctgaaccaagcctaagtagtacacaaaactcacacctaaacatgtaccagctacctcactcatctccccacctgtgttgagcaacccttccgacgtccacttccaaaagcaaagtgcatgtcttcaagataaaaggccatatttattgtgatataatttctcaaccatttgacatatgtaaaaaccaagctatccttttttttta

SEQ ID NO: 428153 - DNA, 2866 bp, Homo sapiens
attcccgtttggctgagcactctaggcctacatccatgaagctaggagagcgacactcaaagactgcactattgagagaagctaacgttaaaggcagtgaatatattcgggagtccagctccggaacccgggagctcttttagtgggaggggcggcgctgatggcgcttctggcctccgaatgctagggggcgctgtgatcgccgggcggcctcttgggcgctgggagtccaccgcgcaagcgcatcctggcctttcttcagtccccacgtgcgatccttcccggcaactttttcgagaaaaatgcccaaattcaaggcggcccgtggggtggggggtcaggaaaaacatgcgcccctggccgatcagatcctggctgggaatgcggtgcgggcgggggtccgggagaagcggcggggtcgcgggacaggagaagcggaggaagagtatgtggggccccggctgagccgacggattttgcagcaagcacggcagcaacaggaggaactcgaggccgagcatgggactggggacaagcccgcggcgccgcgggaacgcaccacgcggctgggtccaagaatgcctcaggatggatcagatgacgaggacgaggagtggcccaccctggagaaggctgccacaatgacagcagcgggccatcatgcagaggtggttgtggaccctgaggatgagcgtgccatagagatgttcatgaacaagaaccctcctgccaggcgcaccctggctgacatcatcatggagaagctgactgagaagcagacagaggttgagacagtcatgtcagaggtgtcgggcttccctatgccccagctggacccccgggtcctagaagtgtacaggggggtccgggaggtattatctaagtaccgcagtggaaaactgcccaaggcatttaagatcatccctgcactctccaactgggagcaaatcctctacgtcacagagccggaggcctggactgcagctgccatgtaccaggccaccaggatttttgcctctaacctgaaggaacgcatggcccagcgcttctacaaccttgtcctgctccctcgagtacgagatgacgttgctgaatacaaacgactcaacttccatctctacatggctctcaagaaggcccttttcaaacctggagcctggttcaaagggatcctgattccactgtgcgagtctggcacttgtaccctccgggaagccatcattgtgggtagcatcatcaccaagtgctccatccctgtgttgcactccagtgcggccatgctgaaaattgctgagatggaatacagcggtgccaacagcatcttcctgcgactgctgctggataagaagtatgcactgccttaccgggtgctggatgccctagtcttccacttcctggggttccggacagagaagcgtgaactgcctgtgctgtggcaccagtgcctcctgactttggtccagcgctacaaggccgacttggccacagaccagaaagaggccctcttagaactgctccggctgcagccccatccacagctatcgcccgaaatcaggcgtgagcttcagagtgcagtcccccgcgatgtggaagatgttcccatcaccgtggagtgaggaaaacagtcagctgtcctggccaaaggggtttggaaggacaccaagacccccgttggtgactgaagatgacactgagctttaatggctgaagacccagatcagggcagtgacagatcacagggacatctgtggctcccagtccaggacaggaaggactgagggtctggctggttccctcttccattctaggcccttatccctgtttagttctgagagccaacttgagataccatatgctagcattcccagtccccagctggggcttggtgtgagtactttttctatggctattgtgtcaggtcactgtggataaaggcaaagacagatatttattgaacctctgtgtttggtgtagtcaatggaggtaggcattactcctgttagtatttggaggacggaggacattcttgtcctgtttatataggacccacctcccttgatctccaagcttgtttctccaggctgcactcaccttgttagcccccaggggacacatcctctgccttcccccatcacaggctacagcagccaggagcaggttgtccaaagatggtcgtgtctcagcagtggatgaaaggactacaagagaaaactccttggggaaagcagagataagagtcaagaaaggccagagagggctgggattacaggcatgagccactgcacccagcccaagtgcccatttttgtgtggcccatgagctaagaatgatttttccatttttaaatggggaaaaaattaaaacagtattttgtgataggtaggaattacatgaaattccagtttcagcatccataaatagttttgttggaacagccatgctcacccatttacatgttttctgtggctggttttgtgctacaacagcagagtttaagtataatcctgctataacccttgttatttgctttcgaaattgcgcatttgttccaacccatttaatatatttgggaacagtttgatcataacgcagacttcatgtttgcttgtgtgtgatttcatcctcgagaaatagtaggtgaatatgggaaactgtatctagctgaaccaagcctaagtagtacacaaaactcacacctaaacatgtaccagctacctcactcatctccccacctgtgttgagcaacccttccgacgtccacttccaaaagcaaagtgcatgtcttcaagataaaaggccatatttattgtgatataatttctcaaccatttgacatatgtaaaaaccaagctatccttttttttta

SEQ ID NO: 428154 - DNA, 2778 bp, Homo sapiens
attcccgtttggctgagcactctaggcctacatccatgaagctaggagagcgacactcaaagactgcactattgagagaagctaacgttaaaggcagtgaatatattcgggagtccagctccggaacccgggagctcttttagtgggaggggcggcgctgatggcgcttctggcctccgaatgctagggggcgctgtgatcgccgggcggcctcttgggcgctgggagtccaccgcgcaagcgcatcctggcctttcttcagtccccacgtgcgatccttcccggcaactttttcgagaaaaatgcccaaattcaaggcggcccgtggggtggggggtcaggaaaaacatgcgcccctggccgatcagatcctggctgggaatgcggtgcgggcgggggtccgggagaagcggcggggtcgcgggacaggagaagcggaggaagagtatgtggggccccggctgagccgacggattttgcagcaagcacggcagcaacaggaggaactcgaggccgagcatgggactggggacaagcccgcggcgccgcgggaacgcaccacgcggctgggtccaagaatgcctcaggatggatcagatgacgaggacgaggagtggcccaccctggagaaggctgccacaatgacagcagcgggccatcatgcagaggtggttgtggaccctgaggatgagcgtgccatagagatgttcatgaacaagaaccctcctgccaggcgcaccctggctgacatcatcatggagaagctgactgagaagcagacagaggttgagacagtcatgtcagaggtgtcgggcttccctatgccccagctggacccccgggtcctagaagtgtacaggggggtccgggaggtattatctaagtaccgcagtggaaaactgcccaaggcatttaagatcatccctgcactctccaactgggagcaaatcctctacgtcacagagccggaggcctggactgcagctgccatgtaccaggccaccaggatttttgcctctaacctgaaggaacgcatggcccagcgcttctacaaccttgtcctgctccctcgagtacgagatgacgttgctgaatacaaacgactcaacttccatctctacatggctctcaagaaggcccttttcaaacctggagcctggttcaaagggatcctgattccactgtgcgagtctggcacttgtaccctccgggaagccatcattgtgggtagcatcatcaccaagtgctccatccctgtgttgcactccagtgcggccatgctgaaaattgctgagatggaatacagcggtgccaacagcatcttcctgcgactgctgctggataagaagtatgcactgccttaccgggtgctggatgccctagtcttccacttcctggggttccggacagagaagcgtgaactgcctgtgctgtggcaccagtgcctcctgactttggtccagcgctacaaggccgacttggccacagaccagaaagaggccctcttagaactgctccggctgcagccccatccacagctatcgcccgaaatcaggcgtgagcttcagagtgcagtcccccgcgatgtggaagatgttcccatcaccgtggagtgaggaaaacagtcagctgtcctggccaaaggggtttggaaggacaccaagacccccgttggtgactgaagatgacactgagctttaatggctgaagacccagatcagggcagtgacagatcacagggacatctgtggctcccagtccaggacaggaaggactgagggtctggctggttccctcttccattctaggcccttatccctgtttagttctgagagccaacttgagataccatatgctagcattcccagtccccagctggggcttggtgtgagtactttttctatggctattgtgtcaggtcactgtggataaaggcaaagacagatatttattgaacctctgtgtttggtgtagtcaatggaggtaggcattactcctgttagtatttggaggacggaggacattcttgtcctgtttatataggacccacctcccttgatctccaagcttgtttctccaggctgcactcaccttgttagcccccaggggacacatcctctgccttcccccatcacaggctacagcagccaggagcaggttgtccaaaggctgggattacaggcatgagccactgcacccagcccaagtgcccatttttgtgtggcccatgagctaagaatgatttttccatttttaaatggggaaaaaattaaaacagtattttgtgataggtaggaattacatgaaattccagtttcagcatccataaatagttttgttggaacagccatgctcacccatttacatgttttctgtggctggttttgtgctacaacagcagagtttaagtataatcctgctataacccttgttatttgctttcgaaattgcgcatttgttccaacccatttaatatatttgggaacagtttgatcataacgcagacttcatgtttgcttgtgtgtgatttcatcctcgagaaatagtaggtgaatatgggaaactgtatctagctgaaccaagcctaagtagtacacaaaactcacacctaaacatgtaccagctacctcactcatctccccacctgtgttgagcaacccttccgacgtccacttccaaaagcaaagtgcatgtcttcaagataaaaggccatatttattgtgatataatttctcaaccatttgacatatgtaaaaaccaagctatccttttttttta

SEQ ID NO: 428155 - DNA, 1927 bp, Homo sapiens
attcccgtttggctgagcactctaggcctacatccatgaagctaggagagcgacactcaaagactgcactattgagagaagctaacgttaaaggcagtgaatatattcgggagtccagctccggaacccgggagctcttttagtgggaggggcggcgctgatggcgcttctggcctccgaatgctagggggcgctgtgatcgccgggcggcctcttgggcgctgggagtccaccgcgcaagcgcatcctggcctttcttcagtccccacgtgcgatccttcccggcaactttttcgagaaaaatgcccaaattcaaggcggcccgtggggtggggggtcaggaaaaacatgcgcccctggccgatcagatcctggctgggaatgcggtgcgggcgggggtccgggagaagcggcggggtcgcgggacaggagaagcggaggaagagtatgtggggccccggctgagccgacggattttgcagcaagcacggcagcaacaggaggaactcgaggccgagcatgggactggggacaagcccgcggcgccgcgggaacgcaccacgcggctgggtccaagaatgcctcaggatggatcagatgacgaggacgaggagtggcccaccctggagaaggctgccacaatgacagcagcgggccatcatgcagaggtggttgtggaccctgaggatgagcgtgccatagagatgttcatgaacaagaaccctcctgccaggcgcaccctggctgacatcatcatggagaagctgactgagaagcagacagaggttgagacagtcatgtcagaggtgtcgggcttccctatgccccagctggacccccgggtcctagaagtgtacaggggggtccgggaggtattatctaagtaccgcagtggaaaactgcccaaggcatttaagatcatccctgcactctccaactgggagcaaatcctctacgtcacagagccggaggcctggactgcagctgccatgtaccaggccaccaggatttttgcctctaacctgaaggaacgcatggcccagcgcttctacaaccttgtcctgctccctcgagtacgagatgacgttgctgaatacaaacgactcaacttccatctctacatggctctcaagaaggcccttttcaaacctggagcctggttcaaagggatcctgattccactgtgcgagtctggcacttgtaccctccgggaagccatcattgtgggtagcatcatcaccaagtgctccatccctgtgttgcactccagtgcggccatgctgaaaattgctgagatggaatacagcggtgccaacagcatcttcctgcgactgctgctggataagaagtatgcactgccttaccgggtgctggatgccctagtcttccacttcctggggttccggacagagaagcgtgaactgcctgtgctgtggcaccagtgcctcctgactttggtccagcgctacaaggccgacttggccacagaccagaaagaggccctcttagaactgctccggctgcagccccatccacagctatcgcccgaaatcaggcgtgagcttcagagtgcagtcccccgcgatgtggaagatgttcccatcaccgtggagtgaggaaaacagtcagctgtcctggccaaaggggtttggaaggacaccaagacccccgttggtgactgaagatgacactgagctttaatggctgaagacccagatcagggcagtgacagatcacagggacatctgtggctcccagtccaggacaggaaggactgagggtctggctggttccctcttccattctaggcccttatccacagtgacctgacacaatagccatagaaaaagtactcacaccaagccccagctggggactgggaatgctagcatatggtatctcaagttggcctcgtgccgctcgtgcc

SEQ ID NO: 428156 - DNA, 384 bp, Homo sapiens
tatcgcccgaaatcaggcgtgagcttcagagtgcagtcccccgcgatgtggaagatgttcccatcaccgtggagtgaggaaaacagtcagctgtcctggccaaaggggtttggaaggacaccaagacccccgttggtgactgaagatgacactgagctttaatggctgaagacccagatcagggcagtgacagatcacagggacatctgtggctcccagtccaggacaggaaggactgagggtctggctggttccctcttccattctaggcccttatccctgtttagttctgagagccaacttgagataccatatgctagcattcccagtccccagctggggcttggtgtgagtactttttctatggctattgtgtcaggtcac

SEQ ID NO: 428157 - DNA, 422 bp, Homo sapiens
gccccgaggtttctaaatccagacattcccgtttggctgagcactctaggcctacatccatgaagctaggagagcgacactcaaagactgcactattgagagaagctaacgttaaaggcagtgaatatattcgggagtccagctccggaacccgggagctcttttagtgggaggggcggcgctgatggcgcttctggcctccgaatgctagggggcgctgtgatcgccgggcggcctcttgggcgctgggagtccaccgcgcaagcgcatcctggcctttcttcagtccccacgtgcgatccttcccggcaactttttcgagaaaaatgcccaaattcaaggcggcccgtggggtggggggtcaggaaaaacatgcgcccctggccgatcagatcctggctgggaatgcggtgcgggcgggg

SEQ ID NO: 428158 - DNA, 2710 bp, Homo sapiens
attcccgtttggctgagcactctaggcctacatccatgaagctaggagagcgacactcaaagactgcactattgagagaagctaacgttaaaggcagtgaatatattcgggagtccagctccggaacccgggagctcttttagtgggaggggcggcgctgatggcgcttctggcctccgaatgctagggggcgctgtgatcgccgggcggcctcttgggcgctgggagtccaccgcgcaagcgcatcctggcctttcttcagtccccacgtgcgatccttcccggcaactttttcgagaaaaatgcccaaattcaaggcggcccgtggggtggggggtcaggaaaaacatgcgcccctggccgatcagatcctggctgggaatgcggtgcgggcgggggtccgggagaagcggcggggtcgcgggacaggagaagcggaggaagagtatgtggggccccggctgagccgacggattttgcagcaagcacggcagcaacaggaggaactcgaggccgagcatgggactggggacaagcccgcggcgccgcgggaacgcaccacgcggctgggtccaagaatgcctcaggatggatcagatgacgaggacgaggagtggcccaccctggagaaggctgccacaatgacagcagcgggccatcatgcagaggtggttgtggaccctgaggatgagcgtgccatagagatgttcatgaacaagaaccctcctgccaggcgcaccctggctgacatcatcatggagaagctgactgagaagcagacagaggttgagacagtcatgtcagaggtgtcgggcttccctatgccccagctggacccccgggtcctagaagtgtacaggggggtccgggaggtattatctaagtaccgcagtggaaaactgcccaaggcatttaagatcatccctgcactctccaactgggagcaaatcctctacgtcacagagccggaggcctggactgcagctgccatgtaccaggccaccaggatttttgcctctaacctgaaggaacgcatggcccagcgcttctacaaccttgtcctgctccctcgagtacgagatgacgttgctgaatacaaacgactcaacttccatctctacatggctctcaagaaggcccttttcaaacctggagcctggttcaaagggatcctgattccactgtgcgagtctggcacttgtaccctccgggaagccatcattgtgggtagcatcatcaccaagtgctccatccctgtgttgcactccagtgcggccatgctgaaaattgctgagatggaatacagcggtgccaacagcatcttcctgcgactgctgctggataagaagtatgcactgccttaccgggtgctggatgccctagtcttccacttcctggggttccggacagagaagcgtgaactgcctgtgctgtggcaccagtgcctcctgactttggtccagcgctacaaggccgacttggccacagaccagaaagaggccctcttagaactgctccggctgcagccccatccacagctatcgcccgaaatcaggcgtgagcttcagagtgcagtcccccgcgatgtggaagatgttcccatcaccgtggagtgaggaaaacagtcagctgtcctggccaaaggggtttggaaggacaccaagacccccgttggtgactgaagatgacactgagctttaatggctgaagacccagatcagggcagtgacagatcacagggacatctgtggctcccagtccaggacaggaaggactgagggtctggctggttccctcttccattctaggcccttatccctgtttagttctgagagccaacttgagataccatatgctagcattcccagtccccagctggggcttggtgtgagtactttttctatggctattgtgtcaggtcactgtggataaaggcaaagacagatatttattgaacctctgtgtttggtgtagtcaatggaggtaggcattactcctgttagtatttggaggacggaggacattcttgtcctgtttatataggacccacctcccttgatctccaagcttgtttctccaggctgcactcaccttgttagcccccaggggacacatcctctgccttcccccatcacaggctacagcagccaggagcaggttgtccaaagatggtcgtgtctcagcagtggatgaaaggactacaagagaaaactccttggggaaagcagagataagagtcaagaaaggccagagaggctgggcttggtggctcacgcctgtaatcccagcactttgggaggctgaggtaggtggattacctgagttcaggagttcgagaccagcctggccaacatggtgaaaccccttctctactaaaaatacaaaaattagctgggtgtggtggcgtgtgcttgtaatcccagctacttgggaggctgaggcaggagaatcgcttcaacctgggaggtggaggttgcggtgatccaggattggggccactacactccagcctgggccacggagcaagactgtctcaaaaaaaaaaaaaaaaggccagagaataaggctgggcccaagaatggttagatcagagctagcatcaaacaggctccctttctggcttttcagccaatgaaagctttagactagtgactagtaaactagggccaggtgcccctttttttgttgatttgttttttgagacggagtc

SEQ ID NO: 428159 - DNA, 1979 bp, Homo sapiens
attcccgtttggctgagcactctaggcctacatccatgaagctaggagagcgacactcaaagactgcactattgagagaagctaacgttaaaggcagtgaatatattcgggagtccagctccggaacccgggagctcttttagtgggaggggcggcgctgatggcgcttctggcctccgaatgctagggggcgctgtgatcgccgggcggcctcttgggcgctgggagtccaccgcgcaagcgcatcctggcctttcttcagtccccacgtgcgatccttcccggcaactttttcgagaaaaatgcccaaattcaaggcggcccgtggggtggggggtcaggaaaaacatgcgcccctggccgatcagatcctggctgggaatgcggtgcgggcgggggtccgggagaagcggcggggtcgcgggacaggagaagcggaggaagagtatgtggggccccggctgagccgacggattttgcagcaagcacggcagcaacaggaggaactcgaggccgagcatgggactggggacaagcccgcggcgccgcgggaacgcaccacgcggctgggtccaagaatgcctcaggatggatcagatgacgaggacgaggagtggcccaccctggagaaggctgccacaatgacagcagcgggccatcatgcagaggtggttgtggaccctgaggatgagcgtgccatagagatgttcatgaacaagaaccctcctgccaggcgcaccctggctgacatcatcatggagaagctgactgagaagcagacagaggttgagacagtcatgtcagaggtgtcgggcttccctatgccccagctggacccccgggtcctagaagtgtacaggggggtccgggaggtattatctaagtaccgcagtggaaaactgcccaaggcatttaagatcatccctgcactctccaactgggagcaaatcctctacgtcacagagccggaggcctggactgcagctgccatgtaccaggccaccaggatttttgcctctaacctgaaggaacgcatggcccagcgcttctacaaccttgtcctgctccctcgagtacgagatgacgttgctgaatacaaacgactcaacttccatctctacatggctctcaagaaggcccttttcaaacctggagcctggttcaaagtggctgccctttgactctccctagggatcctgattccactgtgcgagtctggcacttgtaccctccgggaagccatcattgtgggtagcatcatcaccaagtgctccatccctgtgttgcactccagtgcggccatgctgaaaattgctgagatggaatacagcggtgccaacagcatcttcctgcgactgctgctggataagaagtatgcactgccttaccgggtgctggatgccctagtcttccacttcctggggttccggacagagaagcgtgaactgcctgtgctgtggcaccagtgcctcctgactttggtccagcgctacaaggccgacttggccacagaccagaaagaggccctcttagaactgctccggctgcagccccatccacagctatcgcccgaaatcaggcgtgagcttcagagtgcagtcccccgcgatgtggaagatgttcccatcaccgtggagtgaggaaaacagtcagctgtcctggccaaaggggtttggaaggacaccaagacccccgttggtgactgaagatgacactgagctttaatggctgaagacccagatcagggcagtgacagatcacagggacatctgtggctcccagtccaggacaggaaggactgagggtctggctggttccctcttccattctaggcccttatccctgtttagttctgagagccaacttgagataccatatgctagcattcccagtccccagctggggcttggtgtgagtactttttctatggctattgtgtcaggtcactgtggataaaggcaaagacagatatttattga

SEQ ID NO: 428160 - DNA, 1696 bp, Homo sapiens
  misc_feature (194)..(194): n is a, c, g, or t
  misc_feature (306)..(306): n is a, c, g, or t
  misc_feature (462)..(462): n is a, c, g, or t
  misc_feature (472)..(472): n is a, c, g, or t
  misc_feature (554)..(554): n is a, c, g, or t
gcggagccttccctggcaagctgttttcagagcaagaaagtgcccagactacaagggcggaccgatggggtggggggatcaggaaataactatgcgccgccatgggccgtagtcatgactcctggactgcggaatgacggctgacgggcagcggcggtccgcgcgagaatgacggacggggtctcaacgcggancagtgacgcaaagcggataggacatgagctactgcctggggcctccgcgcctgcatgccgcagcggtacattctgggagcagagacacgagcagcaatcacgtgcacggaanctcgacgtgccgacacactgggagctggggaacaaaagaccgcgtgggcagaccagacggaggaaacgcaagcaacgacaggtgtgaggtccgaaggaatgccatcacggatggcatccaccagtgacaggagggacgcaggcacgctggccacanacccatgagnatgacagcgcatgcgcaacacaattgaacagctcagtcgaggctccatcagtgcgaccagtcgctggctctggggcactccntgcaggggatgagccgtgccagtagagatggttcatgaactaaagaaccctcctgccaggtattatctaagtaccgcagtggaaaactgcccaaggcatttaagatcatccctgcactctccaactgggagcaaatcctctacgtcacagagccggaggcctggactgcagctgccatgtaccaggccaccaggatttttgcctctaacctgaaggaacgcatggcccagcgcttctacaaccttgtcctgctccctcgagtacgagatgacgttgctgaatacaaacgactcaacttccatctctacatggctctcaagaaggcccttttcaaacctggagcctggttcaaagggatcctgattccactgtgcgagtctggcacttgtaccctccgggaagccatcattgtgggtagcatcatcaccaagtgctccatccctgtgttgcactccagtgcggccatgctgaaaattgctgagatggaatacagcggtgccaacagcatcttcctgcgactgctgctggataagaagtatgcactgccttaccgggtgctggatgccctagtcttccacttcctggggttccggacagagaagcgtgaactgcctgtgctgtggcaccagtgcctcctgactttggtccagcgctacaaggccgacttggccacagaccagaaagaggccctcttagaactgctccggctgcagccccatccacagctatcgcccgaaatcaggcgtgagcttcagagtgcagtcccccgcgatgtggaagatgttcccatcaccgtggagtgaggaaaacagtcagctgtcctggccaaaggggtttggaaggacaccaagacccccgttggtgactgaagatgacactgagctttaatggctgaagacccagatcagggcagtgacagatcacagggacatctgtggctcccagtccaggacaggaaggactgagggtctggctggttccctcttccattctaggcccttatccctgtttagttctgagagccaacttgagataccatatgctagcattcccagtccccagctggggcttggtgtgagtactttttctatggctattgtgtcaggtcactgtggataaaggcaaagacagatatttattga

SEQ ID NO: 428161 - DNA, 2431 bp, Homo sapiens
agcggggggaagggttctggaagacggcagagctgccgccattttgcgggaagaggaggcgctgtacctgcagtgctgcttttcttgcctagactctaggaactatccgagctccactccccacaacatactcaaaggaacggagagaaccgggacccccctgcggggacccggaactgatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaatcgtagtcgagatcgggatcggtatagacggagaaatagtcggagccgaagtccaggtcggcagtgtcgtcaccgtagccgtagctgggatcgtcgacatggtagtgagtcgcgaagtcgggaccatcgtcgtgaggatcgtgtgcattacaggagtcctccacttgccactggttataggtatggacacagtaagagtcctcatttcagagagaagagcccagtcagggagccagttgataatctgagtcctgaggagcgtgatgcccgcacagttttctgtatgcagttagctgcccgaattcggcctcgagatctggaggactttttctctgctgtaggcaaggttcgcgatgtacgtatcatctcagatcggaactcacgtcgttctaagggcattgcctacgtggaattctgtgaaatccagtctgtgccactggccattgggctgactgggcagcggttgctgggagtgcctatcattgtacaggcttcacaggcagagaaaaaccgactggcagccatggccaacaacctgcaaaagggcaatggtggaccaatgcgcctctatgtgggttccctgcacttcaatatcactgaagacatgctccggggcatctttgagccctttggtaaaattgataatattgtcctgatgaaggactcagatacaggccgctctaaaggttatggtttcatcacgttctctgattctgagtgtgcccggcgggccctggaacagttgaatgggtttgagcttgctggtcgacctatgagggttggccatgtgactgagcgactggatggtggcacagacatcacttttcctgatggggaccaggagctggatctgggatcagcaggtggacgttttcagctcatggcaaaactggcagaaggcgctggaatccaactgccaagcactgctgctgctgctgctgccgccgccgccgcccaggctgctgccttgcaactgaatggagcagttcccttgggggccctgaatccagcagctctgactgctctgagtccagccctgaaccttgcctcccagtgtttccagctctccagcctctttaccccccagaccatgtaaatcagtggcacagtatactgcctccttgtgcctctggatcctgccacttcacatctactcttccatggccccatttctccattttgtggaccaagccatcctgagggcatggacattgtctctgaggaaattggggccacccttaagataccaagaaaagctcctgcccatggtcccactggaaatggactctgctgagcaaagccaccagttgaagagaacagaatccacacctgcattgaatacctgtttctccatgtgtatcgtctctgagattaccttcttgccctttccaacaccttagtgattcctcaatttctcccccattgggaaggccatagggcattaactgaaggaactgacctctctccttttcctgtacctttaacctttagtctgtcaaggaaaacccttaggacctctgaatcaagaggactgagtttgtgggtgaaccttgaaggtgctctttctgctacaagggccctgggagatagcatggacgtgcattgagaagccagcctcagaccttagcttgaagcagcttgaggccagacctactgtagcctcagcatcttgctaggaggcatggaagtgatctatcctgccaggaggcctcagagtgatctgtcctgccaggaggtgtgagagtgatctgtcctgtgaggcatttaggggctttcaggaatttagtaaaaggtggagtatgcctttccagtatcttccatcttcctttgtatacttgtccttcctcccatttcctccctttggcccgaggtaggaggatggagggaggctgctactctaccacttcctgtgtgcctctactgtggcctcaaccctggcaattatagctactcccatcccttacctgggcatgtgtgagcccttctcactggattttatacccttgtgtctgtgtacataaatatatatacatatatatatacataaaaactttgtacaaaag

SEQ ID NO: 428162 - DNA, 406 bp, Homo sapiens
aaaagaagaaaaaagaaaaaactaccagcctgaaaatgcatagtgtttgctaccttattgcttttagcacatctagaaagacactaaacccagtgagattgcaagtttcaaaatattgtgttgtatatggctttgcttaaacggatatatttgtttctgagtgaaaactttttacgtagaggtttatttgtagaggcttgtaaacttaagtgtaagttttagtgtgtgtgttaagttgttcttaccccgcattagcactcaacaatgagcagttcttgaaatcaagcatttcatttggaggggaaaaagcagattgtaaaaaatagttcataacagaaaatttgtgtagacttggcagcaaaaatgactgaaacagcttgagtataaaaaacttttctttttaggc

SEQ ID NO: 428163 - DNA, 2377 bp, Homo sapiens
agcggggggaagggttctggaagacggcagagctgccgccattttgcgggaagaggaggcgctgtacctgcagtgctgcttttcttgcctagactctaggaactatccgagctccactccccacaacatactcaaaggaacggagagaaccgggacccccctgcggggacccggaactgatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaatcgtagtcgagatcgggatcggtatagacggagaaatagtcggagccgaagtccaggtcggcagtgtcgtcaccgtagccgtagctgggatcgtcgacatggtagtgagtcgcgaagtcgggaccatcgtcgtgaggatcgtgtgcattacaggagtcctccacttgccactggggagccagttgataatctgagtcctgaggagcgtgatgcccgcacagttttctgtatgcagttagctgcccgaattcggcctcgagatctggaggactttttctctgctgtaggcaaggttcgcgatgtacgtatcatctcagatcggaactcacgtcgttctaagggcattgcctacgtggaattctgtgaaatccagtctgtgccactggccattgggctgactgggcagcggttgctgggagtgcctatcattgtacaggcttcacaggcagagaaaaaccgactggcagccatggccaacaacctgcaaaagggcaatggtggaccaatgcgcctctatgtgggttccctgcacttcaatatcactgaagacatgctccggggcatctttgagccctttggtaaaattgataatattgtcctgatgaaggactcagatacaggccgctctaaaggttatggtttcatcacgttctctgattctgagtgtgcccggcgggccctggaacagttgaatgggtttgagcttgctggtcgacctatgagggttggccatgtgactgagcgactggatggtggcacagacatcacttttcctgatggggaccaggagctggatctgggatcagcaggtggacgttttcagctcatggcaaaactggcagaaggcgctggaatccaactgccaagcactgctgctgctgctgctgccgccgccgccgcccaggctgctgccttgcaactgaatggagcagttcccttgggggccctgaatccagcagctctgactgctctgagtccagccctgaaccttgcctcccagtgtttccagctctccagcctctttaccccccagaccatgtaaatcagtggcacagtatactgcctccttgtgcctctggatcctgccacttcacatctactcttccatggccccatttctccattttgtggaccaagccatcctgagggcatggacattgtctctgaggaaattggggccacccttaagataccaagaaaagctcctgcccatggtcccactggaaatggactctgctgagcaaagccaccagttgaagagaacagaatccacacctgcattgaatacctgtttctccatgtgtatcgtctctgagattaccttcttgccctttccaacaccttagtgattcctcaatttctcccccattgggaaggccatagggcattaactgaaggaactgacctctctccttttcctgtacctttaacctttagtctgtcaaggaaaacccttaggacctctgaatcaagaggactgagtttgtgggtgaaccttgaaggtgctctttctgctacaagggccctgggagatagcatggacgtgcattgagaagccagcctcagaccttagcttgaagcagcttgaggccagacctactgtagcctcagcatcttgctaggaggcatggaagtgatctatcctgccaggaggcctcagagtgatctgtcctgccaggaggtgtgagagtgatctgtcctgtgaggcatttaggggctttcaggaatttagtaaaaggtggagtatgcctttccagtatcttccatcttcctttgtatacttgtccttcctcccatttcctccctttggcccgaggtaggaggatggagggaggctgctactctaccacttcctgtgtgcctctactgtggcctcaaccctggcaattatagctactcccatcccttacctgggcatgtgtgagcccttctcactggattttatacccttgtgtctgtgtacataaatatatatacatatatatatacataaaaactttgtacaaaag

SEQ ID NO: 428164 - DNA, 2440 bp, Homo sapiens
  misc_feature (25)..(25): n is a, c, g, or t
  misc_feature (29)..(29): n is a, c, g, or t
aaaaggccggctggtacggtcgggngtanggatcggcagagctgccgccattttgcgggaagaggaggcgctgtacctgcagtgctgcttttcttgcctagactctaggaactatccgagctccactccccacaacatactcaaaggaacggagagaaccgggacccccctgcggggacccggaactgatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaatcgtagtcgagatcgggatcggtatagacggagaaatagtcggagccgaagtccaggtcggcagtgtcgtcaccgtagccgtagctgggatcgtcgacatggtagtgagtcgcgaagtcgggaccatcgtcgtgaggatcgtgtgcattacaggagtcctccacttgccactggttataggtatggacacagtaagagtcctcatttcagagagaagagcccagtcagggagccagttgataatctgagtcctgaggagcgtgatgcccgcacagttttctgtatgcagttagctgcccgaattcggcctcgagatctggaggactttttctctgctgtaggcaaggttcgcgatgtacgtatcatctcagatcggaactcacgtcgttctaagggcattgcctacgtggaattctgtgaaatccagtctgtgccactggccattgggctgactgggcagcggttgctgggagtgcctatcattgtacaggcttcacaggcagagaaaaaccgactggcagccatggccaacaacctgcaaaagggcaatggtggaccaatgcgcctctatgtgggttccctgcacttcaatatcactgaagacatgctccggggcatctttgagccctttggtaaaattgataatattgtcctgatgaaggactcagatacaggccgctctaaaggttatggtttcatcacgttctctgattctgagtgtgcccggcgggccctggaacagttgaatgggtttgagcttgctggtcgacctatgagggttggccatgtgactgagcgactggatggtggcacagacatcacttttcctgatggggaccaggagctggatctgggatcagcaggtggacgttttcagctcatggcaaaactggcagaaggcgctggaatccaactgccaagcactgctgctgctgctgctgccgccgccgccgcccaggctgctgccttgcaactgaatggagcagttcccttgggggccctgaatccagcagctctgactgctctgagtccagccctgaaccttgcctcccagtgtttccagctctccagcctctttaccccccagaccatgtaaatcagtggcacagtatactgcctccttgtgcctctggatcctgccacttcacatctactcttccatggccccatttctccattttgtggaccaagccatcctgagggcatggacattgtctctgaggaaattggggccacccttaagataccaagaaaagctcctgcccatggtcccactggaaatggactctgctgagcaaagccaccagttgaagagaacagaatccacacctgcattgaatacctgtttctccatgtgtatcgtctctgagattaccttcttgccctttccaacaccttagtgattcctcaatttctcccccattgggaaggccatagggcattaactgaaggaactgacctctctccttttcctgtacctttaacctttagtctgtcaaggaaaacccttaggacctctgaatcaagaggactgagtttgtgggtgaaccttgaaggtgctctttctgctacaagggccctgggagatagcatggacgtgcattgagaagccagcctcagaccttagcttgaagcagcttgaggccagacctactgtagcctcagcatcttgctaggaggcatggaagtgatctatcctgccaggaggcctcagagtgatctgtcctgccaggaggtgtgagagtgatctgtcctgtgaggcatttaggggctttcaggaatttagtaaaaggtggagtatgcctttccagtatcttccatcttcctttgtatacttgtccttcctcccatttcctccctttggcccgaggtaggaggatggagggaggctgctactctaccacttcctgtgtgcctctactgtggcctcaaccctggcaattatagctactcccatcccttacctgggcatgtgtgagcccttctcactggattttatacccttgtgtctgtgtacataaatatatatacatatatatatacataaaaactttgtacaaaag

SEQ ID NO: 428165 - DNA, 2416 bp, Homo sapiens
  misc_feature (24)..(24): n is a, c, g, or t
gaataggctaggtcgaggccgggngttaatcggccgagaggaggcgctgtacctgcagtgctgcttttcttgcctagactctaggaactatccgagctccactccccacaacatactcaaaggaacggagagaaccgggacccccctgcggggacccggaactgatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaatcgtagtcgagatcgggatcggtatagacggagaaatagtcggagccgaagtccaggtcggcagtgtcgtcaccgtagccgtagctgggatcgtcgacatggtagtgagtcgcgaagtcgggaccatcgtcgtgaggatcgtgtgcattacaggagtcctccacttgccactggttataggtatggacacagtaagagtcctcatttcagagagaagagcccagtcagggagccagttgataatctgagtcctgaggagcgtgatgcccgcacagttttctgtatgcagttagctgcccgaattcggcctcgagatctggaggactttttctctgctgtaggcaaggttcgcgatgtacgtatcatctcagatcggaactcacgtcgttctaagggcattgcctacgtggaattctgtgaaatccagtctgtgccactggccattgggctgactgggcagcggttgctgggagtgcctatcattgtacaggcttcacaggcagagaaaaaccgactggcagccatggccaacaacctgcaaaagggcaatggtggaccaatgcgcctctatgtgggttccctgcacttcaatatcactgaagacatgctccggggcatctttgagccctttggtaaaattgataatattgtcctgatgaaggactcagatacaggccgctctaaaggttatggtttcatcacgttctctgattctgagtgtgcccggcgggccctggaacagttgaatgggtttgagcttgctggtcgacctatgagggttggccatgtgactgagcgactggatggtggcacagacatcacttttcctgatggggaccaggagctggatctgggatcagcaggtggacgttttcagctcatggcaaaactggcagaaggcgctggaatccaactgccaagcactgctgctgctgctgctgccgccgccgccgcccaggctgctgccttgcaactgaatggagcagttcccttgggggccctgaatccagcagctctgactgctctgagtccagccctgaaccttgcctcccagtgtttccagctctccagcctctttaccccccagaccatgtaaatcagtggcacagtatactgcctccttgtgcctctggatcctgccacttcacatctactcttccatggccccatttctccattttgtggaccaagccatcctgagggcatggacattgtctctgaggaaattggggccacccttaagataccaagaaaagctcctgcccatggtcccactggaaatggactctgctgagcaaagccaccagttgaagagaacagaatccacacctgcattgaatacctgtttctccatgtgtatcgtctctgagattaccttcttgccctttccaacaccttagtgattcctcaatttctcccccattgggaaggccatagggcattaactgaaggaactgacctctctccttttcctgtacctttaacctttagtctgtcaaggaaaacccttaggacctctgaatcaagaggactgagtttgtgggtgaaccttgaaggtgctctttctgctacaagggccctgggagatagcatggacgtgcattgagaagccagcctcagaccttagcttgaagcagcttgaggccagacctactgtagcctcagcatcttgctaggaggcatggaagtgatctatcctgccaggaggcctcagagtgatctgtcctgccaggaggtgtgagagtgatctgtcctgtgaggcatttaggggctttcaggaatttagtaaaaggtggagtatgcctttccagtatcttccatcttcctttgtatacttgtccttcctcccatttcctccctttggcccgaggtaggaggatggagggaggctgctactctaccacttcctgtgtgcctctactgtggcctcaaccctggcaattatagctactcccatcccttacctgggcatgtgtgagcccttctcactggattttatacccttgtgtctgtgtacataaatatatatacatatatatatacataaaaactttgtacaaaag

SEQ ID NO: 428166 - DNA, 2511 bp, Homo sapiens
agcggggggaagggttctggaagacggcagagctgccgccattttgcgggaagaggaggcgctgtacctgcagtgctgcttttcttgcctagactctaggaactatccgagctccactccccacaacatactcaaaggaacggagagaaccgggacccccctgcggggacccggaactgatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaatcgtagtcgagatcgggatcggtatagacggagaaatagtcggagccgaagtccaggtcggcagtgtcgtcaccgtagccgtagctgggatcgtcgacatggtagtgagtcgcgaagtcgggaccatcgtcgtgaggatcgtgtgcattacaggagtcctccacttgccactggttataggtatggacacagtaagagtcctcatttcagagagaagagcccagtcagggagccagttgataatctgagtcctgaggagcgtgatgcccgcacagttttctgtatgcagttagctgcccgaattcggcctcgagatctggaggactttttctctgctgtaggcaaggttcgcgatgtacgtatcatctcagatcggaactcacgtcgttctaagggcattgcctacgtggaattctgtgaaatccagtctgtgccactggccattgggctgactgggcagcggttgctgggagtgcctatcattgtacaggcttcacaggcagagaaaaaccgactggcagccatggccaacaacctgcaaaagggcaatggtggaccaatgcgcctctatgtgggttccctgcacttcaatatcactgaagacatgctccggggcatctttgagccctttggtaaaattgataatattgtcctgatgaaggactcagatacaggccgctctaaaggttatggtttcatcacgttctctgattctgagtgtgcccggcgggccctggaacagttgaatgggtttgagcttgctggtcgacctatgagggttggccatgtgactgagcgactggatggtggcacagacatcacttttcctgatggggaccaggagctggatctgggatcagcaggtggacgttttcagctcatggcaaaactggcagaaggcgctggaatccaactgccaagcactgctgctgctgctgctgccgccgccgccgcccaggctgctgccttgcaactgaatggagcagttcccttgggggccctgaatccagcagctctgactgctctgagtccagccctgaaccttgcctcccagtgtttccagctctccagcctctttaccccccagaccatgtgagtctcagggtctagctcattctagcctttgattattctctttcctttggcttcccatttacctcttctttccacaggtaaatcagtggcacagtatactgcctccttgtgcctctggatcctgccacttcacatctactcttccatggccccatttctccattttgtggaccaagccatcctgagggcatggacattgtctctgaggaaattggggccacccttaagataccaagaaaagctcctgcccatggtcccactggaaatggactctgctgagcaaagccaccagttgaagagaacagaatccacacctgcattgaatacctgtttctccatgtgtatcgtctctgagattaccttcttgccctttccaacaccttagtgattcctcaatttctcccccattgggaaggccatagggcattaactgaaggaactgacctctctccttttcctgtacctttaacctttagtctgtcaaggaaaacccttaggacctctgaatcaagaggactgagtttgtgggtgaaccttgaaggtgctctttctgctacaagggccctgggagatagcatggacgtgcattgagaagccagcctcagaccttagcttgaagcagcttgaggccagacctactgtagcctcagcatcttgctaggaggcatggaagtgatctatcctgccaggaggcctcagagtgatctgtcctgccaggaggtgtgagagtgatctgtcctgtgaggcatttaggggctttcaggaatttagtaaaaggtggagtatgcctttccagtatcttccatcttcctttgtatacttgtccttcctcccatttcctccctttggcccgaggtaggaggatggagggaggctgctactctaccacttcctgtgtgcctctactgtggcctcaaccctggcaattatagctactcccatcccttacctgggcatgtgtgagcccttctcactggattttatacccttgtgtctgtgtacataaatatatatacatatatatatacataaaaactttgtacaaaag

SEQ ID NO: 428167 - DNA, 2479 bp, Homo sapiens
agcggggggaagggttctggaagacggcagagctgccgccattttgcgggaagaggaggcgctgtacctgcagtgctgcttttcttgcctagactctaggaactatccgagctccactccccacaacatactcaaaggaacggagagaaccgggacccccctgcggggacccggaactgatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaagaagaagaggagtcggagccataataaaagcagggatagaaagcgcagtcgtagtcgagatcgggatcggtatagacggagaaatagtcggagccgaagtccaggtcggcagtgtcgtcaccgtagccgtagctgggatcgtcgacatggtagtgagtcgcgaagtcgggaccatcgtcgtgaggatcgtgtgcattacaggagtcctccacttgccactggttataggtatggacacagtaagagtcctcatttcagagagaagagcccagtcagggagccagttgataatctgagtcctgaggagcgtgatgcccgcacagttttctgtatgcagttagctgcccgaattcggcctcgagatctggaggactttttctctgctgtaggcaaggttcgcgatgtacgtatcatctcagatcggaactcacgtcgttctaagggcattgcctacgtggaattctgtgaaatccagtctgtgccactggccattgggctgactgggcagcggttgctgggagtgcctatcattgtacaggcttcacaggcagagaaaaaccgactggcagccatggccaacaacctgcaaaagggcaatggtggaccaatgcgcctctatgtgggttccctgcacttcaatatcactgaagacatgctccggggcatctttgagccctttggtaaaattgataatattgtcctgatgaaggactcagatacaggccgctctaaaggttatggtttcatcacgttctctgattctgagtgtgcccggcgggccctggaacagttgaatgggtttgagcttgctggtcgacctatgagggttggccatgtgactgagcgactggatggtggcacagacatcacttttcctgatggggaccaggagctggatctgggatcagcaggtggacgttttcagctcatggcaaaactggcagaaggcgctggaatccaactgccaagcactgctgctgctgctgctgccgccgccgccgcccaggctgctgccttgcaactgaatggagcagttcccttgggggccctgaatccagcagctctgactgctctgagtccagccctgaaccttgcctcccagtgtttccagctctccagcctctttaccccccagaccatgtaaatcagtggcacagtatactgcctccttgtgcctctggatcctgccacttcacatctactcttccatggccccatttctccattttgtggaccaagccatcctgagggcatggacattgtctctgaggaaattggggccacccttaagataccaagaaaagctcctgcccatggtcccactggaaatggactctgctgagcaaagccaccagttgaagagaacagaatccacacctgcattgaatacctgtttctccatgtgtatcgtctctgagattaccttcttgccctttccaacaccttagtgattcctcaatttctcccccattgggaaggccatagggcattaactgaaggaactgacctctctccttttcctgtacctttaacctttagtctgtcaaggaaaacccttaggacctctgaatcaagaggactgagtttgtgggtgaaccttgaaggtgctctttctgctacaagggccctgggagatagcatggacgtgcattgagaagccagcctcagaccttagcttgaagcagcttgaggccagacctactgtagcctcagcatcttgctaggaggcatggaagtgatctatcctgccaggaggcctcagagtgatctgtcctgccaggaggtgtgagagtgatctgtcctgtgaggcatttaggggctttcaggaatttagtaaaaggtggagtatgcctttccagtatcttccatcttcctttgtatacttgtccttcctcccatttcctccctttggcccgaggtaggaggatggagggaggctgctactctaccacttcctgtgtgcctctactgtggcctcaaccctggcaattatagctactcccatcccttacctgggcatgtgtgagcccttctcactggattttatacccttgtgtctgtgtacataaatatatatacatatatatatacataaaaactttgtacaaaag

SEQ ID NO: 428168 - DNA, 2387 bp, Homo sapiens
tggtgctgctgctgtcctggtggtgctgctgctgcttttcttgcctagactctaggaactatccgagctccactccccacaacatactcaaaggaacggagagaaccgggacccccctgcggggacccggaactgatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaatcgtagtcgagatcgggatcggtatagacggagaaatagtcggagccgaagtccaggtcggcagtgtcgtcaccgtagccgtagctgggatcgtcgacatggtagtgagtcgcgaagtcgggaccatcgtcgtgaggatcgtgtgcattacaggagtcctccacttgccactggttataggtatggacacagtaagagtcctcatttcagagagaagagcccagtcagggagccagttgataatctgagtcctgaggagcgtgatgcccgcacagttttctgtatgcagttagctgcccgaattcggcctcgagatctggaggactttttctctgctgtaggcaaggttcgcgatgtacgtatcatctcagatcggaactcacgtcgttctaagggcattgcctacgtggaattctgtgaaatccagtctgtgccactggccattgggctgactgggcagcggttgctgggagtgcctatcattgtacaggcttcacaggcagagaaaaaccgactggcagccatggccaacaacctgcaaaagggcaatggtggaccaatgcgcctctatgtgggttccctgcacttcaatatcactgaagacatgctccggggcatctttgagccctttggtaaaattgataatattgtcctgatgaaggactcagatacaggccgctctaaaggttatggtttcatcacgttctctgattctgagtgtgcccggcgggccctggaacagttgaatgggtttgagcttgctggtcgacctatgagggttggccatgtgactgagcgactggatggtggcacagacatcacttttcctgatggggaccaggagctggatctgggatcagcaggtggacgttttcagctcatggcaaaactggcagaaggcgctggaatccaactgccaagcactgctgctgctgctgctgccgccgccgccgcccaggctgctgccttgcaactgaatggagcagttcccttgggggccctgaatccagcagctctgactgctctgagtccagccctgaaccttgcctcccagtgtttccagctctccagcctctttaccccccagaccatgtaaatcagtggcacagtatactgcctccttgtgcctctggatcctgccacttcacatctactcttccatggccccatttctccattttgtggaccaagccatcctgagggcatggacattgtctctgaggaaattggggccacccttaagataccaagaaaagctcctgcccatggtcccactggaaatggactctgctgagcaaagccaccagttgaagagaacagaatccacacctgcattgaatacctgtttctccatgtgtatcgtctctgagattaccttcttgccctttccaacaccttagtgattcctcaatttctcccccattgggaaggccatagggcattaactgaaggaactgacctctctccttttcctgtacctttaacctttagtctgtcaaggaaaacccttaggacctctgaatcaagaggactgagtttgtgggtgaaccttgaaggtgctctttctgctacaagggccctgggagatagcatggacgtgcattgagaagccagcctcagaccttagcttgaagcagcttgaggccagacctactgtagcctcagcatcttgctaggaggcatggaagtgatctatcctgccaggaggcctcagagtgatctgtcctgccaggaggtgtgagagtgatctgtcctgtgaggcatttaggggctttcaggaatttagtaaaaggtggagtatgcctttccagtatcttccatcttcctttgtatacttgtccttcctcccatttcctccctttggcccgaggtaggaggatggagggaggctgctactctaccacttcctgtgtgcctctactgtggcctcaaccctggcaattatagctactcccatcccttacctgggcatgtgtgagcccttctcactggattttatacccttgtgtctgtgtacataaatatatatacatatatatatacataaaaactttgtacaaaag

SEQ ID NO: 428169 - DNA, 2344 bp, Homo sapiens
aaaagaagaaaaaagaaaaaactaccagcctgaaaatgcatagtgtttgctaccttattgcttttagcacatctagaaagacactaaacccaatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaatcgtagtcgagatcgggatcggtatagacggagaaatagtcggagccgaagtccaggtcggcagtgtcgtcaccgtagccgtagctgggatcgtcgacatggtagtgagtcgcgaagtcgggaccatcgtcgtgaggatcgtgtgcattacaggagtcctccacttgccactggttataggtatggacacagtaagagtcctcatttcagagagaagagcccagtcagggagccagttgataatctgagtcctgaggagcgtgatgcccgcacagttttctgtatgcagttagctgcccgaattcggcctcgagatctggaggactttttctctgctgtaggcaaggttcgcgatgtacgtatcatctcagatcggaactcacgtcgttctaagggcattgcctacgtggaattctgtgaaatccagtctgtgccactggccattgggctgactgggcagcggttgctgggagtgcctatcattgtacaggcttcacaggcagagaaaaaccgactggcagccatggccaacaacctgcaaaagggcaatggtggaccaatgcgcctctatgtgggttccctgcacttcaatatcactgaagacatgctccggggcatctttgagccctttggtaaaattgataatattgtcctgatgaaggactcagatacaggccgctctaaaggttatggtttcatcacgttctctgattctgagtgtgcccggcgggccctggaacagttgaatgggtttgagcttgctggtcgacctatgagggttggccatgtgactgagcgactggatggtggcacagacatcacttttcctgatggggaccaggagctggatctgggatcagcaggtggacgttttcagctcatggcaaaactggcagaaggcgctggaatccaactgccaagcactgctgctgctgctgctgccgccgccgccgcccaggctgctgccttgcaactgaatggagcagttcccttgggggccctgaatccagcagctctgactgctctgagtccagccctgaaccttgcctcccagtgtttccagctctccagcctctttaccccccagaccatgtaaatcagtggcacagtatactgcctccttgtgcctctggatcctgccacttcacatctactcttccatggccccatttctccattttgtggaccaagccatcctgagggcatggacattgtctctgaggaaattggggccacccttaagataccaagaaaagctcctgcccatggtcccactggaaatggactctgctgagcaaagccaccagttgaagagaacagaatccacacctgcattgaatacctgtttctccatgtgtatcgtctctgagattaccttcttgccctttccaacaccttagtgattcctcaatttctcccccattgggaaggccatagggcattaactgaaggaactgacctctctccttttcctgtacctttaacctttagtctgtcaaggaaaacccttaggacctctgaatcaagaggactgagtttgtgggtgaaccttgaaggtgctctttctgctacaagggccctgggagatagcatggacgtgcattgagaagccagcctcagaccttagcttgaagcagcttgaggccagacctactgtagcctcagcatcttgctaggaggcatggaagtgatctatcctgccaggaggcctcagagtgatctgtcctgccaggaggtgtgagagtgatctgtcctgtgaggcatttaggggctttcaggaatttagtaaaaggtggagtatgcctttccagtatcttccatcttcctttgtatacttgtccttcctcccatttcctccctttggcccgaggtaggaggatggagggaggctgctactctaccacttcctgtgtgcctctactgtggcctcaaccctggcaattatagctactcccatcccttacctgggcatgtgtgagcccttctcactggattttatacccttgtgtctgtgtacataaatatatatacatatatatatacataaaaactttgtacaaaag

SEQ ID NO: 428170 - DNA, 2375 bp, Homo sapiens
  misc_feature (25)..(25): n is a, c, g, or t
  misc_feature (29)..(29): n is a, c, g, or t
aaaaggccggctggtacggtcgggngtanggatcggcagagctgccgccattttgcgggaagaggaggcgctgtacctgcagtgctgcttttcttgcctagactctaggaactatccgagctccactccccacaacatactcaaaggaacggagagaaccgggacccccctgcggggacccggaactgatctgacaggatggcatctgatgactttgacatagtgattgaggccatgctggaagctccctataaaaaagaagaggaagaagaggagtcggagccataataaaagcagggatagaaagcgcagtcgtagtcgagatcgggatcggtatagacggagaaatagtcggagccgaagtccaggtcggcagtgtcgtcaccgtagccgtagctgggatcgtcgacatggtagtgagtcgcgaagtcgggaccatcgtcgtgaggatcgtgtgcattacaggagtcctccacttgccactggttataggtatggacacagtaagagtcctcatttcagagagaagagcccagtcagggagccagttgataatctgagtcctgaggagcgtgatgcccgcacagttttctgtatgcagttagctgcccgaattcggcctcgagatctggaggactttttctctgctgtaggcaaggttcgcgatgtacgtatcatctcagatcggaactcacgtcgttctaagggcattgcctacgtggaattctgtgaaatccagtctgtgccactggccattgggctgactgggcagcggttgctgggagtgcctatcattgtacaggcttcacaggcagagaaaaaccgactggcagccatggccaacaacctgcaaaagggcaatggtggaccaatgcgcctctatgtgggttccctgcacttcaatatcactgaagacatgctccggggcatctttgagccctttggtaaaattgataatattgtcctgatgaaggactcagatacaggccgctctaaaggttatggtttcatcacgttctctgattctgagtgtgcccggcgggccctggaacagttgaatgggtttgagcttgctggtcgacctatgagggttggccatgtgactgagcgactggatggtggcacagacatcacttttcctgatggggaccaggagctggatctgggatcagcaggtggacgttttcagctcatggcaaaactggcagaaggcgctggaatccaactgccaagcactgctgctgctgctgctgccgccgccgccgcccaggctgctgccttgcaactgaatggagcagttcccttgggggccctgaatccagcagctctgactgctctgagtccagccctgaaccttgcctcccagtgtttccagctctccagcctctttaccccccagaccatgtaaatcagtggcacagtatactgcctccttgtgcctctggatcctgccacttcacatctactcttccatggccccatttctccattttgtggaccaagccatcctgagggcatggacattgtctctgaggaaattggggccacccttaagataccaagaaaagctcctgcccatggtcccactggaaatggactctgctgagcaaagccaccagttgaagagaacagaatccacacctgcattgaatacctgtttctccatgtgtatcgtctctgagattaccttcttgccctttccaacaccttagtgattcctcaatttctcccccattgggaaggccatagggcattaactgaaggaactgacctctctccttttcctgtacctttaacctttagtctgtcaaggaaaacccttaggacctctgaatcaagaggactgagtttgtgggtgaaccttgaaggtgctctttctgctacaagggccctgggagatagcatggacgtgcattgagaagccagcctcagaccttagcttgaagcagcttgaggccagacctactgtagcctcagcatcttgctaggaggcatggaagtgatctatcctgccaggaggcctcagagtgatctgtcctgccaggaggtgtgagagtgatctgtcctgtgaggcatttaggggctttcaggaatttagtaaaaggtggagtatgcctttccagtatcttccatcttcctttgtatacttgtccttcctcccatttcctccctttggcccgaggtaggaggatggagggaggctgctactctaccacttcctgtgtgcctctactgtggcctcaaccctggcaattatagctactcccatcccttacctgggcatgtgtgagcccttctcactggattttatacccttgtgtctgtgtacataaatatatatacatatatatatacataaaaactttgtacaaaag

SEQ ID NO: 428171 - DNA, 2597 bp, Homo sapiens
cgtgcctggtctaattttgtgtttttagtagagacggagtttctccatgttggtcaggctggtctcgaactctcgacctcaggtgatctgcccgccttggcctcccaaagtgctgggattacaggcgtgagccaccgcgcccagccctgggtcttattttttctattaaatgacatatttgtatccattcatctacttctgttcattccacccacagccgccatccttccatccttccatccttcccagcctctagtaaacactagtctttctatcttcatgagattcactttgtacataattggatgtgctgtatttttatacaactgggagtgcagtaggtaatagtttggtttacaccagtatcaccacaaacacataagtaatacattacgacattacagtggctgtaacatcactaggttatacgaacttctcagcaccgttataatcttatgggaccactgttgtatatgcacttggttgttggcctaaacatgatgtgggcatgactgtagttgtttccctctgtagtcgtagtcgagatcgggatcggtatagacggagaaatagtcggagccgaagtccaggtcggcagtgtcgtcaccgtagccgtagctgggatcgtcgacatggtagtgagtcgcgaagtcgggaccatcgtcgtgaggatcgtgtgcattacaggagtcctccacttgccactggttataggtatggacacagtaagagtcctcatttcagagagaagagcccagtcagggagccagttgataatctgagtcctgaggagcgtgatgcccgcacagttttctgtatgcagttagctgcccgaattcggcctcgagatctggaggactttttctctgctgtaggcaaggttcgcgatgtacgtatcatctcagatcggaactcacgtcgttctaagggcattgcctacgtggaattctgtgaaatccagtctgtgccactggccattgggctgactgggcagcggttgctgggagtgcctatcattgtacaggcttcacaggcagagaaaaaccgactggcagccatggccaacaacctgcaaaagggcaatggtggaccaatgcgcctctatgtgggttccctgcacttcaatatcactgaagacatgctccggggcatctttgagccctttggtaaaattgataatattgtcctgatgaaggactcagatacaggccgctctaaaggttatggtttcatcacgttctctgattctgagtgtgcccggcgggccctggaacagttgaatgggtttgagcttgctggtcgacctatgagggttggccatgtgactgagcgactggatggtggcacagacatcacttttcctgatggggaccaggagctggatctgggatcagcaggtggacgttttcagctcatggcaaaactggcagaaggcgctggaatccaactgccaagcactgctgctgctgctgctgccgccgccgccgcccaggctgctgccttgcaactgaatggagcagttcccttgggggccctgaatccagcagctctgactgctctgagtccagccctgaaccttgcctcccagtgtttccagctctccagcctctttaccccccagaccatgtaaatcagtggcacagtatactgcctccttgtgcctctggatcctgccacttcacatctactcttccatggccccatttctccattttgtggaccaagccatcctgagggcatggacattgtctctgaggaaattggggccacccttaagataccaagaaaagctcctgcccatggtcccactggaaatggactctgctgagcaaagccaccagttgaagagaacagaatccacacctgcattgaatacctgtttctccatgtgtatcgtctctgagattaccttcttgccctttccaacaccttagtgattcctcaatttctcccccattgggaaggccatagggcattaactgaaggaactgacctctctccttttcctgtacctttaacctttagtctgtcaaggaaaacccttaggacctctgaatcaagaggactgagtttgtgggtgaaccttgaaggtgctctttctgctacaagggccctgggagatagcatggacgtgcattgagaagccagcctcagaccttagcttgaagcagcttgaggccagacctactgtagcctcagcatcttgctaggaggcatggaagtgatctatcctgccaggaggcctcagagtgatctgtcctgccaggaggtgtgagagtgatctgtcctgtgaggcatttaggggctttcaggaatttagtaaaaggtggagtatgcctttccagtatcttccatcttcctttgtatacttgtccttcctcccatttcctccctttggcccgaggtaggaggatggagggaggctgctactctaccacttcctgtgtgcctctactgtggcctcaaccctggcaattatagctactcccatcccttacctgggcatgtgtgagcccttctcactggattttatacccttgtgtctgtgtacataaatatatatacatatatatatacataaaaactttgtacaaaag

SEQ ID NO: 428172 - DNA, 2251 bp, Homo sapiens
  misc_feature (25)..(25): n is a, c, g, or t
  misc_feature (29)..(29): n is a, c, g, or t
aaaaggccggctggtacggtcgggngtanggatcggcagagctgccgccattttgcgggaagaggaggcgctgtacctgcagtgctgcttttcttgcctagactctaggaactatccgagctccactccccacaacatactcaaaggaacggagagaaccgggacccccctgcggggacccggaactgtcgtagtcgagatcgggatcggtatagacggagaaatagtcggagccgaagtccaggtcggcagtgtcgtcaccgtagccgtagctgggatcgtcgacatggtagtgagtcgcgaagtcgggaccatcgtcgtgaggatcgtgtgcattacaggagtcctccacttgccactggttataggtatggacacagtaagagtcctcatttcagagagaagagcccagtcagggagccagttgataatctgagtcctgaggagcgtgatgcccgcacagttttctgtatgcagttagctgcccgaattcggcctcgagatctggaggactttttctctgctgtaggcaaggttcgcgatgtacgtatcatctcagatcggaactcacgtcgttctaagggcattgcctacgtggaattctgtgaaatccagtctgtgccactggccattgggctgactgggcagcggttgctgggagtgcctatcattgtacaggcttcacaggcagagaaaaaccgactggcagccatggccaacaacctgcaaaagggcaatggtggaccaatgcgcctctatgtgggttccctgcacttcaatatcactgaagacatgctccggggcatctttgagccctttggtaaaattgataatattgtcctgatgaaggactcagatacaggccgctctaaaggttatggtttcatcacgttctctgattctgagtgtgcccggcgggccctggaacagttgaatgggtttgagcttgctggtcgacctatgagggttggccatgtgactgagcgactggatggtggcacagacatcacttttcctgatggggaccaggagctggatctgggatcagcaggtggacgttttcagctcatggcaaaactggcagaaggcgctggaatccaactgccaagcactgctgctgctgctgctgccgccgccgccgcccaggctgctgccttgcaactgaatggagcagttcccttgggggccctgaatccagcagctctgactgctctgagtccagccctgaaccttgcctcccagtgtttccagctctccagcctctttaccccccagaccatgtaaatcagtggcacagtatactgcctccttgtgcctctggatcctgccacttcacatctactcttccatggccccatttctccattttgtggaccaagccatcctgagggcatggacattgtctctgaggaaattggggccacccttaagataccaagaaaagctcctgcccatggtcccactggaaatggactctgctgagcaaagccaccagttgaagagaacagaatccacacctgcattgaatacctgtttctccatgtgtatcgtctctgagattaccttcttgccctttccaacaccttagtgattcctcaatttctcccccattgggaaggccatagggcattaactgaaggaactgacctctctccttttcctgtacctttaacctttagtctgtcaaggaaaacccttaggacctctgaatcaagaggactgagtttgtgggtgaaccttgaaggtgctctttctgctacaagggccctgggagatagcatggacgtgcattgagaagccagcctcagaccttagcttgaagcagcttgaggccagacctactgtagcctcagcatcttgctaggaggcatggaagtgatctatcctgccaggaggcctcagagtgatctgtcctgccaggaggtgtgagagtgatctgtcctgtgaggcatttaggggctttcaggaatttagtaaaaggtggagtatgcctttccagtatcttccatcttcctttgtatacttgtccttcctcccatttcctccctttggcccgaggtaggaggatggagggaggctgctactctaccacttcctgtgtgcctctactgtggcctcaaccctggcaattatagctactcccatcccttacctgggcatgtgtgagcccttctcactggattttatacccttgtgtctgtgtacataaatatatatacatatatatatacataaaaactttgtacaaaag

SEQ ID NO: 428173 - DNA, 2434 bp, Homo sapiens
  misc_feature (25)..(25): n is a, c, g, or t
  misc_feature (29)..(29): n is a, c, g, or t
aaaaggccggctggtacggtcgggngtanggatcggcagagctgccgccattttgcgggaagaggaggcgctgtacctgcagtgctgcttttcttgcctagactctaggaactatccgagctccactccccacaacatactcaaaggaacggagagaaccgggacccccctgcggggacccggaactgatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaagaagaagaggagtcggagccataataaaagcagggatagaaagcgcagtcgtagtcgagatcgggatcggtatagacggagaaatagtcggagccgaagtccaggtcggcagtgtcgtcaccgtagccgtagctgggatcgtcgacatggtagtgagtcgcgaagtcgggaccatcgtcgtgaggatcgtgtgcattacaggagtcctccacttgccactggggagccagttgataatctgagtcctgaggagcgtgatgcccgcacagttttctgtatgcagttagctgcccgaattcggcctcgagatctggaggactttttctctgctgtaggcaaggttcgcgatgtacgtatcatctcagatcggaactcacgtcgttctaagggcattgcctacgtggaattctgtgaaatccagtctgtgccactggccattgggctgactgggcagcggttgctgggagtgcctatcattgtacaggcttcacaggcagagaaaaaccgactggcagccatggccaacaacctgcaaaagggcaatggtggaccaatgcgcctctatgtgggttccctgcacttcaatatcactgaagacatgctccggggcatctttgagccctttggtaaaattgataatattgtcctgatgaaggactcagatacaggccgctctaaaggttatggtttcatcacgttctctgattctgagtgtgcccggcgggccctggaacagttgaatgggtttgagcttgctggtcgacctatgagggttggccatgtgactgagcgactggatggtggcacagacatcacttttcctgatggggaccaggagctggatctgggatcagcaggtggacgttttcagctcatggcaaaactggcagaaggcgctggaatccaactgccaagcactgctgctgctgctgctgccgccgccgccgcccaggctgctgccttgcaactgaatggagcagttcccttgggggccctgaatccagcagctctgactgctctgagtccagccctgaaccttgcctcccagtgtttccagctctccagcctctttaccccccagaccatgtaaatcagtggcacagtatactgcctccttgtgcctctggatcctgccacttcacatctactcttccatggccccatttctccattttgtggaccaagccatcctgagggcatggacattgtctctgaggaaattggggccacccttaagataccaagaaaagctcctgcccatggtcccactggaaatggactctgctgagcaaagccaccagttgaagagaacagaatccacacctgcattgaatacctgtttctccatgtgtatcgtctctgagattaccttcttgccctttccaacaccttagtgattcctcaatttctcccccattgggaaggccatagggcattaactgaaggaactgacctctctccttttcctgtacctttaacctttagtctgtcaaggaaaacccttaggacctctgaatcaagaggactgagtttgtgggtgaaccttgaaggtgctctttctgctacaagggccctgggagatagcatggacgtgcattgagaagccagcctcagaccttagcttgaagcagcttgaggccagacctactgtagcctcagcatcttgctaggaggcatggaagtgatctatcctgccaggaggcctcagagtgatctgtcctgccaggaggtgtgagagtgatctgtcctgtgaggcatttaggggctttcaggaatttagtaaaaggtggagtatgcctttccagtatcttccatcttcctttgtatacttgtccttcctcccatttcctccctttggcccgaggtaggaggatggagggaggctgctactctaccacttcctgtgtgcctctactgtggcctcaaccctggcaattatagctactcccatcccttacctgggcatgtgtgagcccttctcactggattttatacccttgtgtctgtgtacataaatatatatacatatatatatacataaaaactttgtacaaaag

SEQ ID NO: 428174 - DNA, 2371 bp, Homo sapiens
caaatgcactatgaaccctgcttgagggtgcttattataacacattgtgattggcaggatactcaggcacagaaagggttggtattcaaaatttactggcgtggtggctcatgcctgtaatcccagcactttgggagactgaggccagaagatcacttgggctcaggaattcaagaccagccaggacaacatggcgaaaccctggttctacaaaaaatgcaaaaatgagctagatatggtcatgtgtgtctgtaatcctagccacacaaggaggctgaggtgggaggattgcttgagcctgggaggcaaaggttgcagtgacccgagatggcgccactgcactccagcctgggtgacagcggaaaccctgtcttaaaaaaacaatgagatgaagtactggaatctggttttctcaccatggaagacccagcattggaccaatgagaataaggtttcaccttttgtttttctctattctttagttataggtatggacacagtaagagtcctcatttcagagagaagagcccagtcagggagccagttgataatctgagtcctgaggagcgtgatgcccgcacagttttctgtatgcagttagctgcccgaattcggcctcgagatctggaggactttttctctgctgtaggcaaggttcgcgatgtacgtatcatctcagatcggaactcacgtcgttctaagggcattgcctacgtggaattctgtgaaatccagtctgtgccactggccattgggctgactgggcagcggttgctgggagtgcctatcattgtacaggcttcacaggcagagaaaaaccgactggcagccatggccaacaacctgcaaaagggcaatggtggaccaatgcgcctctatgtgggttccctgcacttcaatatcactgaagacatgctccggggcatctttgagccctttggtaaaattgataatattgtcctgatgaaggactcagatacaggccgctctaaaggttatggtttcatcacgttctctgattctgagtgtgcccggcgggccctggaacagttgaatgggtttgagcttgctggtcgacctatgagggttggccatgtgactgagcgactggatggtggcacagacatcacttttcctgatggggaccaggagctggatctgggatcagcaggtggacgttttcagctcatggcaaaactggcagaaggcgctggaatccaactgccaagcactgctgctgctgctgctgccgccgccgccgcccaggctgctgccttgcaactgaatggagcagttcccttgggggccctgaatccagcagctctgactgctctgagtccagccctgaaccttgcctcccagtgtttccagctctccagcctctttaccccccagaccatgtaaatcagtggcacagtatactgcctccttgtgcctctggatcctgccacttcacatctactcttccatggccccatttctccattttgtggaccaagccatcctgagggcatggacattgtctctgaggaaattggggccacccttaagataccaagaaaagctcctgcccatggtcccactggaaatggactctgctgagcaaagccaccagttgaagagaacagaatccacacctgcattgaatacctgtttctccatgtgtatcgtctctgagattaccttcttgccctttccaacaccttagtgattcctcaatttctcccccattgggaaggccatagggcattaactgaaggaactgacctctctccttttcctgtacctttaacctttagtctgtcaaggaaaacccttaggacctctgaatcaagaggactgagtttgtgggtgaaccttgaaggtgctctttctgctacaagggccctgggagatagcatggacgtgcattgagaagccagcctcagaccttagcttgaagcagcttgaggccagacctactgtagcctcagcatcttgctaggaggcatggaagtgatctatcctgccaggaggcctcagagtgatctgtcctgccaggaggtgtgagagtgatctgtcctgtgaggcatttaggggctttcaggaatttagtaaaaggtggagtatgcctttccagtatcttccatcttcctttgtatacttgtccttcctcccatttcctccctttggcccgaggtaggaggatggagggaggctgctactctaccacttcctgtgtgcctctactgtggcctcaaccctggcaattatagctactcccatcccttacctgggcatgtgtgagcccttctcactggattttatacccttgtgtctgtgtacataaatatatatacatatatatatacataaaaactttgtacaaaag

SEQ ID NO: 428175 - DNA, 2273 bp, Homo sapiens
  misc_feature (25)..(25): n is a, c, g, or t
  misc_feature (29)..(29): n is a, c, g, or t
aaaaggccggctggtacggtcgggngtanggatcggcagagctgccgccattttgcgggaagaggaggcgctgtacctgcagtgctgcttttcttgcctagactctaggaactatccgagctccactccccacaacatactcaaaggaacggagagaaccgggacccccctgcggggacccggaactgatctgacaggatggcatctgatgactttgacatagtgattgaggccatgctggaagctccctataaaaaagaagagtcgtagtcgagatcgggatcggtatagacggagaaatagtcggagccgaagtccaggtcggcagtgtcgtcaccgtagccgtagctgggatcgtcgacatggtagtgagtcgcgaagtcgggaccatcgtcgtgaggatcgtgtgcattacaggagtcctccacttgccactggggagccagttgataatctgagtcctgaggagcgtgatgcccgcacagttttctgtatgcagttagctgcccgaattcggcctcgagatctggaggactttttctctgctgtaggcaaggttcgcgatgtacgtatcatctcagatcggaactcacgtcgttctaagggcattgcctacgtggaattctgtgaaatccagtctgtgccactggccattgggctgactgggcagcggttgctgggagtgcctatcattgtacaggcttcacaggcagagaaaaaccgactggcagccatggccaacaacctgcaaaagggcaatggtggaccaatgcgcctctatgtgggttccctgcacttcaatatcactgaagacatgctccggggcatctttgagccctttggtaaaattgataatattgtcctgatgaaggactcagatacaggccgctctaaaggttatggtttcatcacgttctctgattctgagtgtgcccggcgggccctggaacagttgaatgggtttgagcttgctggtcgacctatgagggttggccatgtgactgagcgactggatggtggcacagacatcacttttcctgatggggaccaggagctggatctgggatcagcaggtggacgttttcagctcatggcaaaactggcagaaggcgctggaatccaactgccaagcactgctgctgctgctgctgccgccgccgccgcccaggctgctgccttgcaactgaatggagcagttcccttgggggccctgaatccagcagctctgactgctctgagtccagccctgaaccttgcctcccagtgtttccagctctccagcctctttaccccccagaccatgtaaatcagtggcacagtatactgcctccttgtgcctctggatcctgccacttcacatctactcttccatggccccatttctccattttgtggaccaagccatcctgagggcatggacattgtctctgaggaaattggggccacccttaagataccaagaaaagctcctgcccatggtcccactggaaatggactctgctgagcaaagccaccagttgaagagaacagaatccacacctgcattgaatacctgtttctccatgtgtatcgtctctgagattaccttcttgccctttccaacaccttagtgattcctcaatttctcccccattgggaaggccatagggcattaactgaaggaactgacctctctccttttcctgtacctttaacctttagtctgtcaaggaaaacccttaggacctctgaatcaagaggactgagtttgtgggtgaaccttgaaggtgctctttctgctacaagggccctgggagatagcatggacgtgcattgagaagccagcctcagaccttagcttgaagcagcttgaggccagacctactgtagcctcagcatcttgctaggaggcatggaagtgatctatcctgccaggaggcctcagagtgatctgtcctgccaggaggtgtgagagtgatctgtcctgtgaggcatttaggggctttcaggaatttagtaaaaggtggagtatgcctttccagtatcttccatcttcctttgtatacttgtccttcctcccatttcctccctttggcccgaggtaggaggatggagggaggctgctactctaccacttcctgtgtgcctctactgtggcctcaaccctggcaattatagctactcccatcccttacctgggcatgtgtgagcccttctcactggattttatacccttgtgtctgtgtacataaatatatatacatatatatatacataaaaactttgtacaaaag

SEQ ID NO: 428176 - DNA, 2310 bp, Homo sapiens
  misc_feature (25)..(25): n is a, c, g, or t
  misc_feature (29)..(29): n is a, c, g, or t
aaaaggccggctggtacggtcgggngtanggatcggcagagctgccgccattttgcgggaagaggaggcgctgtacctgcagtgctgcttttcttgcctagactctaggaactatccgagctccactccccacaacatactcaaaggaacggagagaaccgggacccccctgcggggacccggaactggatgagcaacaaaggaaagaagttaaaaaggattatcctagcaataccaccagcagcaccagcaacagtggcaatgagaccagtggaagcagcaccatcggggagacaagcaatcgtagtcgagatcgggatcggtatagacggagaaatagtcggagccgaagtccaggtcggcagtgtcgtcaccgtagccgtagctgggatcgtcgacatggtagtgagtcgcgaagtcgggaccatcgtcgtgaggatcgtgtgcattacaggagtcctccacttgccactggggagccagttgataatctgagtcctgaggagcgtgatgcccgcacagttttctgtatgcagttagctgcccgaattcggcctcgagatctggaggactttttctctgctgtaggcaaggttcgcgatgtacgtatcatctcagatcggaactcacgtcgttctaagggcattgcctacgtggaattctgtgaaatccagtctgtgccactggccattgggctgactgggcagcggttgctgggagtgcctatcattgtacaggcttcacaggcagagaaaaaccgactggcagccatggccaacaacctgcaaaagggcaatggtggaccaatgcgcctctatgtgggttccctgcacttcaatatcactgaagacatgctccggggcatctttgagccctttggtaaaattgataatattgtcctgatgaaggactcagatacaggccgctctaaaggttatggtttcatcacgttctctgattctgagtgtgcccggcgggccctggaacagttgaatgggtttgagcttgctggtcgacctatgagggttggccatgtgactgagcgactggatggtggcacagacatcacttttcctgatggggaccaggagctggatctgggatcagcaggtggacgttttcagctcatggcaaaactggcagaaggcgctggaatccaactgccaagcactgctgctgctgctgctgccgccgccgccgcccaggctgctgccttgcaactgaatggagcagttcccttgggggccctgaatccagcagctctgactgctctgagtccagccctgaaccttgcctcccagtgtttccagctctccagcctctttaccccccagaccatgtaaatcagtggcacagtatactgcctccttgtgcctctggatcctgccacttcacatctactcttccatggccccatttctccattttgtggaccaagccatcctgagggcatggacattgtctctgaggaaattggggccacccttaagataccaagaaaagctcctgcccatggtcccactggaaatggactctgctgagcaaagccaccagttgaagagaacagaatccacacctgcattgaatacctgtttctccatgtgtatcgtctctgagattaccttcttgccctttccaacaccttagtgattcctcaatttctcccccattgggaaggccatagggcattaactgaaggaactgacctctctccttttcctgtacctttaacctttagtctgtcaaggaaaacccttaggacctctgaatcaagaggactgagtttgtgggtgaaccttgaaggtgctctttctgctacaagggccctgggagatagcatggacgtgcattgagaagccagcctcagaccttagcttgaagcagcttgaggccagacctactgtagcctcagcatcttgctaggaggcatggaagtgatctatcctgccaggaggcctcagagtgatctgtcctgccaggaggtgtgagagtgatctgtcctgtgaggcatttaggggctttcaggaatttagtaaaaggtggagtatgcctttccagtatcttccatcttcctttgtatacttgtccttcctcccatttcctccctttggcccgaggtaggaggatggagggaggctgctactctaccacttcctgtgtgcctctactgtggcctcaaccctggcaattatagctactcccatcccttacctgggcatgtgtgagcccttctcactggattttatacccttgtgtctgtgtacataaatatatatacatatatatatacataaaaactttgtacaaaag

SEQ ID NO: 428177 - DNA, 1948 bp, Homo sapiens
atgaataaaaggttatttgagccaaattacaggaatgtgtaatacttgagggttagctggagaacaatgaccaggtattgggagggctggtctcaacacatttcactcttcagggagccagttgataatctgagtcctgaggagcgtgatgcccgcacagttttctgtatgcagttagctgcccgaattcggcctcgagatctggaggactttttctctgctgtaggcaaggttcgcgatgtacgtatcatctcagatcggaactcacgtcgttctaagggcattgcctacgtggaattctgtgaaatccagtctgtgccactggccattgggctgactgggcagcggttgctgggagtgcctatcattgtacaggcttcacaggcagagaaaaaccgactggcagccatggccaacaacctgcaaaagggcaatggtggaccaatgcgcctctatgtgggttccctgcacttcaatatcactgaagacatgctccggggcatctttgagccctttggtaaaattgataatattgtcctgatgaaggactcagatacaggccgctctaaaggttatggtttcatcacgttctctgattctgagtgtgcccggcgggccctggaacagttgaatgggtttgagcttgctggtcgacctatgagggttggccatgtgactgagcgactggatggtggcacagacatcacttttcctgatggggaccaggagctggatctgggatcagcaggtggacgttttcagctcatggcaaaactggcagaaggcgctggaatccaactgccaagcactgctgctgctgctgctgccgccgccgccgcccaggctgctgccttgcaactgaatggagcagttcccttgggggccctgaatccagcagctctgactgctctgagtccagccctgaaccttgcctcccagtgtttccagctctccagcctctttaccccccagaccatgtaaatcagtggcacagtatactgcctccttgtgcctctggatcctgccacttcacatctactcttccatggccccatttctccattttgtggaccaagccatcctgagggcatggacattgtctctgaggaaattggggccacccttaagataccaagaaaagctcctgcccatggtcccactggaaatggactctgctgagcaaagccaccagttgaagagaacagaatccacacctgcattgaatacctgtttctccatgtgtatcgtctctgagattaccttcttgccctttccaacaccttagtgattcctcaatttctcccccattgggaaggccatagggcattaactgaaggaactgacctctctccttttcctgtacctttaacctttagtctgtcaaggaaaacccttaggacctctgaatcaagaggactgagtttgtgggtgaaccttgaaggtgctctttctgctacaagggccctgggagatagcatggacgtgcattgagaagccagcctcagaccttagcttgaagcagcttgaggccagacctactgtagcctcagcatcttgctaggaggcatggaagtgatctatcctgccaggaggcctcagagtgatctgtcctgccaggaggtgtgagagtgatctgtcctgtgaggcatttaggggctttcaggaatttagtaaaaggtggagtatgcctttccagtatcttccatcttcctttgtatacttgtccttcctcccatttcctccctttggcccgaggtaggaggatggagggaggctgctactctaccacttcctgtgtgcctctactgtggcctcaaccctggcaattatagctactcccatcccttacctgggcatgtgtgagcccttctcactggattttatacccttgtgtctgtgtacataaatatatatacatatatatatacataaaaactttgtacaaaag

SEQ ID NO: 428178 - DNA, 1784 bp, Homo sapiens
aagctagtaagctcggtgaatcggcagaggtggctcagattgaggacttttctctgctgtaggcaaggttcgcgatgtacgtatcatctcagatcggaactcacgtcgttctaagggcattgcctacgtggaattctgtgaaatccagtctgtgccactggccattgggctgactgggcagcggttgctgggagtgcctatcattgtacaggcttcacaggcagagaaaaaccgactggcagccatggccaacaacctgcaaaagggcaatggtggaccaatgcgcctctatgtgggttccctgcacttcaatatcactgaagacatgctccggggcatctttgagccctttggtaaaattgataatattgtcctgatgaaggactcagatacaggccgctctaaaggttatggtttcatcacgttctctgattctgagtgtgcccggcgggccctggaacagttgaatgggtttgagcttgctggtcgacctatgagggttggccatgtgactgagcgactggatggtggcacagacatcacttttcctgatggggaccaggagctggatctgggatcagcaggtggacgttttcagctcatggcaaaactggcagaaggcgctggaatccaactgccaagcactgctgctgctgctgctgccgccgccgccgcccaggctgctgccttgcaactgaatggagcagttcccttgggggccctgaatccagcagctctgactgctctgagtccagccctgaaccttgcctcccagtgtttccagctctccagcctctttaccccccagaccatgtaaatcagtggcacagtatactgcctccttgtgcctctggatcctgccacttcacatctactcttccatggccccatttctccattttgtggaccaagccatcctgagggcatggacattgtctctgaggaaattggggccacccttaagataccaagaaaagctcctgcccatggtcccactggaaatggactctgctgagcaaagccaccagttgaagagaacagaatccacacctgcattgaatacctgtttctccatgtgtatcgtctctgagattaccttcttgccctttccaacaccttagtgattcctcaatttctcccccattgggaaggccatagggcattaactgaaggaactgacctctctccttttcctgtacctttaacctttagtctgtcaaggaaaacccttaggacctctgaatcaagaggactgagtttgtgggtgaaccttgaaggtgctctttctgctacaagggccctgggagatagcatggacgtgcattgagaagccagcctcagaccttagcttgaagcagcttgaggccagacctactgtagcctcagcatcttgctaggaggcatggaagtgatctatcctgccaggaggcctcagagtgatctgtcctgccaggaggtgtgagagtgatctgtcctgtgaggcatttaggggctttcaggaatttagtaaaaggtggagtatgcctttccagtatcttccatcttcctttgtatacttgtccttcctcccatttcctccctttggcccgaggtaggaggatggagggaggctgctactctaccacttcctgtgtgcctctactgtggcctcaaccctggcaattatagctactcccatcccttacctgggcatgtgtgagcccttctcactggattttatacccttgtgtctgtgtacataaatatatatacatatatatatacataaaaactttgtacaaaag

SEQ ID NO: 428179 - DNA, 1648 bp, Homo sapiens
  misc_feature (24)..(24): n is a, c, g, or t
gaataggctaggtcgaggccgggngttaatcggccgagtgggcagcggttgctgggagtgcctatcattgtacaggcttcacaggcagagaaaaaccgactggcagccatggccaacaacctgcaaaagggcaatggtggaccaatgcgcctctatgtgggttccctgcacttcaatatcactgaagacatgctccggggcatctttgagccctttggtaaaattgataatattgtcctgatgaaggactcagatacaggccgctctaaaggttatggtttcatcacgttctctgattctgagtgtgcccggcgggccctggaacagttgaatgggtttgagcttgctggtcgacctatgagggttggccatgtgactgagcgactggatggtggcacagacatcacttttcctgatggggaccaggagctggatctgggatcagcaggtggacgttttcagctcatggcaaaactggcagaaggcgctggaatccaactgccaagcactgctgctgctgctgctgccgccgccgccgcccaggctgctgccttgcaactgaatggagcagttcccttgggggccctgaatccagcagctctgactgctctgagtccagccctgaaccttgcctcccagtgtttccagctctccagcctctttaccccccagaccatgtaaatcagtggcacagtatactgcctccttgtgcctctggatcctgccacttcacatctactcttccatggccccatttctccattttgtggaccaagccatcctgagggcatggacattgtctctgaggaaattggggccacccttaagataccaagaaaagctcctgcccatggtcccactggaaatggactctgctgagcaaagccaccagttgaagagaacagaatccacacctgcattgaatacctgtttctccatgtgtatcgtctctgagattaccttcttgccctttccaacaccttagtgattcctcaatttctcccccattgggaaggccatagggcattaactgaaggaactgacctctctccttttcctgtacctttaacctttagtctgtcaaggaaaacccttaggacctctgaatcaagaggactgagtttgtgggtgaaccttgaaggtgctctttctgctacaagggccctgggagatagcatggacgtgcattgagaagccagcctcagaccttagcttgaagcagcttgaggccagacctactgtagcctcagcatcttgctaggaggcatggaagtgatctatcctgccaggaggcctcagagtgatctgtcctgccaggaggtgtgagagtgatctgtcctgtgaggcatttaggggctttcaggaatttagtaaaaggtggagtatgcctttccagtatcttccatcttcctttgtatacttgtccttcctcccatttcctccctttggcccgaggtaggaggatggagggaggctgctactctaccacttcctgtgtgcctctactgtggcctcaaccctggcaattatagctactcccatcccttacctgggcatgtgtgagcccttctcactggattttatacccttgtgtctgtgtacataaatatatatacatatatatatacataaaaactttgtacaaaag

SEQ ID NO: 428180 - DNA, 2561 bp, Homo sapiens
agcggggggaagggttctggaagacggcagagctgccgccattttgcgggaagaggaggcgctgtacctgcagtgctgcttttcttgcctagactctaggaactatccgagctccactccccacaacatactcaaaggaacggagagaaccgggacccccctgcggggacccggaactgatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaatcgtagtcgagatcgggatcggtatagacggagaaatagtcggagccgaagtccaggtcggcagtgtcgtcaccgtagccgtagctgggatcgtcgacatggtagtgagtcgcgaagtcgggaccatcgtcgtgaggatcgtgtgcattacaggagtcctccacttgccactggttataggtatggacacagtaagagtcctcatttcagagagaagagcccagtcagggagccagttgataatctgagtcctgaggagcgtgatgcccgcacagttttctgtatgcagttagctgcccgaattcggcctcgagatctggaggactttttctctgctgtaggcaaggttcgcgatgtacgtatcatctcagatcggaactcacgtcgttctaagggcattgcctacgtggaattctgtgaaatccagtctgtgccactggccattgggctgactgggcagcggttgctgggagtgcctatcattgtacaggcttcacaggcagagaaaaaccgactggcagccatggccaacaacctgcaaaagggcaatggtggaccaatgcgcctctatgtgggttccctgcacttcaatatcactgaagacatgctccggggcatctttgagccctttggtaaaattgataatattgtcctgatgaaggactcagatacaggccgctctaaaggttatggtttcatcacgttctctgattctgagtgtgcccggcgggccctggaacagttgaatgggtttgagcttgctggtcgacctatgagggttggccatgtgactgagcgactggatggtggcacagacatcacttttcctgatggggaccaggagctggatctgggatcagcaggtggacgttttcagctcatggcaaaactggcagaaggcgctggaatccaactgccaagcactgctgctgctgctgctgccgccgccgccgcccaggctgctgccttgcaactgaatggagcagttcccttgggggccctgaatccagcagctctgactgctctgagtccagccctgaaccttgcctcccagtgtttccagctctccagcctctttaccccccagaccatgtaaatcagtggcacagtatactgcctccttgtgcctctggatcctgccacttcacatctactcttccatggccccatttctccattttgtggaccaagccatcctgagggcatggacattgtctctgaggaaattggggccacccttaagataccaagaaaagctcctgcccatggtcccactggaaatggactctgctgagcaaagccaccagttgaagagaacagaatccacacctgcattgaatacctgtttctccatgtgtatcgtctctgagattaccttcttgccctttccaacaccttagtgattcctcaatttctcccccattgggaaggccatagggcattaactgaaggaactgacctctctccttttcctgtacctttaacctttagtctgtcaaggaaaacccttaggacctctgaatcaagaggactgagtttgtgggtgaaccttgaaggtgctctttctgctacaagggccctgggagatagcatggacgtgcattgagaagccagcctcagaccttagcttgaagcagcttgaggccagacctactgtagcctcagcatcttgctaggaggcatggaagtgatctatcctgccaggaggcctcagagtgatctgtcctgccaggaggtgtgagagtgatctgtcctgtgaggcatttaggggctttcaggaatttagtaaaaggtggagtatgcctttccagtatcttccatcttcctttgtatacttgtccttcctcccatttcctccctttggcccgaggtaggaggatggagggaggctgctactctaccacttcctgtgtgcctctactgtggcctcaaccctggcaattatagctactcccatcccttacctgggcatgtgtgagcccttctcactggattttatacccttgtgtctgtgtacataaatatatatacatatatatatacataaaaactttgtacaaaaggcaagcctcctccttgtggcagctgttgcccatttgtgtgtggtctttgttgtgtgtctgacaacttctcattagcccaacttatgatgtttctagggatataaaacattagtaacatcaagagaaaatt

SEQ ID NO: 428181 - DNA, 1319 bp, Homo sapiens
aagtgtgctgggtgatctagaggatcccggtattgagtggcatgtgactgagcgactggatggtggcacagacatcacttttcctgatggggaccaggagctggatctgggatcagcaggtggacgttttcagctcatggcaaaactggcagaaggcgctggaatccaactgccaagcactgctgctgctgctgctgccgccgccgccgcccaggctgctgccttgcaactgaatggagcagttcccttgggggccctgaatccagcagctctgactgctctgagtccagccctgaaccttgcctcccagtgtttccagctctccagcctctttaccccccagaccatgtaaatcagtggcacagtatactgcctccttgtgcctctggatcctgccacttcacatctactcttccatggccccatttctccattttgtggaccaagccatcctgagggcatggacattgtctctgaggaaattggggccacccttaagataccaagaaaagctcctgcccatggtcccactggaaatggactctgctgagcaaagccaccagttgaagagaacagaatccacacctgcattgaatacctgtttctccatgtgtatcgtctctgagattaccttcttgccctttccaacaccttagtgattcctcaatttctcccccattgggaaggccatagggcattaactgaaggaactgacctctctccttttcctgtacctttaacctttagtctgtcaaggaaaacccttaggacctctgaatcaagaggactgagtttgtgggtgaaccttgaaggtgctctttctgctacaagggccctgggagatagcatggacgtgcattgagaagccagcctcagaccttagcttgaagcagcttgaggccagacctactgtagcctcagcatcttgctaggaggcatggaagtgatctatcctgccaggaggcctcagagtgatctgtcctgccaggaggtgtgagagtgatctgtcctgtgaggcatttaggggctttcaggaatttagtaaaaggtggagtatgcctttccagtatcttccatcttcctttgtatacttgtccttcctcccatttcctccctttggcccgaggtaggaggatggagggaggctgctactctaccacttcctgtgtgcctctactgtggcctcaaccctggcaattatagctactcccatcccttacctgggcatgtgtgagcccttctcactggattttatacccttgtgtctgtgtacataaatatatatacatatatatatacataaaaactttgtacaaaag

SEQ ID NO: 428182 - DNA, 2517 bp, Homo sapiens
  misc_feature (2508)..(2508): n is a, c, g, or t
agcggggggaagggttctggaagacggcagagctgccgccattttgcgggaagaggaggcgctgtacctgcagtgctgcttttcttgcctagactctaggaactatccgagctccactccccacaacatactcaaaggaacggagagaaccgggacccccctgcggggacccggaactgatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaatcgtagtcgagatcgggatcggtatagacggagaaatagtcggagccgaagtccaggtcggcagtgtcgtcaccgtagccgtagctgggatcgtcgacatggtagtgagtcgcgaagtcgggaccatcgtcgtgaggatcgtgtgcattacaggagtcctccacttgccactggttataggtatggacacagtaagagtcctcatttcagagagaagagcccagtcagggagccagttgataatctgagtcctgaggagcgtgatgcccgcacagttttctgtatgcagttagctgcccgaattcggcctcgagatctggaggactttttctctgctgtaggcaaggttcgcgatgtacgtatcatctcagatcggaactcacgtcgttctaagggcattgcctacgtggaattctgtgaaatccagtctgtgccactggccattgggctgactgggcagcggttgctgggagtgcctatcattgtacaggcttcacaggcagagaaaaaccgactggcagccatggccaacaacctgcaaaagggcaatggtggaccaatgcgcctctatgtgggttccctgcacttcaatatcactgaagacatgctccggggcatctttgagccctttggtaaaattgataatattgtcctgatgaaggactcagatacaggccgctctaaaggttatggtttcatcacgttctctgattctgagtgtgcccggcgggccctggaacagttgaatgggtttgagcttgctggtcgacctatgagggttggccatgtgactgagcgactggatggtggcacagacatcacttttcctgatggggaccaggagctggatctgggatcagcaggtggacgttttcagctcatggcaaaactggcagaaggcgctggaatccaactgccaagcactgctgctgctgctgctgccgccgccgccgcccaggctgctgccttgcaactgaatggagcagttcccttgggggccctgaatccagcagctctgactgctctgagtccagccctgaaccttgcctcccagtgtttccagctctccagcctctttaccccccagaccatgtaaatcagtggcacagtatactgcctccttgtgcctctggatcctgccacttcacatctactcttccatggccccatttctccattttgtggaccaagccatcctgagggcatggacattgtctctgaggaaattggggccacccttaagataccaagaaaagctcctgcccatggtcccactggaaatggactctgctgagcaaagccaccagttgaagagaacagaatccacacctgcattgaatacctgtttctccatgtgtatcgtctctgagattaccttcttgccctttccaacaccttagtgattcctcaatttctcccccattgggaaggccatagggcattaactgaaggaactgacctctctccttttcctgtacctttaacctttagtctgtcaaggaaaacccttaggacctctgaatcaagaggactgagtttgtgggtgaaccttgaaggtgctctttctgctacaagggccctgggagatagcatggacgtgcattgagaagccagcctcagaccttagcttgaagcagcttgaggccagacctactgtagcctcagcatcttgctaggaggcatggaagtgatctatcctgccaggaggcctcagagtgatctgtcctgccaggaggtgtgagagtgatctgtcctgtgaggcatttaggggctttcaggaatttagtaaaaggtggagtatgcctttccagtatcttccatcttcctttgtatacttgtccttcctcccatttcctccctttggcccgaggtaggaggatggagggaggctgctactctaccacttcctgtgtgcctctactgtggcctcaaccctggcaattatagctactcccatcccttacctgggcatgtgtgagcccttctcactggattttatacccttgtgtctgtgtacataaatatatatacatatatatatacataaaaactttgtacaaaagaaataaaaaaaataaacgggcggccgctttctagagatatgccctcgaagggcccaagcatatacgcggtacccagnctttctatg

SEQ ID NO: 428183 - DNA, 1361 bp, Homo sapiens
agagccaacaactgcctgcgagcagccttggaggcgtcacagtaaggcatgaatgttgggtgacagggcctcacgtcgttgcacaggctggtttgagtacctggggtcaagcaatccttctgctgtggccgccgggccagtactggatctgggatcagcaggtggacgttttcagctcatggcaaaactggcagaaggcgctggaatccaactgccaagcactgctgctgctgctgctgccgccgccgccgcccaggctgctgccttgcaactgaatggagcagttcccttgggggccctgaatccagcagctctgactgctctgagtccagccctgaaccttgcctcccagtgtttccagctctccagcctctttaccccccagaccatgtaaatcagtggcacagtatactgcctccttgtgcctctggatcctgccacttcacatctactcttccatggccccatttctccattttgtggaccaagccatcctgagggcatggacattgtctctgaggaaattggggccacccttaagataccaagaaaagctcctgcccatggtcccactggaaatggactctgctgagcaaagccaccagttgaagagaacagaatccacacctgcattgaatacctgtttctccatgtgtatcgtctctgagattaccttcttgccctttccaacaccttagtgattcctcaatttctcccccattgggaaggccatagggcattaactgaaggaactgacctctctccttttcctgtacctttaacctttagtctgtcaaggaaaacccttaggacctctgaatcaagaggactgagtttgtgggtgaaccttgaaggtgctctttctgctacaagggccctgggagatagcatggacgtgcattgagaagccagcctcagaccttagcttgaagcagcttgaggccagacctactgtagcctcagcatcttgctaggaggcatggaagtgatctatcctgccaggaggcctcagagtgatctgtcctgccaggaggtgtgagagtgatctgtcctgtgaggcatttaggggctttcaggaatttagtaaaaggtggagtatgcctttccagtatcttccatcttcctttgtatacttgtccttcctcccatttcctccctttggcccgaggtaggaggatggagggaggctgctactctaccacttcctgtgtgcctctactgtggcctcaaccctggcaattatagctactcccatcccttacctgggcatgtgtgagcccttctcactggattttatacccttgtgtctgtgtacataaatatatatacatatatatatacataaaaactttgtacaaaag

SEQ ID NO: 428184 - DNA, 1273 bp, Homo sapiens
atggtgacacgtgattagctggaagctcgcacgtccgtactggcccggccagtactggatctgggatcagcaggtggacgttttcagctcatggcaaaactggcagaaggcgctggaatccaactgccaagcactgctgctgctgctgctgccgccgccgccgcccaggctgctgccttgcaactgaatggagcagttcccttgggggccctgaatccagcagctctgactgctctgagtccagccctgaaccttgcctcccagtgtttccagctctccagcctctttaccccccagaccatgtaaatcagtggcacagtatactgcctccttgtgcctctggatcctgccacttcacatctactcttccatggccccatttctccattttgtggaccaagccatcctgagggcatggacattgtctctgaggaaattggggccacccttaagataccaagaaaagctcctgcccatggtcccactggaaatggactctgctgagcaaagccaccagttgaagagaacagaatccacacctgcattgaatacctgtttctccatgtgtatcgtctctgagattaccttcttgccctttccaacaccttagtgattcctcaatttctcccccattgggaaggccatagggcattaactgaaggaactgacctctctccttttcctgtacctttaacctttagtctgtcaaggaaaacccttaggacctctgaatcaagaggactgagtttgtgggtgaaccttgaaggtgctctttctgctacaagggccctgggagatagcatggacgtgcattgagaagccagcctcagaccttagcttgaagcagcttgaggccagacctactgtagcctcagcatcttgctaggaggcatggaagtgatctatcctgccaggaggcctcagagtgatctgtcctgccaggaggtgtgagagtgatctgtcctgtgaggcatttaggggctttcaggaatttagtaaaaggtggagtatgcctttccagtatcttccatcttcctttgtatacttgtccttcctcccatttcctccctttggcccgaggtaggaggatggagggaggctgctactctaccacttcctgtgtgcctctactgtggcctcaaccctggcaattatagctactcccatcccttacctgggcatgtgtgagcccttctcactggattttatacccttgtgtctgtgtacataaatatatatacatatatatatacataaaaactttgtacaaaag

SEQ ID NO: 428185 - DNA, 1637 bp, Homo sapiens
agcggggggaagggttctggaagacggcagagctgccgccattttgcgggaagaggaggcgctgtacctgcagtgctgcttttcttgcctagactctaggaactatccgagctccactccccacaacatactcaaaggaacggagagaaccgggacccccctgcggggacccggaactgatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaatcgtagtcgagatcgggatcggtatagacggagaaatagtcggagccgaagtccaggtcggcagtgtcgtcaccgtagccgtagctgggatcgtcgacatggtagtgagtcgcgaagtcgggaccatcgtcgtgaggatcgtgtgcattacaggagtcctccacttgccactggttataggtatggacacagtaagagtcctcatttcagagagaagagcccagtcagctctgagtccagccctgaaccttgcctcccagtgtttccagctctccagcctctttaccccccagaccatgtaaatcagtggcacagtatactgcctccttgtgcctctggatcctgccacttcacatctactcttccatggccccatttctccattttgtggaccaagccatcctgagggcatggacattgtctctgaggaaattggggccacccttaagataccaagaaaagctcctgcccatggtcccactggaaatggactctgctgagcaaagccaccagttgaagagaacagaatccacacctgcattgaatacctgtttctccatgtgtatcgtctctgagattaccttcttgccctttccaacaccttagtgattcctcaatttctcccccattgggaaggccatagggcattaactgaaggaactgacctctctccttttcctgtacctttaacctttagtctgtcaaggaaaacccttaggacctctgaatcaagaggactgagtttgtgggtgaaccttgaaggtgctctttctgctacaagggccctgggagatagcatggacgtgcattgagaagccagcctcagaccttagcttgaagcagcttgaggccagacctactgtagcctcagcatcttgctaggaggcatggaagtgatctatcctgccaggaggcctcagagtgatctgtcctgccaggaggtgtgagagtgatctgtcctgtgaggcatttaggggctttcaggaatttagtaaaaggtggagtatgcctttccagtatcttccatcttcctttgtatacttgtccttcctcccatttcctccctttggcccgaggtaggaggatggagggaggctgctactctaccacttcctgtgtgcctctactgtggcctcaaccctggcaattatagctactcccatcccttacctgggcatgtgtgagcccttctcactggattttatacccttgtgtctgtgtacataaatatatatacatatatatatacataaaaactttgtacaaaag

SEQ ID NO: 428186 - DNA, 2404 bp, Homo sapiens
agcggggggaagggttctggaagacggcagagctgccgccattttgcgggaagaggaggcgctgtacctgcagtgctgcttttcttgcctagactctaggaactatccgagctccactccccacaacatactcaaaggaacggagagaaccgggacccccctgcggggacccggaactgatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaatcgtagtcgagatcgggatcggtatagacggagaaatagtcggagccgaagtccaggtcggcagtgtcgtcaccgtagccgtagctgggatcgtcgacatggtagtgagtcgcgaagtcgggaccatcgtcgtgaggatcgtgtgcattacaggagtcctccacttgccactggttataggtatggacacagtaagagtcctcatttcagagagaagagcccagtcagggagccagttgataatctgagtcctgaggagcgtgatgcccgcacagttttctgtatgcagttagctgcccgaattcggcctcgagatctggaggactttttctctgctgtaggcaaggttcgcgatgtacgtatcatctcagatcggaactcacgtcgttctaagggcattgcctacgtggaattctgtgaaatccagtctgtgccactggccattgggctgactgggcagcggttgctgggagtgcctatcattgtacaggcttcacaggcagagaaaaaccgactggcagccatggccaacaacctgcaaaagggcaatggtggaccaatgcgcctctatgtgggttccctgcacttcaatatcactgaagacatgctccggggcatctttgagccctttggtaaaattgataatattgtcctgatgaaggactcagatacaggccgctctaaaggttatggtttcatcacgttctctgattctgagtgtgcccggcgggccctggaacagttgaatgggtttgagcttgctggtcgacctatgagggttggccatgtgactgagcgactggatggtggcacagacatcacttttcctgatggggaccaggagctggatctgggatcagcaggtggacgttttcagctcatggcaaaactggcagaaggcgctggaatccaactgccaagcactgctgctgctgctgctgccgccgccgccgcccaggctgctgccttgcaactgaatggagcagttcccttgggggccctgaatccagcagctctgactgctctgagtccagccctgaaccttgcctcccagtgtttccagctctccagcctctttaccccccagaccatgtaaatcagtggcacagtatactgcctccttgtgcctctggatcctgccacttcacatctactcttccatggccccatttctccattttgtggaccaagccatcctgagggcatggacattgtctctgaggaaattggggccacccttaagataccaagaaaagctcctgcccatggtcccactggaaatggactctgctgagcaaagccaccagttgaagagaacagaatccacacctgcattgaatacctgtttctccatgtgtatcgtctctgagattaccttcttgccctttccaacaccttagtgattcctcaatttctcccccattgggaaggccatagggcattaactgaaggaactgacctctctccttttcctgtacctttaacctttagtctgtcaaggaaaacccttaggacctctgaatcaagaggactgagtttgtgggtgaaccttgaaggtgctctttctgctacaagggccctgggagatagcatggacgtgcattgagaagccagcctcagaccttagcttgaagcagcttgaggccagacctactgtagcctcagcatcttgctaggaggcatggaagtgatctatcctgccaggaggcctcagaagtgatctgtcctgtgaggcatttaggggctttcaggaatttagtaaaaggtggagtatgcctttccagtatcttccatcttcctttgtatacttgtccttcctcccatttcctccctttggcccgaggtaggaggatggagggaggctgctactctaccacttcctgtgtgcctctactgtggcctcaaccctggcaattatagctactcccatcccttacctgggcatgtgtgagcccttctcactggattttatacccttgtgtctgtgtacataaatatatatacatatatatatacataaaaactttgtacaaaag

SEQ ID NO: 428187 - DNA, 2377 bp, Homo sapiens
agcggggggaagggttctggaagacggcagagctgccgccattttgcgggaagaggaggcgctgtacctgcagtgctgcttttcttgcctagactctaggaactatccgagctccactccccacaacatactcaaaggaacggagagaaccgggacccccctgcggggacccggaactgatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaatcgtagtcgagatcgggatcggtatagacggagaaatagtcggagccgaagtccaggtcggcagtgtcgtcaccgtagccgtagctgggatcgtcgacatggtagtgagtcgcgaagtcgggaccatcgtcgtgaggatcgtgtgcattacaggagtcctccacttgccactggttataggtatggacacagtaagagtcctcatttcagagagaagagcccagtcagggagccagttgataatctgagtcctgaggagcgtgatgcccgcacagttttctgtatgcagttagctgcccgaattcggcctcgagatctggaggactttttctctgctgtaggcaaggttcgcgatgtacgtatcatctcagatcggaactcacgtcgttctaagggcattgcctacgtggaattctgtgaaatccagtctgtgccactggccattgggctgactgggcagcggttgctgggagtgcctatcattgtacaggcttcacaggcagagaaaaaccgactggcagccatggccaacaacctgcaaaagggcaatggtggaccaatgcgcctctatgtgggttccctgcacttcaatatcactgaagacatgctccggggcatctttgagccctttggtaaaattgataatattgtcctgatgaaggactcagatacaggccgctctaaaggttatggtttcatcacgttctctgattctgagtgtgcccggcgggccctggaacagttgaatgggtttgagcttgctggtcgacctatgagggttggccatgtgactgagcgactggatggtggcacagacatcacttttcctgatggggaccaggagctggatctgggatcagcaggtggacgttttcagctcatggcaaaactggcagaaggcgctggaatccaactgccaagcactgctgctgctgctgctgccgccgccgccgcccaggctgctgccttgcaactgaatggagcagttcccttgggggccctgaatccagcagctctgactgctctgagtccagccctgaaccttgcctcccagtgtttccagctctccagcctctttaccccccagaccatgtaaatcagtggcacagtatactgcctccttgtgcctctggatcctgccacttcacatctactcttccatggccccatttctccattttgtggaccaagccatcctgagggcatggacattgtctctgaggaaattggggccacccttaagataccaagaaaagctcctgcccatggtcccactggaaatggactctgctgagcaaagccaccagttgaagagaacagaatccacacctgcattgaatacctgtttctccatgtgtatcgtctctgagattaccttcttgccctttccaacaccttagtgattcctcaatttctcccccattgggaaggccatagggcattaactgaaggaactgacctctctccttttcctgtacctttaacctttagtctgtcaaggaaaacccttaggacctctgaatcaagaggactgagtttgtgggtgaaccttgaaggtgctctttctgctacaagggccctgggagatagcatggacgtgcattgagaagccagcctcagaccttagcttgaagcagcttgaggccagacctactgtagcctcagcatcttgctaggaggcatggaagtgatctatcctgccaggaggcctcagagtgatctgtcctgccaggaggtgtgagagtgatctgtcctgtgaggcatttaggggctttcaggaatttagtttcctcccatttcctccctttggcccgaggtaggaggatggagggaggctgctactctaccacttcctgtgtgcctctactgtggcctcaaccctggcaattatagctactcccatcccttacctgggcatgtgtgagcccttctcactggattttatacccttgtgtctgtgtacataaatatatatacatatatatatacataaaaactttgtacaaaag

SEQ ID NO: 428188 - DNA, 1635 bp, Homo sapiens
agcggggggaagggttctggaagacggcagagctgccgccattttgcgggaagaggaggcgctgtacctgcagtgctgcttttcttgcctagactctaggaactatccgagctccactccccacaacatactcaaaggaacggagagaaccgggacccccctgcggggacccggaactgatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaatcgtagtcgagatcgggatcggtatagacggagaaatagtcggagccgaagtccaggtcggcagtgtcgtcaccgtagccgtagctgggatcgtcgacatggtagtgagtcgcgaagtcgggaccatcgtcgtgaggatcgtgtgcattacaggagtcctccacttgccactggttataggtatggacacagtaagagtcctcatttcagagagaagagcccagtcagggagccagttgataatctgagtcctgaggagcgtgatgcccgcacagttttctgtatgcagttagctgcccgaattcggcctcgagatctggaggactttttctctgctgtaggcaaggttcgcgatgtacgtatcatctcagatcggaactcacgtcgttctaagggcattgcctacgtggaattctgtgaaatccagtctgtgccactggccattgggctgactgggcagcggttgctgggagtgcctatcattgtacaggcttcacaggcagagaaaaaccgactggcagccatggccaacaacctgcaaaagggcaatggtggaccaatgcgcctctatgtgggttccctgcacttcaatatcactgaagacatgctccggggcatctttgagccctttggtaaaattgataatattgtcctgatgaaggactcagatacaggccgctctaaaggttatggtttcatcacgttctctgattctgagtgtgcccggcgggccctggaacagttgaatgggtttgagcttgctggtcgacctatgagggttggccatgtgactgagcgactggatggtggcacagacatcacttttcctgatggggaccaggagctggatctgggatcagcaggtggacgttttcagctcatggcaaaactggcagaaggcgctggaatccaactgccaagcactgctgctgctgctgctgccgccgccgccgcccaggctgctgccttgcaactgaatggagcagttcccttgggggccctgaatccagcagctctgactgctctgagtccagccctgaaccttgcctcccagtgtttccagctctccagcctctttaccccccagaccatgtaaatcagtggcacagtatactgcctccttgtgcctctggatcctgccacttcacatctactcttccatggccccatttctccattttgtggaccaagccatcctgagggtggcttgtccgggggattgggggccccttagtacagaaagtcctcggctggcctgggaggactg

SEQ ID NO: 428189 - DNA, 1553 bp, Homo sapiens
agcggggggaagggttctggaagacggcagagctgccgccattttgcgggaagaggaggcgctgtacctgcagtgctgcttttcttgcctagactctaggaactatccgagctccactccccacaacatactcaaaggaacggagagaaccgggacccccctgcggggacccggaactgatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaatcgtagtcgagatcgggatcggtatagacggagaaatagtcggagccgaagtccaggtcggcagtgtcgtcaccgtagccgtagctgggatcgtcgacatggtagtgagtcgcgaagtcgggaccatcgtcgtgaggatcgtgtgcattacaggagtcctccacttgccactggttataggtatggacacagtaagagtcctcatttcagagagaagagcccagtcagggagccagttgataatctgagtcctgaggagcgtgatgcccgcacagttttctgtatgcagttagctgcccgaattcggcctcgagatctggaggactttttctctgctgtaggcaaggttcgcgatgtacgtatcatctcagatcggaactcacgtcgttctaagggcattgcctacgtggaattctgtgaaatccagtctgtgccactggccattgggctgactgggcagcggttgctgggagtgcctatcattgtacaggcttcacaggcagagaaaaaccgactggcagccatggccaacaacctgcaaaagggcaatggtggaccaatgcgcctctatgtgggttccctgcacttcaatatcactgaagacatgctccggggcatctttgagccctttggtaaaattgataatattgtcctgatgaaggactcagatacaggccgctctaaaggttatggtttcatcacgttctctgattctgagtgtgcccggcgggccctggaacagttgaatgggtttgagcttgctggtcgacctatgagggttggccatgtgactgagcgactggatggtggcacagacatcacttttcctgatggggaccaggagctggatctgggatcagcaggtggacgttttcagctcatggcaaaactggcagaaggcgctggaatccaactgccaagcactgctgctgctgctgctgccgccgccgccgcccaggctgctgccttgcaactgaatggagcagttcccttgggggccctgaatccagcagctctgactgctctgagtccagccctgaaccttgcctcccagtgtttccagctctccagcctctttaccccccagaccatgtaaatcagtggcacagtatactgcctccttgtgcctctggatcctgccacttcacatgccactcaataccgggatcctctaggtacctcagc

SEQ ID NO: 428190 - DNA, 665 bp, Homo sapiens
tggtgctgctgctgtcctggtggtgctgctgctgcttttcttgcctagactctaggaactatccgagctccactccccacaacatactcaaaggaacggagagaaccgggacccccctgcggggacccggaactgatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaagaagaagaggagtcggagccataataaaagcagggatagaaagcgcaggtcagtaattctgggccaggcacagtggctcgtatctttaatcctagcactttggaagccaaggcgggaggatcacttcaggccaggagttcaaaaccagcctgggcaacatagcaaaatcctgtctctacaaaaaatttaaaaattacccaggtgtagtagtacatgtttgtactcccagctacttgggaggctaaggctggaggattgcttgggcccaggagttcgaggttgcagtgagccgagattgcagcactaaactcctgcctgggcaacagatggagaacctgtct

SEQ ID NO: 428191 - DNA, 408 bp, Homo sapiens
  misc_feature (25)..(25): n is a, c, g, or t
  misc_feature (29)..(29): n is a, c, g, or t
aaaaggccggctggtacggtcgggngtanggatcggcagagctgccgccattttgcgggaagaggaggcgctgtacctgcagtgctgcttttcttgcctagactctaggaactatccgagctccactccccacaacatactcaaaggaacggagagaaccgggacccccctgcggggacccggaactggatggaagaaaacatactctatgtggatgagattgagtggaccttgacccataagttgggacatgaagagagcgtttgaaaactaccaacctgggccgggtgcagtggctcacgcctgtaatcccagcactttgggtggccgaggcgggcggatcacgaggtcaggagatcgcgaccatcctggctaacacggcgaaaccccgtctctactaaaaataca

SEQ ID NO: 428192 - DNA, 247 bp, Homo sapiens
aaggtttgggggtctggaaagaaggagtgcgcggtgcttgctcactcactctgcctgtctttgttctagctctgagtccagccctgaaccttgcctcccagtgtttccagctctccagcctctttaccccccagaccatgtgagtctcagggtctagctcattctagcctttgattattctctttcctttggcttcccatttacctcttctttccacaggtaaatcagtggcacagtatactgcctc

SEQ ID NO: 428193 - DNA, 480 bp, Homo sapiens
atggcatctgatgactttgacatagtgattgaggccatgctggaagctccctataaaaaagaagaggtaatattttccacctcactcctggaattgggttaatgagaaagagtagttgtcgatcatcactttcaactttcaacattttatgaatcctctttccctgcttatttattatgtagaataactaatcataaaaggcatagtcttagtaagctttgctggagactatggttaagagccatacttttagagacaacctcagaaaccggagtgggcacataatgtggtgttggtaatctgtgctttgctcaaaactcgaagtgacacagtagaaagtcactgtacctcagacctagcaccaatttcttttttttttcttttgagacagagtctcgctctgttgccaggctggagtgcagtggcacaatcttggctcactgcaacctccgcctcctgggttcaagccattctcatgcc

SEQ ID NO: 428194 - DNA, 161 bp, Homo sapiens
acttttcctgatggggaccaggagctggatctgggatcagcaggtggacgttttcagctcatggcaaaactggcagaaggtaaaatatctccgcaaggtgaagattatggggttgaattttagatgaagggttggggcttaatcccaccttttcttttcct

SEQ ID NO: 428195 - DNA, 437 bp, Homo sapiens
ggatttcttttgcgtcctggataggttcgcgatgtacgtatcatctcagatcggaactcacgtcgttctaagggcattgcctacgtggaattctgtgaaatccagtctgtgccactggccattgggctgactgggcagcggttgctgggagtgcctatcattgtacaggcttcacaggtgagcaggctgagaaacagacataagattttaaggggagagggaatgtgggacatgacccatcatttcctccttcacaggcagagaaaaaccgactggcagccatggccaacaacctgcaaaagggcaatggtggaccaatgcgcctctatgtgggttccctgcacttcaatatcactgaagacatgctccggggcatctttgagccctttggtaaagtgagtagaagtgagagaaacctctgaagggaattggaagaa

SEQ ID NO: 428196 - DNA, 1351 bp, Homo sapiens
agcggggggaagggttctggaagacggcagagctgccgccattttgcgggaagaggaggcgctgtacctgcagtgctgcttttcttgcctagactctaggaactatccgagctccactccccacaacatactcaaaggaacggagagaaccgggacccccctgcggggacccggaactgatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaatcgtagtcgagatcgggatcggtatagacggagaaatagtcggagccgaagtccaggtcggcagtgtcgtcaccgtagccgtagctgggatcgtcgacatggtagtgagtcgcgaagtcgggaccatcgtcgtgaggatcgtgtgcattacaggagtcctccacttgccactggttataggtatggacacagtaagagtcctcatttcagagagaagagcccagtcagggagccagttgataatctgagtcctgaggagcgtgatgcccgcacagttttctgtatgcagttagctgcccgaattcggcctcgagatctggaggactttttctctgctgtaggcaaggttcgcgatgtacgtatcatctcagatcggaactcacgtcgttctaagggcattgcctacgtggaattctgtgaaatccagtctgtgccactggccattgggctgactgggcagcggttgctgggagtgcctatcattgtacaggcttcacaggcagagaaaaaccgactggcagccatggccaacaacctgcaaaagggcaatggtggaccaatgcgcctctatgtgggttccctgcacttcaatatcactgaagacatgctccggggcatctttgagccctttggtaaagtgagtagaagtgagagaaacctctgaagggaattggaagaagtggggagggtgagtgtttgagtgtacttctctgttgtgcctggccgtgattaacttgctgcatacgtcatagtgggcatatgagtctatgctgtgaaagtttggctccatctctgttcatgtgcttggtggacaaataagttagacacaaatcaaataataggccaggttaagaaagattaaaaaatacaaaaattagccaatgtggtggtgcacgcctatagtcccaactagtcgagaggctgaggtgggagggtcacttgagcctgggaggtcaaggctgtagtgagcctcggaaaaaaaa

SEQ ID NO: 428197 - DNA, 447 bp, Homo sapiens
tagcttagcttgtatctccctttatgcctaactcaggatttcttttgcgtcctggataggttcgcgatgtacgtatcatctcagatcggaactcacgtcgttctaagggcattgcctacgtggaattctgtgaaatccagtctgtgccactggccattgggctgactgggcagcggttgctgggagtgcctatcattgtacaggcttcacaggtgagcaggctgagaaacagacataagattttaaggggagagggaatgtgggacatgacccatcatttcctccttcacaggcagagaaaaaccgactggcagccatggccaacaacctgcaaaagggcaatggtggaccaatgcgcctctatgtgggttccctgcacttcaatatcactgaagacatgctccggggcatctttgagccctttggtaaagtgagtagaagtgagag

SEQ ID NO: 428198 - DNA, 516 bp, Homo sapiens
tgtctcatgcacaagccccaggctggtgtggagggcacagaagccatgcatctgcggaagtccctccgccagagcccaggcagcctgaaggccgtcctgaagacaatggaggagaagcagatcccggatgtggaaaccttcaggaatcttctgcccttgatgctccagatcgacccctcggatcgaataacgataaagtgagctcagggtcggggtttattttaacctgtggatttatctttcaacatctctccaccctaatacaagcacagctagttggctttgtaacgcctcaaagaactccatcacagatgccctgattatccctgcacagctgggctttgcccagttctggctctcccaaaccgtgctgcggcgagtaatcccgaatgtacggtggagtgagcagactgacccccaggaggcacaggaggcgtagcccccaggacccacgacacttttagggttccagaaaaaagttttcattctacataaaaaaaaaaattcctaaagaca

SEQ ID NO: 428199 - DNA, 1231 bp, Homo sapiens
tggatggatggatggggtgtgcgtggatggatgggtggacagacgggcagatggttggttctattggaggtgtagatggcatgcgtccttggagtccagccctttactgttgggctggggaatggaggtccagagaaggaggggctgcctgaagccaaccagggactgatggactcagaggagtctgctcttttgcctccctgtctggggttccagttgagaaagtagggcagagcaactgtaactttgcccccaaggtcctgacatttagaaggggcaagaagtttagaggggtgcacagtttcttggcacgtgcctcttccaactccttctacagccatccagggcacacagacacaccacctatatgggccagcctggtgggcacccaccaagatggacagcttcagtggctccagatcaacacaaagctcccgctgattggggcctcttcctccccacagttaatattctccacctcttctgagaagaggacctgcagggcttgtgtttcaagctgcttgcggggggccaccaaaggggatacagtgctgggcagggtgactctgtcaagcccctgcccccagggagcaaaggactcagggatcccaccttgcttttaccaacagacccctttcgtaagtcctggatggcccctgaagccctcaacttctccttcagccagaaatcagacatctggtccctgggctgcatcattctggacatgaccagctgctccttcatggatggcacagaagccatgcatctgcggaagtccctccgccagagcccaggcagcctgaaggccgtcctgaagacaatggaggagaagcagatcccggatgtggaaaccttcaggaatcttctgcccttgatgctccagatcgacccctcggatcgaataacgataaagtgagctcagggtcggggtttattttaacctgtggatttatctttcaacatctctccaccctaatacaagcacagctagttggctttgtaacgcctcaaagaactccatcacagatgccctgattatccctgcacagctgggctttgcccagttctggctctcccaaaccgtgctgcggcgagtaatcccgaatgtacggtggagtgagcagactgacccccaggaggcacaggaggcgtagcccccaggacccacgacacttttagggttccagaaaaaagttttcattctacataaaaaaaaaaattcctaaagaca

SEQ ID NO: 428200 - DNA, 487 bp, Homo sapiens
gagctaggattgcaccactgcattccagcctgggtgacagagtaagaccctgtctcttaaaaaaaaaaaaaaatcaccttaccagaaagacttttctatatgaaatattttatataaaacaaaagaccattctatatgaaatattttgtataaaataaaatcctgttcctccctatcctctttgccctgctttagttttcttcttactgctcatttatttgcttatttattgaccgtctcccctgcttagaatgtcagctccagcagggaagggatttttttttctctctctttttttttttcagacgggatttcgctatgttgcctcggctagcctcgaactcctggactcaagtagtccggcctgccttgtcttcccaaagtgctgtggttgtagatatgagccactgcgccctccggtgctagaatagtacccggcacacagtagaagcttattaaatatttgctaaatgaatgaattaattaa

SEQ ID NO: 428201 - DNA, 641 bp, Homo sapiens
cggcgtgcggccgctgactcggcgcagtggctctcggtgaaggaagagaccatcttcctgcacgacgggctgatccgggtcaccgacctggccgagctgcccagcgagatcctcggggccccagaggccgcggacaccgacctggagattttaacctttgagaccaagaacccgtcggaattagcagaacgtttgcgctctgtttgtgggaatcagagcaatgcctatgcccggctgctggaataccgcctgaatgccttgcgaggactgtggaatgcccagcgccagctggccttagaagaacagcatgaaagggaaagttcaggtggtatttaaatttttcttcagcccacaaactgaaaggaatcgagacatcattcgacggtcgggattgcttctttggcagttgttgatggctccaaaagatcaaatttgccctgaaattcagaaggaagtctgccttgccatcagctctggtttaaatatcttgtacccaggtgaaactgaaatcaataacttacttaaactggtcttaacagaaggagagagaaacagtggactctcccagctacgggatgtgatcctaaccaacctggctgaacagctccaaaacaaccgatttggcagtgatgaggatgatc

SEQ ID NO: 428202 - DNA, 1446 bp, Homo sapiens
cggcgtgcggccgctgactcggcgcagtggctctcggtgaaggaagagaccatcttcctgcacgacgggctgatccgggtcaccgacctggccgagctgcccagcgagatcctcggggccccagaggccgcggacaccgacctggagattttaacctttgagaccaagaacccgtcggaattagcagaacgtttgcgctctgtttgtgggaatcagagcaatgcctatgcccggctgctggaataccgcctgaatgccttgcgaggactgtggaatgcccagcgccagctggccttagaagaacagcatgaaagggaaagttcaggtgatgaggaaactttggccctgctcaaacgccagggcttgttgcagcaacctgagcaagcgcccttcacatcgaggatggggctcctgctggtcttcccccttattcagtcccagagtagaacagacccctctctctgtaacataactgctgaggtgctattgaactgccttcgtgactgccagcctttgagcttgaccaaggagcctgctgactgtctcaatggaattgaaactttgctgtgctcttggctagaggagacttctgacacaggccgacacatcccacataagcaaaaagaaaatgctgctgctgccctggtggctttggcttgtgccaggggatcattgaaaactttcgtccacacagtccatctattacagaaacagacggatctagggtccctgcctgtagctgatgtgctatataggctgttgcttttggaaggggggcctggatctccctcctgtttgcttgggggcaaacacatagtatcatggggttatgaagacatgttgcctgcgccggatagcaacactggctccagttctgaaaataaagatgctgacttgggacgctgtctcacggcagatggtctttacctgtatactactaactcagttggaagaggagtaagcaaattgggatctggattacatggtactctcagaggttttgtgtactgccggaacgaggagttggaaccaggatgggtggcttttggcagcggcagtcttctccaccggcctgtctctttcgataataaacctcactcccttttccaggtcattgaccagaacacccttcaggtgtgccaggtggtgccaatgccagccaatcacctccccattggcagcaccatgagcactgtgcacctgtcttcagatggcacttacttctattggatctggtctcctgccagcctgaatgagaaaacaccgaagggacattctgtcttcatggacatttttgaacttgtggttgaaaatggtgtatttgtagccaacccacttcaggaacgtacaattctaatgagaaaagagggcgaatctgccaaaagcattaatgagatgcttctaagtagactttctcggtatagagcctccccgtcagcaacgctt

SEQ ID NO: 428203 - DNA, 1487 bp, Homo sapiens
cggcgtgcggccgctgactcggcgcagtggctctcggtgaaggaagagaccatcttcctgcacgacgggctgatccgggtcaccgacctggccgagctgcccagcgagatcctcggggccccagaggccgcggacaccgacctggagattttaacctttgagaccaagaacccgtcggaattagcagaacgtttgcgctctgtttgtgggaatcagagcaatgcctatgcccggctgctggaataccgcctgaatgccttgcgaggactgtggaatgcccagcgccagctggccttagaagaacagcatgaaagggaaagttcaggtgatgaggaaactttggccctgctcaaacgccagggcttgttgcagcaacctgagcaagcgcccttcacatcgaggatggggctcctgctggtcttcccccttattcagtcccagagtagaacagacccctctctctgtaacataactgctgaggtgctattgaactgccttcgtgactgccagcctttgagcttgaccaaggagcctgctgactgtctcaatggaattgaaactttgctgtgctcttggctagaggagacttctgacacaggccgacacatcccacataagcaaaaagaaaatgctgctgctgccctggtggctttggcttgtgccaggggatcattgaaaactttcgtccacacagtccatctattacagaaacagacggatctagggtccctgcctgtagctgatgtgctatataggctgttgcttttggaaggggggcctggatctccctcctgtttgcttgggggcaaacacatagtatcatggggttatgaagacatgttgcctgcgccggatagcaacactggctccagttctgaaaataaagatgctgacttgggacgctgtctcacggcagatggtctttacctgtatactactaactcagttggaagaggagtaagcaaattgggatctggattacatggtactctcagaggttttgtgtactgccggaacgaggagttggaaccaggatgggtggcttttggcagcggcagtcttctccaccggcctgtctctttcgataataaacctcactcccttttccaggtcattgaccagaacacccttcaggtgtgccaggtggtgccaatgccagccaatcacctccccattggcagcaccatgagcactgtgcacctgtcttcagatggcacttacttctattggatctggtctcctgccagcctgaatgagaaaacaccgaagggacattctgtcttcatggacatttttgaacttgtgacgggatttcgctatgttgcctcggctagcctcgaactcctggactcaagtagtccggcctgccttgtcttcccaaagtgctgtggttgtagatatgagccactgcgccctccggtgctagaatagtacccggcacacagtagaagcttattaaatatttgctaaatgaatgaattaattaa

SEQ ID NO: 428204 - DNA, 690 bp, Homo sapiens
gagcgtgttatgacacagtgaacaacatgctatggacatgctcaaatgactatatcgatcagtggtgtaaccctgggaatcaagccttccattatgtctgccagagacttggagtcagtcacattatcactgagcccaaagaagaggctataaccacgaatgaggttataaaccaattattgcaccacgttggtgcgatgtgcatacaccaactcaatcttcttgccaccaaccccaatcttccaatcacaagtgtcttgggcaagcagcatccaattgaagcacatcatcttagcagtatttgtgacattatggagaaggccatggttaatggagatacctgtattatacgctgcattctcgttgtctttcaggtggtatttaaatttttcttcagcccacaaactgaaaggaatcgagacatcattcgacggtcgggattgcttctttggcagttgttgatggctccaaaagatcaaatttgccctgaaattcagaaggaagtctgccttgccatcagctctggtttaaatatcttgtacccaggtgaaactgaaatcaataacttacttaaactggtcttaacagaaggagagagaaacagtggactctcccagctacgggatgtgatcctaaccaacctggctgaacagctccaaaacaaccgatttggcagtgatgaggatgatc

SEQ ID NO: 428205 - DNA, 619 bp, Homo sapiens
  misc_feature (605)..(605): n is a, c, g, or t
  misc_feature (619)..(619): n is a, c, g, or t
ctttcacagaattttctccagaccatattacatttaatttcctgggactcctacagttacagtgatatagtagtggactggggaactcaaacttaaagacctaaaggggccaagcagtgtctttacatccaaaatgcaaagcagacaaatgggcatatcagggaagaacatgacaaaaagcaccagcatcagtggagacatgtgctcactggagaagaatgatggcagccagtctgacactgcagtgggcaccttgggcaccagtggcaaaaagcggcgctctagccttggtgccaaaatggtagctatcgttggtctgtcacggaaaagtcgcagtgcttctcagctcagccaaacgggtactatggatatagaggagagaaatcgccaaatgttaacaaatacaaacaggtagccggatcagatcccagactggaacaagattaccattcgaagtatcgatcaggatgggatcctcatagaggggcagataatgtttctacttcttcggacagtgatgtaagtgatatatctgcggttcaaggactagtagtgcttctcgtttcagcagcacagctcatgtctgtccaatcagaacgcccagnaggacaggtcagcn

SEQ ID NO: 428206 - DNA, 4610 bp, Homo sapiens
agaattcttgctacagtcaggagaaagccgaaagctgcacgggtactgaatcttctacgactgaattagaagaataatgactgtacaattaactatcaacctctgttcatttaagcacagtttttacagagctcaggagaaatatggaacttgattggcgtgtttttatttgatggtgtcagcaaatagatgattttaaagacaggtggtagggaaaaataagagaaggggaaaaaaaaagaaagaaaatgcaatttgagacattgcgccaggtctgcaattctgttttatctcattttcatggggttttttcatccccaccaaatatcttacaaaatgagctttttggacaaacactgaacaatgcaaggaaaagaagcccatctgtgtccagagatcagaatagaagatacgaccaaagggaagaaagagaggaatattcacagtatgctacttcggataccgcaatgcctagatctccatcagattatgctgataggcgatctcaacatgaacctcagttttatgaagactctgatcatttaagttatagggactccaacaggagaagtcataggcattccaaagaatatattgtagatgatgaggatgtggaaagcagagatgaatacgaaaggcaaaggagagaggaagagtaccagtcacgctaccgaagtgatccgaatttggcccgttatccagtaaagccacaaccctatgaagaacaaatgcggatccatgctgaagtgtcccgagcacggcatgagagaaggcatagtgatgtttctttggcaaatgctgatctggaagattccaggatttctatgctaaggatggatcgaccatcaaggcaaagatctatatcagaacgtagagctgccatggaaaatcagcgatcttattcaatggaaagaactcgagaggctcagggaccaagttcttatgcacaaaggaccacaaaccatagtcctcctacccccaggaggagtccactacccatagatagaccagacttgaggcgtactgactcactacggaaacagcaccacttagatcctagctctgctgtaagaaaaacaaaacgggaaaaaatggaaacaatgttaaggaatgattctctcagttcagaccagtcagagtcagtgagacctccaccaccaaagcctcataaatcaaagaaaggcggtaaaatgcgccagatttcgttgagcagttcagaggaggaattggcttccacgcctgaatatacaagttgtgatgatgttgagattgaaagtgagagtgtaagtgaaaaaggggacagtcaaaagggaaaaagaaaaactagtgagcaggcagttttgtcggactctaacaccaggtctgagagacaaaaggaaatgatgtactttggtggccactctttggaagaggatttggaatggtctgaacctcagattaaggactctggggtagatacgtgtagtagcacaacccttaacgaggagcatagccatagtgataagcaccctgtaacctggcaaccatctaaagatggagatcgtttaattggtcgcattttattaaataagcgtctaaaagatggaagtgtacctcgagattcaggagcaatgcttggcttgaaggttgtaggaggaaagatgactgaatcaggtcggctttgtgcatttattactaaagtaaaaaaaggaagtttagctgatactgtaggacatcttagaccaggtgatgaagtattagaatggaatggaagactactgcaaggagccacatttgaggaagtgtacaacatcattctagaatccaaacctgaaccacaagtagaacttgtagtttcaaggcctattggagatataccgcgaatacctgatagcacacatgcacaactggagtccagttctagctcctttgaatctcaaaaaatggatcgtccttctatttctgttacctctcccatgagtcctggaatgttgagggatgtcccacagttcttatcaggacaactttcaataaaactatggtttgacaaggttggtcaccaattaatagttacaattttgggagcaaaagatctcccttccagggaagatgggaggccaaggaatccttatgttaaaatttactttcttccagacagaagtgataaaaacaagagaagaactaaaacagtaaagaaaacattggaacccaaatggaaccaaacattcatttattctccagtccaccgaagagaatttcgggaacgaatgctagagattaccctttgggatcaagctcgtgttcgagaggaagaaagtgaattcttaggcgagattttaattgaattagaaacagcattattagatgatgagccacattggtacaaacttcagacgcatgatgtctcttcattgccacttccccacccttctccatatatgccacgaagacagctccatggagagagcccaacacggaggttgcaaaggtcaaagagaataagtgatagtgaagtctctgactatgactgtgatgatggaattggtgtagtatcagattatcgacatgatggtcgagatcttcaaagctcaacattatcagtgccagaacaagtaatgtcatcaaaccactgttcaccatcagggtctcctcatcgagtagatgttataggaaggactagatcatggtcacccagtgtccctcctccacaaagtcggaatgtggaacaggggcttcgagggacccgcactatgaccggacattataatacaattagccgaatggacagacatcgtgtcatggatgaccattattctccagatagagacaggattgtgaagcagcagatagacagccatatcacagatccagatcaacagaacaacggcctctccttgagcggaccaccacccgctccagatccactgaacgtcctgatacaaacctcatgaggtcgatgccttcattaatgactggaagatctgcccctccttcacctgccttatcgaggtctcatcctcgtactgggtctgtccagacaagcccatcaagtactccagtcgcaggacgaaggggccgacagcttccacagcttccaccaaagggaacgttggatagaaaagcaggaggtaaaaaactaaggagcactgtccaaagaagtacagaaacaggcctggccgtggaaatgaggaactggatgactcgacaggcaagccgagagtctacagatggtagcatgaacagctacagctcagaaggaaatctgattttccctggtgttcgcttggcctctgatagccagttcagtgatttcctggatggccttggccctgctcagctagtgggacgccagactctggcaacacctgcaatgggtgacattcaggtaggaatgatggacaaaaagggacagctggaggtagaaatcatccgggcccgtggccttgttgtaaaaccaggttccaagacactgccagcaccgtatgtaaaagtgtatctattagataacggagtctgcatagccaaaaagaaaacaaaagtggcaagaaaaacgctggaacccctttaccagcagctattatctttcgaagagagtccacaaggaaaagttttacagatcatcgtctggggagattatggccgcatggatcacaaatcttttatgggagtggcccagatacttttagatgaactagagctatccaatatggtgatcggatggttcaaacttttcccaccttcctccctagtagatccaaccttggctcctctgacaagaagagcttcccaatcatctctggaaagttcaactggaccttcttactctcgttcatagcagctgtaaaaaaattgttgtcacagcaaccagcgttacaaaaaaaaaaaaaaaaatcacaggttgcaaaccctggtaacactgcatgcttaatgttgtgtcttctgagcctgtttctagggatacaaagcaatcctgtgttctcagaggaagttgcacacattgtgccctaaagaaggccctcaggtgaaagagcagagctgtgaagaactatcagatttggaattcaatgacactcgagttctggtccaatctgaagccatggattaatctcaaagaatcagtcagtttcatgcaacagaagcccttttcaatggcacctttatatttttatcattcctttttcttcatttatctaaccccaaagccctgatatgccacagaaatggagctatacagccatgaagcggtgttacaggtgaggagtgtaatcctaggaagcatcaggtgaaaagcaggagaccaaagaagtggtcaggaacaatcatcagccctcctctgggcgggaatcagagcagtcagtccagcaggaagagtggcagactttgtagctccatgggcacgtcatttactaatgctaagatgtgttggactctgaaaaacaaaattctgtggctacactgtactgaatgaaattaaagaaactttttttgcatggacacagattagctgaatacttaaattattttcttggggctgcaacttgcaaaaaaaaaaaaaagaataaaaatcagccattttcaacaatttatattatttttaaaaataaatttcactagtgcatggttttaaaaag

SEQ ID NO: 428207 - DNA, 4556 bp, Homo sapiens
agaattcttgctacagtcaggagaaagccgaaagctgcacgggtactgaatcttctacgactgaattagaagaataatgactgtacaattaactatcaacctctgttcatttaagcacagtttttacagagctcaggagaaatatggaacttgattggcgtgtttttatttgatggtgtcagcaaatagatgattttaaagacaggtggtagggaaaaataagagaaggggaaaaaaaaagaaagaaaatgcaatttgagacattgcgccaggtctgcaattctgttttatctcattttcatggggttttttcatccccaccaaatatcttacaaaatgagctttttggacaaacactgaacaatgcaaggaaaagaagcccatctgtgtccagagatcagaatagaagatacgaccaaagggaagaaagagaggaatattcacagtatgctacttcggataccgcaatgcctagatctccatcagattatgctgataggcgatctcaacatgaacctcagttttatgaagactctgatcatttaagttatagggactccaacaggagaagtcataggcattccaaagaatatattgtagatgatgaggatgtggaaagcagagatgaatacgaaaggcaaaggagagaggaagagtaccagtcacgctaccgaagtgatccgaatttggcccgttatccagtaaagccacaaccctatgaagaacaaatgcggatccatgctgaagtgtcccgagcacggcatgagagaaggcatagtgatgtttctttggcaaatgctgatctggaagattccaggatttctatgctaaggatggatcgaccatcaaggcaaagatctatatcagaacgtagagctgccatggaaaatcagcgatcttattcaatggaaagaactcgagaggctcagggaccaagttcttatgcacaaaggaccacaaaccatagtcctcctacccccaggaggagtccactacccatagatagaccagacttgaggcgtactgactcactacggaaacagcaccacttagatcctagctctgctgtaagaaaaacaaaacgggaaaaaatggaaacaatgttaaggaatgattctctcagttcagaccagtcagagtcagtgagacctccaccaccaaagcctcataaatcaaagaaaggcggtaaaatgcgccagatttcgttgagcagttcagaggaggaattggcttccacgcctgaatatacaagttgtgatgatgttgagattgaaagtgagagtgtaagtgaaaaaggggacagtcaaaagggaaaaagaaaaactagtgagcaggcagttttgtcggactctaacaccaggtctgagagacaaaaggaaatgatgtactttggtggccactctttggaagaggatttggaatggtctgaacctcagattaaggactctggggtagatacgtgtagtagcacaacccttaacgaggagcatagccatagtgataagcaccctgtaacctggcaaccatctaaagatggagatcgtttaattggtcgcattttattaaataagcgtctaaaagatggaagtgtacctcgagattcaggagcaatgcttggcttgaaggttgtaggaggaaagatgactgaatcaggtcggctttgtgcatttattactaaagtaaaaaaaggaagtttagctgatactgtaggacatcttagaccaggtgatgaagtattagaatggaatggaagactactgcaaggagccacatttgaggaagtgtacaacatcattctagaatccaaacctgaaccacaagtagaacttgtagtttcaaggcctattggagatataccgcgaatacctgatagcacacatgcacaactggagtccagttctagctcctttgaatctcaaaaaatggatcgtccttctatttctgttacctctcccatgagtcctggaatgttgagggatgtcccacagttcttatcaggacaactttcaataaaactatggtttgacaaggttggtcaccaattaatagttacaattttgggagcaaaagatctcccttccagggaagatgggaggccaaggaatccttatgttaaaatttactttcttccagacagaagtgataaaaacaagagaagaactaaaacagtaaagaaaacattggaacccaaatggaaccaaacattcatttattctccagtccaccgaagagaatttcgggaacgaatgctagagattaccctttgggatcaagctcgtgttcgagaggaagaaagtgaattcttaggcgagattttaattgaattagaaacagcattattagatgatgagccacattggtacaaacttcagacgcatgatgtctcttcattgccacttccccacccttctccatatatgccacgaagacagctccatggagagagcccaacacggaggttgcaaaggtcaaagagaataagtgatagtgaagtctctgactatgactgtgatgatggaattggtgtagtatcagattatcgacatgatggtcgagatcttcaaagctcaacattatcagtgccagaacaagtaatgtcatcaaaccactgttcaccatcagggtctcctcatcgagtagatgttataggaaggactagatcatggtcacccagtgtccctcctccacaaagtcggaatgtggaacaggggcttcgagggacccgcactatgaccggacattataatacaattagccgaatggacagacatcgtgtcatggatgaccattattctccagatagagacaggattgtgaagcagcagatagacagccatatcacagatccagatcaacagaacaacggcctctccttgagcggaccaccacccgctccagatccactgaacgtcctgatacaaacctcatgaggtcgatgccttcattaatgactggaagatctgcccctccttcacctgccttatcgaggtctcatcctcgtactgggtctgtccagacaagcccatcaagtactccagtcgcaggacgaaggggccgacagcttccacagcttccaccaaagggaacgttggatagaaaagcaggaggtaaaaaactaaggagcactgtccaaagaagtacagaaacaggcctggccgtggaaatgaggaactggatgactcgacaggcaagccgagagtctacagatggtagcatgaacagctacagctcagaaggaaatctgattttccctggtgttcgcttggcctctgatagccagttcagtgatttcctggatggccttggccctgctcagctagtgggacgccagactctggcaacacctgcaatgggtgacattcaggtaggaatgatggacaaaaagggacagctggaggtagaaatcatccgggcccgtggccttgttgtaaaaccaggttccaagacactgccagcaccgtatgtaaaagtgtatctattagataacggagtctgcatagccaaaaagaaaacaaaagtggcaagaaaaacgctggaacccctttaccagcagctattatctttcgaagagagtccacaaggaaaagttttacagatcatcgtctggggagattatggccgcatggatcacaaatcttttatgggagtggcccagatacttttagatgaactagagctatccaatatggtgatcggatggttcaaacttttcccaccttcctccctagtagatccaaccttggctcctctgacaagaagagcttcccaatcatctctggaaagttcaactggaccttcttactctcgttcatagcagctgtaaaaaaattgttgtcacagcaaccagcgttacaaaaaaaaaaaaaaaaatcacaggttgcaaaccctggtaacactgcatgcttaatgttgtgtcttctgagcctgtttctagggatacaaagcaatcctgtgttctcagaggaagttgcacacattgtgccctaaagaaggccctcaggtgaaagagcagagctgtgaagaactatcagatttggaattcaatgacactcgagttctggtccaatctgaagccatggattaatctcaaagaatcagtcagtttcatgcaacagaagcccttttcaatggcacctttatatttttatcattcctttttcttcatttatctaaccccaaagccctgatatgccacagaaatggagctatacagccatgaagcggtgttacaggtgaggagtgtaatcctaggaagcatcaggtggggaatcagagcagtcagtccagcaggaagagtggcagactttgtagctccatgggcacgtcatttactaatgctaagatgtgttggactctgaaaaacaaaattctgtggctacactgtactgaatgaaattaaagaaactttttttgcatggacacagattagctgaatacttaaattattttcttggggctgcaacttgcaaaaaaaaaaaaaagaataaaaatcagccattttcaacaatttatattatttttaaaaataaatttcactagtgcatggttttaaaaag

SEQ ID NO: 428208 - DNA, 4677 bp, Homo sapiens
agaattcttgctacagtcaggagaaagccgaaagctgcacgggtactgaatcttctacgactgaattagaagaataatgactgtacaattaactatcaacctctgttcatttaagcacagtttttacagagctcaggagaaatatggaacttgattggcgtgtttttatttgatggtgtcagcaaatagatgattttaaagacaggtggtagggaaaaataagagaaggggaaaaaaaaagaaagaaaatgcaatttgagacattgcgccaggtctgcaattctgttttatctcattttcatggggttttttcatccccaccaaatatcttacaaaatgagctttttggacaaacactgaacaatgcaaggaaaagaagcccatctgtgtccagagatcagaatagaagatacgaccaaagggaagaaagagaggaatattcacagtatgctacttcggataccgcaatgcctagatctccatcagattatgctgataggcgatctcaacatgaacctcagttttatgaagactctgatcatttaagttatagggactccaacaggagaagtcataggcattccaaagaatatattgtagatgatgaggatgtggaaagcagagatgaatacgaaaggcaaaggagagaggaagagtaccagtcacgctaccgaagtgatccgaatttggcccgttatccagtaaagccacaaccctatgaagaacaaatgcggatccatgctgaagtgtcccgagcacggcatgagagaaggcatagtgatgtttctttggcaaatgctgatctggaagattccaggatttctatgctaaggatggatcgaccatcaaggcaaagatctatatcagaacgtagagctgccatggaaaatcagcgatcttattcaatggaaagaactcgagaggctcagggaccaagttcttatgcacaaaggaccacaaaccatagtcctcctacccccaggaggagtccactacccatagatagaccagacttgaggcgtactgactcactacggaaacagcaccacttagatcctagctctgctgtaagaaaaacaaaacgggaaaaaatggaaacaatgttaaggaatgattctctcagttcagaccagtcagagtcagtgagacctccaccaccaaagcctcataaatcaaagaaaggcggtaaaatgcgccagatttcgttgagcagttcagaggaggaattggcttccacgcctgaatatacaagttgtgatgatgttgagattgaaagtgagagtgtaagtgaaaaaggggacagtcaaaagggaaaaagaaaaactagtgagcaggcagttttgtcggactctaacaccaggtctgagagacaaaaggaaatgatgtactttggtggccactctttggaagaggatttggaatggtctgaacctcagattaaggactctggggtagatacgtgtagtagcacaacccttaacgaggagcatagccatagtgataagcaccctgtaacctggcaaccatctaaagatggagatcgtttaattggtcgcattttattaaataagcgtctaaaagatggaagtgtacctcgagattcaggagcaatgcttggcttgaaggttgtaggaggaaagatgactgaatcaggtcggctttgtgcatttattactaaagtaaaaaaaggaagtttagctgatactgtaggacatcttagaccaggtgatgaagtattagaatggaatggaagactactgcaaggagccacatttgaggaagtgtacaacatcattctagaatccaaacctgaaccacaagtagaacttgtagtttcaaggcctattggagatataccgcgaatacctgatagcacacatgcacaactggagtccagttctagctcctttgaatctcaaaaaatggatcgtccttctatttctgttacctctcccatgagtcctggaatgttgagggatgtcccacagttcttatcaggacaactttcaataaaactatggtttgacaaggttggtcaccaattaatagttacaattttgggagcaaaagatctcccttccagggaagatgggaggccaaggaatccttatgttaaaatttactttcttccagacagaagtgataaaaacaagagaagaactaaaacagtaaagaaaacattggaacccaaatggaaccaaacattcatttattctccagtccaccgaagagaatttcgggaacgaatgctagagattaccctttgggatcaagctcgtgttcgagaggaagaaagtgaattcttaggcgagattttaattgaattagaaacagcattattagatgatgagccacattggtacaaacttcagacgcatgatgtctcttcattgccacttccccacccttctccatatatgccacgaagacagctccatggagagagcccaacacggaggttgcaaaggtcaaagagaataagtgatagtgaagtctctgactatgactgtgatgatggaattggtgtagtatcagattatcgacatgatggtcgagatcttcaaagctcaacattatcagtgccagaacaagtaatgtcatcaaaccactgttcaccatcagggtctcctcatcgagtagatgttataggaaggactagatcatggtcacccagtgtccctcctccacaaagtcggaatgtggaacaggggcttcgagggacccgcactatgaccggacattataatacaattagccgaatggacagacatcgtgtcatggatgaccattattctccagatagagacagtcattttcttactctacctcgctccagatacagtcagaccattgaccatcatcacagggatggcagggattgtgaagcagcagatagacagccatatcacagatccagatcaacagaacaacggcctctccttgagcggaccaccacccgctccagatccactgaacgtcctgatacaaacctcatgaggtcgatgccttcattaatgactggaagatctgcccctccttcacctgccttatcgaggtctcatcctcgtactgggtctgtccagacaagcccatcaagtactccagtcgcaggacgaaggggccgacagcttccacagcttccaccaaagggaacgttggatagaaaagcaggaggtaaaaaactaaggagcactgtccaaagaagtacagaaacaggcctggccgtggaaatgaggaactggatgactcgacaggcaagccgagagtctacagatggtagcatgaacagctacagctcagaaggaaatctgattttccctggtgttcgcttggcctctgatagccagttcagtgatttcctggatggccttggccctgctcagctagtgggacgccagactctggcaacacctgcaatgggtgacattcaggtaggaatgatggacaaaaagggacagctggaggtagaaatcatccgggcccgtggccttgttgtaaaaccaggttccaagacactgccagcaccgtatgtaaaagtgtatctattagataacggagtctgcatagccaaaaagaaaacaaaagtggcaagaaaaacgctggaacccctttaccagcagctattatctttcgaagagagtccacaaggaaaagttttacagatcatcgtctggggagattatggccgcatggatcacaaatcttttatgggagtggcccagatacttttagatgaactagagctatccaatatggtgatcggatggttcaaacttttcccaccttcctccctagtagatccaaccttggctcctctgacaagaagagcttcccaatcatctctggaaagttcaactggaccttcttactctcgttcatagcagctgtaaaaaaattgttgtcacagcaaccagcgttacaaaaaaaaaaaaaaaaatcacaggttgcaaaccctggtaacactgcatgcttaatgttgtgtcttctgagcctgtttctagggatacaaagcaatcctgtgttctcagaggaagttgcacacattgtgccctaaagaaggccctcaggtgaaagagcagagctgtgaagaactatcagatttggaattcaatgacactcgagttctggtccaatctgaagccatggattaatctcaaagaatcagtcagtttcatgcaacagaagcccttttcaatggcacctttatatttttatcattcctttttcttcatttatctaaccccaaagccctgatatgccacagaaatggagctatacagccatgaagcggtgttacaggtgaggagtgtaatcctaggaagcatcaggtgaaaagcaggagaccaaagaagtggtcaggaacaatcatcagccctcctctgggcgggaatcagagcagtcagtccagcaggaagagtggcagactttgtagctccatgggcacgtcatttactaatgctaagatgtgttggactctgaaaaacaaaattctgtggctacactgtactgaatgaaattaaagaaactttttttgcatggacacagattagctgaatacttaaattattttcttggggctgcaacttgcaaaaaaaaaaaaaagaataaaaatcagccattttcaacaatttatattatttttaaaaataaatttcactagtgcatggttttaaaaag

SEQ ID NO: 428209 - DNA, 1874 bp, Homo sapiens
ctttcacagaattttctccagaccatattacatttaatttcctgggactcctacagttacagtgatatagtagtggactggggaactcaaacttaaagacctaaaggggccaagcagtgtctttacatccaaaatgcaaagcagacaaatgggcatatcagggaagaacatgacaaaaagcaccagcatcagtggagacatgtgctcactggagaagaatgatggcagccagtctgacactgcagtgggcaccttgggcaccagtggcaaaaagcggcgctctagccttggtgccaaaatggtagctatcgttggtctgtcacggaaaagtcgcagtgcttctcagctcagccaaacgggtaaagcaggaggtaaaaaactaaggagcactgtccaaagaagtacagaaacaggcctggccgtggaaatgaggaactggatgactcgacaggcaagccgagagtctacagatggtagcatgaacagctacagctcagaaggaaatctgattttccctggtgttcgcttggcctctgatagccagttcagtgatttcctggatggccttggccctgctcagctagtgggacgccagactctggcaacacctgcaatgggtgacattcaggtaggaatgatggacaaaaagggacagctggaggtagaaatcatccgggcccgtggccttgttgtaaaaccaggttccaagacactgccagcaccgtatgtaaaagtgtatctattagataacggagtctgcatagccaaaaagaaaacaaaagtggcaagaaaaacgctggaacccctttaccagcagctattatctttcgaagagagtccacaaggaaaagttttacagatcatcgtctggggagattatggccgcatggatcacaaatcttttatgggagtggcccagatacttttagatgaactagagctatccaatatggtgatcggatggttcaaacttttcccaccttcctccctagtagatccaaccttggctcctctgacaagaagagcttcccaatcatctctggaaagttcaactggaccttcttactctcgttcatagcagctgtaaaaaaattgttgtcacagcaaccagcgttacaaaaaaaaaaaaaaaaatcacaggttgcaaaccctggtaacactgcatgcttaatgttgtgtcttctgagcctgtttctagggatacaaagcaatcctgtgttctcagaggaagttgcacacattgtgccctaaagaaggccctcaggtgaaagagcagagctgtgaagaactatcagatttggaattcaatgacactcgagttctggtccaatctgaagccatggattaatctcaaagaatcagtcagtttcatgcaacagaagcccttttcaatggcacctttatatttttatcattcctttttcttcatttatctaaccccaaagccctgatatgccacagaaatggagctatacagccatgaagcggtgttacaggtgaggagtgtaatcctaggaagcatcaggtgaaaagcaggagaccaaagaagtggtcaggaacaatcatcagccctcctctgggcgggaatcagagcagtcagtccagcaggaagagtggcagactttgtagctccatgggcacgtcatttactaatgctaagatgtgttggactctgaaaaacaaaattctgtggctacactgtactgaatgaaattaaagaaactttttttgcatggacacagattagctgaatacttaaattattttcttggggctgcaacttgcaaaaaaaaaaaaaagaataaaaatcagccattttcaacaatttatattatttttaaaaataaatttcactagtgcatggttttaaaaag

SEQ ID NO: 428210 - DNA, 566 bp, Homo sapiens
  misc_feature (552)..(552): n is a, c, g, or t
  misc_feature (566)..(566): n is a, c, g, or t
ctttcacagaattttctccagaccatattacatttaatttcctgggactcctacagttacagtgatatagtagtggactggggaactcaaacttaaagacctaaaggggccaagcagtgtctttacatccaaaatgcaaagcagacaaatgggcatatcagggaagaacatgacaaaaagcaccagcatcagtggagacatgtgctcactggagaagaatgatggcagccagtctgacactgcagtgggcaccttgggcaccagtggcaaaaagcggcgctctagccttggtgccaaaatggtagctatcgttggtctgtcacggaaaagtcgcagtgcttctcagctcagccaaacgggtaccggatcagatcccagactggaacaagattaccattcgaagtatcgatcaggatgggatcctcatagaggggcagataatgtttctacttcttcggacagtgatgtaagtgatatatctgcggttcaaggactagtagtgcttctcgtttcagcagcacagctcatgtctgtccaatcagaacgcccagnaggacaggtcagcn

SEQ ID NO: 428211 - DNA, 4552 bp, Homo sapiens
agaattcttgctacagtcaggagaaagccgaaagctgcacgggtactgaatcttctacgactgaattagaagaataatgactgtacaattaactatcaacctctgttcatttaagcacagtttttacagagctcaggagaaatatggaacttgattggcgtgtttttatttgatggtgtcagcaaatagatgattttaaagacaggtggtagggaaaaataagagaaggggaaaaaaaaagaaagaaaatgcaatttgagacattgcgccaggtctgcaattctgttttatctcattttcatggggttttttcatccccaccaaatatcttacaaaatgagctttttggacaaacactgaacaatgcaaggaaaagaagcccatctgtgtccagagatcagaatagaagatacgaccaaagggaagaaagagaggaatattcacagtatgctacttcggataccgcaatgcctagatctccatcagattatgctgataggcgatctcaacatgaacctcagttttatgaagactctgatcatttaagttatagggactccaacaggagaagtcataggcattccaaagaatatattgtagatgatgaggatgtggaaagcagagatgaatacgaaaggcaaaggagagaggaagagtaccagtcacgctaccgaagtgatccgaatttggcccgttatccagtaaagccacaaccctatgaagaacaaatgcggatccatgctgaagtgtcccgagcacggcatgagagaaggcatagtgatgtttctttggcaaatgctgatctggaagattccaggatttctatgctaaggatggatcgaccatcaaggcaaagatctatatcagaacgtagagctgccatggaaaatcagcgatcttattcaatggaaagaactcgagaggctcagggaccaagttcttatgcacaaaggaccacaaaccatagtcctcctacccccaggaggagtccactacccatagatagaccagacttgaggcgtactgactcactacggaaacagcaccacttagatcctagctctgctgtaagaaaaacaaaacgggaaaaaatggaaacaatgttaaggaatgattctctcagttcagaccagtcagagtcagtgagacctccaccaccaaagcctcataaatcaaagaaaggcggtaaaatgcgccagatttcgttgagcagttcagaggaggaattggcttccacgcctgaatatacaagttgtgatgatgttgagattgaaagtgagagtgtaagtgaaaaaggggacagtcaaaagggaaaaagaaaaactagtgagcaggcagttttgtcggactctaacaccaggtctgagagacaaaaggaaatgatgtactttggtggccactctttggaagaggatttggaatggtctgaacctcagattaaggactctggggtagatacgtgtagtagcacaacccttaacgaggagcatagccatagtgataagcaccctgtaacctggcaaccatctaaagatggagatcgtttaattggtcgcattttattaaataagcgtctaaaagatggaagtgtacctcgagattcaggagcaatgcttggcttgaaggttgtaggaggaaagatgactgaatcaggtcggctttgtgcatttattactaaagtaaaaaaaggaagtttagctgatactgtaggacatcttagaccaggtgatgaagtattagaatggaatggaagactactgcaaggagccacatttgaggaagtgtacaacatcattctagaatccaaacctgaaccacaagtagaacttgtagtttcaaggcctattggagatataccgcgaatacctgatagcacacatgcacaactggagtccagttctagctcctttgaatctcaaaaaatggatcgtccttctatttctgttacctctcccatgagtcctggaatgttgagggatgtcccacagttcttatcaggacaactttcaataaaactatggtttgacaaggttggtcaccaattaatagttacaattttgggagcaaaagatctcccttccagggaagatgggaggccaaggaatccttatgttaaaatttactttcttccagacagaagtgataaaaacaagagaagaactaaaacagtaaagaaaacattggaacccaaatggaaccaaacattcatttattctccagtccaccgaagagaatttcgggaacgaatgctagagattaccctttgggatcaagctcgtgttcgagaggaagaaagtgaattcttaggcgagattttaattgaattagaaacagcattattagatgatgagccacattggtacaaacttcagacgcatgatgtctcttcattgccacttccccacccttctccatatatgccacgaagacagctccatggagagagcccaacacggaggttgcaaaggtcaaagagaataagtgatagtgaagtctctgactatgactgtgatgatggaattggtgtagtatcagattatcgacatgatggtcgagatcttcaaagctcaacattatcagtgccagaacaagtaatgtcatcaaaccactgttcaccatcagggtctcctcatcgagtagatgttataggaaggactagatcatggtcacccagtgtccctcctccacaaagtcggaatgtggaacaggggcttcgagggacccgcactatgaccggacattataatacaattagccgaatggacagacatcgtgtcatggatgaccattattctccagatagagacaggattgtgaagcagcagatagacagccatatcacagatccagatcaacagaacaacggcctctccttgagcggaccaccacccgctccagatccactgaacgtcctgatacaaacctcatgaggtcgatgccttcattaatgactggaagatctgcccctccttcacctgccttatcgaggtctcatcctcgtactgggtctgtccagacaagcccatcaagtactccagtcgcaggacgaaggggccgacagcttccacagcttccaccaaagggaacgttggatagaaaagcaggaggtaaaaaactaaggagcactgtccaaagaagtacagaaacaggcctggccgtggaaatgaggaactggatgactcgacaggcaagccgagagtctacagatggtagcatgaacagctacagctcagaaggaaatctgattttccctggtgttcgcttggcctctgatagccagttcagtgatttcctggatggccttggccctgctcagctagtgggacgccagactctggcaacacctgcaatgggtgacattcaggtaggaatgatggacaaaaagggacagctggaggtagaaatcatccgggcccgtggccttgttgtaaaaccaggttccaagacactgccagcaccgtatgtaaaagtgtatctattagataacggagtctgcatagccaaaaagaaaacaaaagtggcaagaaaaacgctggaacccctttaccagcagctattatctttcgaagagagtccacaaggaaaagttttacagatcatcgtctggggagattatggccgcatggatcacaaatcttttatgggagtggcccagatacttttagatgaactagagctatccaatatggtgatcggatggttcaaacttttcccaccttcctccctagtagatccaaccttggctcctctgacaagaagagcttcccaatcatctctggaaagttcaactggaccttcttactctcgttcatagcagctgtaaaaaaattgttgtcacagcaaccagcgttacaaaaaaaaaaaacctgtttctagggatacaaagcaatcctgtgttctcagaggaagttgcacacattgtgccctaaagaaggccctcaggtgaaagagcagagctgtgaagaactatcagatttggaattcaatgacactcgagttctggtccaatctgaagccatggattaatctcaaagaatcagtcagtttcatgcaacagaagcccttttcaatggcacctttatatttttatcattcctttttcttcatttatctaaccccaaagccctgatatgccacagaaatggagctatacagccatgaagcggtgttacaggtgaggagtgtaatcctaggaagcatcaggtgaaaagcaggagaccaaagaagtggtcaggaacaatcatcagccctcctctgggcgggaatcagagcagtcagtccagcaggaagagtggcagactttgtagctccatgggcacgtcatttactaatgctaagatgtgttggactctgaaaaacaaaattctgtggctacactgtactgaatgaaattaaagaaactttttttgcatggacacagattagctgaatacttaaattattttcttggggctgcaacttgcaaaaaaaaaaaaaagaataaaaatcagccattttcaacaatttatattatttttaaaaataaatttcactagtgcatggttttaaaaag

SEQ ID NO: 428212 - DNA, 3443 bp, Homo sapiens
  misc_feature (2729)..(2729): n is a, c, g, or t
  misc_feature (2781)..(2781): n is a, c, g, or t
agaattcttgctacagtcaggagaaagccgaaagctgcacgggtactgaatcttctacgactgaattagaagaataatgactgtacaattaactatcaacctctgttcatttaagcacagtttttacagagctcaggagaaatatggaacttgattggcgtgtttttatttgatggtgtcagcaaatagatgattttaaagacaggtggtagggaaaaataagagaaggggaaaaaaaaagaaagaaaatgcaatttgagacattgcgccaggtctgcaattctgttttatctcattttcatggggttttttcatccccaccaaatatcttacaaaatgagctttttggacaaacactgaacaatgcaaggaaaagaagcccatctgtgtccagagatcagaatagaagatacgaccaaagggaagaaagagaggaatattcacagtatgctacttcggataccgcaatgcctagatctccatcagattatgctgataggcgatctcaacatgaacctcagttttatgaagactctgatcatttaagttatagggactccaacaggagaagtcataggcattccaaagaatatattgtagatgatgaggatgtggaaagcagagatgaatacgaaaggcaaaggagagaggaagagtaccagtcacgctaccgaagtgatccgaatttggcccgttatccagtaaagccacaaccctatgaagaacaaatgcggatccatgctgaagtgtcccgagcacggcatgagagaaggcatagtgatgtttctttggcaaatgctgatctggaagattccaggatttctatgctaaggatggatcgaccatcaaggcaaagatctatatcagaacgtagagctgccatggaaaatcagcgatcttattcaatggaaagaactcgagaggctcagggaccaagttcttatgcacaaaggaccacaaaccatagtcctcctacccccaggaggagtccactacccatagatagaccagacttgaggcgtactgactcactacggaaacagcaccacttagatcctagctctgctgtaagaaaaacaaaacgggaaaaaatggaaacaatgttaaggaatgattctctcagttcagaccagtcagagtcagtgagacctccaccaccaaagcctcataaatcaaagaaaggcggtaaaatgcgccagatttcgttgagcagttcagaggaggaattggcttccacgcctgaatatacaagttgtgatgatgttgagattgaaagtgagagtgtaagtgaaaaaggggacagtcaaaagggaaaaagaaaaactagtgagcaggcagttttgtcggactctaacaccaggtctgagagacaaaaggaaatgatgtactttggtggccactctttggaagaggatttggaatggtctgaacctcagattaaggactctggggtagatacgtgtagtagcacaacccttaacgaggagcatagccatagtgataagcaccctgtaacctggcaaccatctaaagatggagatcgtttaattggtcgcattttattaaataagcgtctaaaagatggaagtgtacctcgagattcaggagcaatgcttggcttgaaggttgtaggaggaaagatgactgaatcaggtcggctttgtgcatttattactaaagtaaaaaaaggaagtttagctgatactgtaggacatcttagaccaggtgatgaagtattagaatggaatggaagactactgcaaggagccacatttgaggaagtgtacaacatcattctagaatccaaacctgaaccacaagtagaacttgtagtttcaaggcctattggagatataccgcgaatacctgatagcacacatgcacaactggagtccagttctagctcctttgaatctcaaaaaatggatcgtccttctatttctgttacctctcccatgagtcctggaatgttgagggatgtcccacagttcttatcaggacaactttcaataaaactatggtttgacaaggttggtcaccaattaatagttacaattttgggagcaaaagatctcccttccagggaagatgggaggccaaggaatccttatgttaaaatttactttcttccagacagaagtgataaaaacaagagaagaactaaaacagtaaagaaaacattggaacccaaatggaaccaaacattcatttattctccagtccaccgaagagaatttcgggaacgaatgctagagattaccctttgggatcaagctcgtgttcgagaggaagaaagtgaattcttaggcgagattttaattgaattagaaacagcattattagatgatgagccacattggtacaaacttcagacgcatgatgtctcttcattgccacttccccacccttctccatatatgccacgaagacagctccatggagagagcccaacacggaggttgcaaaggtcaaagagaataagtgatagtgaagtctctgactatgactgtgatgatggaattggtgtagtatcagattatcgacatgatggtcgagatcttcaaagctcaacattatcagtgccagaacaagtaatgtcatcaaaccactgttcaccatcagggtctcctcatcgagtagatgttataggaaggactagatcatggtcacccagtgtccctcctccacaaaggtaagatagactacttattttatttgtagggtggctntattagtcagtgttctccagagggacaaaactaataggatatatgtatatangaaagggagtttattagggagaattggctcatatgattataagacaaagtcccaccatagaatttctgcaagctggggaagggagaagccagtagtggcttagtccaagtgtgagtccattttgaaaggcttaaaaccagggaagctgacaggacaggcttcagtctgtggtcaaaggcctgagagccaccagcaagccactggtgcaagttccagagtccaaaggccaaagaacctagtgttggatgtccaagggcaggaagagtgaaagggaatcatcccagcacaggaaaaagaaagaagcccagaaaacttagcaagcaaggttatccccaccttcttcacccgctttgttcccagctgcattggcagccgactggatggtggattgggtgagtcttcctctcctagtccacatattcaaatgtcagtctcctctggcaacaccttacagacacatctagaaacaatactttaccagcctaggcttccttcattccattcaagttgacacgtaatgttaaccatcaaaatggcattacagacctatttatcacatatcggtaataatctctaaagataagagattcttgtggaaaaagaatttaaggaaagcaagatggttttgtttatttaaggaaaaacaaaatgctattcaagga

SEQ ID NO: 428213 - DNA, 3389 bp, Homo sapiens
gttcagtcccgccccgcagcgtccgacgggaaaggaaagggggaggacgccatgttggacggaaccatctgctgccacacatggggtggtcaatgctcccatgagtttactgatgcacagaaacaaccttgctgaatggaattaagcactttcttgtcacaaatatatcagtttgatgattttcgggcgcggtcttgtggatgcgagtcctctcagggtcgttcgtgaggccccagggcgtgggtgcgccccccgccccgcggccttggtgcggcctccccgtcgcacgcacatggctgggctgtagccgtcgcggcgcgcggtgcggcctgggagagtcggaagcgcggcggccgcggagccctgcgagtaggcagcgttgggcccatgcaggacgcggagaacgtggcggtgcccgaggcggccgaggagcgcgccgagcccggccagcagcagccggccgccgagccgccgccagccgaggggctgctgcggcccgcggggcccggcgctccggaggccgcggggaccgaggcctccagtgaggaggtggggatcgcggaggccgggccggagcccgaggtgaggaccgagccggcggccgaggcagaggcggcctccggcccgtccgagtcgccctcgccgccggccgccgaggagctgcccgggtcgcatgctgagccccctgtcccggcacagggcgaggccccaggagagcaggctcgggacgagcgctccgacagccgggcccaggcggtgtccgaggacgcgggaggaaacgagggcagagcggccgaggccgaaccccgggcgctggagaacggcgacgcggacgagccctccttcagcgaccccgaggacttcgtggacgacgtgagcgaggaagaattactgggagatgtactcaaagatcggccccaggaagcagatggaatcgattcggtgattgtagtggacaatgtccctcaggtgggacccgaccgacttgagaaactcaaaaatgtcatccacaagatcttttccaagtttgggaaaatcacaaatgatttttatcctgaagaggatgggaagacaaaagggtatattttcctggagtacgcgtcccctgcccacgctgtggatgctgtgaagaacgccgacggctacaagcttgacaagcagcacacattccgggtcaacctctttacggattttgacaagtatatgacgatcagtgacgagtgggatattccagagaaacagcctttcaaagacctggggaacttacgttactggcttgaagaggcagaatgcagagatcagtacagtgtgatttttgagagtggagaccgcacttccatattctggaatgacgtaaaagaccctgtctcaattgaagaaagagcgagatggacagagacgtatgtgcgttggtctcctaagggcacctacctggctacctttcatcaaagaggcattgctctatgggggggagagaaattcaagcaaattcagagattcagccaccaaggggttcagcttattgacttctcaccttgtgaaaggtacctggtgacctttagccccctgatggacacgcaggatgaccctcaggccataatcatctgggacatccttacggggcacaagaagaggggttttcactgtgagagctcagcccattggcctatttttaagtggagccatgatggcaaattctttgccagaatgaccctggatacgcttagcatctatgaaactccttctatgggtcttttggacaagaagagtttgaagatctctgggataaaagacttttcttggtctcctggtggtaacataatcgccttctgggtgcctgaagacaaagatattccagccagggtaaccctgatgcagctccctaccaggcaagagatccgagtgaggaacctgttcaatgtggtggactgcaagctccattggcagaagaacggagactacttgtgtgtgaaagtagataggactccgaaaggcacccagggtgttgtcacaaattttgaaattttccgaatgagggagaaacaggtacctgtggatgtggtcgagatgaaagaaaccatcatagcctttgcctgggaaccaaatggaagtaagtttgctgtgctgcacggagaggctccgcggatatctgtgtctttctaccacgtcaaaaacaacgggaagattgaactcatcaagatgttcgacaagcagcaggcgaacaccatcttctggagcccccaaggacagttcgtggtgttggcgggcctgaggagtatgaacggtgccttagcgtttgtggacacttcggactgcacggtcatgaacatcgcagagcactacatggcttccgacgtcgaatgggatcctactgggcgctacgtcgtcacctctgtgtcctggtggagccataaggtggacaacgcgtactggctgtggactttccagggacgcctcctgcagaagaacaacaaggaccgcttctgccagctgctgtggcggccccggcctcccacactcctgagccaggaacagatcaagcaaattaaaaaggatctgaagaaatactctaagatctttgaacagaaggatcgtttgagtcagtccaaagcctcaaaggaattggtggagagaaggcgcaccatgatggaagatttccggaagtaccggaaaatggcccaggagctctatatggagcagaaaaacgagcgcctggagttgcgaggaggggtggacactgacgagctggacagcaacgtggacgactgggaagaggagaccattgagttcttcgtcactgaagaaatcattcccctcgggaatcaggagtgacctggagcactgtggggacggactccgcctgctgttcccgcgctgagctacaggactcccgagtgtgagccgcggttcctctgttgcagcgcagccgtgtgtgctgtggagccgaggccgtcctgcaggaagccgcgtgactcccgcctcctccctgtgctctctggctctggactgtgactgcgcctggattctgccattgcgacacatttttgtgcctttcagcccctggtgtctgcagtgggggatttaaggcacccgcttccacttctttcttgtttggagttttctgttggaaccgccggcgttggctccgaagacttagcgacgccactggcggcaccttctcctgcgcccagtgatgtttccacggtgcctgtacacagccgagcagcatttccgttgaaggacttgcatccccattgcgggcagtgctggacgtgtcccggagacccaccgggagggcgccgccatgccttgtacccccaccgtgcaggttgtggccggttttctccgcaggttgaacatggaaataaaagcaaacttgtatgaaaaaa

SEQ ID NO: 428214 - DNA, 789 bp, Homo sapiens
gtggagagaaggcgcaccaattcctttgaggctttggactgactcaaacgatccttctgttcaaagatcgtttgagtcagtccaaagcctcaaaggaattggtggagagaaggcgcaccatgatggaagatttccggaagtaccggaaaatggcccaggagctctatatggagcagaaaaacgagcgcctggagttgcgaggaggggtggacactgacgagctggacagcaacgtggacgactgggaagaggagaccattgagttcttcgtcactgaagaaatcattcccctcgggaatcaggagtgacctggagcactgtggcagccgtgtgtgctgtggagccgaggccgtcctgcaggaagccgcgtgactcccgcctcctccctgtgctctctggctctggactgtgactgcgcctggattctgccattgcgacacatttttgtgcctttcagcccctggtgtctgcagtgggggatttaaggcacccgcttccacttctttcttgtttggagttttctgttggaaccgccggcgttggctccgaagacttagcgacgccactggcggcaccttctcctgcgcccagtgatgtttccacggtgcctgtacacagccgagcagcatttccgttgaaggacttgcatccccattgcgggcagtgctggacgtgtcccggagacccaccgggagggcgccgccatgccttgtacccccaccgtgcaggttgtggccggttttctccgcaggttgaacatggaaataaaagcaaacttgtatgaaaaaa

SEQ ID NO: 428215 - DNA, 585 bp, Homo sapiens
gagtgaggagtactttcttgtaaaattacattttctagatatggttggtgatatgattgggatatctgttccctccaaatctcatgctgaaatgtaacccccaggcctggcatggcagctcatacctgcaatcccagcaatttgggaggccaactgggctgaagcttaagcccgggagttcaagtccagcctgggtgacggagcaagaccctgtctaaaaaaaagagaaaagagattgagcctgtgttcttgtttggctttttgttttgccatggagaaaaggaggaaggaagggttaaaaataggtgagaaaatgggaaacatggccgcccttccaggcagggagaccggaggtcaggatcccactgtaggtgcacactgggtgcgagggaagcggcatccacagctgctgacaatgtcgggctcctgcggtcctgctgtgggtgtcctgctctcaggaagggagcagtttcacgtaggtcactccacacaagtggaagcagctgtctctgaaactccaggaatgtgcacctttcctgctgttgcttgctctcccgtccttttaatgaacttttacacgtcggg

SEQ ID NO: 428216 - DNA, 263 bp, Homo sapiens
taagagtcggtactgttgctaggtggagtccatatgagtctgtgcgtgatggtggggttgctaatattctgtctgcattcactccttgtcacagtgagcacagtagtgccacagggtcctggcgaggacctatgaagctgcgcggaatgcccagagcagtggctgtgcagagggagcgctcagcgtcaggtgtgacagcattgagcttctatatagcaaatgagttgttatattctcttcgtgcttttcagtttcgtcatcac

SEQ ID NO: 428217 - DNA, 484 bp, Homo sapiens
cgccttgtcgctaggagagtggctttggtcttttggggtcacacgtctctgacatctctctgttggggtccctgcagcagtgaacatttgctgtaaagggaattctttgtccagttacctcaggaaataagatagtattgttttgaaatacccctgtcgcatcttcttttttttcccatttaaagtatggatcatgacttagggggtacttggcgatggactttgtaaaattgttttccgaggtggtccagcattaccagctctgccctcatgggcagcatgagcacggccaagtcctccagccttggctgccccggcactgtggaagccctcgcagctcgtgacaggcgcgctctttcctttcagagatgttcgacaagcagcaggcgaacaccatcttctggagcccccaaggacagttcgtggtgttggcgggcctgaggaggtaggtgtctgcgctctgagcctgtccgccctgtgagta

SEQ ID NO: 428218 - DNA, 917 bp, Homo sapiens
caagtagctgggactgcaggtgcctgccaccatgcctagctaatttttgtatttttagtagagatggggtttcactgtgttggccatgctggtctcagaactcctgacctcaagtgatctgcccacctcagcctcccaaagtgctgggattactggcgtgagccaccacacccagccatttttaaatcttttttgagacagagtcttactctgttgcccaggctggagtacagtggcgtgatctcggctgactgcagccttcacctcccaggttcaaacgattctggtgcttcagtctcctgagtagctggaattacaggcgcgcaaccactacgcccagctaattttttgtatattttagaagagtcggggtttcaccatgttggccaggctggtctcgaactcctgacctcaagtgatccgcctgcccgcctcagcctctcaaagtgcagggattacaggtgtgagccaccgcgcccggcctaaggtgagtttgttctggacacaaggatggaggcttgagtcagtgggcagcaaggctgctcagcattgggcccgccacccttgaggcaccacttcagtgaccccttcccgtgcctagaaatgaattttcaaggccagagccttgagtcggcttccttccatctacctcgtctttgatctagaaactgaggagggtggggtttccagccttttaaggaaaagaggggactctgcttaggtgaaaggttttcctggtactcttccatccgaggcagggtttggggagccttcggctcattttcaccagcaaagaatgggcacgtttttatttatcgcaaaacttgggactggtcagtatcacggcagtgaacttccaacaatccaaggacattgacgtttcttctttcgtttttacattcttgggcaaaattatg

SEQ ID NO: 428219 - DNA, 3196 bp, Homo sapiens
gttcagtcccgccccgcagcgtccgacgggaaaggaaagggggaggacgccatgttggacggaaccatctgctgccacacatggggtggtcaatgctcccatgagtttactgatgcacagaaacaaccttgctgaatggaattaagcactttcttgtcacaaatatatcagtttgatgattttcgggcgcggtcttgtggatgcgagtcctctcagggtcgttcgtgaggccccagggcgtgggtgcgccccccgccccgcggccttggtgcggcctccccgtcgcacgcacatggctgggctgtagccgtcgcggcgcgcggtgcggcctgggagagtcggaagcgcggcggccgcggagccctgcgagtaggcagcgttgggcccatgcaggacgcggagaacgtggcggtgcccgaggcggccgaggagcgcgccgagcccggccagcagcagccggccgccgagccgccgccagccgaggggctgctgcggcccgcggggcccggcgctccggaggccgcggggaccgaggcctccagtgaggaggtggggatcgcggaggccgggccggagcccgagggcgaggccccaggagagcaggctcgggacgagcgctccgacagccgggcccaggcggtgtccgaggacgcgggaggaaacgagggcagagcggccgaggccgaaccccgggcgctggagaacggcgacgcggacgagccctccttcagcgaccccgaggacttcgtggacgacgtgagcgaggaagaattactgggagatgtactcaaagatcggccccaggaagcagatggaatcgattcggtgattgtagtggacaatgtccctcaggtgggacccgaccgacttgagaaactcaaaaatgtcatccacaagatcttttccaagtttgggaaaatcacaaatgatttttatcctgaagaggatgggaagacaaaagggtatattttcctggagtacgcgtcccctgcccacgctgtggatgctgtgaagaacgccgacggctacaagcttgacaagcagcacacattccgggtcaacctctttacggattttgacaagtatatgacgatcagtgacgagtgggatattccagagaaacagcctttcaaagacctggggaacttacgttactggcttgaagaggcagaatgcagagatcagtacagtgtgatttttgagagtggagaccgcacttccatattctggaatgacgtaaaagaccctgtctcaattgaagaaagagcgagatggacagagacgtatgtgcgttggtctcctaagggcacctacctggctacctttcatcaaagaggcattgctctatgggggggagagaaattcaagcaaattcagagattcagccaccaaggggttcagcttattgacttctcaccttgtgaaaggtacctggtgacctttagccccctgatggacacgcaggatgaccctcaggccataatcatctgggacatccttacggggcacaagaagaggggttttcactgtgagagctcagcccattggcctatttttaagtggagccatgatggcaaattctttgccagaatgaccctggatacgcttagcatctatgaaactccttctatgggtcttttggacaagaagagtttgaagatctctgggataaaagacttttcttggtctcctggtggtaacataatcgccttctgggtgcctgaagacaaagatattccagccagggtaaccctgatgcagctccctaccaggcaagagatccgagtgaggaacctgttcaatgtggtggactgcaagctccattggcagaagaacggagactacttgtgtgtgaaagtagataggactccgaaaggcacccagggtgttgtcacaaattttgaaattttccgaatgagggagaaacaggtacctgtggatgtggtcgagatgaaagaaaccatcatagcctttgcctgggaaccaaatggaagtaagtttgctgtgctgcacggagaggctccgcggatatctgtgtctttctaccacgtcaaaaacaacgggaagattgaactcatcaagatgttcgacaagcagcaggcgaacaccatcttctggagcccccaaggacagttcgtggtgttggcgggcctgaggagtatgaacggtgccttagcgtttgtggacacttcggactgcacggtcatgaacatcgcagagcactacatggcttccgacgtcgaatgggatcctactgggcgctacgtcgtcacctctgtgtcctggtggagccataaggtggacaacgcgtactggctgtggactttccagggacgcctcctgcagaagaacaacaaggaccgcttctgccagctgctgtggcggccccggcctcccacactcctgagccaggaacagatcaagcaaattaaaaaggatctgaagaaatactctaagatctttgaacagaaggatcgtttgagtcagtccaaagcctcaaaggaattggtggagagaaggcgcaccatgatggaagatttccggaagtaccggaaaatggcccaggagctctatatggagcagaaaaacgagcgcctggagttgcgaggaggggtggacactgacgagctggacagcaacgtggacgactgggaagaggagaccattgagttcttcgtcactgaagaaatcattcccctcgggaatcaggagtgacctggagcactgtggcagccgtgtgtgctgtggagccgaggccgtcctgcaggaagccgcgtgactcccgcctcctccctgtgctctctggctctggactgtgactgcgcctggattctgccattgcgacacatttttgtgcctttcagcccctggtgtctgcagtgggggatttaaggcacccgcttccacttctttcttgtttggagttttctgttggaaccgccggcgttggctccgaagacttagcgacgccactggcggcaccttctcctgcgcccagtgatgtttccacggtgcctgtacacagccgagcagcatttccgttgaaggacttgcatccccattgcgggcagtgctggacgtgtcccggagacccaccgggagggcgccgccatgccttgtacccccaccgtgcaggttgtggccggttttctccgcaggttgaacatggaaataaaagcaaacttgtatgaaaaaa

SEQ ID NO: 428220 - DNA, 2320 bp, Homo sapiens
  misc_feature (17)..(17): n is a, c, g, or t
cgagcccggtacccgangcgcacgatggcgcgtcccctgcccacgctgtggatgctgtgaagaacgccgacggctacaagcttgacaagcagcacacattccgggtcaacctctttacggattttgacaagtatatgacgatcagtgacgagtgggatattccagagaaacagcctttcaaagacctggggaacttacgttactggcttgaagaggcagaatgcagagatcagtacagtgtgatttttgagagtggagaccgcacttccatattctggaatgacgtaaaagaccctgtctcaattgaagaaagagcgagatggacagagacgtatgtgcgttggtctcctaagggcacctacctggctacctttcatcaaagaggcattgctctatgggggggagagaaattcaagcaaattcagagattcagccaccaaggggttcagcttattgacttctcaccttgtgaaaggtacctggtgacctttagccccctgatggacacgcaggatgaccctcaggccataatcatctgggacatccttacggggcacaagaagaggggttttcactgtgagagctcagcccattggcctatttttaagtggagccatgatggcaaattctttgccagaatgaccctggatacgcttagcatctatgaaactccttctatgggtcttttggacaagaagagtttgaagatctctgggataaaagacttttcttggtctcctggtggtaacataatcgccttctgggtgcctgaagacaaagatattccagccagggtaaccctgatgcagctccctaccaggcaagagatccgagtgaggaacctgttcaatgtggtggactgcaagctccattggcagaagaacggagactacttgtgtgtgaaagtagataggactccgaaaggcacccagggtgttgtcacaaattttgaaattttccgaatgagggagaaacaggtacctgtggatgtggtcgagatgaaagaaaccatcatagcctttgcctgggaaccaaatggaagtaagtttgctgtgctgcacggagaggctccgcggatatctgtgtctttctaccacgtcaaaaacaacgggaagattgaactcatcaagatgttcgacaagcagcaggcgaacaccatcttctggagcccccaaggacagttcgtggtgttggcgggcctgaggagtatgaacggtgccttagcgtttgtggacacttcggactgcacggtcatgaacatcgcagagcactacatggcttccgacgtcgaatgggatcctactgggcgctacgtcgtcacctctgtgtcctggtggagccataaggtggacaacgcgtactggctgtggactttccagggacgcctcctgcagaagaacaacaaggaccgcttctgccagctgctgtggcggccccggcctcccacactcctgagccaggaacagatcaagcaaattaaaaaggatctgaagaaatactctaagatctttgaacagaaggatcgtttgagtcagtccaaagcctcaaaggaattggtggagagaaggcgcaccatgatggaagatttccggaagtaccggaaaatggcccaggagctctatatggagcagaaaaacgagcgcctggagttgcgaggaggggtggacactgacgagctggacagcaacgtggacgactgggaagaggagaccattgagttcttcgtcactgaagaaatcattcccctcgggaatcaggagtgacctggagcactgtggggacggactccgcctgctgttcccgcgctgagctacaggactcccgagtgtgagccgcggttcctctgttgcagcgcagccgtgtgtgctgtggagccgaggccgtcctgcaggaagccgcgtgactcccgcctcctccctgtgctctctggctctggactgtgactgcgcctggattctgccattgcgacacatttttgtgcctttcagcccctggtgtctgcagtgggggatttaaggcacccgcttccacttctttcttgtttggagttttctgttggaaccgccggcgttggctccgaagacttagcgacgccactggcggcaccttctcctgcgcccagtgatgtttccacggtgcctgtacacagccgagcagcatttccgttgaaggacttgcatccccattgcgggcagtgctggacgtgtcccggagacccaccgggagggcgccgccatgccttgtacccccaccgtgcaggttgtggccggttttctccgcaggttgaacatggaaataaaagcaaacttgtatgaaaaaa

SEQ ID NO: 428221 - DNA, 3412 bp, Homo sapiens
gttcagtcccgccccgcagcgtccgacgggaaaggaaagggggaggacgccatgttggacggaaccatctgctgccacacatggggtggtcaatgctcccatgagtttactgatgcacagaaacaaccttgctgaatggaattaagcactttcttgtcacaaatatatcagtttgatgattttcgggcgcggtcttgtggatgcgagtcctctcagggtcgttcgtgaggccccagggcgtgggtgcgccccccgccccgcggccttggtgcggcctccccgtcgcacgcacatggctgggctgtagccgtcgcggcgcgcggtgcggcctgggagagtcggaagcgcggcggccgcggagccctgcgagtaggcagcgttgggcccatgcaggacgcggagaacgtggcggtgcccgaggcggccgaggagcgcgccgagcccggccagcagcagccggccgccgagccgccgccagccgaggggctgctgcggcccgcggggcccggcgctccggaggccgcggggaccgaggcctccagtgaggaggtggggatcgcggaggccgggccggagcccgaggtgaggaccgagccggcggccgaggcagaggcggcctccggcccgtccgagtcgccctcgccgccggccgccgaggagctgcccgggtcgcatgctgagccccctgtcccggcacagggcgaggccccaggagagcaggctcgggacgagcgctccgacagccgggcccaggcggtgtccgaggacgcgggaggaaacgagggcagagcggccgaggccgaaccccgggcgctggagaacggcgacgcggacgagccctccttcagcgaccccgaggacttcgtggacgacgtgagcgaggaagaattactgggagatgtactcaaagatcggccccaggaagcagatggaatcgattcggtgattgtagtggacaatgtccctcaggtgggacccgaccgacttgagaaactcaaaaatgtcatccacaagatcttttccaagtttgggaaaatcacaaatgatttttatcctgaagaggatgggaagacaaaagggtatattttcctggagtacgcgtcccctgcccacgctgtggatgctgtgaagaacgccgacggctacaagcttgacaagcagcacacattccgggtcaacctctttacggattttgacaagtatatgacgatcagtgacgagtgggatattccagagaaacagcctttcaaagacctggggaacttacgttactggcttgaagaggcagaatgcagagatcagtacagtgtgatttttgagagtggagaccgcacttccatattctggaatgacgtaaaagaccctgtctcaattgaagaaagagcgagatggacagagacgtatgtgcgttggtctcctaagggcacctacctggctacctttcatcaaagaggcattgctctatgggggggagagaaattcaagcaaattcagagattcagccaccaaggggttcagcttattgacttctcaccttgtgaaaggtacctggtgacctttagccccctgatggacacgcaggatgaccctcaggccataatcatctgggacatccttacggggcacaagaagaggggttttcactgtgagagctcagcccattggcctatttttaagtggagccatgatggcaaattctttgccagaatgaccctggatacgcttagcatctatgaaactccttctatgggtcttttggacaagaagagtttgaagatctctgggataaaagacttttcttggtctcctggtggtaacataatcgccttctgggtgcctgaagacaaagatattccagccagggtaaccctgatgcagctccctaccaggcaagagatccgagtgaggaacctgttcaatgtggtggactgcaagctccattggcagaagaacggagactacttgtgtgtgaaagtagataggactccgaaaggcacccagggtgttgtcacaaattttgaaattttccgaatgagggagaaacaggtacctgtggatgtggtcgagatgaaagaaaccatcatagcctttgcctgggaaccaaatggaagtaagtttgctgtgctgcacggagaggctccgcggatatctgtgtctttctaccacgtcaaaaacaacgggaagattgaactcatcaagatgttcgacaagcagcaggcgaacaccatcttctggagcccccaaggacagttcgtggtgttggcgggcctgaggagtatgaacggtgccttagcgtttgtggacacttcggactgcacggtcatgaacatcgcagagcactacatggcttccgacgtcgaatgggatcctactgggcgctacgtcgtcacctctgtgtcctggtggagccataaggtggacaacgcgtactggctgtggactttccagggacgcctcctgcagaagaacaacaaggaccgcttctgccagctgctgtggcggccccggcctcccacactcctgagccaggaacagatcaagcaaattaaaaaggatctgaagaaatactctaagatctttgaacagaaggatcgtttgagtcagtccaaagcctcaaaggaattggtggagagaaggcgcaccatgatggaagatttccggaagtaccggaaaatggcccaggagctctatatggagcagaaaaacgagcgcctggagttgcgaggaggggtggacactgacgagctggacagcaacgtggacgactgggaagaggagaccattgagttcttcgtcactgaagaaatcattcccctcgggaatcaggagtgacctggagcactgtgggccgccatgcctgtctatccaggggacggactccgcctgctgttcccgcgctgagctacaggactcccgagtgtgagccgcggttcctctgttgcagcgcagccgtgtgtgctgtggagccgaggccgtcctgcaggaagccgcgtgactcccgcctcctccctgtgctctctggctctggactgtgactgcgcctggattctgccattgcgacacatttttgtgcctttcagcccctggtgtctgcagtgggggatttaaggcacccgcttccacttctttcttgtttggagttttctgttggaaccgccggcgttggctccgaagacttagcgacgccactggcggcaccttctcctgcgcccagtgatgtttccacggtgcctgtacacagccgagcagcatttccgttgaaggacttgcatccccattgcgggcagtgctggacgtgtcccggagacccaccgggagggcgccgccatgccttgtacccccaccgtgcaggttgtggccggttttctccgcaggttgaacatggaaataaaagcaaacttgtatgaaaaaa

SEQ ID NO: 428222 - DNA, 3668 bp, Homo sapiens
gttcagtcccgccccgcagcgtccgacgggaaaggaaagggggaggacgccatgttggacggaaccatctgctgccacacatggggtggtcaatgctcccatgagtttactgatgcacagaaacaaccttgctgaatggaattaagcactttcttgtcacaaatatatcagtttgatgattttcgggcgcggtcttgtggatgcgagtcctctcagggtcgttcgtgaggccccagggcgtgggtgcgccccccgccccgcggccttggtgcggcctccccgtcgcacgcacatggctgggctgtagccgtcgcggcgcgcggtgcggcctgggagagtcggaagcgcggcggccgcggagccctgcgagtaggcagcgttgggcccatgcaggacgcggagaacgtggcggtgcccgaggcggccgaggagcgcgccgagcccggccagcagcagccggccgccgagccgccgccagccgaggggctgctgcggcccgcggggcccggcgctccggaggccgcggggaccgaggcctccagtgaggaggtggggatcgcggaggccgggccggagcccgaggtgaggaccgagccggcggccgaggcagaggcggcctccggcccgtccgagtcgccctcgccgccggccgccgaggagctgcccgggtcgcatgctgagccccctgtcccggcacagggcgaggccccaggagagcaggctcgggacgagcgctccgacagccgggcccaggcggtgtccgaggacgcgggaggaaacgagggcagagcggccgaggccgaaccccgggcgctggagaacggcgacgcggacgagccctccttcagcgaccccgaggacttcgtggacgacgtgagcgaggaagaattactgggagatgtactcaaagatcggccccaggaagcagatggaatcgattcggtgattgtagtggacaatgtccctcaggtgggacccgaccgacttgagaaactcaaaaatgtcatccacaagatcttttccaagtttgggaaaatcacaaatgatttttatcctgaagaggatgggaagacaaaagggtatattttcctggagtacgcgtcccctgcccacgctgtggatgctgtgaagaacgccgacggctacaagcttgacaagcagcacacattccgggtcaacctctttacggattttgacaagtatatgacgatcagtgacgagtgggatattccagagaaacagcctttcaaagacctggggaacttacgttactggcttgaagaggcagaatgcagagatcagtacagtgtgatttttgagagtggagaccgcacttccatattctggaatgacgtaaaagaccctgtctcaattgaagaaagagcgagatggacagagacgtatgtgcgttggtctcctaagggcacctacctggctacctttcatcaaagaggcattgctctatgggggggagagaaattcaagcaaattcagagattcagccaccaaggggttcagcttattgacttctcaccttgtgaaaggtacctggtgacctttagccccctgatggacacgcaggatgaccctcaggccataatcatctgggacatccttacggggcacaagaagaggggttttcactgtgagagctcagcccattggcctatttttaagtggagccatgatggcaaattctttgccagaatgaccctggatacgcttagcatctatgaaactccttctatgggtcttttggacaagaagagtttgaagatctctgggataaaagacttttcttggtctcctggtggtaacataatcgccttctgggtgcctgaagacaaagatattccagccagggtaaccctgatgcagctccctaccaggcaagagatccgagtgaggaacctgttcaatgtggtggactgcaagctccattggcagaagaacggagactacttgtgtgtgaaagtagataggactccgaaaggcacccagggtgttgtcacaaattttgaaattttccgaatgagggagaaacaggtacctgtggatgtggtcgagatgaaagaaaccatcatagcctttgcctgggaaccaaatggaagtaagtttgctgtgctgcacggagaggctccgcggatatctgtgtctttctaccacgtcaaaaacaacgggaagattgaactcatcaagatgttcgacaagcagcaggcgaacaccatcttctggagcccccaaggacagttcgtggtgttggcgggcctgaggagtatgaacggtgccttagcgtttgtggacacttcggactgcacggtcatgaacatcgcagagcactacatggcttccgacgtcgaatgggatcctactgggcgctacgtcgtcacctctgtgtcctggtggagccataaggtggacaacgcgtactggctgtggactttccagggacgcctcctgcagaagaacaacaaggaccgcttctgccagctgctgtggcggccccggcctcccacactcctgagccaggaacagatcaagcaaattaaaaaggatctgaagaaatactctaagatctttgaacagaaggatcgtttgagtcagtccaaagcctcaaaggaattggtggagagaaggcgcaccatgatggaagatttccggaagtaccggaaaatggcccaggagctctatatggagcagaaaaacgagcgcctggagttgcgaggaggggtggacactgacgagctggacagcaacgtggacgactgggaagaggagaccattgagttcttcgtcactgaagaaatcattcccctcgggaatcaggagtgacctggagcactgtggggacggactccgcctgctgttcccgcgctgagctacaggactcccgagtgtgagccgcggttcctctgttgcagcgcagccgtgtgtgctgtggagccgaggccgtcctgcaggaagccgcgtgactcccgcctcctccctgtgctctctggctctggactgtgactgcgcctggattctgccattgcgacacatttttgtgcctttcagcccctggtgtctgcagtgggggatttaaggcacccgcttccacttctttcttgtttggagttttctgttggaaccgccggcgttggctccgaagacttagcgacgccactggcggcaccttctcctgcgcccagtgatgtttccacggtgcctgtacacagccgagcagcatttccgttgaaggacttgcatccccattgcgggcagtgctggacgtgtcccggagacccaccgggagggcgccgccatgccttgtacccccaccgtgcaggttgtggccggttttctccgcaggttgaacatggaaataaaagcaaacttgtatgaaaaaaaaaaaaaaaaaaaaaagaaaaaaactgtctgcgcgcacagggccccaaagagaggcatagaaaacacagacgttggcgaccacacggcccccagagatgagaagtgaaacacaggcacaaagagggtcacacagggaaagaccgggggccgagaaagagggagcggaatacgacccaaatatacaaagccacgggcgcaacaacgacagagtggagacaacatccaagggagcaagaggcacacacgggacacacaaaggcagcagcggagctagaata

SEQ ID NO: 428223 - DNA, 1890 bp, Homo sapiens
  misc_feature (21)..(21): n is a, c, g, or t
  misc_feature (29)..(29): n is a, c, g, or t
  misc_feature (31)..(31): n is a, c, g, or t
  misc_feature (44)..(44): n is a, c, g, or t
aactgagtatagtacgaggcngggtgtgntntcaccttgtgaanggtacctggtgacctttagccccctgatggacacgcaggatgaccctcaggccataatcatctgggacatccttacggggcacaagaagaggggttttcactgtgagagctcagcccattggcctatttttaagtggagccatgatggcaaattctttgccagaatgaccctggatacgcttagcatctatgaaactccttctatgggtcttttggacaagaagagtttgaagatctctgggataaaagacttttcttggtctcctggtggtaacataatcgccttctgggtgcctgaagacaaagatattccagccagggtaaccctgatgcagctccctaccaggcaagagatccgagtgaggaacctgttcaatgtggtggactgcaagctccattggcagaagaacggagactacttgtgtgtgaaagtagataggactccgaaaggcacccagggtgttgtcacaaattttgaaattttccgaatgagggagaaacaggtacctgtggatgtggtcgagatgaaagaaaccatcatagcctttgcctgggaaccaaatggaagtaagtttgctgtgctgcacggagaggctccgcggatatctgtgtctttctaccacgtcaaaaacaacgggaagattgaactcatcaagatgttcgacaagcagcaggcgaacaccatcttctggagcccccaaggacagttcgtggtgttggcgggcctgaggagtatgaacggtgccttagcgtttgtggacacttcggactgcacggtcatgaacatcgcagagcactacatggcttccgacgtcgaatgggatcctactgggcgctacgtcgtcacctctgtgtcctggtggagccataaggtggacaacgcgtactggctgtggactttccagggacgcctcctgcagaagaacaacaaggaccgcttctgccagctgctgtggcggccccggcctcccacactcctgagccaggaacagatcaagcaaattaaaaaggatctgaagaaatactctaagatctttgaacagaaggatcgtttgagtcagtccaaagcctcaaaggaattggtggagagaaggcgcaccatgatggaagatttccggaagtaccggaaaatggcccaggagctctatatggagcagaaaaacgagcgcctggagttgcgaggaggggtggacactgacgagctggacagcaacgtggacgactgggaagaggagaccattgagttcttcgtcactgaagaaatcattcccctcgggaatcaggagtgacctggagcactgtggggacggactccgcctgctgttcccgcgctgagctacaggactcccgagtgtgagccgcggttcctctgttgcagcgcagccgtgtgtgctgtggagccgaggccgtcctgcaggaagccgcgtgactcccgcctcctccctgtgctctctggctctggactgtgactgcgcctggattctgccattgcgacacatttttgtgcctttcagcccctggtgtctgcagtgggggatttaaggcacccgcttccacttctttcttgtttggagttttctgttggaaccgccggcgttggctccgaagacttagcgacgccactggcggcaccttctcctgcgcccagtgatgtttccacggtgcctgtacacagccgagcagcatttccgttgaaggacttgcatccccattgcgggcagtgctggacgtgtcccggagacccaccgggagggcgccgccatgccttgtacccccaccgtgcaggttgtggccggttttctccgcaggttgaacatggaaataaaagcaaacttgtatgaaaaaa

SEQ ID NO: 428224 - DNA, 3146 bp, Homo sapiens
gttcagtcccgccccgcagcgtccgacgggaaaggaaagggggaggacgccatgttggacggaaccatctgctgccacacatggggtggtcaatgctcccatgagtttactgatgcacagaaacaaccttgctgaatggaattaagcactttcttgtcacaaatatatcagtttgatgattttcgggcgcggtcttgtggatgcgagtcctctcagggtcgttcgtgaggccccagggcgtgggtgcgccccccgccccgcggccttggtgcggcctccccgtcgcacgcacatggctgggctgtagccgtcgcggcgcgcggtgcggcctgggagagtcggaagcgcggcggccgcggagccctgcgagtaggcagcgttgggcccatgcaggacgcggagaacgtggcggtgcccgaggcggccgaggagcgcgccgagcccggccagcagcagccggccgccgagccgccgccagccgaggggctgctgcggcccgcggggcccggcgctccggaggccgcggggaccgaggcctccagtgaggaggtggggatcgcggaggccgggccggagcccgaggtgaggaccgagccggcggccgaggcagaggcggcctccggcccgtccgagtcgccctcgccgccggccgccgaggagctgcccgggtcgcatgctgagccccctgtcccggcacagggcgaggccccaggagagcaggctcgggacgagcgctccgacagccgggcccaggcggtgtccgaggacgcgggaggaaacgagggcagagcggccgaggccgaaccccgggcgctggagaacggcgacgcggacgagccctccttcagcgaccccgaggacttcgtggacgacgtgagcgaggaagaattactgggagatgtactcaaagatcggccccaggaagcagatggaatcgattcggtgattgtagtggacaatgtccctcaggtgggacccgaccgacttgagaaactcaaaaatgtcatccacaagatcttttccaagtttgggaaaatcacaaatgatttttatcctgaagaggatgggaagacaaaagggtatattttcctggagtacgcgtcccctgcccacgctgtggatgctgtgaagaacgccgacggctacaagcttgacaagcagcacacattccgggtcaacctctttacggattttgacaagtatatgacgatcagtgacgagtgggatattccagagaaacagcctttcaaagacctggggaacttacgttactggcttgaagaggcagaatgcagagatcagtacagtgtgatttttgagagtggagaccgcacttccatattctggaatgacgtaaaagaccctgtctcaattgaagaaagagcgaagaggggttttcactgtgagagctcagcccattggcctatttttaagtggagccatgatggcaaattctttgccagaatgaccctggatacgcttagcatctatgaaactccttctatgggtcttttggacaagaagagtttgaagatctctgggataaaagacttttcttggtctcctggtggtaacataatcgccttctgggtgcctgaagacaaagatattccagccagggtaaccctgatgcagctccctaccaggcaagagatccgagtgaggaacctgttcaatgtggtggactgcaagctccattggcagaagaacggagactacttgtgtgtgaaagtagataggactccgaaaggcacccagggtgttgtcacaaattttgaaattttccgaatgagggagaaacaggtacctgtggatgtggtcgagatgaaagaaaccatcatagcctttgcctgggaaccaaatggaagtaagtttgctgtgctgcacggagaggctccgcggatatctgtgtctttctaccacgtcaaaaacaacgggaagattgaactcatcaagatgttcgacaagcagcaggcgaacaccatcttctggagcccccaaggacagttcgtggtgttggcgggcctgaggagtatgaacggtgccttagcgtttgtggacacttcggactgcacggtcatgaacatcgcagagcactacatggcttccgacgtcgaatgggatcctactgggcgctacgtcgtcacctctgtgtcctggtggagccataaggtggacaacgcgtactggctgtggactttccagggacgcctcctgcagaagaacaacaaggaccgcttctgccagctgctgtggcggccccggcctcccacactcctgagccaggaacagatcaagcaaattaaaaaggatctgaagaaatactctaagatctttgaacagaaggatcgtttgagtcagtccaaagcctcaaaggaattggtggagagaaggcgcaccatgatggaagatttccggaagtaccggaaaatggcccaggagctctatatggagcagaaaaacgagcgcctggagttgcgaggaggggtggacactgacgagctggacagcaacgtggacgactgggaagaggagaccattgagttcttcgtcactgaagaaatcattcccctcgggaatcaggagtgacctggagcactgtggggacggactccgcctgctgttcccgcgctgagctacaggactcccgagtgtgagccgcggttcctctgttgcagcgcagccgtgtgtgctgtggagccgaggccgtcctgcaggaagccgcgtgactcccgcctcctccctgtgctctctggctctggactgtgactgcgcctggattctgccattgcgacacatttttgtgcctttcagcccctggtgtctgcagtgggggatttaaggcacccgcttccacttctttcttgtttggagttttctgttggaaccgccggcgttggctccgaagacttagcgacgccactggcggcaccttctcctgcgcccagtgatgtttccacggtgcctgtacacagccgagcagcatttccgttgaaggacttgcatccccattgcgggcagtgctggacgtgtcccggagacccaccgggagggcgccgccatgccttgtacccccaccgtgcaggttgtggccggttttctccgcaggttgaacatggaaataaaagcaaacttgtatgaaaaaa

SEQ ID NO: 428225 - DNA, 3178 bp, Homo sapiens
gttcagtcccgccccgcagcgtccgacgggaaaggaaagggggaggacgccatgttggacggaaccatctgctgccacacatggggtggtcaatgctcccatgagtttactgatgcacagaaacaaccttgctgaatggaattaagcactttcttgtcacaaatatatcagtttgatgattttcgggcgcggtcttgtggatgcgagtcctctcagggtcgttcgtgaggccccagggcgtgggtgcgccccccgccccgcggccttggtgcggcctccccgtcgcacgcacatggctgggctgtagccgtcgcggcgcgcggtgcggcctgggagagtcggaagcgcggcggccgcggagccctgcgagtaggcagcgttgggcccatgcaggacgcggagaacgtggcggtgcccgaggcggccgaggagcgcgccgagcccggccagcagcagccggccgccgagccgccgccagccgaggggctgctgcggcccgcggggcccggcgctccggaggccgcggggaccgaggcctccagtgaggaggtggggatcgcggaggccgggccggagcccgaggtgaggaccgagccggcggccgaggcagaggcggcctccggcccgtccgagtcgccctcgccgccggccgccgaggagctgcccgggtcgcatgctgagccccctgtcccggcacagggcgaggccccaggagagcaggctcgggacgagcgctccgacagccgggcccaggcggtgtccgaggacgcgggaggaaacgagggcagagcggccgaggccgaaccccgggcgctggagaacggcgacgcggacgagccctccttcagcgaccccgaggacttcgtggacgacgtgagcgaggaagaattactgggagatgtactcaaagatcggccccaggaagcagatggaatcgattcggtgattgtagtggacaatgtccctcaggtgggacccgaccgacttgagaaactcaaaaatgtcatccacaagatcttttccaagtttgggaaaatcacaaatgatttttatcctgaagaggatgggaagacaaaagggtatattttcctggagtacgcgtcccctgcccacgctgtggatgctgtgaagaacgccgacggctacaagcttgacaagcagcacacattccgggtcaacctctttacggattttgacaagtatatgacgatcagtgacgagtgggatattccagagaaacagcctttcaaagacctggggaacttacgttactggcttgaagaggcagaatgcagagatcagtacagtgtgatttttgagagtggagaccgcacttccatattctggaatgacgtaaaagaccctgtctcaattgaagaaagagcgagatggacagagacgtatgtgcgttggtctcctaagggcacctacctggctacctttcatcaaagaggcattgctctatgggggggagagaaattcaagcaaattcagagattcagccaccaaggggttcagcttattgacttctcaccttgtgaaaggtacctggtgacctttagccccctgatggacacgcaggatgaccctcaggccataatcatctgggacatccttacggggcacaagaagaggggttttcactgtgagagctcagcccattggcctatttttaagtggagccatgatggcaaattctttgccagaatgaccctggatacgcttagcatctatgaaactccttctatgggtcttttggacaagaagagtttgaagatctctgggataaaagacttttcttggtctcctggtggtaacataatcgccttctgggtgcctgaagacaaagatattccagccagggtaaccctgatgcagctccctaccaggcaagagatccgagtgaggaacctgttcaatgtggtggactgcaagctccattggcagaagaacggagactacttgtgtgtgaaagtagataggactccgaaaggcacccagggtgttgtcacaaattttgaaattttccgaatgagggagaaacaggtacctgtggatgtggtcgagatgaaagaaaccatcatagcctttgcctgggaaccaaatggaagtaagtttgctgtgctgcacggagaggctccgcggatatctgtgtctttctaccacgtcaaaaacaacgggaagattgaactcatcaagatgttcgacaagcagcaggcgaacaccatcttctggagcccccaaggacagttcgtggtgttggcgggcctgaggagtatgaacggtgccttagcgtttgtggacacttcggactgcacggtcatgaacatcgcagagcactacatggcttccgacgtcgaatgggatcctactgggcgctacgtcgtcacctctgtgtcctggtggagccataaggtggacaacgcgtactggctgtggactttccagggacgcctcctgcagaagaacaacaaggaccgcttctgccagctgctgtggcggccccggcctcccacactcctgagccaggaacagatcaagcaaattaaaaaggatctgaagaaatactctaagatctttgaacagaaggatcgtttgagtcagtccaaagcctcaaaggaattggtggagagaaggcgcaccatgatggaagatttccggaagtaccggaaaatggcccaggagctctatatggagcagaaaaacgagcgcctggagttgcgaggaggggtggacactgacgagctggacagcaacgtggacgactgggaagaggagaccattgagttcttcgtcactgaagaaatcattcccctcgggaatcaggagtgacctggagcactgtgcccctggtgtctgcagtgggggatttaaggcacccgcttccacttctttcttgtttggagttttctgttggaaccgccggcgttggctccgaagacttagcgacgccactggcggcaccttctcctgcgcccagtgatgtttccacggtgcctgtacacagccgagcagcatttccgttgaaggacttgcatccccattgcgggcagtgctggacgtgtcccggagacccaccgggagggcgccgccatgccttgtacccccaccgtgcaggttgtggccggttttctccgcaggttgaacatggaaataaaagcaaacttgtatgaaaaaa

SEQ ID NO: 428226 - DNA, 2995 bp, Homo sapiens
gttcagtcccgccccgcagcgtccgacgggaaaggaaagggggaggacgccatgttggacggaaccatctgctgccacacatggggtggtcaatgctcccatgagtttactgatgcacagaaacaaccttgctgaatggaattaagcactttcttgtcacaaatatatcagtttgatgattttcgggcgcggtcttgtggatgcgagtcctctcagggtcgttcgtgaggccccagggcgtgggtgcgccccccgccccgcggccttggtgcggcctccccgtcgcacgcacatggctgggctgtagccgtcgcggcgcgcggtgcggcctgggagagtcggaagcgcggcggccgcggagccctgcgagtaggcagcgttgggcccatgcaggacgcggagaacgtggcggtgcccgaggcggccgaggagcgcgccgagcccggccagcagcagccggccgccgagccgccgccagccgaggggctgctgcggcccgcggggcccggcgctccggaggccgcggggaccgaggcctccagtgaggaggtggggatcgcggaggccgggccggagcccgaggtgaggaccgagccggcggccgaggcagaggcggcctccggcccgtccgagtcgccctcgccgccggccgccgaggagctgcccgggtcgcatgctgagccccctgtcccggcacagggcgaggccccaggagagcaggctcgggacgagcgctccgacagccgggcccaggcggtgtccgaggacgcgggaggaaacgagggcagagcggccgaggccgaaccccgggcgctggagaacggcgacgcggacgagccctccttcagcgaccccgaggacttcgtggacgacgtgagcgaggaagaattactgggagatgtactcaaagatcggccccaggaagcagatggaatcgattcggtgattgtagtggacaatgtccctcaggtgggacccgaccgacttgagaaactcaaaaatgtcatccacaagatcttttccaagtttgggaaaatcacaaatgatttttatcctgaagaggatgggaagacaaaagggtatattttcctggagtacgcgtcccctgcccacgctgtggatgctgtgaagaacgccgacggctacaagcttgacaagcagcacacattccgggtcaacctctttacggattttgacaagtatatgacgatcagtgacgagtgggatattccagagaaacagcctttcaaagacctggggaacttacgttactggcttgaagaggcagaatgcagagatcagtacagtgtgatttttgagagtggagaccgcacttccatattctggaatgacgtaaaagaccctgtctcaattgaagaaagagcgagatggacagagacgtatgtgcgttggtctcctaagggcacctacctggctacctttcatcaaagaggcattgctctatgggggggagagaaattcaagcaaattcagagattcagccaccaaggggttcagcttattgacttctcaccttgtgaaaggtacctggtgacctttagccccctgatggacacgcaggatgaccctcaggccataatcatctgggacatccttacggggcacaagaagaggggttttcactgtgagagctcagcccattggcctatttttaagtggagccatgatggcaaattctttgccagaatgaccctggatacgcttagcatctatgaaactccttctatgggtcttttggacaagaagagtttgaagatctctgggataaaagacttttcttggtctcctggtggtaacataatcgccttctgggtgcctgaagacaaagatattccagccagggtaaccctgatgcagctccctaccaggcaagagatccgagtgaggaacctgttcaatgtggtggactgcaagctccattggcagaagaacggagactacttgtgtgtgaaagtagataggactccgaaaggcacccagggtgttgtcacaaattttgaaattttccgaatgagggagaaacaggtacctgtggatgtggtcgagatgaaagaaaccatcatagcctttgcctgggaaccaaatggaagtaagtttgctgtgctgcacggagaggctccgcggatatctgtgtctttctaccacgtcaaaaacaacgggaagattgaactcatcaagatgttcgacaagcagcaggcgaacaccatcttctggagcccccaaggacagttcgtggtgttggcgggcctgaggagtatgaacggtgccttagcgtttgtggacacttcggactgcacggtcatgaacatcgcagagcactacatggcttccgacgtcgaatgggatcctactgggcgctacgtcgtcacctctgtgtcctggtggagccataaggtggacaacgcgtactggctgtggactttccagggacgcctcctgcagaagaacaacaaggaccgcttctgccagctgctgtggcggccccggcctcccacactcctgagccaggaacagatcaagcaaattaaaaaggatctgaagaaatactctaagatctttgaacagaaggatcgtttgagtcagtccaaagcctcaaaggaattggtggagagaaggcgcaccatgatggaagatttccggaagtaccggaaaatggcccaggagctctatatggagcagaaaaacgagcgcctggagttgcgaggaggggtggacactgacgagctggacacgaagacttagcgacgccactggcggcaccttctcctgcgcccagtgatgtttccacggtgcctgtacacagccgagcagcatttccgttgaaggacttgcatccccattgcgggcagtgctggacgtgtcccggagacccaccgggagggcgccgccatgccttgtacccccaccgtgcaggttgtggccggttttctccgcaggttgaacatggaaataaaagcaaacttgtatgaaaaaa

SEQ ID NO: 428227 - DNA, 2086 bp, Homo sapiens
caagtagctgggactgcaggtgcctgccaccatgcctagctaatttttgtatttttagtagagatggggtttcactgtgttggccatgctggtctcagaactcctgacctcaagtgatctgcccacctcagcctcccaaagtgctgggattactggcgtgagccaccacacccagccatttttaaatcttttttgagacagagtcttactctgttgcccaggctggagtacagtggcgtgatctcggctgactgcagccttcacctcccaggttcaaacgattctggtgcttcagtctcctgagtagctggaattacaggcgcgcaaccactacgcccagctaattttttgtatattttagaagagtcggggtttcaccatgttggccaggctggtctcgaactcctgacctcaagtgatccgcctgcccgcctcagcctctcaaagtgcagggattacaggtgtgagccaccgcgcccggcctaagagacttttcttggtctcctggtggtaacataatcgccttctgggtgcctgaagacaaagatattccagccagggtaaccctgatgcagctccctaccaggcaagagatccgagtgaggaacctgttcaatgtggtggactgcaagctccattggcagaagaacggagactacttgtgtgtgaaagtagataggactccgaaaggcacccagggtgttgtcacaaattttgaaattttccgaatgagggagaaacaggtacctgtggatgtggtcgagatgaaagaaaccatcatagcctttgcctgggaaccaaatggaagtaagtttgctgtgctgcacggagaggctccgcggatatctgtgtctttctaccacgtcaaaaacaacgggaagattgaactcatcaagatgttcgacaagcagcaggcgaacaccatcttctggagcccccaaggacagttcgtggtgttggcgggcctgaggagtatgaacggtgccttagcgtttgtggacacttcggactgcacggtcatgaacatcgcagagcactacatggcttccgacgtcgaatgggatcctactgggcgctacgtcgtcacctctgtgtcctggtggagccataaggtggacaacgcgtactggctgtggactttccagggacgcctcctgcagaagaacaacaaggaccgcttctgccagctgctgtggcggccccggcctcccacactcctgagccaggaacagatcaagcaaattaaaaaggatctgaagaaatactctaagatctttgaacagaaggatcgtttgagtcagtccaaagcctcaaaggaattggtggagagaaggcgcaccatgatggaagatttccggaagtaccggaaaatggcccaggagctctatatggagcagaaaaacgagcgcctggagttgcgaggaggggtggacactgacgagctggacagcaacgtggacgactgggaagaggagaccattgagttcttcgtcactgaagaaatcattcccctcgggaatcaggagtgacctggagcactgtggggacggactccgcctgctgttcccgcgctgagctacaggactcccgagtgtgagccgcggttcctctgttgcagcgcagccgtgtgtgctgtggagccgaggccgtcctgcaggaagccgcgtgactcccgcctcctccctgtgctctctggctctggactgtgactgcgcctggattctgccattgcgacacatttttgtgcctttcagcccctggtgtctgcagtgggggatttaaggcacccgcttccacttctttcttgtttggagttttctgttggaaccgccggcgttggctccgaagacttagcgacgccactggcggcaccttctcctgcgcccagtgatgtttccacggtgcctgtacacagccgagcagcatttccgttgaaggacttgcatccccattgcgggcagtgctggacgtgtcccggagacccaccgggagggcgccgccatgccttgtacccccaccgtgcaggttgtggccggttttctccgcaggttgaacatggaaataaaagcaaacttgtatgaaaaaa

SEQ ID NO: 428228 - DNA, 2859 bp, Homo sapiens
gttcagtcccgccccgcagcgtccgacgggaaaggaaagggggaggacgccatgttggacggaaccatctgctgccacacatggggtggtcaatgctcccatgagtttactgatgcacagaaacaaccttgctgaatggaattaagcactttcttgtcacaaatatatcagtttgatgattttcgggcgcggtcttgtggatgcgagtcctctcagggtcgttcgtgaggccccagggcgtgggtgcgccccccgccccgcggccttggtgcggcctccccgtcgcacgcacatggctgggctgtagccgtcgcggcgcgcggtgcggcctgggagagtcggaagcgcggcggccgcggagccctgcgagtaggcagcgttgggcccatgcaggacgcggagaacgtggcggtgcccgaggcggccgaggagcgcgccgagcccggccagcagcagccggccgccgagccgccgccagccgaggggctgctgcggcccgcggggcccggcgctccggaggccgcggggaccgaggcctccagtgaggaggtggggatcgcggaggccgggccggagcccgaggtgaggaccgagccggcggccgaggcagaggcggcctccggcccgtccgagtcgccctcgccgccggccgccgaggagctgcccgggtcgcatgctgagccccctgtcccggcacagggcgaggccccaggagagcaggctcgggacgagcgctccgacagccgggcccaggcggtgtccgaggacgcgggaggaaacgagggcagagcggccgaggccgaaccccgggcgctggagaacggcgacgcggacgagccctccttcagcgaccccgaggacttcgtggacgacgtgagcgaggaagaattactgggagatgtactcaaagatcggccccaggaagcagatggaatcgattcggtgattgtagtggacaatgtccctcaggtgggacccgaccgacttgagaaactcaaaaatgtcatccacaagatcttttccaagtttgggaaaatcacaaatgatttttatcctgaagaggatgggaagacaaaagggtatattttcctggagtacgcgtcccctgcccacgctgtggatgctgtgaagaacgccgacggctacaagcttgacaagcagcacacattccgggtcaacctctttacggattttgacaagtatatgacgatcagtgacgagtgggatattccagagaaacagcctttcaaagacctggggaacttacgttactggcttgaagaggcagaatgcagagatcagtacagtgtgatttttgagagtggagaccgcacttccatattctggaatgacgtaaaagaccctgtctcaattgaagaaagagcgagatggacagagacgtatgtgcgttggtctcctaagggcacctacctggctacctttcatcaaagaggcattgctctatgggggggagagaaattcaagcaaattcagagattcagccaccaaggggttcagcttattgacttctcaccttgtgaaagaaaccatcatagcctttgcctgggaaccaaatggaagtaagtttgctgtgctgcacggagaggctccgcggatatctgtgtctttctaccacgtcaaaaacaacgggaagattgaactcatcaagatgttcgacaagcagcaggcgaacaccatcttctggagcccccaaggacagttcgtggtgttggcgggcctgaggagtatgaacggtgccttagcgtttgtggacacttcggactgcacggtcatgaacatcgcagagcactacatggcttccgacgtcgaatgggatcctactgggcgctacgtcgtcacctctgtgtcctggtggagccataaggtggacaacgcgtactggctgtggactttccagggacgcctcctgcagaagaacaacaaggaccgcttctgccagctgctgtggcggccccggcctcccacactcctgagccaggaacagatcaagcaaattaaaaaggatctgaagaaatactctaagatctttgaacagaaggatcgtttgagtcagtccaaagcctcaaaggaattggtggagagaaggcgcaccatgatggaagatttccggaagtaccggaaaatggcccaggagctctatatggagcagaaaaacgagcgcctggagttgcgaggaggggtggacactgacgagctggacagcaacgtggacgactgggaagaggagaccattgagttcttcgtcactgaagaaatcattcccctcgggaatcaggagtgacctggagcactgtggggacggactccgcctgctgttcccgcgctgagctacaggactcccgagtgtgagccgcggttcctctgttgcagcgcagccgtgtgtgctgtggagccgaggccgtcctgcaggaagccgcgtgactcccgcctcctccctgtgctctctggctctggactgtgactgcgcctggattctgccattgcgacacatttttgtgcctttcagcccctggtgtctgcagtgggggatttaaggcacccgcttccacttctttcttgtttggagttttctgttggaaccgccggcgttggctccgaagacttagcgacgccactggcggcaccttctcctgcgcccagtgatgtttccacggtgcctgtacacagccgagcagcatttccgttgaaggacttgcatccccattgcgggcagtgctggacgtgtcccggagacccaccgggagggcgccgccatgccttgtacccccaccgtgcaggttgtggccggttttctccgcaggttgaacatggaaataaaagcaaacttgtatgaaaaaa

SEQ ID NO: 428229 - DNA, 2974 bp, Homo sapiens
gttcagtcccgccccgcagcgtccgacgggaaaggaaagggggaggacgccatgttggacggaaccatctgctgccacacatggggtggtcaatgctcccatgagtttactgatgcacagaaacaaccttgctgaatggaattaagcactttcttgtcacaaatatatcagtttgatgattttcgggcgcggtcttgtggatgcgagtcctctcagggtcgttcgtgaggccccagggcgtgggtgcgccccccgccccgcggccttggtgcggcctccccgtcgcacgcacatggctgggctgtagccgtcgcggcgcgcggtgcggcctgggagagtcggaagcgcggcggccgcggagccctgcgagtaggcagcgttgggcccatgcaggacgcggagaacgtggcggtgcccgaggcggccgaggagcgcgccgagcccggccagcagcagccggccgccgagccgccgccagccgaggggctgctgcggcccgcggggcccggcgctccggaggccgcggggaccgaggcctccagtgaggaggtggggatcgcggaggccgggccggagcccgaggtgaggaccgagccggcggccgaggcagaggcggcctccggcccgtccgagtcgccctcgccgccggccgccgaggagctgcccgggtcgcatgctgagccccctgtcccggcacagggcgaggccccaggagagcaggctcgggacgagcgctccgacagccgggcccaggcggtgtccgaggacgcgggaggaaacgagggcagagcggccgaggccgaaccccgggcgctggagaacggcgacgcggacgagccctccttcagcgaccccgaggacttcgtggacgacgtgagcgaggaagaattactgggagatgtactcaaagatcggccccaggaagcagatggaatcgattcggtgattgtagtggacaatgtccctcaggtgggacccgaccgacttgagaaactcaaaaatgtcatccacaagatcttttccaagtttgggaaaatcacaaatgatttttatcctgaagaggatgggaagacaaaagggtatattttcctggagtacgcgtcccctgcccacgctgtggatgctgtgaagaacgccgacggctacaagcttgacaagcagcacacattccgggtcaacctctttacggattttgacaagtatatgacgatcagtgacgagtgggatattccagagaaacagcctttcaaagacctggggaacttacgttactggcttgaagaggcagaatgcagagatcagtacagtgtgatttttgagagtggagaccgcacttccatattctggaatgacgtaaaagaccctgtctcaattgaagaaagagcgagatggacagagacgtatgtgcgttggtctcctaagggcacctacctggctacctttcatcaaagaggcattgctctatgggggggagagaaattcaagcaaattcagagattcagccaccaaggggttcagcttattgacttctcaccttgtgaaaggtacctggtgacctttagccccctgatggacacgcaggatgaccctcaggccataatcatctgggacatccttacggggcacaagaagaggggttttcactgtgagagctcagcccattggcctatttttaagtggagccatgatggcaaattctttgccagaatgaccctggatacgcttagcatctatgaaactccttctaccacgtcaaaaacaacgggaagattgaactcatcaagatgttcgacaagcagcaggcgaacaccatcttctggagcccccaaggacagttcgtggtgttggcgggcctgaggagtatgaacggtgccttagcgtttgtggacacttcggactgcacggtcatgaacatcgcagagcactacatggcttccgacgtcgaatgggatcctactgggcgctacgtcgtcacctctgtgtcctggtggagccataaggtggacaacgcgtactggctgtggactttccagggacgcctcctgcagaagaacaacaaggaccgcttctgccagctgctgtggcggccccggcctcccacactcctgagccaggaacagatcaagcaaattaaaaaggatctgaagaaatactctaagatctttgaacagaaggatcgtttgagtcagtccaaagcctcaaaggaattggtggagagaaggcgcaccatgatggaagatttccggaagtaccggaaaatggcccaggagctctatatggagcagaaaaacgagcgcctggagttgcgaggaggggtggacactgacgagctggacagcaacgtggacgactgggaagaggagaccattgagttcttcgtcactgaagaaatcattcccctcgggaatcaggagtgacctggagcactgtggggacggactccgcctgctgttcccgcgctgagctacaggactcccgagtgtgagccgcggttcctctgttgcagcgcagccgtgtgtgctgtggagccgaggccgtcctgcaggaagccgcgtgactcccgcctcctccctgtgctctctggctctggactgtgactgcgcctggattctgccattgcgacacatttttgtgcctttcagcccctggtgtctgcagtgggggatttaaggcacccgcttccacttctttcttgtttggagttttctgttggaaccgccggcgttggctccgaagacttagcgacgccactggcggcaccttctcctgcgcccagtgatgtttccacggtgcctgtacacagccgagcagcatttccgttgaaggacttgcatccccattgcgggcagtgctggacgtgtcccggagacccaccgggagggcgccgccatgccttgtacccccaccgtgcaggttgtggccggttttctccgcaggttgaacatggaaataaaagcaaacttgtatgaaaaaa

SEQ ID NO: 428230 - DNA, 2726 bp, Homo sapiens
gttcagtcccgccccgcagcgtccgacgggaaaggaaagggggaggacgccatgttggacggaaccatctgctgccacacatggggtggtcaatgctcccatgagtttactgatgcacagaaacaaccttgctgaatggaattaagcactttcttgtcacaaatatatcagtttgatgattttcgggcgcggtcttgtggatgcgagtcctctcagggtcgttcgtgaggccccagggcgtgggtgcgccccccgccccgcggccttggtgcggcctccccgtcgcacgcacatggctgggctgtagccgtcgcggcgcgcggtgcggcctgggagagtcggaagcgcggcggccgcggagccctgcgagtaggcagcgttgggcccatgcaggacgcggagaacgtggcggtgcccgaggcggccgaggagcgcgccgagcccggccagcagcagccggccgccgagccgccgccagccgaggggctgctgcggcccgcggggcccggcgctccggaggccgcggggaccgaggcctccagtgaggaggtggggatcgcggaggccgggccggagcccgaggtgaggaccgagccggcggccgaggcagaggcggcctccggcccgtccgagtcgccctcgccgccggccgccgaggagctgcccgggtcgcatgctgagccccctgtcccggcacagggcgaggccccaggagagcaggctcgggacgagcgctccgacagccgggcccaggcggtgtccgaggacgcgggaggaaacgagggcagagcggccgaggccgaaccccgggcgctggagaacggcgacgcggacgagccctccttcagcgaccccgaggacttcgtggacgacgtgagcgaggaagaattactgggagatgtactcaaagatcggccccaggaagcagatggaatcgattcggtgattgtagtggacaatgtccctcaggtgggacccgaccgacttgagaaactcaaaaatgtcatccacaagatcttttccaagtttgggaaaatcacaaatgatttttatcctgaagaggatgggaagacaaaagggtatattttcctggagtacgcgtcccctgcccacgctgtggatgctgtgaagaacgccgacggctacaagcttgacaagcagcacacattccgggtcaacctctttacggattttgacaagtatatgacgatcagtgacgagtgggatattccagagaaacagcctttcaaagacctggggaacttacgttactggcttgaagaggcagaatgcagagatcagtacagtgtgatttttgagagtggagaccgcacttccatattctggaatgacgtaaaagaccctgtctcaattgaagaaagagcgagatggacagagacgtatgtgcgttggtctcctaagggcacctacctggctacctttcatcaaagaggcattgctctatgggggggagagaaattcaagcaaattcagagattcagccaccaaggggttcagcttattgacttctcaccttgtgaaaggtacctggtgacctttagccccctgatggacacgcaggatgaccctcaggccataatcatctgggacatccttacggggcacaagaagaggggttttcactgtgagagctcagcccattggcctatttttaagtggagccatgatggcaaattctttgccagaatgaccctggatacgcttagcatctatgaaactccttctatgggtcttttggacaagaagagtttgaagatctctgggataaaagacttttcttggtctcctggtggtaacataatcgccttctgggtgcctgaagacaaagatattccagccagggtaaccctgatgcagctccctaccaggcaagagatccgagtgaggaacctgttcaatgtggtggactgcaagctccattggcagaagaacggagactacttgtgtgtgaaagtagataggactccgaaaggcacccagggtgttgtcacaaattttgaaattttccgaatgagggagaaacaggtacctgtggatgtggtcgagatgaaagaaaccatcatagcctttgcctgggaaccaaatggaagtaagtttgctgtgctgcacggagaggctccgcggatatctgtgtctttctaccacgtcaaaaacaacgggaagattgaactcatcaagatgttcgacaagcagcaggcgaacaccatcttctggagcccccaaggacagttcgtggtgttggcgggcctgaggagtatgaacggtgccttagcgtttgtggacacttcggactgcacggtcatgaacatcgcagagcactacatggcttccgacgtcgaatgggatcttgcgacacatttttgtgcctttcagcccctggtgtctgcagtgggggatttaaggcacccgcttccacttctttcttgtttggagttttctgttggaaccgccggcgttggctccgaagacttagcgacgccactggcggcaccttctcctgcgcccagtgatgtttccacggtgcctgtacacagccgagcagcatttccgttgaaggacttgcatccccattgcgggcagtgctggacgtgtcccggagacccaccgggagggcgccgccatgccttgtacccccaccgtgcaggttgtggccggttttctccgcaggttgaacatggaaataaaagcaaacttgtatgaaaaaa

SEQ ID NO: 428231 - DNA, 1642 bp, Homo sapiens
gatgattttcccctgatagttacacctgattggaggatcgccttaccacgggcatggatactcttagatgtagaagacgtgtccaaaagtagctcggtgagctcgaagtgtctaaaagagcaccaatcatactagataaatactatcgtgtgtgaaccctggacttggaggtccggagttgcgtgtccatggctgttgtccaaagattgtgaaaagcggcgaatcgactgtgaagacacacgagggatagcgtgatggtatgctaggttgcagacaatagaatcgacagatccactcgctacgtcctattgctcgtggtgatacgaagatgcggaacgtcacggtcttgatgctcgcgtgagggcggaagagtgtcgccgtgaactagtcgtgtcggttgttctcttgcactctcagaactgcgagatgagtaaagatgggactccgtccagatgttcgacaagcagcaggcgaacaccatcttctggagcccccaaggacagttcgtggtgttggcgggcctgaggagtatgaacggtgccttagcgtttgtggacacttcggactgcacggtcatgaacatcgcagagcactacatggcttccgacgtcgaatgggatcctactgggcgctacgtcgtcacctctgtgtcctggtggagccataaggtggacaacgcgtactggctgtggactttccagggacgcctcctgcagaagaacaacaaggaccgcttctgccagctgctgtggcggccccggcctcccacactcctgagccaggaacagatcaagcaaattaaaaaggatctgaagaaatactctaagatctttgaacagaaggatcgtttgagtcagtccaaagcctcaaaggaattggtggagagaaggcgcaccatgatggaagatttccggaagtaccggaaaatggcccaggagctctatatggagcagaaaaacgagcgcctggagttgcgaggaggggtggacactgacgagctggacagcaacgtggacgactgggaagaggagaccattgagttcttcgtcactgaagaaatcattcccctcgggaatcaggagtgacctggagcactgtggggacggactccgcctgctgttcccgcgctgagctacaggactcccgagtgtgagccgcggttcctctgttgcagcgcagccgtgtgtgctgtggagccgaggccgtcctgcaggaagccgcgtgactcccgcctcctccctgtgctctctggctctggactgtgactgcgcctggattctgccattgcgacacatttttgtgcctttcagcccctggtgtctgcagtgggggatttaaggcacccgcttccacttctttcttgtttggagttttctgttggaaccgccggcgttggctccgaagacttagcgacgccactggcggcaccttctcctgcgcccagtgatgtttccacggtgcctgtacacagccgagcagcatttccgttgaaggacttgcatccccattgcgggcagtgctggacgtgtcccggagacccaccgggagggcgccgccatgccttgtacccccaccgtgcaggttgtggccggttttctccgcaggttgaacatggaaataaaagcaaacttgtatgaaaaaa

SEQ ID NO: 428232 - DNA, 1316 bp, Homo sapiens
tgtccacacttgctactgtatttttggaggcttacttagcctcagataacatttccagtaaaaataatatgatggcagtcgtatgtaatactcactgcacactctgcatctgtgatttggtaagtctcacagcggccaccagaggctgttgctgtgcttgtttccatgttaacgccgaggctggctccctggggaccccatgccgcagcacctctcaggagtgggatgccaggaggtatgcgtctccatgaagcctgacggtcctgtctgtctttgcagtatgaacggtgccttagcgtttgtggacacttcggactgcacggtcatgaacatcgcagagcactacatggcttccgacgtcgaatgggatcctactgggcgctacgtcgtcacctctgtgtcctggtggagccataaggtggacaacgcgtactggctgtggactttccagggacgcctcctgcagaagaacaacaaggaccgcttctgccagctgctgtggcggccccggcctcccacactcctgagccaggaacagatcaagcaaattaaaaaggatctgaagaaatactctaagatctttgaacagaaggatcgtttgagtcagtccaaagcctcaaaggaattggtggagagaaggcgcaccatgatggaagatttccggaagtaccggaaaatggcccaggagctctatatggagcagaaaaacgagcgcctggagttgcgaggaggggtggacactgacgagctggacagcaacgtggacgactgggaagaggagaccattgagttcttcgtcactgaagaaatcattcccctcgggaatcaggagtgacctggagcactgtggcagccgtgtgtgctgtggagccgaggccgtcctgcaggaagccgcgtgactcccgcctcctccctgtgctctctggctctggactgtgactgcgcctggattctgccattgcgacacatttttgtgcctttcagcccctggtgtctgcagtgggggatttaaggcacccgcttccacttctttcttgtttggagttttctgttggaaccgccggcgttggctccgaagacttagcgacgccactggcggcaccttctcctgcgcccagtgatgtttccacggtgcctgtacacagccgagcagcatttccgttgaaggacttgcatccccattgcgggcagtgctggacgtgtcccggagacccaccgggagggcgccgccatgccttgtacccccaccgtgcaggttgtggccggttttctccgcaggttgaacatggaaataaaagcaaacttgtatgaaaaaa

SEQ ID NO: 428233 - DNA, 2088 bp, Homo sapiens
  misc_feature (127)..(127): n is a, c, g, or t
cctgggcccagggacccctgaaaaggagtgagaatgtctgcagagaggagtcgtttcctttgaagtctgaacagagttccataaccgcagacattaagatctgttttggggtcagtggttgagtccnagctgccgcgttacccacaactcgtattccaaaactgctggttaagtttgtcaaggactttcagtatttagtgacttgtaaaaacattgatggaggcactgatacttgaactagtccatgccaatagagcctgtgaaaccaaacgcgggtaattttgtttaatgagatacagaatttgtaggaatatcaacttcccaaatgttactgcaagtgtctagagttagaaatcttcgcattcgaatcaggatatgttgatcacagcctgtgtccaggtatgttcagatgtcactgcggtggggcctgccttgacacttgaaatcactttaggccaggcacagtggctcacacctgtaatcccagcacttcaggaggcagaggtagaaaaatcacttgaacccaggagtttgagactagcctgagcaacatagcgaaaccctagccccattaaaaaaaaaaaaaaaaaaaagactttttaagctgttgaccactctccttgagttatgaacacttagcttccaaaatgccggcctgcaacaaggagtttatgctgagtgccagtgaaggcgccctccttcatgagagaggcctgccatgaggagagcggaactaggcggcgtgtagtgatgcagttagcttacatccagcacagggctccgcacagctcacacccggcccagggctcagcagtgagtagtgctatgcagttagcttacgtttggcacagggttcagtccagtttaaatccagcacggggttcagcggcgcagtagtgaggcagttagcttacatccagcatggggttcttattgccagccagaatgtgcaggcctgtgctgtgatgagcgctgctccagctgctccgtgccccgcactccgggtcggttgcataatggaggtgtcttgcattgactgcccacctaccctgctgtcagctcagcacaggcagagctttgtttgcttcacacgtgtccccgatacccaggaccttgttcagcaagtgacatagtcacggttgtggctctctgacccctctgtgtcctggtgtgtccctgccctggcctaggtggacaacgcgtactggctgtggactttccagggacgcctcctgcagaagaacaacaaggaccgcttctgccagctgctgtggcggccccggcctcccacactcctgagccaggaacagatcaagcaaattaaaaaggatctgaagaaatactctaagatctttgaacagaaggatcgtttgagtcagtccaaagcctcaaaggaattggtggagagaaggcgcaccatgatggaagatttccggaagtaccggaaaatggcccaggagctctatatggagcagaaaaacgagcgcctggagttgcgaggaggggtggacactgacgagctggacagcaacgtggacgactgggaagaggagaccattgagttcttcgtcactgaagaaatcattcccctcgggaatcaggagtgacctggagcactgtggcagccgtgtgtgctgtggagccgaggccgtcctgcaggaagccgcgtgactcccgcctcctccctgtgctctctggctctggactgtgactgcgcctggattctgccattgcgacacatttttgtgcctttcagcccctggtgtctgcagtgggggatttaaggcacccgcttccacttctttcttgtttggagttttctgttggaaccgccggcgttggctccgaagacttagcgacgccactggcggcaccttctcctgcgcccagtgatgtttccacggtgcctgtacacagccgagcagcatttccgttgaaggacttgcatccccattgcgggcagtgctggacgtgtcccggagacccaccgggagggcgccgccatgccttgtacccccaccgtgcaggttgtggccggttttctccgcaggttgaacatggaaataaaagcaaacttgtatgaaaaaa

SEQ ID NO: 428234 - DNA, 1428 bp, Homo sapiens
cgccttgtcgctaggagagtggctttggtcttttggggtcacacgtctctgacatctctctgttggggtccctgcagcagtgaacatttgctgtaaagggaattctttgtccagttacctcaggaaataagatagtattgttttgaaatacccctgtcgcatcttcttttttttcccatttaaagtatggatcatgacttagggggtacttggcgatggactttgtaaaattgttttccgaggtggtccagcattaccagctctgccctcatgggcagcatgagcacggccaagtcctccagccttggctgccccggcactgtggaagccctcgcagctcgtgacaggcgcgctctttcctttcagagatgttcgacaagcagcaggcgaacaccatcttctggagcccccaaggacagttcgtggtgttggcgggcctgaggagtatgaacggtgccttagcgtttgtggacacttcggactgcacggtcatgaacatcgcagaaacaacaaggaccgcttctgccagctgctgtggcggccccggcctcccacactcctgagccaggaacagatcaagcaaattaaaaaggatctgaagaaatactctaagatctttgaacagaaggatcgtttgagtcagtccaaagcctcaaaggaattggtggagagaaggcgcaccatgatggaagatttccggaagtaccggaaaatggcccaggagctctatatggagcagaaaaacgagcgcctggagttgcgaggaggggtggacactgacgagctggacagcaacgtggacgactgggaagaggagaccattgagttcttcgtcactgaagaaatcattcccctcgggaatcaggagtgacctggagcactgtggggacggactccgcctgctgttcccgcgctgagctacaggactcccgagtgtgagccgcggttcctctgttgcagcgcagccgtgtgtgctgtggagccgaggccgtcctgcaggaagccgcgtgactcccgcctcctccctgtgctctctggctctggactgtgactgcgcctggattctgccattgcgacacatttttgtgcctttcagcccctggtgtctgcagtgggggatttaaggcacccgcttccacttctttcttgtttggagttttctgttggaaccgccggcgttggctccgaagacttagcgacgccactggcggcaccttctcctgcgcccagtgatgtttccacggtgcctgtacacagccgagcagcatttccgttgaaggacttgcatccccattgcgggcagtgctggacgtgtcccggagacccaccgggagggcgccgccatgccttgtacccccaccgtgcaggttgtggccggttttctccgcaggttgaacatggaaataaaagcaaacttgtatgaaaaaa

SEQ ID NO: 428235 - DNA, 924 bp, Homo sapiens
cacctctgaccgagttcccacctctgaccgagttcccacctctgaccgagttcccacctctgaccgagttcccaagcaaattaaaaaggatctgaagaaatactctaagatctttgaacagaaggatcgtttgagtcagtccaaagcctcaaaggaattggtggagagaaggcgcaccatgatggaagatttccggaagtaccggaaaatggcccaggagctctatatggagcagaaaaacgagcgcctggagttgcgaggaggggtggacactgacgagctggacagcaacgtggacgactgggaagaggagaccattgagttcttcgtcactgaagaaatcattcccctcgggaatcaggagtgacctggagcactgtggggacggactccgcctgctgttcccgcgctgagctacaggactcccgagtgtgagccgcggttcctctgttgcagcgcagccgtgtgtgctgtggagccgaggccgtcctgcaggaagccgcgtgactcccgcctcctccctgtgctctctggctctggactgtgactgcgcctggattctgccattgcgacacatttttgtgcctttcagcccctggtgtctgcagtgggggatttaaggcacccgcttccacttctttcttgtttggagttttctgttggaaccgccggcgttggctccgaagacttagcgacgccactggcggcaccttctcctgcgcccagtgatgtttccacggtgcctgtacacagccgagcagcatttccgttgaaggacttgcatccccattgcgggcagtgctggacgtgtcccggagacccaccgggagggcgccgccatgccttgtacccccaccgtgcaggttgtggccggttttctccgcaggttgaacatggaaataaaagcaaacttgtatgaaaaaa

SEQ ID NO: 428236 - DNA, 2798 bp, Homo sapiens
gttcagtcccgccccgcagcgtccgacgggaaaggaaagggggaggacgccatgttggacggaaccatctgctgccacacatggggtggtcaatgctcccatgagtttactgatgcacagaaacaaccttgctgaatggaattaagcactttcttgtcacaaatatatcagtttgatgattttcgggcgcggtcttgtggatgcgagtcctctcagggtcgttcgtgaggccccagggcgtgggtgcgccccccgccccgcggccttggtgcggcctccccgtcgcacgcacatggctgggctgtagccgtcgcggcgcgcggtgcggcctgggagagtcggaagcgcggcggccgcggagccctgcgagtaggcagcgttgggcccatgcaggacgcggagaacgtggcggtgcccgaggcggccgaggagcgcgccgagcccggccagcagcagccggccgccgagccgccgccagccgaggggctgctgcggcccgcggggcccggcgctccggaggccgcggggaccgaggcctccagtgaggaggtggggatcgcggaggccgggccggagcccgaggtgaggaccgagccggcggccgaggcagaggcggcctccggcccgtccgagtcgccctcgccgccggccgccgaggagctgcccgggtcgcatgctgagccccctgtcccggcacagggcgaggccccaggagagcaggctcgggacgagcgctccgacagccgggcccaggcggtgtccgaggacgcgggaggaaacgagggcagagcggccgaggccgaaccccgggcgctggagaacggcgacgcggacgagccctccttcagcgaccccgaggacttcgtggacgacgtgagcgaggaagaattactgggagatgtactcaaagatcggccccaggaagcagatggaatcgattcggtgattgtagtggacaatgtccctcaggtgggacccgaccgacttgagaaactcaaaaatgtcatccacaagatcttttccaagtttgggaaaatcacaaatgatttttatcctgaagaggatgggaagacaaaagggtatattttcctggagtacgcgtcccctgcccacgctgtggatgctgtgaagaacgccgacggctacaagcttgacaagcagcacacattccgggtcaacctctttacggattttgacaagtatatgacgatcagtgacgagtgggatattccagagaaacagcctttcaaagacctggggaacttacgttactggcttgaagaggcagaatgcagagatcagtacagtgtgatttttgagagtggagaccgcacttccatattctggaatgacgtaaaagaccctgtctcaattgaagaaagagcgagatggacagagacgtatgtgcgttggtctcctaagggcacctacctggctacctttcatcaaagaggcattgctctatgggggggagagaaattcaagcaaattcagagattcagccaccaaggggttcagcttattgacttctcaccttgtgaaaggtacctggtgacctttagccccctgatggacacgcaggatgaccctcaggccataatcatctgggacatccttacggggcacaagaagaggggttttcactgtgagagctcagcccattggcctatttttaagtggagccatgatggcaaattctttgccagaatgaccctggatacgcttagcatctatgaaactccttctatgggtcttttggacaagaagagtttgaagatctctgggataaaagacttttcttggtctcctggtggtaacataatcgccttctgggtgcctgaagacaaagatattccagccagggtaaccctgatgcagctccctaccaggcaagagatccgagtgaggaacctgttcaatgtggtggactgcaagctccattggcagaagaacggagactacttgtgtgtgaaagtagataggactccgaaaggcacccagggtgttgtcacaaattttgaaattttccgaatgagggagaaacaggtacctgtggatgtggtcgagatgaaaggcaagttgtattttagtcactttgaggcgaatggggcctacgtgctgttttactcttggctttaacacttccatgcgaggggttgtctgagcagctgagtcaggactgtgagccctcaccatgaatagtcatctccaggtcacagaacgtgtttagagcctgggcaacatagtgagaccctctctgtacaaaaaacaaattaaaaaaattagccaggtgtggtggtgcgcaccgatagtcccagctgtttgagacgctgaagcgggaggatcacttgagcccaggagcagaggttgcagtgaactgagattgcgcccctgcactccagcctgggtgacggagcaagaccctgtctaaaaaaaagagaaaagagattgagcctgtgttcttgtttggctttttgttttgccatggagaaaaggaggaaggaagggttaaaaataggtgagaaaatgggaaacatggccgcccttccaggcagggagaccggaggtcaggatcccactgtaggtgcacactgggtgcgagggaagcggcatccacagctgctgacaatgtcgggctcctgcggtcctgctgtgggtgtcctgctctcaggaagggagcagtttcacgtaggtcactccacacaagtggaagcagctgtctctgaaactccaggaatgtgcacctttcctgctgttgcttgctctcccgtccttttaatgaacttttacacgtcggg

SEQ ID NO: 428237 - DNA, 2334 bp, Homo sapiens
gttcagtcccgccccgcagcgtccgacgggaaaggaaagggggaggacgccatgttggacggaaccatctgctgccacacatggggtggtcaatgctcccatgagtttactgatgcacagaaacaaccttgctgaatggaattaagcactttcttgtcacaaatatatcagtttgatgattttcgggcgcggtcttgtggatgcgagtcctctcagggtcgttcgtgaggccccagggcgtgggtgcgccccccgccccgcggccttggtgcggcctccccgtcgcacgcacatggctgggctgtagccgtcgcggcgcgcggtgcggcctgggagagtcggaagcgcggcggccgcggagccctgcgagtaggcagcgttgggcccatgcaggacgcggagaacgtggcggtgcccgaggcggccgaggagcgcgccgagcccggccagcagcagccggccgccgagccgccgccagccgaggggctgctgcggcccgcggggcccggcgctccggaggccgcggggaccgaggcctccagtgaggaggtggggatcgcggaggccgggccggagcccgaggtgaggaccgagccggcggccgaggcagaggcggcctccggcccgtccgagtcgccctcgccgccggccgccgaggagctgcccgggtcgcatgctgagccccctgtcccggcacagggcgaggccccaggagagcaggctcgggacgagcgctccgacagccgggcccaggcggtgtccgaggacgcgggaggaaacgagggcagagcggccgaggccgaaccccgggcgctggagaacggcgacgcggacgagccctccttcagcgaccccgaggacttcgtggacgacgtgagcgaggaagaattactgggagatgtactcaaagatcggccccaggaagcagatggaatcgattcggtgattgtagtggacaatgtccctcaggtgggacccgaccgacttgagaaactcaaaaatgtcatccacaagatcttttccaagtttgggaaaatcacaaatgatttttatcctgaagaggatgggaagacaaaagggtatattttcctggagtacgcgtcccctgcccacgctgtggatgctgtgaagaacgccgacggctacaagcttgacaagcagcacacattccgggtcaacctctttacggattttgacaagtatatgacgatcagtgacgagtgggatattccagagaaacagcctttcaaagacctggggaacttacgttactggcttgaagaggcagaatgcagagatcagtacagtgtgatttttgagagtggagaccgcacttccatattctggaatgacgtaaaagaccctgtctcaattgaagaaagagcgagatggacagagacgtatgtgcgttggtctcctaagggcacctacctggctacctttcatcaaagaggcattgctctatgggggggagagaaattcaagcaaattcagagattcagccaccaaggggttcagcttattgacttctcaccttgtgaaaggtacctggtgacctttagccccctgatggacacgcaggatgaccctcaggccataatcatctgggacatccttacggggcacaagaagaggggttttcactgtgagagctcagcccattggcctatttttaagtaagtggaccattgtaacgagctctgtagcctttgtcttttcatgggaataccctggcacttttgtttttcttaggtggagccatgatggcaaattctttgccagaatgaccctggatacgcttagcatctatgaaactcctgtaagtggcctcagtgatggcaaacgccccgtccggtccttgcttgtaaccggggtgtggtgcctttccttatttgtgctagaagaggaggaggaggtttcacagatgcataggaaaggcctgtctcctgtgcctttttaactgcccctgctctgggcagagctcttcagtcactcctgcccacctggcgcagccgtgggaagtcctggatgggagttaatgcagtgggcttcagaactgcagttctgggtggcgggtgggtggatgggttcactgtcacgctctgtgtgcactgccccctaggcaaactcacatcagactcttgtttccttttgtaaaaagttaggtgtgtttctgagacactgacatgatttgactcaactgcagccttccttttttttgggcagtctatgggtcttttggacaagaagagtttgaagatctctgggataaagtgagtattcttatcagtttggtgtcttagtgtgttcaggctgcttaacacaataccaaaa

SEQ ID NO: 428238 - DNA, 1851 bp, Homo sapiens
gttcagtcccgccccgcagcgtccgacgggaaaggaaagggggaggacgccatgttggacggaaccatctgctgccacacatggggtggtcaatgctcccatgagtttactgatgcacagaaacaaccttgctgaatggaattaagcactttcttgtcacaaatatatcagtttgatgattttcgggcgcggtcttgtggatgcgagtcctctcagggtcgttcgtgaggccccagggcgtgggtgcgccccccgccccgcggccttggtgcggcctccccgtcgcacgcacatggctgggctgtagccgtcgcggcgcgcggtgcggcctgggagagtcggaagcgcggcggccgcggagccctgcgagtaggcagcgttgggcccatgcaggacgcggagaacgtggcggtgcccgaggcggccgaggagcgcgccgagcccggccagcagcagccggccgccgagccgccgccagccgaggggctgctgcggcccgcggggcccggcgctccggaggccgcggggaccgaggcctccagtgaggaggtggggatcgcggaggccgggccggagcccgaggtgaggaccgagccggcggccgaggcagaggcggcctccggcccgtccgagtcgccctcgccgccggccgccgaggagctgcccgggtcgcatgctgagccccctgtcccggcacagggcgaggccccaggagagcaggctcgggacgagcgctccgacagccgggcccaggcggtgtccgaggacgcgggaggaaacgagggcagagcggccgaggccgaaccccgggcgctggagaacggcgacgcggacgagccctccttcagcgaccccgaggacttcgtggacgacgtgagcgaggaagaattactgggagatgtactcaaagatcggccccaggaagcagatggaatcgattcggtgattgtagtggacaatgtccctcaggtgggacccgaccgacttgagaaactcaaaaatgtcatccacaagatcttttccaagtttgggaaaatcacaaatgatttttatcctgaagaggatgggaagacaaaagggtatattttcctggagtacgcgtcccctgcccacgctgtggatgctgtgaagaacgccgacggctacaagcttgacaagcagcacacattccgggtcaacctctttacggattttgacaagtatatgacgatcagtgacgagtgggatattccagagaaacagcctttcaaagacctggggaacttacgttactggcttgaagaggcagaatgcagagatcagtacagtgtgatttttgagagtggagaccgcacttccatattctggaatgacgtaaaagaccctgtctcaattgaagaaagagcgagatggacagagacgtatgtgcgttggtctcctaagggcacctacctggctacctttcatcaaagaggcattgctctatgggggggagagaaattcaagcaaattcagagattcagccaccaaggggttcagcttattgacttctcaccttgtgaaaggtacctggtgacctttagccccctgatggacacgcaggatgaccctcaggccataatcatctgggacatccttacggggcacaagaagaggggttttcactgtgagagctcagcccattggcctatttttaagtggagccatgatggcaaattctttgccagaatgaccctggatacgcttagcatctatgaaactccttctatgggtcttttggacaagaagagtttgaagatctctgggataaagtgagtattcttatcagtttggtgtcttagtgtgttcaggctgcttaacacaataccaaaa

SEQ ID NO: 428239 - DNA, 1858 bp, Homo sapiens
  misc_feature (127)..(127): n is a, c, g, or t
cctgggcccagggacccctgaaaaggagtgagaatgtctgcagagaggagtcgtttcctttgaagtctgaacagagttccataaccgcagacattaagatctgttttggggtcagtggttgagtccnagctgccgcgttacccacaactcgtattccaaaactgctggttaagtttgtcaaggactttcagtatttagtgacttgtaaaaacattgatggaggcactgatacttgaactagtccatgccaatagagcctgtgaaaccaaacgcgggtaattttgtttaatgagatacagaatttgtaggaatatcaacttcccaaatgttactgcaagtgtctagagttagaaatcttcgcattcgaatcaggatatgttgatcacagcctgtgtccaggtatgttcagatgtcactgcggtggggcctgccttgacacttgaaatcactttaggccaggcacagtggctcacacctgtaatcccagcacttcaggaggcagaggtagaaaaatcacttgaacccaggagtttgagactagcctgagcaacatagcgaaaccctagccccattaaaaaaaaaaaaaaaaaaaagactttttaagctgttgaccactctccttgagttatgaacacttagcttccaaaatgccggcctgcaacaaggagtttatgctgagtgccagtgaaggcgccctccttcatgagagaggcctgccatgaggagagcggaactaggcggcgtgtagtgatgcagttagcttacatccagcacagggctccgcacagctcacacccggcccagggctcagcagtgagtagtgctatgcagttagcttacgtttggcacagggttcagtccagtttaaatccagcacggggttcagcggcgcagtagtgaggcagttagcttacatccagcatggggttcttattgccagccagaatgtgcaggcctgtgctgtgatgagcgctgctccagctgctccgtgccccgcactccgggtcggttgcataatggaggtgtcttgcattgactgcccacctaccctgctgtcagctcagcacaggcagagctttgtttgcttcacacgtgtccccgatacccaggaccttgttcagcaagtgacatagtcacggttgtggctctctgacccctctgtgtcctggtgtgtccctgccctggcctaggtggacaacgcgtactggctgtggactttccagggacgcctcctgcagaagaacaacaaggaccgcttctgccagctgctgtggcggccccggcctcccacactcctgagccaggaacagatcaaggtcagcatgcccccacccccgggtgcagggcacatggaggcaattgtggcgttgaaaaggtgtcagttttttctgttattgttagggtggtgactgggggataaaaacgtgacatttgcaaggattctttgaagagacgcaggaacagtgagaactgaatggaatagaacagctttaggatagtaacttgaggctttcagcttctttagggaagttttgcatgaacccgaggggtggataaaaagatgccagggccattaaaaagtcctgctgggattagaagcggcttgtctgggatttacattattgtggtaaaataggccgttggtcttaggtcagagcaaagaggagggttaaatcccagggagaaagtccgtctcaaagtgaaagatggaggaaggagcaggcacgagcgctcctgggatgctgtgttgtgtgaatgaccctgggtgtcaaggaggaaggagcaggcacgagcgctcctgggatgctgtgttctgtgaatgaccctgggtgtcatggaggaaggagcaggcgcgagc

SEQ ID NO: 428240 - DNA, 772 bp, Homo sapiens
gtaacttagagatccctcagtccccaggagctggcccttacgctgcccctgggccctggtgcccgcggactcctgcgttccttcccactggcctcggcggtgccactaggcatgtgcccccatgggtgatctgcgccctttgtcccctcaggggtggacactgacgagctggacagcaacgtggacgactgggaagaggagaccattgagttcttcgtcactgaagaaatcattcccctcgggaatcaggagtgacctggagcactgtggtgagcgtctgcagggggcgcgatgggggtcctgttggctgctcatgctgcttcagttatccccgtcactgaggaagcacctcctttaaggcaggggtgaagggtgaagccctagtgtcatgtgcccagggttagctgagcctcgtgtgaaatgtagagtcggtgccgacgtggcctcgactgcgccctctgaccacattgcagatggcgcctttcaggcagtgctgggtgagggaggagctgtggccaggtgttgggaagtgccaggaagaggagggtggccatgcctggccatttcctgatacctgtgctagtgacggccgcggtgtgtccactggaaagaaacactggcgtgcacggctgtgactctggtttcagcagttctgagacaagagccttccaagtcgggggctggggagcagagtgcgggagctcctgagtcctgggggcctccgcgcctcacagcatgggcacatgtgggacagaaggcctaatggggtgcc

SEQ ID NO: 428241 - DNA, 3313 bp, Homo sapiens
gttcagtcccgccccgcagcgtccgacgggaaaggaaagggggaggacgccatgttggacggaaccatctgctgccacacatggggtggtcaatgctcccatgagtttactgatgcacagaaacaaccttgctgaatggaattaagcactttcttgtcacaaatatatcagtttgatgattttcgggcgcggtcttgtggatgcgagtcctctcagggtcgttcgtgaggccccagggcgtgggtgcgccccccgccccgcggccttggtgcggcctccccgtcgcacgcacatggctgggctgtagccgtcgcggcgcgcggtgcggcctgggagagtcggaagcgcggcggccgcggagccctgcgagtaggcagcgttgggcccatgcaggacgcggagaacgtggcggtgcccgaggcggccgaggagcgcgccgagcccggccagcagcagccggccgccgagccgccgccagccgaggggctgctgcggcccgcggggcccggcgctccggaggccgcggggaccgaggcctccagtgaggaggtggggatcgcggaggccgggccggagcccgaggtgaggaccgagccggcggccgaggcagaggcggcctccggcccgtccgagtcgccctcgccgccggccgccgaggagctgcccgggtcgcatgctgagccccctgtcccggcacagggcgaggccccaggagagcaggctcgggacgagcgctccgacagccgggcccaggcggtgtccgaggacgcgggaggaaacgagggcagagcggccgaggccgaaccccgggcgctggagaacggcgacgcggacgagccctccttcagcgaccccgaggacttcgtggacgacgtgagcgaggaagaattactgggagatgtactcaaagatcggccccaggaagcagatggaatcgattcggtgattgtagtggacaatgtccctcaggtgggacccgaccgacttgagaaactcaaaaatgtcatccacaagatcttttccaagtttgggaaaatcacaaatgatttttatcctgaagaggatgggaagacaaaagggtatattttcctggagtacgcgtcccctgcccacgctgtggatgctgtgaagaacgccgacggctacaagcttgacaagcagcacacattccgggtcaacctctttacggattttgacaagtatatgacgatcagtgacgagtgggatattccagagaaacagcctttcaaagacctggggaacttacgttactggcttgaagaggcagaatgcagagatcagtacagtgtgatttttgagagtggagaccgcacttccatattctggaatgacgtaaaagaccctgtctcaattgaagaaagagcgagatggacagagacgtatgtgcgttggtctcctaagggcacctacctggctacctttcatcaaagaggcattgctctatgggggggagagaaattcaagcaaattcagagattcagccaccaaggggttcagcttattgacttctcaccttgtgaaaggtacctggtgacctttagccccctgatggacacgcaggatgaccctcaggccataatcatctgggacatccttacggggcacaagaagaggggttttcactgtgagagctcagcccattggcctatttttaagtggagccatgatggcaaattctttgccagaatgaccctggatacgcttagcatctatgaaactccttctatgggtcttttggacaagaagagtttgaagatctctgggataaaagacttttcttggtctcctggtggtaacataatcgccttctgggtgcctgaagacaaagatattccagccagggtaaccctgatgcagctccctaccaggcaagagatccgagtgaggaacctgttcaatgtggtggactgcaagctccattggcagaagaacggagactacttgtgtgtgaaagtagataggactccgaaaggcacccagggtgttgtcacaaattttgaaattttccgaatgagggagaaacaggtacctgtggatgtggtcgagatgaaagaaaccatcatagcctttgcctgggaaccaaatggaagtaagtttgctgtgctgcacggagaggctccgcggatatctgtgtctttctaccacgtcaaaaacaacgggaagattgaactcatcaagatgttcgacaagcagcaggcgaacaccatcttctggagcccccaaggacagttcgtggtgttggcgggcctgaggagtatgaacggtgccttagcgtttgtggacacttcggactgcacggtcatgaacatcgcagagcactacatggcttccgacgtcgaatgggatcctactgggcgctacgtcgtcacctctgtgtcctggtggagccataaggtggacaacgcgtactggctgtggactttccagggacgcctcctgcagaagaacaacaaggaccgcttctgccagctgctgtggcggccccggcctcccacactcctgagccaggaacagatcaagcaaattaaaaaggatctgaagaaatactctaagatctttgaacagaaggatcgtttgagtcagtccaaagcctcaaaggaattggtggagagaaggcgcaccatgatggaagatttccggaagtaccggaaaatggcccaggagctctatatggagcagaaaaacgagcgcctggagttgcgaggaggggtggacactgacgagctggacagcaacgtggacgactgggaagaggagaccattgagttcttcgtcactgaagaaatcattcccctcgggaatcaggagtgacctggagcactgtggcagccgtgtgtgctgtggagccgaggccgtcctgcaggaagccgcgtgactcccgcctcctccctgtgctctctggctctggactgtgactgcgcctggattctgccattgcgacacatttttgtgcctttcagcccctggtgtctgcagtgggggatttaaggcacccgcttccacttctttcttgtttggagttttctgttggaaccgccggcgttggctccgaagacttagcgacgccactggcggcaccttctcctgcgcccagtgatgtttccacggtgcctgtacacagccgagcagcatttccgttgaaggacttgcatccccattgcgggcagtgctggacgtgtcccggagacccaccgggagggcgccgccatgccttgtacccccaccgtgcaggttgtggccggttttctccgcaggttgaacatggaaataaaagcaaacttgtatgaaaaaa

SEQ ID NO: 428242 - DNA, 3198 bp, Homo sapiens
gttcagtcccgccccgcagcgtccgacgggaaaggaaagggggaggacgccatgttggacggaaccatctgctgccacacatggggtggtcaatgctcccatgagtttactgatgcacagaaacaaccttgctgaatggaattaagcactttcttgtcacaaatatatcagtttgatgattttcgggcgcggtcttgtggatgcgagtcctctcagggtcgttcgtgaggccccagggcgtgggtgcgccccccgccccgcggccttggtgcggcctccccgtcgcacgcacatggctgggctgtagccgtcgcggcgcgcggtgcggcctgggagagtcggaagcgcggcggccgcggagccctgcgagtaggcagcgttgggcccatgcaggacgcggagaacgtggcggtgcccgaggcggccgaggagcgcgccgagcccggccagcagcagccggccgccgagccgccgccagccgaggggctgctgcggcccgcggggcccggcgctccggaggccgcggggaccgaggcctccagtgaggaggtggggatcgcggaggccgggccggagcccgaggtgaggaccgagccggcggccgaggcagaggcggcctccggcccgtccgagtcgccctcgccgccggccgccgaggagctgcccgggtcgcatgctgagccccctgtcccggcacagggcgaggccccaggagagcaggctcgggacgagcgctccgacagccgggcccaggcggtgtccgaggacgcgggaggaaacgagggcagagcggccgaggccgaaccccgggcgctggagaacggcgacgcggacgagccctccttcagcgaccccgaggacttcgtggacgacgtgagcgaggaagaattactgggagatgtactcaaagatcggccccaggaagcagatggaatcgattcggtgattgtagtggacaatgtccctcaggtgggacccgaccgacttgagaaactcaaaaatgtcatccacaagatcttttccaagtttgggaaaatcacaaatgatttttatcctgaagaggatgggaagacaaaagggtatattttcctggagtacgcgtcccctgcccacgctgtggatgctgtgaagaacgccgacggctacaagcttgacaagcagcacacattccgggtcaacctctttacggattttgacaagtatatgacgatcagtgacgagtgggatattccagagaaacagcctttcaaagacctggggaacttacgttactggcttgaagaggcagaatgcagagatcagtacagtgtgatttttgagagtggagaccgcacttccatattctggaatgacgtaaaagaccctgtctcaattgaagaaagagcgagatggacagagacgtatgtgcgttggtctcctaagggcacctacctggctacctttcatcaaagaggcattgctctatgggggggagagaaattcaagcaaattcagagattcagccaccaaggggttcagcttattgacttctcaccttgtgaaaggtacctggtgacctttagccccctgatggacacgcaggatgaccctcaggccataatcatctgggacatccttacggggcacaagaagaggggttttcactgtgagagctcagcccattggcctatttttaagtggagccatgatggcaaattctttgccagaatgaccctggatacgcttagcatctatgaaactccttctatgggtcttttggacaagaagagtttgaagatctctgggataaaagacttttcttggtctcctggtggtaacataatcgccttctgggtgcctgaagacaaagatattccagccagggtaaccctgatgcagctccctaccaggcaagagatccgagtgaggaacctgttcaatgtggtggactgcaagctccattggcagaagaacggagactacttgtgtgtgaaagtagataggactccgaaaggcacccagggtgttgtcacaaattttgaaattttccgaatgagggagaaacaggtacctgtggatgtggtcgagatgaaagaaaccatcatagcctttgcctgggaaccaaatggaagtaagtttgctgtgctgcacggagaggctccgcggatatctgtgtctttctaccacgtcaaaaacaacgggaagattgaactcatcaagatgttcgacaagcagcaggcgaacaccatcttctggagcccccaaggacagttcgtggtgttggcgggcctgaggagtatgaacggtgccttagcgtttgtggacacttcggactgcacggtcatgaacatcgcagagcactacatggcttccgacgtcgaatgggatcctactgggcgctacgtcgtcacctctgtgtcctggtggagccataaggtggacaacgcgtactggctgtggactttccagggacgcctcctgcagaagaacaacaaggaccgcttctgccagctgctgtggcggccccggcctcccacactcctgagccaggaacagatcaagcaaattaaaaaggatctgaagaaatactctaagatctttgaacagaaggatcgtttgagtcagtccaaagcctcaaaggaattggtggagagaaggcgcaccatgatggaagatttccggaagtaccggaaaatggcccaggagctctatatggagcagaaaaacgagcgcctggagttgcgaggaggggtggacactgacgagctggacagcaacgtggacgactgggaagaggagaccattgagttcttcgtcactgaagaaatcattcccctcgggaatcaggagtgacctggagcactgtggcagccgtgtgtgctgtggagccgaggccgtcctgcaggaagccgcgtgactcccgcctcctccctgtgctctctggctctggactgtgactgcgcctggattctgccacgaagacttagcgacgccactggcggcaccttctcctgcgcccagtgatgtttccacggtgcctgtacacagccgagcagcatttccgttgaaggacttgcatccccattgcgggcagtgctggacgtgtcccggagacccaccgggagggcgccgccatgccttgtacccccaccgtgcaggttgtggccggttttctccgcaggttgaacatggaaataaaagcaaacttgtatgaaaaaa

SEQ ID NO: 428243 - DNA, 994 bp, Homo sapiens
  misc_feature (13)..(13): n is a, c, g, or t
  misc_feature (26)..(26): n is a, c, g, or t
gttaagctaggtncaggctgggtgtnagcaaattaaaaaggatctgaagaaatactctaagatctttgaacagaaggatcgtttgagtcagtccaaagcctcaaaggaattggtggagagaaggcgcaccatgatggaagatttccggaagtaccggaaaatggcccaggagctctatatggagcagaaaaacgagcgcctggagttgcgaggaggggtggacactgacgagctggacagcaacgtggacgactgggaagaggagaccattgagttcttcgtcactgaagaaatcattcccctcgggaatcaggagtgacctggagcactgtggcagccgtgtgtgctgtggagccgaggccgtcctgcaggaagccgcgtgactcccgcctcctccctgtgctctctggctctggactgtgactgcgcctggattctgccattgcgacacatttttgtgcctttcagcccctggtgtctgcagtgggggatttaaggcacccgcttccacttctttcttgtttggagttttctgttggaaccgccggcgttggctccgaagacttagcgacgccactggcggcaccttctcctgcgcccagtgatgtttccacggtgcctgtacacagccgagcagcatttccgttgaaggacttgcatccccattgcgggcagtgctggacgtgtcccggagacccaccgggagggcgccgccatgccttgtacccccaccgtgcaggttgtggccggttttctccgcaggttgaacatggaaataaaagcaaacttgtatgaaaaaaaaaacaaaacaccagaggaaataataacagaagcggaaaaaaggcatgaaggggacaaggcaagacgaaccgaccagatacgacaaagggaacagcggacccaaagaggagaataacaaagacagacgtaaaaaagaaggcgaagaaaataacgaaaggaaaagaaagaaaagacaaaaaaaaacgaagaaagc

SEQ ID NO: 428244 - DNA, 4081 bp, Homo sapiens
gttcagtcccgccccgcagcgtccgacgggaaaggaaagggggaggacgccatgttggacggaaccatctgctgccacacatggggtggtcaatgctcccatgagtttactgatgcacagaaacaaccttgctgaatggaattaagcactttcttgtcacaaatatatcagtttgatgattttcgggcgcggtcttgtggatgcgagtcctctcagggtcgttcgtgaggccccagggcgtgggtgcgccccccgccccgcggccttggtgcggcctccccgtcgcacgcacatggctgggctgtagccgtcgcggcgcgcggtgcggcctgggagagtcggaagcgcggcggccgcggagccctgcgagtaggcagcgttgggcccatgcaggacgcggagaacgtggcggtgcccgaggcggccgaggagcgcgccgagcccggccagcagcagccggccgccgagccgccgccagccgaggggctgctgcggcccgcggggcccggcgctccggaggccgcggggaccgaggcctccagtgaggaggtggggatcgcggaggccgggccggagcccgaggtgaggaccgagccggcggccgaggcagaggcggcctccggcccgtccgagtcgccctcgccgccggccgccgaggagctgcccgggtcgcatgctgagccccctgtcccggcacagggcgaggccccaggagagcaggctcgggacgagcgctccgacagccgggcccaggcggtgtccgaggacgcgggaggaaacgagggcagagcggccgaggccgaaccccgggcgctggagaacggcgacgcggacgagccctccttcagcgaccccgaggacttcgtggacgacgtgagcgaggaagaattactgggagatgtactcaaagatcggccccaggaagcagatggaatcgattcggtgattgtagtggacaatgtccctcaggtgggacccgaccgacttgagaaactcaaaaatgtcatccacaagatcttttccaagtttgggaaaatcacaaatgatttttatcctgaagaggatgggaagacaaaagggtatattttcctggagtacgcgtcccctgcccacgctgtggatgctgtgaagaacgccgacggctacaagcttgacaagcagcacacattccgggtcaacctctttacggattttgacaagtatatgacgatcagtgacgagtgggatattccagagaaacagcctttcaaagacctggggaacttacgttactggcttgaagaggcagaatgcagagatcagtacagtgtgatttttgagagtggagaccgcacttccatattctggaatgacgtaaaagaccctgtctcaattgaagaaagagcgagatggacagagacgtatgtgcgttggtctcctaagggcacctacctggctacctttcatcaaagaggcattgctctatgggggggagagaaattcaagcaaattcagagattcagccaccaaggggttcagcttattgacttctcaccttgtgaaaggtacctggtgacctttagccccctgatggacacgcaggatgaccctcaggccataatcatctgggacatccttacggggcacaagaagaggggttttcactgtgagagctcagcccattggcctatttttaagtggagccatgatggcaaattctttgccagaatgaccctggatacgcttagcatctatgaaactccttctatgggtcttttggacaagaagagtttgaagatctctgggataaaagacttttcttggtctcctggtggtaacataatcgccttctgggtgcctgaagacaaagatattccagccagggtaaccctgatgcagctccctaccaggcaagagatccgagtgaggaacctgttcaatgtggtggactgcaagctccattggcagaagaacggagactacttgtgtgtgaaagtagataggactccgaaaggcacccagggtgttgtcacaaattttgaaattttccgaatgagggagaaacaggtacctgtggatgtggtcgagatgaaagaaaccatcatagcctttgcctgggaaccaaatggaagtaagtttgctgtgctgcacggagaggctccgcggatatctgtgtctttctaccacgtcaaaaacaacgggaagattgaactcatcaagatgttcgacaagcagcaggcgaacaccatcttctggagcccccaaggacagttcgtggtgttggcgggcctgaggagtatgaacggtgccttagcgtttgtggacacttcggactgcacggtcatgaacatcgcagagcactacatggcttccgacgtcgaatgggatcctactgggcgctacgtcgtcacctctgtgtcctggtggagccataaggtggacaacgcgtactggctgtggactttccagggacgcctcctgcagaagaacaacaaggaccgcttctgccagctgctgtggcggccccggcctcccacactcctgagccaggaacagatcaagcaaattaaaaaggatctgaagaaatactctaagatctttgaacagaaggatcgtttgagtcagtccaaagcctcaaaggaattggtggagagaaggcgcaccatgatggaagatttccggaagtaccggaaaatggcccaggagctctatatggagcagaaaaacgagcgcctggagttgcgaggaggggtggacactgacgagctggacagcaacgtggacgactgggaagaggagaccattgagttcttcgtcactgaagaaatcattcccctcgggaatcaggagtgacctggagcactgtggtgagcgtctgcagggggcgcgatgggggtcctgttggctgctcatgctgcttcagttatccccgtcactgaggaagcacctcctttaaggcaggggtgaagggtgaagccctagtgtcatgtgcccagggttagctgagcctcgtgtgaaatgtagagtcggtgccgacgtggcctcgactgcgccctctgaccacattgcagatggcgcctttcaggcagtgctgggtgagggaggagctgtggccaggtgttgggaagtgccaggaagaggagggtggccatgcctggccatttcctgatacctgtgctagtgacggccgcggtgtgtccactggaaagaaacactggcgtgcacggctgtgactctggtttcagcagttctgagacaagagccttccaagtcgggggctggggagcagagtgcgggagctcctgagtcctgggggcctccgcgcctcacagcatgggcacatgtgggacagaaggcctaatggggtgcctgagggtggcctggttgctgtccccccagggtgggaccatgagcgagtaggggtggcacacgggctcagctctctgtggccggggtggctcctcttgcgggactcaacgtcagccccaaggcgatgttcagggggtccctcagccttttgaggtggtgccgtttagggccgccatgcctgtctatccaggggacggactccgcctgctgttcccgcgctgagctacaggactcccgagtgtgagccgcggttcctctgttgcagcgcagccgtgtgtgctgtggagccgaggccgtcctgcaggaagccgcgtgactcccgcctcctccctgtgctctctggctctggactgtgactgcgcctggattctgccattgcgacacatttttgtgcctttcagcccctggtgtctgcagtgggggatttaaggcacccgcttccacttctttcttgtttggagttttctgttggaaccgccggcgttggctccgaagacttagcgacgccactggcggcaccttctcctgcgcccagtgatgtttccacggtgcctgtacacagccgagcagcatttccgttgaaggacttgcatccccattgcgggcagtgctggacgtgtcccggagacccaccgggagggcgccgccatgccttgtacccccaccgtgcaggttgtggccggttttctccgcaggttgaacatggaaataaaagcaaacttgtatgaaaaaa

SEQ ID NO: 428245 - DNA, 2036 bp, Homo sapiens
  misc_feature (13)..(13): n is a, c, g, or t
ctgattcttgagnataaaactaggtccaaagcgagatggacagagacgtatgtgcgttggtctcctaagggcacctacctggctacctttcatcaaagaggcattgctctatgggggggagagaaattcaagcaaattcagagattcagccaccaaggggttcagcttattgacttctcaccttgtgaaaggtacctggtgacctttagccccctgatggacacgcaggatgaccctcaggccataatcatctgggacatccttacggggcacaagaagaggggttttcactgtgagagctcagcccattggcctatttttaagtggagccatgatggcaaattctttgccagaatgaccctggatacgcttagcatctatgaaactccttctatgggtcttttggacaagaagagtttgaagatctctgggataaaagacttttcttggtctcctggtggtaacataatcgccttctgggtgcctgaagacaaagatattccagccagggtaaccctgatgcagctccctaccaggcaagagatccgagtgaggaacctgttcaatgtggtggactgcaagctccattggcagaagaacggagactacttgtgtgtgaaagtagataggactccgaaaggcacccagggtgttgtcacaaattttgaaattttccgaatgagggagaaacaggtacctgtggatgtggtcgagatgaaagaaaccatcatagcctttgcctgggaaccaaatggaagtaagtttgctgtgctgcacggagaggctccgcggatatctgtgtctttctaccacgtcaaaaacaacgggaagattgaactcatcaagatgttcgacaagcagcaggcgaacaccatcttctggagcccccaaggacagttcgtggtgttggcgggcctgaggagtatgaacggtgccttagcgtttgtggacacttcggactgcacggtcatgaacatcgcagagcactacatggcttccgacgtcgaatgggatcctactgggcgctacgtcgtcacctctgtgtcctggtggagccataaggtggacaacgcgtactggctgtggactttccagggacgcctcctgcagaagaacaacaaggaccgcttctgccagctgctgtggcggccccggcctcccacactcctgagccaggaacagatcaagcaaattaaaaaggatctgaagaaatactctaagatctttgaacagaaggatcgtttgagtcagtccaaagcctcaaaggaattggtggagagaaggcgcaccatgatggaagatttccggaagtaccggaaaatggcccaggagctctatatggagcagaaaaacgagcgcctggagttgcgaggaggggtggacactgacgagctggacagcaacgtggacgactgggaagaggagaccattgagttcttcgtcactgaagaaatcattcccctcgggaatcaggagtgacctggagcactgtggggacggactccgcctgctgttcccgcgctgagctacaggactcccgagtgtgagccgcggttcctctgttgcagcgcagccgtgtgtgctgtggagccgaggccgtcctgcaggaagccgcgtgactcccgcctcctccctgtgctctctggctctggactgtgactgcgcctggattctgccattgcgacacatttttgtgcctttcagcccctggtgtctgcagtgggggatttaaggcacccgcttccacttctttcttgtttggagttttctgttggaaccgccggcgttggctccgaagacttagcgacgccactggcggcaccttctcctgcgcccagtgatgtttccacggtgcctgtacacagccgagcagcatttccgttgaaggacttgcatccccattgcgggcagtgctggacgtgtcccggagacccaccgggagggcgccgccatgccttgtacccccaccgtgcaggttgtggccggttttctccgcaggttgaacatggaaataaaagcaaacttgtatgaaaaaa

SEQ ID NO: 428246 - DNA, 3408 bp, Homo sapiens
gttcagtcccgccccgcagcgtccgacgggaaaggaaagggggaggacgccatgttggacggaaccatctgctgccacacatggggtggtcaatgctcccatgagtttactgatgcacagaaacaaccttgctgaatggaattaagcactttcttgtcacaaatatatcagtttgatgattttcgggcgcggtcttgtggatgcgagtcctctcagggtcgttcgtgaggccccagggcgtgggtgcgccccccgccccgcggccttggtgcggcctccccgtcgcacgcacatggctgggctgtagccgtcgcggcgcgcggtgcggcctgggagagtcggaagcgcggcggccgcggagccctgcgagtaggcagcgttgggcccatgcaggacgcggagaacgtggcggtgcccgaggcggccgaggagcgcgccgagcccggccagcagcagccggccgccgagccgccgccagccgaggggctgctgcggcccgcggggcccggcgctccggaggccgcggggaccgaggcctccagtgaggaggtggggatcgcggaggccgggccggagcccgaggtgaggaccgagccggcggccgaggcagaggcggcctccggcccgtccgagtcgccctcgccgccggccgccgaggagctgcccgggtcgcatgctgagccccctgtcccggcacagggcgaggccccaggagagcaggctcgggacgagcgctccgacagccgggcccaggcggtgtccgaggacgcgggaggaaacgagggcagagcggccgaggccgaaccccgggcgctggagaacggcgacgcggacgagccctccttcagcgaccccgaggacttcgtggacgacgtgagcgaggaagaattactgggagatgtactcaaagatcggccccaggaagcagatggaatcgattcggtgattgtagtggacaatgtccctcaggtgggacccgaccgacttgagaaactcaaaaatgtcatccacaagatcttttccaagtttgggaaaatcacaaatgatttttatcctgaagaggatgggaagacaaaagggtatattttcctggagtacgcgtcccctgcccacgctgtggatgctgtgaagaacgccgacggctacaagcttgacaagcagcacacattccgggtcaacctctttacggattttgacaagtatatgacgatcagtgacgagtgggatattccagagaaacagcctttcaaagacctggggaacttacgttactggcttgaagaggcagaatgcagagatcagtacagtgtgatttttgagagtggagaccgcacttccatattctggaatgacgtaaaagaccctgtctcaattgaagaaagagcgagatggacagagacgtatgtgcgttggtctcctaagggcacctacctggctacctttcatcaaagaggcattgctctatgggggggagagaaattcaagcaaattcagagattcagccaccaaggggttcagcttattgacttctcaccttgtgaaagtgttgcccttctcttctaggtacctggtgacctttagccccctgatggacacgcaggatgaccctcaggccataatcatctgggacatccttacggggcacaagaagaggggttttcactgtgagagctcagcccattggcctatttttaagtggagccatgatggcaaattctttgccagaatgaccctggatacgcttagcatctatgaaactccttctatgggtcttttggacaagaagagtttgaagatctctgggataaaagacttttcttggtctcctggtggtaacataatcgccttctgggtgcctgaagacaaagatattccagccagggtaaccctgatgcagctccctaccaggcaagagatccgagtgaggaacctgttcaatgtggtggactgcaagctccattggcagaagaacggagactacttgtgtgtgaaagtagataggactccgaaaggcacccagggtgttgtcacaaattttgaaattttccgaatgagggagaaacaggtacctgtggatgtggtcgagatgaaagaaaccatcatagcctttgcctgggaaccaaatggaagtaagtttgctgtgctgcacggagaggctccgcggatatctgtgtctttctaccacgtcaaaaacaacgggaagattgaactcatcaagatgttcgacaagcagcaggcgaacaccatcttctggagcccccaaggacagttcgtggtgttggcgggcctgaggagtatgaacggtgccttagcgtttgtggacacttcggactgcacggtcatgaacatcgcagagcactacatggcttccgacgtcgaatgggatcctactgggcgctacgtcgtcacctctgtgtcctggtggagccataaggtggacaacgcgtactggctgtggactttccagggacgcctcctgcagaagaacaacaaggaccgcttctgccagctgctgtggcggccccggcctcccacactcctgagccaggaacagatcaagcaaattaaaaaggatctgaagaaatactctaagatctttgaacagaaggatcgtttgagtcagtccaaagcctcaaaggaattggtggagagaaggcgcaccatgatggaagatttccggaagtaccggaaaatggcccaggagctctatatggagcagaaaaacgagcgcctggagttgcgaggaggggtggacactgacgagctggacagcaacgtggacgactgggaagaggagaccattgagttcttcgtcactgaagaaatcattcccctcgggaatcaggagtgacctggagcactgtggggacggactccgcctgctgttcccgcgctgagctacaggactcccgagtgtgagccgcggttcctctgttgcagcgcagccgtgtgtgctgtggagccgaggccgtcctgcaggaagccgcgtgactcccgcctcctccctgtgctctctggctctggactgtgactgcgcctggattctgccattgcgacacatttttgtgcctttcagcccctggtgtctgcagtgggggatttaaggcacccgcttccacttctttcttgtttggagttttctgttggaaccgccggcgttggctccgaagacttagcgacgccactggcggcaccttctcctgcgcccagtgatgtttccacggtgcctgtacacagccgagcagcatttccgttgaaggacttgcatccccattgcgggcagtgctggacgtgtcccggagacccaccgggagggcgccgccatgccttgtacccccaccgtgcaggttgtggccggttttctccgcaggttgaacatggaaataaaagcaaacttgtatgaaaaaa

SEQ ID NO: 428247 - DNA, 3872 bp, Homo sapiens
gttcagtcccgccccgcagcgtccgacgggaaaggaaagggggaggacgccatgttggacggaaccatctgctgccacacatggggtggtcaatgctcccatgagtttactgatgcacagaaacaaccttgctgaatggaattaagcactttcttgtcacaaatatatcagtttgatgattttcgggcgcggtcttgtggatgcgagtcctctcagggtcgttcgtgaggccccagggcgtgggtgcgccccccgccccgcggccttggtgcggcctccccgtcgcacgcacatggctgggctgtagccgtcgcggcgcgcggtgcggcctgggagagtcggaagcgcggcggccgcggagccctgcgagtaggcagcgttgggcccatgcaggacgcggagaacgtggcggtgcccgaggcggccgaggagcgcgccgagcccggccagcagcagccggccgccgagccgccgccagccgaggggctgctgcggcccgcggggcccggcgctccggaggccgcggggaccgaggcctccagtgaggaggtggggatcgcggaggccgggccggagcccgaggtgaggaccgagccggcggccgaggcagaggcggcctccggcccgtccgagtcgccctcgccgccggccgccgaggagctgcccgggtcgcatgctgagccccctgtcccggcacagggcgaggccccaggagagcaggctcgggacgagcgctccgacagccgggcccaggcggtgtccgaggacgcgggaggaaacgagggcagagcggccgaggccgaaccccgggcgctggagaacggcgacgcggacgagccctccttcagcgaccccgaggacttcgtggacgacgtgagcgaggaagaattactgggagatgtactcaaagatcggccccaggaagcagatggaatcgattcggtgattgtagtggacaatgtccctcaggtgggacccgaccgacttgagaaactcaaaaatgtcatccacaagatcttttccaagtttgggaaaatcacaaatgatttttatcctgaagaggatgggaagacaaaagggtatattttcctggagtacgcgtcccctgcccacgctgtggatgctgtgaagaacgccgacggctacaagcttgacaagcagcacacattccgggtcaacctctttacggattttgacaagtatatgacgatcagtgacgagtgggatattccagagaaacagcctttcaaagacctggggaacttacgttactggcttgaagaggcagaatgcagagatcagtacagtgtgatttttgagagtggagaccgcacttccatattctggaatgacgtaaaagaccctgtctcaattgaagaaagagcgagatggacagagacgtatgtgcgttggtctcctaagggcacctacctggctacctttcatcaaagaggcattgctctatgggggggagagaaattcaagcaaattcagagattcagccaccaaggggttcagcttattgacttctcaccttgtgaaaggtacctggtgacctttagccccctgatggacacgcaggatgaccctcaggccataatcatctgggacatccttacggggcacaagaagaggggttttcactgtgagagctcagcccattggcctatttttaagtaagtggaccattgtaacgagctctgtagcctttgtcttttcatgggaataccctggcacttttgtttttcttaggtggagccatgatggcaaattctttgccagaatgaccctggatacgcttagcatctatgaaactcctgtaagtggcctcagtgatggcaaacgccccgtccggtccttgcttgtaaccggggtgtggtgcctttccttatttgtgctagaagaggaggaggaggtttcacagatgcataggaaaggcctgtctcctgtgcctttttaactgcccctgctctgggcagagctcttcagtcactcctgcccacctggcgcagccgtgggaagtcctggatgggagttaatgcagtgggcttcagaactgcagttctgggtggcgggtgggtggatgggttcactgtcacgctctgtgtgcactgccccctaggcaaactcacatcagactcttgtttccttttgtaaaaagttaggtgtgtttctgagacactgacatgatttgactcaactgcagccttccttttttttgggcagtctatgggtcttttggacaagaagagtttgaagatctctgggataaaagacttttcttggtctcctggtggtaacataatcgccttctgggtgcctgaagacaaagatattccagccagggtaaccctgatgcagctccctaccaggcaagagatccgagtgaggaacctgttcaatgtggtggactgcaagctccattggcagaagaacggagactacttgtgtgtgaaagtagataggactccgaaaggcacccagggtgttgtcacaaattttgaaattttccgaatgagggagaaacaggtacctgtggatgtggtcgagatgaaagaaaccatcatagcctttgcctgggaaccaaatggaagtaagtttgctgtgctgcacggagaggctccgcggatatctgtgtctttctaccacgtcaaaaacaacgggaagattgaactcatcaagatgttcgacaagcagcaggcgaacaccatcttctggagcccccaaggacagttcgtggtgttggcgggcctgaggagtatgaacggtgccttagcgtttgtggacacttcggactgcacggtcatgaacatcgcagagcactacatggcttccgacgtcgaatgggatcctactgggcgctacgtcgtcacctctgtgtcctggtggagccataaggtggacaacgcgtactggctgtggactttccagggacgcctcctgcagaagaacaacaaggaccgcttctgccagctgctgtggcggccccggcctcccacactcctgagccaggaacagatcaagcaaattaaaaaggatctgaagaaatactctaagatctttgaacagaaggatcgtttgagtcagtccaaagcctcaaaggaattggtggagagaaggcgcaccatgatggaagatttccggaagtaccggaaaatggcccaggagctctatatggagcagaaaaacgagcgcctggagttgcgaggaggggtggacactgacgagctggacagcaacgtggacgactgggaagaggagaccattgagttcttcgtcactgaagaaatcattcccctcgggaatcaggagtgacctggagcactgtggggacggactccgcctgctgttcccgcgctgagctacaggactcccgagtgtgagccgcggttcctctgttgcagcgcagccgtgtgtgctgtggagccgaggccgtcctgcaggaagccgcgtgactcccgcctcctccctgtgctctctggctctggactgtgactgcgcctggattctgccattgcgacacatttttgtgcctttcagcccctggtgtctgcagtgggggatttaaggcacccgcttccacttctttcttgtttggagttttctgttggaaccgccggcgttggctccgaagacttagcgacgccactggcggcaccttctcctgcgcccagtgatgtttccacggtgcctgtacacagccgagcagcatttccgttgaaggacttgcatccccattgcgggcagtgctggacgtgtcccggagacccaccgggagggcgccgccatgccttgtacccccaccgtgcaggttgtggccggttttctccgcaggttgaacatggaaataaaagcaaacttgtatgaaaaaa

SEQ ID NO: 428248 - DNA, 2931 bp, Homo sapiens
gttcagtcccgccccgcagcgtccgacgggaaaggaaagggggaggacgccatgttggacggaaccatctgctgccacacatggggtggtcaatgctcccatgagtttactgatgcacagaaacaaccttgctgaatggaattaagcactttcttgtcacaaatatatcagtttgatgattttcgggcgcggtcttgtggatgcgagtcctctcagggtcgttcgtgaggccccagggcgtgggtgcgccccccgccccgcggccttggtgcggcctccccgtcgcacgcacatggctgggctgtagccgtcgcggcgcgcggtgcggcctgggagagtcggaagcgcggcggccgcggagccctgcgagtaggcagcgttgggcccatgcaggacgcggagaacgtggcggtgcccgaggcggccgaggagcgcgccgagcccggccagcagcagccggccgccgagccgccgccagccgaggggctgctgcggcccgcggggcccggcgctccggaggccgcggggaccgaggcctccagtgaggaggtggggatcgcggaggccgggccggagcccgaggtgaggaccgagccggcggccgaggcagaggcggcctccggcccgtccgagtcgccctcgccgccggccgccgaggagctgcccgggtcgcatgctgagccccctgtcccggcacagggcgaggccccaggagagcaggctcgggacgagcgctccgacagccgggcccaggcggtgtccgaggacgcgggaggaaacgagggcagagcggccgaggccgaaccccgggcgctggagaacggcgacgcggacgagccctccttcagcgaccccgaggacttcgtggacgacgtgagcgaggaagaattactgggagatgtactcaaagatcggccccaggaagcagatggaatcgattcggtgattgtagtggacaatgtccctcaggtgggacccgaccgacttgagaaactcaaaaatgtcatccacaagatcttttccaagtttgggaaaatcacaaatgatttttatcctgaagaggatgggaagacaaaagggtatattttcctggagtacgcgtcccctgcccacgctgtggatgctgtgaagaacgccgacggctacaagcttgacaagcagcacacattccgggtcaacctctttacggattttgacaagtatatgacgatcagtgacgagtgggatattccagagaaacagcctttcaaagacctggggaacttacgttactggcttgaagaggcagaatgcagagatcagtacagtgtgatttttgagagtggagaccgcacttccatattctggaatgacgtaaaagaccctgtctcaattgaagaaagagcgagatggacagagacgtatgtgcgttggtctcctaagggcacctacctggctacctttcatcaaagaggcattgctctatgggggggagagaaattcaagcaaattcagagattcagccaccaaggggttcagcttattgacttctcaccttgtgaaaggtacctggtgacctttagccccctgatggacacgcaggatgaccctcaggccataatcatctgggacatccttacggggcacaagaagaggggttttcactgtgagagctcagcccattggcctatttttaagtggagccatgatggcaaattctttgccagaatgaccctggatacgcttagcatctatgaaactccttctatgggtcttttggacaagaagagtttgaagatctctgggataaaagacttttcttggtctcctggtggtaacataatcgccttctgggtgcctgaagacaaagatattccagccagggtaaccctgatgcagctccctaccaggcaagagatccgagtgaggaacctgttcaatgtggtggactgcaagctccattggcagaagaacggagactacttgtgtgtgaaagtagataggactccgaaaggcacccagggtgttgtcacaaattttgaaattttccgaatgagggagaaacaggtacctgtggatgtggtcgagatgaaagaaaccatcatagcctttgcctgggaaccaaatggaagtaagtttgctgtgctgcacggagaggctccgcggatatctgtgtctttctaccacgtcaaaaacaacgggaagattgaactcatcaagatgttcgacaagcagcaggcgaacaccatcttctggagcccccaaggacagttcgtggtgttggcgggcctgaggagtatgaacggtgccttagcgtttgtggacacttcggactgcacggtcatgaacatcgcagagcactacatggcttccgacgtcgaatgggatcctactgggcgctacgtcgtcacctctgtgtcctggtggagccataaggtggacaacgcgtactggctgtggactttccagggacgcctcctgcagaagaacaacaaggaccgcttctgccagctgctgtggcggccccggcctcccacactcctgagccaggaacagatcaagcaaattaaaaaggatctgaagaaatactctaagatctttgaacagaaggatcgtttgagtcagtccaaagcctcaaaggaattggtggagagaaggcgcaccatgatggaagatttccggaagtaccggaaaatggcccaggagctctatatggagcagaaaaacgagcgcctggagttgcgaggaggggtggacactgacgagctggacagcaacgtggacgactgggaagaggagaccattgagttcttcgtcactgaagaaatcattcccctcgggaatcaggagtgacctggagcactgtgggacggactccgcctgctgttcccgccgaatgacgcactgaatgacacacagcatgcatccagcgcggaataggtaccgagctat

SEQ ID NO: 428249 - DNA, 1660 bp, Homo sapiens
tagctagcaggcgcgctgaaatcggccgaggcagacagagttgaagatctctgggattaaaagacttttcttggtctcctggtggtaacataatcgccttctgggtgcctgaagacaaagatattccagccagggtaaccctgatgcagctccctaccaggcaagagatccgagtgaggaacctgttcaatgtggtggactgcaagctccattggcagaagaacggagactacttgtgtgtgaaagtagataggactccgaaaggcacccagggtgttgtcacaaattttgaaattttccgaatgagggagaaacaggtacctgtggatgtggtcgagatgaaagaaaccatcatagcctttgcctgggaaccaaatggaagtaagtttgctgtgctgcacggagaggctccgcggatatctgtgtctttctaccacgtcaaaaacaacgggaagattgaactcatcaagatgttcgacaagcagcaggcgaacaccatcttctggagcccccaaggacagttcgtggtgttggcgggcctgaggagtatgaacggtgccttagcgtttgtggacacttcggactgcacggtcatgaacatcgcagagcactacatggcttccgacgtcgaatgggatcctactgggcgctacgtcgtcacctctgtgtcctggtggagccataaggtggacaacgcgtactggctgtggactttccagggacgcctcctgcagaagaacaacaaggaccgcttctgccagctgctgtggcggccccggcctcccacactcctgagccaggaacagatcaagcaaattaaaaaggatctgaagaaatactctaagatctttgaacagaaggatcgtttgagtcagtccaaagcctcaaaggaattggtggagagaaggcgcaccatgatggaagatttccggaagtaccggaaaatggcccaggagctctatatggagcagaaaaacgagcgcctggagttgcgaggaggggtggacactgacgagctggacagcaacgtggacgactgggaagaggagaccattgagttcttcgtcactgaagaaatcattcccctcgggaatcaggagtgacctggagcactgtggggacggactccgcctgctgttcccgcgctgagctacaggactcccgagtgtgagccgcggttcctctgttgcagcgcagccgtgtgtgctgtggagccgaggccgtcctgcaggaagccgcgtgactcccgcctcctccctgtgctctctggctctggactgtgactgcgcctggattctgccattgcgacacatttttgtgcctttcagcccctggtgtctgcagtgggggatttaaggcacccgcttccacttctttcttgtttggagttttctgttggaaccgccggcgttggctccgaagacttagcgacgccactggcggcaccttctcctgcgcccagtgatgtttccacggtgcctgtacacagccgagcagcatttccgttgaaggacttgcatccccattgcgggcagtgctggacgtgtcccggagacccaccgggagggcgccgccatgccttgtacccccaccgtgcaggttgtggccggttttctccgcaggttgaacatggaaataaaagcaaacttgtatgaaaaaa

SEQ ID NO: 428250 - DNA, 1762 bp, Homo sapiens
gtgagactgggaagaggagaccattgagttcttcgtcactgaagaaatcattccccccggcctcccacactcctgagccaggaacagatcaagcaaattaaaaaggatctgaagaaatactctaagatctttgaacagaaggatcgtttgagtcagtccaaagcctcaaaggaattggtggagagaaggcgcaccatgatggaagatttccggaagtaccggaaaatggcccaggagctctatatggagcagaaaaacgagcgcctggagttgcgaggaggggtggacactgacgagctggacagcaacgtggacgactgggaagaggagactacttgtgtgtgaaagtagataggactccgaaaggcacccagggtgttgtcacaaattttgaaattttccgaatgagggagaaacaggtacctgtggatgtggtcgagatgaaagaaaccatcatagcctttgcctgggaaccaaatggaagtaagtttgctgtgctgcacggagaggctccgcggatatctgtgtctttctaccacgtcaaaaacaacgggaagattgaactcatcaagatgttcgacaagcagcaggcgaacaccatcttctggagcccccaaggacagttcgtggtgttggcgggcctgaggagtatgaacggtgccttagcgtttgtggacacttcggactgcacggtcatgaacatcgcagagcactacatggcttccgacgtcgaatgggatcctactgggcgctacgtcgtcacctctgtgtcctggtggagccataaggtggacaacgcgtactggctgtggactttccagggacgcctcctgcagaagaacaacaaggaccgcttctgccagctgctgtggcggccccggcctcccacactcctgagccaggaacagatcaagcaaattaaaaaggatctgaagaaatactctaagatctttgaacagaaggatcgtttgagtcagtccaaagcctcaaaggaattggtggagagaaggcgcaccatgatggaagatttccggaagtaccggaaaatggcccaggagctctatatggagcagaaaaacgagcgcctggagttgcgaggaggggtggacactgacgagctggacagcaacgtggacgactgggaagaggagaccattgagttcttcgtcactgaagaaatcattcccctcgggaatcaggagtgacctggagcactgtggggacggactccgcctgctgttcccgcgctgagctacaggactcccgagtgtgagccgcggttcctctgttgcagcgcagccgtgtgtgctgtggagccgaggccgtcctgcaggaagccgcgtgactcccgcctcctccctgtgctctctggctctggactgtgactgcgcctggattctgccattgcgacacatttttgtgcctttcagcccctggtgtctgcagtgggggatttaaggcacccgcttccacttctttcttgtttggagttttctgttggaaccgccggcgttggctccgaagacttagcgacgccactggcggcaccttctcctgcgcccagtgatgtttccacggtgcctgtacacagccgagcagcatttccgttgaaggacttgcatccccattgcgggcagtgctggacgtgtcccggagacccaccgggagggcgccgccatgccttgtacccccaccgtgcaggttgtggccggttttctccgcaggttgaacatggaaataaaagcaaacttgtatgaaaaaa

SEQ ID NO: 428251 - DNA, 3083 bp, Homo sapiens
gttcagtcccgccccgcagcgtccgacgggaaaggaaagggggaggacgccatgttggacggaaccatctgctgccacacatggggtggtcaatgctcccatgagtttactgatgcacagaaacaaccttgctgaatggaattaagcactttcttgtcacaaatatatcagtttgatgattttcgggcgcggtcttgtggatgcgagtcctctcagggtcgttcgtgaggccccagggcgtgggtgcgccccccgccccgcggccttggtgcggcctccccgtcgcacgcacatggctgggctgtagccgtcgcggcgcgcggtgcggcctgggagagtcggaagcgcggcggccgcggagccctgcgagtaggcagcgttgggcccatgcaggacgcggagaacgtggcggtgcccgaggcggccgaggagcgcgccgagcccggccagcagcagccggccgccgagccgccgccagccgaggggctgctgcggcccgcggggcccggcgctccggaggccgcggggaccgaggcctccagtgaggaggtggggatcgcggaggccgggccggagcccgaggtgaggaccgagccggcggccgaggcagaggcggcctccggcccgtccgagtcgccctcgccgccggccgccgaggagctgcccgggtcgcatgctgagccccctgtcccggcacagggcgaggccccaggagagcaggctcgggacgagcgctccgacagccgggcccaggcggtgtccgaggacgcgggaggaaacgagggcagagcggccgaggccgaaccccgggcgctggagaacggcgacgcggacgagccctccttcagcgaccccgaggacttcgtggacgacgtgagcgaggaagaattactgggagatgtactcaaagatcggccccaggaagcagatggaatcgattcggtgattgtagtggacaatgtccctcaggtgggacccgaccgacttgagaaactcaaaaatgtcatccacaagatcttttccaagtttgggaaaatcacaaatgatttttatcctgaagaggatgggaagacaaaagggtatattttcctggagtacgcgtcccctgcccacgctgtggatgctgtgaagaacgccgacggctacaagcttgacaagcagcacacattccgggtcaacctctttacggattttgacaagtatatgacgatcagtgacgagtgggatattccagagaaacagcctttcaaagacctggggaacttacgttactggcttgaagaggcagaatgcagagatcagtacagtgtgatttttgagagtggagaccgcacttccatattctggaatgacgtaaaagaccctgtctcaattgaagaaagagcgagatggacagagacgtatgtgcgttggtctcctaagggcacctacctggctacctttcatcaaagaggcattgctctatgggggggagagaaattcaagcaaattcagagattcagccaccaaggggttcagcttattgacttctcaccttgtgaaaggtacctggtgacctttagccccctgatggacacgcaggatgaccctcaggccataatcatctgggacatccttacggggcacaagaagaggggttttcactgtgagagctcagcccattggcctatttttaagtggagccatgatggcaaattctttgccagaatgaccctggatacgcttagcatctatgaaactccttctatgggtcttttggacaagaagagtttgaagatctctgggataaaagacttttcttggtctcctggtggtaacataatcgccttctgggtgcctgaagacaaagatattccagccagggtaaccctgatgcagctccctaccaggcaagagatccgagtgaggaacctgttcaatgtggtggactgcaagctccattggcagaagaacggagactacttgtgtgtgaaagtagataggactccgaaaggcacccagggtgttgtcacaaattttgaaattttccgaatgagggagaaacaggtacctgtggatgtggtcgagatgaaagaaaccatcatagcctttgcctgggaaccaaatggaagtaagtttgctgtgctgcacggagaggctccgcggatatctgtgtctttctaccacgtcaaaaacaacgggaagattgaactcatcaagatgttcgacaagcagcaggcgaacaccatcttctggagcccccaaggacagttcgtggtgttggcgggcctgaggagtatgaacggtgccttagcgtttgtggacacttcggactgcacggtcatgaacatcgcagagcactacatggcttccgacgtcgaatgggatcctactgggcgctacgtcgtcacctctgtgtcctggtggagccataaggtggacaacgcgtactggctgtggactttccagggacgcctcctgcagaagaacaacaaggaccgcttctgccagctgctgtggcggccccggcctcccacactcctgagccaggaacagatcaaggtcagcatgcccccacccccgggtgcagggcacatggaggcaattgtggcgttgaaaaggtgtcagttttttctgttattgttagggtggtgactgggggataaaaacgtgacatttgcaaggattctttgaagagacgcaggaacagtgagaactgaatggaatagaacagctttaggatagtaacttgaggctttcagcttctttagggaagttttgcatgaacccgaggggtggataaaaagatgccagggccattaaaaagtcctgctgggattagaagcggcttgtctgggatttacattattgtggtaaaataggccgttggtcttaggtcagagcaaagaggagggttaaatcccagggagaaagtccgtctcaaagtgaaagatggaggaaggagcaggcacgagcgctcctgggatgctgtgttgtgtgaatgaccctgggtgtcaaggaggaaggagcaggcacgagcgctcctgggatgctgtgttctgtgaatgaccctgggtgtcatggaggaaggagcaggcgcgagc

SEQ ID NO: 428252 - DNA, 800 bp, Homo sapiens
  misc_feature (13)..(13): n is a, c, g, or t
  misc_feature (26)..(26): n is a, c, g, or t
gttaagctaggtncaggctgggtgtnagcaaattaaaaaggatctgaagaaatactctaagatctttgaacagaaggatcgtttgagtcagtccaaagcctcaaaggaattggtggagagaaggcgcaccatgatggaagatttccggaagtaccggaaaatggcccaggagctctatatggagcagaaaaacgagcgcctggagttgcgaggaggggtggacactgacgagctggacagcaacgtggacgactgggaagaggagaccattgagttcttcgtcactgaagaaatcattcccctcgggaatcaggagtgacctggagcactgtggcagccgtgtgtgctgtggagccgaggccgtcctgcaggaagccgcgtgactcccgcctcctccctgtgctctctggctctggactgtgactgcgcctggattctgccattgcgacacatttttgtgcctttcagcccctggtgtctgcagtgggggatttaaggcacccgcttccacttctttcttgtttggagttttctgttggaaccgccggcgttggctccgaagacttagcgacgccactggcggcaccttctcctgcgcccagtgatgtttccacggtgcctgtacacagccgagcagcatttccgttgaaggacttgcatccccattgcgggcagtgctggacgtgtcccggagacccaccgggagggcgccgccatgccttgtacccccaccgtgcaggttgtggccggttttctccgcaggttgaacatggaaataaaagcaaacttgtatgaaaaaa

SEQ ID NO: 428253 - DNA, 2190 bp, Homo sapiens
gttcagtcccgccccgcagcgtccgacgggaaaggaaagggggaggacgccatgttggacggaaccatctgctgccacacatggggtggtcaatgctcccatgagtttactgatgcacagaaacaaccttgctgaatggaattaagcactttcttgtcacaaatatatcagtttgatgattttcgggcgcggtcttgtggatgcgagtcctctcagggtcgttcgtgaggccccagggcgtgggtgcgccccccgccccgcggccttggtgcggcctccccgtcgcacgcacatggctgggctgtagccgtcgcggcgcgcggtgcggcctgggagagtcggaagcgcggcggccgcggagccctgcgagtaggcagcgttgggcccatgcaggacgcggagaacgtggcggtgcccgaggcggccgaggagcgcgccgagcccggccagcagcagccggccgccgagccgccgccagccgaggggctgctgcggcccgcggggcccggcgctccggaggccgcggggaccgaggcctccagtgaggaggtggggatcgcggaggccgggccggagcccgaggtgaggaccgagccggcggccgaggcagaggcggcctccggcccgtccgagtcgccctcgccgccggccgccgaggagctgcccgggtcgcatgctgagccccctgtcccggcacagggcgaggccccaggagagcaggctcgggacgagcgctccgacagccgggcccaggcggtgtccgaggacgcgggaggaaacgagggcagagcggccgaggccgaaccccgggcgctggagaacggcgacgcggacgagccctccttcagcgaccccgaggacttcgtggacgacgtgagcgaggaagaattactgggagatgtactcaaagatcggccccaggaagcagatggaatcgattcggtgattgtagtggacaatgtccctcaggtgggacccgaccgacttgagaaactcaaaaatgtcatccacaagatcttttccaagtttgggaaaatcacaaatgatttttatcctgaagaggatgggaagacaaaagggtatattttcctggagtacgcgtcccctgcccacgctgtggatgctgtgaagaacgccgacggctacaagcttgacaagcagcacacattccgggtcaacctctttacggattttgacaagtatatgacgatcagtgacgagtgggatattccagagaaacagcctttcaaagacctggggaacttacgttactggcttgaagaggcagaatgcagagatcagtacagtgtgatttttgagagtggagaccgcacttccatattctggaatgacgtaaaagaccctgtctcaattgaagaaagagcgagatggacagagacgtatgtgcgttggtctcctaagggcacctacctggctacctttcatcaaagaggcattgctctatgggggggagagaaattcaagcaaattcagagattcagccaccaaggggttcagcttattgacttctcaccttgtgaaaggtacctggtgacctttagccccctgatggacacgcaggatgaccctcaggccataatcatctgggacatccttacggggcacaagaagaggggttttcactgtgagagctcagcccattggcctatttttaagtggagccatgatggcaaattctttgccagaatgaccctggatacgcttagcatctatgaaactccttctatgggtcttttggacaagaagagtttgaagatctctgggataaaagacttttcttggtctcctggtggtaacataatcgccttctgggtgcctgaagacaaagatattccagccagggtaaccctgatgcagctccctaccaggcaagagatccgagtgaggaacctgttcaatgtggtggactgcaagctccattggcagaagaacggagactacttgtgtgtgaaagtagataggactccgaaaggcacccagggtgttgtcacaaattttgaaattttccgaatgagggagaaacaggtacctgtggatgtggtcgagatgaaagaaaccatcatagcctttgcctgggaaccaaatggaagtaagtttgctgtgctgcttgtcgaacatcttgatgagttcaatcttcccgttgtttttgacgtggtagaaagacacaga

SEQ ID NO: 428254 - DNA, 2129 bp, Homo sapiens
gttcagtcccgccccgcagcgtccgacgggaaaggaaagggggaggacgccatgttggacggaaccatctgctgccacacatggggtggtcaatgctcccatgagtttactgatgcacagaaacaaccttgctgaatggaattaagcactttcttgtcacaaatatatcagtttgatgattttcgggcgcggtcttgtggatgcgagtcctctcagggtcgttcgtgaggccccagggcgtgggtgcgccccccgccccgcggccttggtgcggcctccccgtcgcacgcacatggctgggctgtagccgtcgcggcgcgcggtgcggcctgggagagtcggaagcgcggcggccgcggagccctgcgagtaggcagcgttgggcccatgcaggacgcggagaacgtggcggtgcccgaggcggccgaggagcgcgccgagcccggccagcagcagccggccgccgagccgccgccagccgaggggctgctgcggcccgcggggcccggcgctccggaggccgcggggaccgaggcctccagtgaggaggtggggatcgcggaggccgggccggagcccgaggtgaggaccgagccggcggccgaggcagaggcggcctccggcccgtccgagtcgccctcgccgccggccgccgaggagctgcccgggtcgcatgctgagccccctgtcccggcacagggcgaggccccaggagagcaggctcgggacgagcgctccgacagccgggcccaggcggtgtccgaggacgcgggaggaaacgagggcagagcggccgaggccgaaccccgggcgctggagaacggcgacgcggacgagccctccttcagcgaccccgaggacttcgtggacgacgtgagcgaggaagaattactgggagatgtactcaaagatcggccccaggaagcagatggaatcgattcggtgattgtagtggacaatgtccctcaggtgggacccgaccgacttgagaaactcaaaaatgtcatccacaagatcttttccaagtttgggaaaatcacaaatgatttttatcctgaagaggatgggaagacaaaagggtatattttcctggagtacgcgtcccctgcccacgctgtggatgctgtgaagaacgccgacggctacaagcttgacaagcagcacacattccgggtcaacctctttacggattttgacaagtatatgacgatcagtgacgagtgggatattccagagaaacagcctttcaaagacctggggaacttacgttactggcttgaagaggcagaatgcagagatcagtacagtgtgatttttgagagtggagaccgcacttccatattctggaatgacgtaaaagaccctgtctcaattgaagaaagagcgagatggacagagacgtatgtgcgttggtctcctaagggcacctacctggctacctttcatcaaagaggcattgctctatgggggggagagaaattcaagcaaattcagagattcagccaccaaggggttcagcttattgacttctcaccttgtgaaaggtacctggtgacctttagccccctgatggacacgcaggatgaccctcaggccataatcatctgggacatccttacggggcacaagaagaggggttttcactgtgagagctcagcccattggcctatttttaagtggagccatgatggcaaattctttgccagaatgaccctggatacgcttagcatctatgaaactccttctatgggtcttttggacaagaagagtttgaagatctctgggataaaagacttttcttggtctcctggtggtaacataatcgccttctgggtgcctgaagacaaagatattccagccagggtaaccctgatgcagctccctaccaggcaagagatccgagtgaggaacctgttcaatgtggtggactgcaagctccattggcagaagaacggagactacttgtgtgtgaaagtagataggactccgaaaggcacccagggtgttgtcacagattcttgaaaagggattcattatggctgaagtaatgaaatacgaagattttaaagaggaaggttctgaaaatgcagtcaggctgctggaaagtacacgacaacaaggaggtcaca
